United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 8

SEQ ID NO: 21210 - DNA, 1386 bp, Triticum aestivum
  Clone ID: PAT_TA_21210
cgcacacgtcggggacaaggaagaaatctcgggagagggggagagcgagagagaaacgcatcgcgatgtcggcggagacggagaagagcgccgccgcgcccgcgcccgcgcccatgcggtgccagcgaataggctgcgacgccatgttcaccgacgacgacaaccccgacggctcctgccactaccacccctccggacctatgtttcatgatggcatgaaagagtggagctgttgcaagcaaagaagccatgattttagcttatttttagctattcctggatgtgccacagggaagcatacaactgagaaaccagtcacaaaagctgtttctcttaactcaaaggcaaccccaccaaagttagctccagtccagtcttctaagcagggtgtggaaaccgaggcctgctccaggtgccgtcagggtttcttttgctccgactatggatcacagcccaaggcacaaaaagccagttgctgtaaatggtacaaataccggaacctgtcgagaaatgctcggttccacagcccaagaaaaaggttgttaatataaacgagtcctagggtttgtaagaataaatgatgtggtaaaacctacaaaggagaaggatatccatgatgctgcatgcgaataccatacaggccctgcggttttccatgacaggagtaggatgtcggaaagtgttgcgatgtccatgtcaaggagtttgacgaatttatggagatacctccatgcacaaaggggtggcacaatgctgatgccggtgtgagttcacaccatgactcttgcattaagagttatatttgttgtattatctcctggtgcataaggttggcatcttgccgcaatttatggagaagtatgcttggaagtgtgacctgatattcaagaataggctgcttggatgagtaattacctcgaaatctcatgtgatgtttcatgtaatctggaatcggaacttgaaaccatatgtgcacactcaatttagtaatttaactatgcccttttgtaatctggaatcggaacttgaaaccatatgcggtcttctagttgtttgttaccaagcggcctccattaaggtctaccgacaatcatgtagtttggattactctgggcaattctctccggagttgagagtactctgagcactgcccatagcgtgccacgacgaccgtttgcactataggtgcctcgcgacgcagtcctcatatgagaagtggggattccaccagcattctcacaaataggtactattcattttgcttcagagagatgtcggttgatgctgcatttaactggatttggaaagccaggtgcaatatgaaatggaaaggtgttcgcctggcttctcttggctgacaggctggtcgacgcggccgcgaattcg

SEQ ID NO: 21211 - DNA, 634 bp, Triticum aestivum
  unsure (1)..(634): unsure at all n locations
  Clone ID: PAT_TA_21211
cgtcgtcgtccatcatggtcatcatcaccacttcaccggtcaccgccatggcatggatcccacccctcatcacatgcattggtttctgtcaacatccatccaatcccaatccatcgccgggcatcccggcgcgtttagttcattaggtcttctttctcatcgggggctagtgttattttacctttcttcttttctgtctattgggttaattggttccccctgaatgtttttttgtttgtatagagagagaaagagagaggagggtgagaggagaggcaggagaaatagatgaatcagagtggttgctgcattgcagttgcagttgcctgcaggttaggtactaagtgagaaggagagctaaaccagcancagagggagacagatctagagaggaaactttgcagctatcagtcagtcantcaatcaattanaagaaagcagggcagtgctttaacaaatgaaaggggaattgttggttgctaatttcaaggaggtatcagggaagtcagtagtagcttcacggcatgatgattanaactataagaggggacagcatcatcacatatcggttcctgtccggcntgngtcgaacccgaactctttngttacaagttaggattgaaaanaaaaancn

SEQ ID NO: 21212 - DNA, 386 bp, Triticum aestivum
  Clone ID: PAT_TA_21212
cggcgatgagcctttcagcgcgttcgtgaaatcggcccggaggctgacgatcctgaccgacgccggcagcgacaacatagggggctgagaatgaagcagcagaatcatcatcagccgaataacttaggtggccggccattccaagtcgtcattagcgagcaataagccggaccaagtgccccctgcgtgtacagctgaacggcaagctgtggttggtttcttcccgagttagctcatttccctttcatttcctcgtcaccgtagccaggccgtagccgtaggagctgcaaaacaaaccaaatcaatgtggcagcagcaccactccactctggacacctttcatgatcatcatcgaatgtaacgtacttgcggtcaaaaaggggggg

SEQ ID NO: 21213 - DNA, 258 bp, Triticum aestivum
  unsure (1)..(258): unsure at all n locations
  Clone ID: PAT_TA_21213
ctgtgctggcgcgtcaaagccgtactcttcagcgttccatagataataagataaacccatgaataagtgtccctaccctttgatcatgtgacagggacagggacagggacagtttcctgtacttgtggggtgaatttgtacgtgtgatacggtaacttggtccgtgtactgtttatgctgctacgttttccttcctaaaagtacgtatatatatnacagcacttgcaaggggctttactggtgtgcaaaaaaaaaaaa

SEQ ID NO: 21214 - DNA, 618 bp, Triticum aestivum
  unsure (1)..(618): unsure at all n locations
  Clone ID: PAT_TA_21214
gcctgggcgacccccccccctccgcccccgccccgccgccgccccgccggcgccgccctcgcgggggccgcgcagcccccccgcatcccccccggcccggcgaaggccccgggcgggcctctgcgggtccacttcggggacacctggggcgctgcgcttgcgccccgcgaccaggccttagccctaccgcgaggctgttactgctcgcatgctggcgctcccttccgggcattccctggacggggttggtccgcaccgctcgggcaacaccccgccactccataacgcgactccaacgctggccgctgctgccccttgatcaacatgggcttcctcggttagctggcggagctgacgctgcctgattagatgcggacgttggacacccctttgcttcaaacatccaagtgcaccaagcccaagaacaaaagcgccgcactaccctgctccacggacgcattccccttatattctccccttgcaaatggactgatccgtcaagagaaggaaacccgtgaagaaaagcttctccttccccgggcgatcgtgattatcctacccgttgaccgttcgtcaagatatacgtaccnttagtcctttagcgnacatactgnttgg

SEQ ID NO: 21215 - DNA, 576 bp, Triticum aestivum
  unsure (1)..(576): unsure at all n locations
  Clone ID: PAT_TA_21215
cggccgcgcggtgtccatcgccgacgtcttcctcaggttccttgccatcgtggccaccatcggcagcgccgtctccatgggcaccaccaacgagacgctccccttcttcacgcagttcatccagttcgaggccaagtacagcgacctcccgtccttcaccttcttcgtggcggcgaacgcggtggtgtgcacgtacctccgtcctgtccatcccgctgtccatcgtgcacatcgtcaggcccagggctcactacagccgtctgatcctcctcttctttgacgcggcgatgctggcctgctgacggccggcgcgtcggcggcggcggcgattcgttaccgggcgcacaagggaactgcgcccccctgggcccgcctcccgcatccgttccttctgcgacgcactcgggtcatcatcggtccttcgccgcatggcctgctcatagcctcacttccanctgcctcgcgctcgccgaccactgatataagccctcataaccgggatcatatcnaagaagccaaagattttgtccccggtcattgtgtcangncaatacaagctgattctcgcgtgtgctt

SEQ ID NO: 21216 - DNA, 590 bp, Triticum aestivum
  unsure (1)..(590): unsure at all n locations
  Clone ID: PAT_TA_21216
ctttattttcctccgcacgtaattctaatgatacttaaattttctacacaggcagattctctccacagctagattttcagaaaagctgatgagaaaaaaacaagctttggccgccgcggcgcgcgctgcagcctggtgggcgcaagccgggaagtagcactagcagtaggcctgcggtgaccacgccgcaggtcgcaaccgacagttcctggttcatggcgctgcttgcttgatgttctctctcaaaaataaaaaataaacaatggcacccaggtgtgaatctgcagataggaccatttacagccatccgtcccgtctctaggatgcgccctgaaaaaaagaaagatacacacaggcaagagcaagaacaagaggacacccgccgtacagcgcgatttatcggcagaaccaaaagtcaaacagaccatattgtgtgcacttatgttcctcacaccaatacgataactaaatacaggacgnacctaccgcgttgctaagcgcctcggtcgcagctacgaaaaccattgaagtcaggcctgtaacgggcaggcctcttggaaactacgccctgcctctggcgccgcaggacg

SEQ ID NO: 21217 - DNA, 620 bp, Triticum aestivum
  unsure (1)..(620): unsure at all n locations
  Clone ID: PAT_TA_21217
agcgccgcctcccctccctcgctccgtgaggtcctcgccggcgacgagtgccgccgcccgtttccatgttttttccgccgattagtgtccaccagatctagtgaaggctggtaacttgacgcaaggtgttcaagaaatttaagccacacactcttcatcataggcccaggcaatatttgtgttaatctcagggacctccagtagattgctgagagttatccttgatacaggggaatatagacacagaattttttgaacattgatctgtagccagtgctgcaatggctacaaagcttgtggttctcggtatcccctgggatgttgacactgaagggttacgagagtacatggccaagtttgggacccctagatgattgtgcctccatgaaggagcggtctcctgggcgatctcctgggtttggctatgtaacattcgcatcagccgacgagcaaagaatgttcctggatgcgaacatttctgggacccgtacattagaatgaagatactacccaaaggaagaaatgaatcacaaggacaaagaaacncaaggtattgtgcccaatccnatcagngcaatcagttccnngattnaacttgggaatctgatctaatcaaagaa

SEQ ID NO: 21218 - DNA, 583 bp, Triticum aestivum
  unsure (1)..(583): unsure at all n locations
  Clone ID: PAT_TA_21218
cgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaagtcactgtccaccacttccatggaaacaatgtcgaccttggaactgcctgtggtaaatactttccggtctgctgcctcagcattattgatcctgggtgatctgatatcatcaagactacaccggggtgagcagtaaagaacccctgcagtaggggatcttacgcatttgtcctcctctggttaaacacatttactgctataaatgattatccgaaatttcctgaatgaattttgcccgggtttgacactaataaacttacttataccttgtcagtccaacttnntgtactacaaacgtcaacaaagc

SEQ ID NO: 21219 - DNA, 568 bp, Triticum aestivum
  unsure (1)..(568): unsure at all n locations
  Clone ID: PAT_TA_21219
atccgttgcgctgcgcccggttccctcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaattcacgagggtgacgatgatcctcccgctgacgggcgagcagtacgcggagaaagtgacggagaatgcgtggcgttctggaaggccgccggcctgtacacggacgccgagggctcccgtggagaattcaaggaagtttcaagccaaagacttcgcgccgggcgcctcacctcctacgcatcgcccgccggatcccaacgtcgcttctcaaggatctccgtcaacggccgcgcgggcgtnaaacacgctctcaggct

SEQ ID NO: 21220 - DNA, 260 bp, Triticum aestivum
  Clone ID: PAT_TA_21220
cggctcctccggcaagcttgcagacgacaggacgaggagatccgacagtgttctgtagtcaacgggtgtgtgtgtggagcacgtccagccggcacgcggcgatgcagtccggctggtgccaacgtgcacttcccaagcgggaccatgaagtttacttcctggcgtgatataatttctttgaatttacaagttttgttcaccatgtagttcagttcagttgcgaatcaagaaaaaaggcacccgattccaaaaaaaaaaaa

SEQ ID NO: 21221 - DNA, 565 bp, Triticum aestivum
  Clone ID: PAT_TA_21221
gagatatataataaagtttagtttgagttttctttattctcttgtttcaataaaaagaaaggaaatacaaggaaaagatcatatgctaatcttatggtaagtgatgacattacacaaggaaaagtataagtagaaaattttattgtagattgacaaacatagcattggtcaatgatgcaactcatgaaagaattaataagggaagtgaagattcacatataaatatactatcctgggaaatattttatgattggggagcacccatcaaaatattatgtgccaaaatttttgacgttgggacaaggaagaaaacttaatgatttatgtttgttcatattcacatagaagttatattgtcatagatccttcaacatgtggggcttgccccctatattggatagccaaaaactccgcactaatgtagagatactacttgtgcatccaaaaacccttaaccctatctgtttaagagcccccatacctacctatggatggagtaggtcctcaagtaagttgtcatcggtgcaaaagggaataaaatgccctaaaatgcagtcattatgta

SEQ ID NO: 21222 - DNA, 573 bp, Triticum aestivum
  unsure (1)..(573): unsure at all n locations
  Clone ID: PAT_TA_21222
caacgggctcacctccaacctggccggcagccgcaaccccagcctggactacggcttcaagggcaccgagatcgccatggcctcctactgctccgagctccagtacctgggcaaccccatcaccaaccacgtgcagagcgcggagcagcacaaccaaggacgtgaactccctggggcctccgtctccggccaaggaagaccgccgaggcgattcgacatccttgaagctcatgttcgtccacctacatccgtggcgctgtgccaaggccgtgggacctgcgccacctccgaaggagaacatcaaggcgtccggtgaaagaacaccgtgacccaaagtggccaagaanggtgctgaccatgaaccctcccgggcgantcttccaacgcccgcttctaaccgaagaaggactgatttaacgccatcgaccgcgagccgtttcccgctcccccggaccaccccccgaacctgccgctgatcanaactgccgcctnctggtggacacccctcaacaacggnacccgacgggacctcgtgtctcaagnnacaagtcaggaggactcncgcgtgctgcc

SEQ ID NO: 21223 - DNA, 382 bp, Triticum aestivum
  Clone ID: PAT_TA_21223
cgggagaggatgctccccaacagccgccaccagacgttgcagggaagatgtttgagccaccgcttcgtgcgtgggcggctgcaagacctgctcaggaagatgactctgactctggcagcggaaagaaggctccgccattgctgcttaagttttgacggccttcttatgccgatactagttcttaggctccaccatgggtgttgaaagctgaaagatcagatctgatggatgcctgaccttcttcgaacctcagttgtggttcttgtaatttgcaccgcatttctgttctgagtatgtttttatgagaagactgggaagatgacagacagatactgtatcacgtgatgctcgtaaattaacactacatgcgaaaaaaaaaaaa

SEQ ID NO: 21224 - DNA, 684 bp, Triticum aestivum
  Clone ID: PAT_TA_21224
aggaattcggcacgagccccccgtccggaaggccaccactatactcacgctctcctcgtcccctgccgccgcggcccgccgctcgccggcgagggcgaccatctccgacccccacctccggcagtaccccgtccgcacttcccgcctccgcgttgcccagagcctggcctcacgtcccctatcctcggggtggaggcggcgccggagggggagcgggctggtggtgcgggcagagacgttcgggcagctcaccaccgggctcgattccgcgtggaacaagctgcgtggcgtcgatgtgctgacgaaggaaaccattgtggagccgatgcgggacatcagaagagcacttctggaagcagatgttagtttgccggtcgtcagacggttcgtgtcgtctgtgagcgagaaggctttaggttcagatgttatccgaggaatccgaccagagcagcaattagtcaagattgtgcatgatgaacttgttcaactgatgggtggagaggtatcagacttggtgttcgcaaaacctggcccaacggtcatcctactggcaggtctgcaaggtgttgggaagactactgtttgtgcaaaacttgcattctatctgaagaaactggggaagagttgtatgctggtcgctgcagatgtttacaggcctgctgccattgatcaactcactgtact

SEQ ID NO: 21225 - DNA, 413 bp, Triticum aestivum
  unsure (1)..(413): unsure at all n locations
  Clone ID: PAT_TA_21225
gtcggagccgtccttcgacaaggacgagctgtagtcggcgtgctggtggtcctcgtctcgtcttcgggatctgttttgaagtctagctgtagctcccgtttagttgagatatcggggagcccactcactgccagctttgtgtttaggaacgtgatacgggatctttttttttttgttgcctgtctttgtacttgtacaaacctcagttcagtgactcggtctaattaccggctccgattagtgaactgtttctgtccgattagtgagctcaccgacatccatagggtggcgctccctcccttctaatttaacttgtatccttaattcagctgctcagcttttgtagcttccgtccgatttatatgaagatacaanaatacanaccatgtttatagcaattaaaaaaaaaaaaa

SEQ ID NO: 21226 - DNA, 570 bp, Triticum aestivum
  unsure (1)..(570): unsure at all n locations
  Clone ID: PAT_TA_21226
cgaccaccggagcgcggaggaggcacaggcgccgatctaaagacgatggccgccgcgggctcctcgccgtccttctcctcctcgagtaagcggctggaagggaaggtggccctcgtcactggtggcgccaccggcatcggtgaggccatcgttcgcctcttcatggacgcacggcgccaaggtctgcatcgcggacatccaggatgaggctgtggcagcagctgcgcgacgccctgggaggtgacgcgcagggcgccatgttcgtccactgcgacgtgacgtcngcggacgacgtgagccgcgccgtnggacgctgcggcggagcggtccggcgcgctggacgtgatgcggaacaactccggcgtttcgggcccaagtgacggacatccgcaacgtggacttcgcngagcgccaggtgctccactcaactgcacgctttcctgggatgaacaccngcccgctatntccgcggaacgggtccatcnttcctggcaactggcannccatcggcggacggccgcactctaacgngtcaacacccntgtcggctacaagactccncgactcgcc

SEQ ID NO: 21227 - DNA, 583 bp, Triticum aestivum
  unsure (1)..(583): unsure at all n locations
  Clone ID: PAT_TA_21227
cgtgggcctcttgctagccggcggcgcgggcgcgggcgtggcgtccggcggcttgtggccgtgaggggcggcggcgcgtgcacctgcggctgtacatgcacgacgtgatcggcgggccgaaccggacggccatccgcctcatctggggcgtngggcccgccgcacgcgtccatgccggggcgcaccttccggcgacacggtggccatccgacgacctcctcacggacgggcccggcgtcccgcgcagactcccagccccgtcggccgcgcgcnagggcacctacatgctgactccgcaacacgagangtgattnctggtccacatcacctcctcctcaccggccgggcctttcaacggcacacctcntttggtggccgccgcgacaggtttacgacaaaccaaggactccccgttgtccgcggacccggatccgcgggctccggnacttctgtngacacgcaagttngtccganntcaatgtctggactcgactgcaccgtcgtgcatgccgacaagacacacacaacacntctcgtctgcataggatctataaataaatgtcgttcgtccttcacnccattn

SEQ ID NO: 21228 - DNA, 584 bp, Triticum aestivum
  unsure (1)..(584): unsure at all n locations
  Clone ID: PAT_TA_21228
ctcagatccgccaaacccgccgagacagagagatcgccatggccgcnggcatcgcctccgctcctccccaccacggtcgtcccggcggccgcagcacccccgacacccgcgcccacggccatatcctccgcggacgccaccgacaccaacccagcggcgatccgggccttcctctcccgcctcctcgacaccacccggcgcgcgctgtcgggcgcccgcccctgggtccgagctcgcggaccgctcggctctctcccgcccggagtccctcgccgaggccacgtcccgcttgcgcaagaacctggcctacttccgcgtcaactacgccgccgtggccgcgctgtgcctcgccgcggcgctcctggcgcacccttctccctgggcgcgctgctgggcgctgctcgccgcctggtgcctcntctacgtgctccgcccggccgacgcccgcccgtctccgcgttcggcgcacttctccgacgcnagggctcggtggctcccgccgctcgcgtcgtctctcctagccgggggcccctatctctccgcgccgccgggggccccatgttgcccangggcttcgctgccaa

SEQ ID NO: 21229 - DNA, 877 bp, Triticum aestivum
  unsure (1)..(877): unsure at all n locations
  Clone ID: PAT_TA_21229
gcaagctaggatcatcagcatctgagcttatatattactacatcgatcggttgccaaatggcggggatgacagtcggcaataagctggcgctggctgcggtgctgctgtgcgcggcggcggccatggccacggcgcagcaggcctccggcgtgcgcgccacctacaacttctacaacccgcagcagaacaactgggacctcaacgccgtgagcgcgtactgcgcgacgtgggacgccagcaagccgctgtcgtggcgcatgaagtacggctggacggccttctgcgggcccgccggccccaccggccaggccgcgtgcgggcagtgtcttctggtgactaacactgcgacgggggcgtccatcacggtgaggatcgtggaccagtgcagcaacggcggcctggacctggactacgacacggcgttcaagcccatcgacaccaacggccagggcttccaggccggccacctcaccgtcaactaccattcgtcaactgcggcgacaactgaactgatagattatcacctgtgcatgcactatatgttctagcaccattattccaagattatatggtgtcatcccacacgttaagaccaataaaacatatatccccagtgggataaactgattacctaaataccgggcggccccgtacctctctcctcacggaacccttcccccccccctgnctcntttanaactcctgacnggaaaccngggttccaactaangcttcanaatccccttccactgggtatacaaaagccgacgatgcctcaantnccactatgcatggaccccttacggataancgggtttggtaccactacgtaatncaagccaagcngccttctttctcttcnnttngttccnanan

SEQ ID NO: 21230 - DNA, 1219 bp, Triticum aestivum
  Clone ID: PAT_TA_21230
cgtagcaggtgcagagaacacgacacggaaggagataaccgcaccaaacaaaccaaactccgaagaaacgaagcatggggacgcaagcggcgccggcgaccagcgagatcgcggcggtgggtgtgatcggcgcggggcagatgggctcgggcatcgcccagctcgccgccgcggccggctgcggcgtcttcctcctcgactccgaccccgccgccctctcccgcgccgccgcctccatctcctcctccctcggccgcctcgtctccaagggccagctctcccaggctgcgtgcgatgattccgtcaagcggataaagtgcgtctccgatgtgcaagagctgcggggcgtggatctggtgattgaggccatcgtcgagtccgaagacatcaagaagaagctgttcgtggagctggacaggatcaccaaaccttctgctattcttgcctccaacaccagctccatttctataacccggcttgcctctgctaccggccgcccctctcaagtgataggcatgcactttttcaaccctcctcctataatgaagctggttgaaataatacgaggagctgatacatcagaagagattttctctcgagttaaatcattttctgaaaggatcgggaaggccggggtaggccctcaagattaccccggcttcactgtaaaccgcatcctaatgccgatgattaatgaagcattttgggcactttacacgggggtacaatccggtggcgacctcagtacacggcggcaccggggcgcagctcggccagtatgccctctgcagcttgccgacttcatagggttagatgtttgcctgtcagtacttaggctgctccacaacgggctaggagataacaagtacagcccttgccctctgcttgtccaatatgtcgacgccggacgacttggaaagaagcggggactaggtgtgtactcttacgggagaagctcttcatctgttaaacccaagtcatctctgtgaaaaccaacatatccatgtggctgttgcgccgcggatggtggtgctgtgtgtcgtagtgtgacgaacccggtaaatgggaaaaaaaaaaaaacactgggggccgactcaatggctgggcgggccagtcccattttacctctggcaggcaattcagagcggccaaaagtacttgtcctcgtgggctctagcatcggaatataacaggctcacgcgggcttggatttgtagaa

SEQ ID NO: 21231 - DNA, 488 bp, Triticum aestivum
  Clone ID: PAT_TA_21231
ggagcacgggttcgagcgcgggcagtgcagggtggccggcaagcatggattgcgcgagacaggcggcgagcatggagatcttccttttttcttttttcttcacgcgtgtgtgaaagggagaagacgactcaatcgcgctatccagaccgtttatttgtacgggatccaacgcctggcagcggaccggccgaaacttcggccggtgcgccggcgcctagcagcatgcatacatcgtattcgactaaagaggcggcgtggtgcattataccgttcgcgagctgatcctagcaaatgaggtgatcgagtgtgttgcagtttgtcaactaaaaaaaaaaaaaaaaaaaaaaaaaaaaaaaaaaaaaaaaaaaaaaaaaacaaaaaaaaaaaaaaaaaaaaaaaaaaaaattacaaaaaaaaaaaaggatttgaaaaaaagcataaataaaaaaaaaaaaaagggggccccccaagggtttcaacctttattt

SEQ ID NO: 21232 - DNA, 870 bp, Triticum aestivum
  unsure (1)..(870): unsure at all n locations
  Clone ID: PAT_TA_21232
ggtcccttccatctcctagccgccgccgccgccgcccaaaaccctacctaccctcttctccccctcactctcctttcatctccattctaatggcggcccaacccgtccggcgaagctgctagtgcttgtatctactatcttcatcaggtacttcgcgatcctactgaagtattccccgccgccgctgccatggccaccctcaaccctttcgaactcctcggcgccgacgacaacgacgacccgtcgctgttgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcaaaagtggacggggatatggtcagaaccgtggcttcagtggtgacaatggaatgagttcaagggaagttatggtggcggaggtatggggatggtgctgtactggtggatcgaaaggagaaagggagacagacactcgtcccccgtaccgtggcggaggcagccgggggggttgcaggtgtgtggggttgccgatggctctcgggggctccacgcagacgctctgccgcctcagcgcgactggcatgccggtgtggggatcntgatggcgcaggcgtgggaactgggcactgccactgataactatgccaagatcagagatctcnaagatgaggagctgccctttctaagaaaagtgacagatcatnccacacagtgagacaagtacaagatcactcaatagagaaaaaggaangcaggaa

SEQ ID NO: 21233 - DNA, 286 bp, Triticum aestivum
  Clone ID: PAT_TA_21233
atgaggaggagctacggcggcgcgccgcccagcctcgcacatgacgcggccatgcctggttttggccttgataaagtgagctaccactaccagccgttgccgttgcctccttattacgtcgggagcagcagcggctcgtcagacgacgcgtcggtgggcagccttggtcttctgcaggctgatggtgctccacaggatggggcgagcgccggggatatctggagcctcgacgagctgctcatgctggcagcagctggtgcttattgagaaccgcaaaaaaaaaaaa

SEQ ID NO: 21234 - DNA, 657 bp, Triticum aestivum
  unsure (1)..(657): unsure at all n locations
  Clone ID: PAT_TA_21234
atggagccgttcatgagtataccggtggcgcgttggctgcagcttgcctgcagcgcggcctgcaagaccatagacactgtcaatgagctgcacgacgcgagaccacaggctgctgcaacgttgacaaggatgctgccccaccttgccatcgtgaagaatgccatggccatcgaggtgcaggagacgaaaaaactagtgatgcgggcagacgaggagagggcaagtcggtttccaaattattacaccgaaattaccgaggaaccaaaaactcgaccagtttctgaggaagcaatgatttttgggagagggtcagataaagagaggataatagccgccctgctatgtagtactgagcccaacatcacgcaagagcacatcaccattcttcccatctatgggcttgaaggcagcggggaagacaaccttggcacaaatgggatttaacgggacccactcccttcaaacggggatgactttcccggtatgggttcanngtgtctcccccacnttggggcttccatgcactaangnaacctcccattattttgtcacnctgttgnggaaanggngacaaagaaacntcanaacatagganggggntnggaggggtataaangaaaangcccntcacncagctacctttcancncttaagaag

SEQ ID NO: 21235 - DNA, 646 bp, Triticum aestivum
  unsure (1)..(646): unsure at all n locations
  Clone ID: PAT_TA_21235
ggccggtgcagatcttcgtgtccaaccatttgattccagacgatatggagttccaatcaggagatgtgccgaactacacaacttctgatggatcggtgaaaattcaaaaagagagtgaggtgcggctgaagattattggtactcgtgtcgatgctacagaaattttttgcattggcacaataaaggatgattttctgggtgttatcagcgatcctggtgcggcagtgtaaatggtctaagaagcgagattgtactccattgttctgacttctgagtactatcgcagacgtgtgtaatcgctggtccgttaaaactgcaatggctgtactgactgcggaacttgttgagaatgatgtgactaggaccttgtttaaggcctgtttgggtccttagtatggccctgattggcacaactgctgcttattgaaaaaacagcttatctgataacctggtgaaaaatagctctgcttgttgacgcttagtgtatttgagaagcagctgaactgataactgcgcagaagcaacgttgggaaaaaaaggggggccggtaccaatccccttagggtctctaccccgcctcacggcgtctttaaactctacggaaaacctgngtaccactatccctgagaatcccttccacgggana

SEQ ID NO: 21236 - DNA, 667 bp, Triticum aestivum
  Clone ID: PAT_TA_21236
accggtccggaatcccgggtcgacccacgcgtccggcgggccgtcatcttcaccctcactcatggccgacggcgacggtgacggcggcggagagggcggcgggagtgccgagtggcagcccatctacgaccgggtccaggcgcaggccgaggctctcgccgccgaccgcgcgcggctggaggcggccagcaaggtccagcgcgagtcgtgggaggcggcgcggaggcttcagcggagcgtggaggagctgcaagcggcggcgcgggagaaggacgccgaggtcggcaggttgcgagcagaagccgccgacgctaccaagaagctgcaggaagtgcgcgaggcggatgcgggcaggaggatgaggtgggaggcggcctacgtggatctgattctcggtgctaaccagaagctcgccgaactcagagatgtcgacatggaggattccagaatttgtgcagaaacccccaactctaaggcaagactcagtcagaacactgtggatcaggcatgtgttgcaagtgatttaagcacggagctaagaaaactaaagcaagcttacgagactctgagctcaaagaaggaccaggaagtttctgcattattctcagaaaaagaacttgcacgtaaccagttggttgtaatgcaaaaagcctatgatgcgcttctt

SEQ ID NO: 21237 - DNA, 564 bp, Triticum aestivum
  unsure (1)..(564): unsure at all n locations
  Clone ID: PAT_TA_21237
ggaggaggacacgggcgcccaggtggctcccatcgtgcggcttgaggaggtagccgtcaccaccggcgaggaggacgaggacgtcctgctcgacatgaaggcgaagctgtaccgattcgacaaagacggtaaccaatggaaggaacggggcacgggcgctgtcaagcttctcaagcacaagcagaccggcaaggtccgcctagtcatgcgccaggctaaaacgcttaagatctgcgcgaaccacctcgtgggcctccaccacgaaagatgcaggagcatgcgggcagcgacattcctgtgtttggcacgctgctgacttgccgatggcgaacttaaggaggatttttgccatcaagtttggttcggtagaaaactgcaagaattcaaggattggttgaggaatactgatcnctacaaagaacaaggcaaggaagtgaaatggtggtccacgctggattctggcnaactcactgtgacnaaggcaatctaaggaagtgcaatctaatcactgatctggnaatgactgaaacaaagccacaaacccactaatattggttgntcctt

SEQ ID NO: 21238 - DNA, 568 bp, Triticum aestivum
  unsure (1)..(568): unsure at all n locations
  Clone ID: PAT_TA_21238
caaaaacccagtaactcgcatcttcctccgtgatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcatccgtgacgccgtcacctacaccgagcacgcccgccgcaagaccgtcaccgccatggatgtcgtctacgcgctcaagcgacaaggccgcacctctacggcttcggcggtaagtcgcttcctcatctggtggcgaactgcatctgtgtcgccgtggcctttgtgtgcctaatcaatgtatccgttctcaaatgtcctgtgtccgtgggtctgtacccattctgcaatacaacttgcattacaatgggaaacctcgttcaaaaaaaaaaaagggccgtaccaatncccnanatggtctataac

SEQ ID NO: 21239 - DNA, 678 bp, Triticum aestivum
  unsure (1)..(678): unsure at all n locations
  Clone ID: PAT_TA_21239
aacctgacaagttagctacccgcgcagcgccgcgcgccatggccacgatgaaccaccgcattgtgcccctcctgctggtcgcagccacactgctcgcgcaggccgcggcctgcccctactgcccgacgccgaagccgccgccgcctccgccgccgtcgtcgtcgtccacgccgtgccctcccccgccctactcgccgtcgccgtccacgccgacgggtaagtgccccgtgaacacgctcaagctgctcgcgtgcgtggacgcgctcaaacggccccgtgcacgccgtcatcgggaccaaggccaagcgacacctgctgcccgctgctctccgggcgtggccgacctcgacgccgcgctctgcctctgcacaccatcaagccaaggcgctcagcgtcacctcgtgctcccgtcgcatctcggtgctcggtaacgagtgcgggaagcatgtgcctcaactccaagtgccgtaatanatcagctgcatatttgtctacatgattctacacactatcatatcgntcatcatatcatggtgattaggttatcccggcaagtntcaccatattattacttaaaatgagctgggtngatnatttaanaagtcagtttntgagncnaaacattnatttgccttggggggttgaccaatanaacatntnacngtaattgttaaaaan

SEQ ID NO: 21240 - DNA, 563 bp, Triticum aestivum
  Clone ID: PAT_TA_21240
caccgatgtcgttgacctgctctcatgcgaggacgcgcgcctgggccgtccccgaagtgcccgtcgggtccgggcccagggccgccgtcgcccccaacctcaggagtgaggaggctcctactagggtcctccaaccgcgcggccaccggcgtccctacagcggtctcgttctcccaaggtgcccgccgtgcacggggccttccgggattcggcatgggtactgaagctcgggaaccaaggaggagacattgatactgatgacacttggtgcaacctcagcactgctccctgcacttgtcctaaactggagtccctacagagactacagggtaaagtgaagaaagctacggagagcagtgaagaggaggagattccctaacgttcccaaggtaccttccggcgatgcaccctccgcgctctggcgcggtgttgcgtgctttcgggaccccacggacaatggctcgctgtgtgtaggccctccccgtctcttggttcttactctttacgctgatctacgtcggctgcatcgcgcccatggccacaatcagcaaagggaacaaaaa

SEQ ID NO: 21241 - DNA, 604 bp, Triticum aestivum
  unsure (1)..(604): unsure at all n locations
  Clone ID: PAT_TA_21241
naangntcgatagtccgcctcgggncaagacgggatgtgtgtcgggtntccgcggcgggtcgtgatcgggccgcctgccatcggcctggcgccccgggccttgcaccaaggcctgggcagtgccggacgagttgaccgacccgccggagctggcgtctcagcaccacccggggtggatggatgcaaggagaacaaatctccctggcttttggaagctctgctcgtctcttgtatcatactcgtcgtccctgccctcccagcctctgtatctccctgatcaatgagtccttttggtgtgtcaactgttctctccgtgcccagcttgtccagtgaaaggtcagtcagtgtccatccaagtctcatcttgtcctatacagaagagagaagccatgcatgaacatgtacctgtccctataacaatgtctttttttgctacctgttttttctctttctctctctttttttggggcacgagctgcgcacccgccctgctcctgcccttgcgcccttctgctgctttagccgtggggttctttggaccatggcgtgccgggggaacaaatgtctgttgcaaggtgttaaaaaaaaaaaaaaaaaaaactcg

SEQ ID NO: 21242 - DNA, 354 bp, Triticum aestivum
  unsure (1)..(354): unsure at all n locations
  Clone ID: PAT_TA_21242
ttttttttttttttttatgattccaaacaacatatcaaattctcacataaactggaacaggtcgcttgtaacaattaccaagagttcttcaggttcacagacaggacagcaaaattaactacggcaacaggaccaaaccaccacttctgagatccagatgacacacacaactctagtcgaacagggagaatcccatgtcgtcgtcgctctcttccttctcctcttccttcttctcctccttggggagcctcggcagcagcaccaccagatgcagcagcaccgccgccgccacctccgctcaccatcattgcaccaccaccgacagcaccgacgatcactggnaaaggggggggg

SEQ ID NO: 21243 - DNA, 572 bp, Triticum aestivum
  Clone ID: PAT_TA_21243
ctcgtgccgatttgaccctgtggagtacgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgacaagggatcaatcttcccgcccttcaccaacattagaaagatctctgcgcgcattgccgcagccgtggctgcaaaagcttatgaacccggtttgggcgacccgtctgcctcccccaagggacctgggtgaaatatgcacagagctgcatgtacactcctgtctaccgtaactaccggtagtgctgctgggatcaatccgcagtaataaaatatgtccgacgcagattatcctgcaatgttgtatttatttttcatttgttgggcctgctgctgacaactttggtggcgctagcactgtactgtctatgcatatatatactggacattggcgccttggcccccctgtcatgagatgaatgctggatttattgcccattaaaaaaaaa

SEQ ID NO: 21244 - DNA, 602 bp, Triticum aestivum
  unsure (1)..(602): unsure at all n locations
  Clone ID: PAT_TA_21244
ctccaaattcaatcgtctccaagcgccaatccgccccgtctccaaatcccaggcaggcaggcagccaaccagccatggagtgcgagccggaggagctgcagttcctgggcgtcgtcggcatctaccgcttctccgcggagatcctccgaggcccgcaccgcccgctcttcgcgcgcatcgcggccgccttcgcgctgcccctctccgcgctgttcctcctgcacgtcgccatctcgcacgcgctcttcacccacatcgactccgacgacacggccctggacgcatcctcccccgggcaccgacacgcagcgccgcctgctgtcccgcctccgcctccgactggctcgccctgctcctcttcaagtccgcctaccttctcgcgctctcctgtctcctctctccgtccgccgctccgtgntctccgtcgcctccgtctantccggccaagcgcgacgcgctaacttccgcgcgtgtctccgtcgtgcccgcgtctggcggaggtcgccgcacgttctcccgcttgnctctctcgctaaagcgtccgtctctttcncgctctctncgcgnaaggtcggctccggctnnccctctctnnctnctat

SEQ ID NO: 21245 - DNA, 739 bp, Triticum aestivum
  unsure (1)..(739): unsure at all n locations
  Clone ID: PAT_TA_21245
cgagttttttttttttttttttttcgcgtacatgtcgcacgcgccaggtgttttgagcacccgatttctacaaacaaattggacccttccgttgtatagggaaggtcttcaccctcattttaacccccctcaaccacaggctcaccccaccaacagcaagcgaaaatctcccgatcccctctggtctccgcggcgaagatgtcggggcgcggcaagggcgggaagggcctgggcaagggcggcgcgaagcgccaccggaaggtgctccgcgataacatccaggggatcacgaagccggcgatccggcggctggcgcgcaggggcggcgtgaagcgcatctccgggctcatctacgaggagagccgcggcgtcctcaagatcttcctggagaacgtgatccgcgacgccgtcacttacaccgagcacgcgcgccgcaagaccgtcacagccatggacgtcgtctacgcgctcaagcgccaaggccgcacctctatgcttccgcggctaagctaagccggcgcgcctcgctgtctccctgcggtctattgtttttgcaatccgcaaattaatggctccgtggcgaaaatgctggttactgtggcactagatnaaacatgttgtgcgtgtctgaanaaatgcaattgtactgctgtttgtcaaacatctcggggcccgtcccctcctccttgttgtgtttacataaaaaaaaggggnccgtccaatccctaatattnatanc

SEQ ID NO: 21246 - DNA, 645 bp, Triticum aestivum
  unsure (1)..(645): unsure at all n locations
  Clone ID: PAT_TA_21246
gaagatccagccggcacacacagacaccatcggcgaagaagaggccggagagaggatgatactggccgtgctcttcgccaactccgatggaaacatccttgtcgagcgattccatggggttcccgcggaggagaggctccactggcgctccttcctggtgaagctcggatccgagaacctcaaagggtccaagaacgaggagctccacgttgcctcccacaagtctgtgtctattgtttataccacggtcggggatgtctgcctctacattgttgggcaaggatgaatatgatgagcttgctttgggctgaggtgatctttgcaattacatcagcagccaaggatgtttgtgcaaaacctcctaccgagcgcctcctccttgacaaatacgggaggttctgcttgtgccttgatgagattgtttggaagggggcgctgaaaacacggagaaaacagattagagttgataaacaaanccctgtgggancatantgcatttaacaatttggcttcttnancantcatccattgcattgtaggcaattcaagtttcatcgcacatgtactacagaatacacactatggngatgcgttgtaatcaaaacattacatcgttattcatgtgaaagttgtacgcttgaaaaa

SEQ ID NO: 21247 - DNA, 644 bp, Triticum aestivum
  unsure (1)..(644): unsure at all n locations
  Clone ID: PAT_TA_21247
aaatgacatcgggccctcatgcaaatgtccgtggcgaccttgccaagcctcccttcttcctctatggaaatgttgttaacatcaccaaagatgcgtggtctgaaatatcgggtttcttgtccggtgtgcagcccgagtttataaatagtcagcttttctcggctttgatgcgaagggaaggttaccttcataaccttccaacagagagaaggcatgttgcggtcccaaatccaccaatggacaatggaggatgcatgcctccctccaagacattactgggccacatgggacaccaagaaaacatattggtagtgttacttccaaagtggcaagaattngaacactttggtgagatgtttgggaaagaccataaaattcacgaggatcctttccangaagaaaacgacgcaattttgcaccaatgcaagatggaatcttatccggatgggccaagccggtaggcatctcgagccaacnaatggancggtttagtaccatcaaccatacaaatcgtttggctaaccacggcagagtgcgcagaatacctttcaacggcacattgctacctttgcattcaaaaatcctcaggggtggcgccccaatgattggnaaattcctcacccgatcacaaggttgcngtaann

SEQ ID NO: 21248 - DNA, 1433 bp, Triticum aestivum
  Clone ID: PAT_TA_21248
tcaacacctccgtgcattatctctctttgttcataagctccatatgccagagcgtgccgttggatactgtgaccgtgtttatgaggaaggagcgcagcagccttccaagtccaatatttattttaatcttctgcaaatttatctaaacccgaaaaaagctgaaaaagagatcgagcagaaaattattccaatggcatcacagtaccctggaattcagagggttaactctactaataagctcagaggagggcgtatgtgtagaaaggtggttgagattgaaggggctgaagacacacgctttagccctagtggaccagatagtggccgaagtgatggtgatggagatgatgttagcgacggaggccctataatgttgaacgaagcacttgaattgttaagccaacggtgggacagaataaatggtgctcaggctcttcggttgttaccaagagacacaaaactgcaggatctggtgtcatttctcgaaccactattgcggaactctagtgaacatcggcgcaattatatggttatcaaaaacttgattctccgggcaaacttgcagataaaggaggacctgtacaaacgacgccaagctgttgtgaagattgatggagatagcatgtgttctctttgtcataagcgcattgcaaacagtgctttcgcaatctatccaaatggacagacattggtgcattttgtgtgctttagagaatcacaacagatcaaggctgttagaggcgcaaactctgcgaaacgtagatgatgtgaccccgtactccaggtatatatttgaactccatattcatatattgctgttcagccttaggtattatggcggactaggtacagccgtttgttcagcctattacggcggactagaataaatcaagagcgtgcgctaactagattccacttttcatatatgtattttgacaagccagatgtcaatccccaagaattttaagtttgagcatcggggggagaattggccaataactgcattttttctggatcatgcttggaaaaagttgtgttgaagccctgatccaacccgagccatcaacccatggcttggctttgcctgtaagcattgcttcctgggtgaatctcttgcccccgctttgtcgcatcaagttttcgtcgatgccgtcttgtggaaatcctttttgttgatctttaccggatccgagcggattgcttcggaaagtctttagcgggctctcttcagagccttgtatttagtgcatgtgcgtgcacgctcgcttgtttgtttcagagtccagaaagcttacagagttgagtgggtgtgtgaacgtatagtgtccctgtctgttcaagcctgttgtaaatgtggaggcggcgatgtcttgttgtttgttgtaccaatcataagagtaaatattgagatccgatttcccaaaaaaaaaaaa

SEQ ID NO: 21249 - DNA, 755 bp, Triticum aestivum
  Clone ID: PAT_TA_21249
gccccgcgaccccgaggaggaggcaagatgaagacgatcctggcgtcggagacgatggacatcccggagggcgtcacagtgacggtggcggccaagctggtgacggtggagggcccccgcgggaagctcacccggaacttcaagcacctcaacctcgacttccagctgcaggagggcggccgcaagctcaaggtggacgcatggttcggcacccgccgcaccatggccgccatccgcaccgccatctcccacgtccagaacctcatcaagggggtcaccaagggctaccgctacaagatgaggtttgtctacgcccatttccccatcaacgcgtccatcaccaactccaacaccgccatcgagataaggaacttcctccgcgagaagaaggtcagaaaggtggacatgcttgacggcgtgcccaccccccgctccgagaggctcaaggaccacctgatcctcgatggcaacgccctcgagctactctctcgctcgccgccctcatcaacaagaacagccatgtcgacaagacacataccacgacgtttgtcagtggcatttatgtgaccgtctaggtattgatccaagtcgggcagtgaggcgcaagttgttgctttcgtctgagttcgacgttttgtttggtttgcaattttctcaaggtgaactttgtaatcggttaggatgtgttgtggaccattatcttatcctacaatattatcgtatctgtttaagaataaaaaaaaaaaaaaaaaact

SEQ ID NO: 21250 - DNA, 842 bp, Triticum aestivum
  unsure (1)..(842): unsure at all n locations
  Clone ID: PAT_TA_21250
cgtggangcagactttactattcaagggggaccacntgcncaacaanttcagggacaccttaagccttncaagccnttnttntggtacctatnngtcancgagatccatttntcaggtgcttgagcactatgccaactcactgatggattggacagaaagtgcagattgtaggagatgacttctcgttaccaaccccaccagggtcgccaaggcccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattcctctcctcgctgtcggcccgtctaccggccaaatcaagacgggagctccttgccggtctgagcgcctggccaaatacacccagctgctcaggaatcgaggaggagctcggtgatgccgcggtctacgccgggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctccgagagctactcaggtgattttgtccgtgggagcaccaaaagcagaaaagaactgtttttttcctctctctctctagattctgacgagtggtggtctgcactcgtcgtaatgtcgtttgcctaaggccccgttcggtttggcctgaacgacctggaatacagcatattccagctgaaattatgtcacttggattaaaaaaaaa

SEQ ID NO: 21251 - DNA, 438 bp, Triticum aestivum
  unsure (1)..(438): unsure at all n locations
  Clone ID: PAT_TA_21251
caattatggttcgttccagggaaggtgtgtgatctgtggaggagtcggcatctcagacgcttactactgcaaggagtgcacccagcaggagaaggaccgggacggttgccccaagatcgtgaatctcggaagcgccaagacggatctcttctatgagcgcaagaagtatggttttaagaagagatgaccgagaagatggagctgtgtgtggttcactttggctgtgtggtctgttctatggcactgaatactgagagtaggcagctgagacagcagctttgtattcctgttatggtttgataattgatactcgcatggaaatacagctgtgatatgcgttgtaataactaagtccaactgtatgatgcaaagagactgcttatgtaatctgtgcttgatggtaatggttatgaatggacttganatattggacaaaaa

SEQ ID NO: 21252 - DNA, 542 bp, Triticum aestivum
  unsure (1)..(542): unsure at all n locations
  Clone ID: PAT_TA_21252
ttcnaccgcgacccctacgagctcaccttcacctacgactcgctcttcgtctcngactggacgcgcctcggccgcccccccctgggcgccggctggggcggccccgcacacggcctgcccttctcctacaacccgttcatggccgtcgccgtcatcggcgccccgcctaagcccaagcccggcgcccggcatcatgaccatgtgcgtcncaggggcagcacctgcccggagttccagggagcagatgttgagccagcaggccgcctaggctagctccttcctgatcatcccatcaccatgttcatctatatcgtcatcgtcatcatgcatgcgcgtgcacgtttggaatatttgttaatcaatcaataacggtgaggtgaggttgctattatatgatgtagtagtaacacctcaacaacaacaacccaatgcaatgggaactcgcgtgtaatttgctccttcttcttcaaatataattccgcctcaattgtatgtatgtattccgcctcgctgtctgtctttgctcttgctttttgtttctt

SEQ ID NO: 21253 - DNA, 689 bp, Triticum aestivum
  unsure (1)..(689): unsure at all n locations
  Clone ID: PAT_TA_21253
tatggtgtaccggttgttatgccaatagcagcgccgggcagctgggctgctggggatgcggcacgacgcgcctcttgcagcctaaccccacctctcgagtctcgacaccctcgaatcagcgtccatggcacccaaggcggagaagaagccggtggccacggagaaggctccagcggggaagaagcccaaggcagagaagcggccgccggcgtccaaggagggcggcgagaagaagggcaagaagaagtccaagaagagcgtggagacgtacaagatctacatcttcaaggtgctcaagcaggtgcacccggacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcagcctaggcttcatcggacgaatggatggtcgcattctgtatgtagctagctgccagtttgtgttctgaagatgttatctcgtgagaatcaaattgtatcgcctgtcggtctgaagaaatagtaatgttcctttcagtgtaacttttagccttcgtcttnn

SEQ ID NO: 21254 - DNA, 584 bp, Triticum aestivum
  unsure (1)..(584): unsure at all n locations
  Clone ID: PAT_TA_21254
gacgaacagacctctaaaacctagcagaggcccgcgccgccgccgccaaccgcgacgaggaaggaagcaggaacgcgatgccgaagtcgaagcgcaaccgcccagtgaccttatcgaagaccaagaagaagccaggtttaagagcgcaagggcaaagtagtcgccgagataaaagatgctgtcgacaaatacagcagcgcctatgttttttacctacgataacatgaggaatcaagaagctcaaggacctcaagggagcagctcaagtcttccagcaaggattttccccgccggggaagaaggttttgccagataccgctggggcgttccccggctgatgaagctaaaacaggcctccacaaactttccaagttccttcaaggcaactctggtctgttattcaccaatcttcaanggatgatgttganagattttcgagaatcaggacatgatttgaaggacagaagtatgctatcatacgttactaagaagcctctggacattaacatgagatggcattcaccaagcagactcantccttacaagttttaantggtnaacattatttagaagaaccttccaaa

SEQ ID NO: 21255 - DNA, 676 bp, Triticum aestivum
  unsure (1)..(676): unsure at all n locations
  Clone ID: PAT_TA_21255
gcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccaagggcatcgcctggtccttcggcggcatgatcttcgccctcgtctactgcaccgccggcatctccggcgggcacatcaacccggcggtgacttcgggctgttcctggcgaggaatttcctcacaaggcggtgtttacacatcatgcatgcctgggcgcatctgcggcgcgggcgtctaaggggtcacagggctgtcatggaacggcgcgcgcaactctgggccggctaacaaggccaacgctaagccccaatttcggacttatccctccaccgtctcgcgcccagcaaaggaaccgggtcccgtgcctttncccccacgttcttccctatgaatccacagacganancggggg

SEQ ID NO: 21256 - DNA, 1079 bp, Triticum aestivum
  Clone ID: PAT_TA_21256
ctgggctgcattctcgcggtttctctcgactcatacctcatcccccaaacacgatcaacccaatcgtccccatggcggccacgctcttctccatctcccccatgttcctctccctcccctcgtcctcctcctcatttaagcaggccccctccgcattctttccctcgaagaccccgcagcaccgcgccctcgcctccgctggctggaggcacccgctcgcttccttggccgtgtccgtgtcgtcagatgtcgagacggaggtcgcccaggagttctcggaggacctaagggtgttcgttggcaacctccccttcagcgtcgacagcgctcagctagccggcctattcgagcaggctggctccgttgagatggtcgaggtcatctatgacaaattgactggacgaagccgtggatttgggtttgtaactatgtctactgtcgaagaggttgaggaggcagttgagcggctcaatggctatgtacttgatgggagaagtttgaaggtgaattcagggccgccaccacccagggaccaatcctcaccaagaggatttagagagcaatcaggcggattcaggcagcaatcctcacgtgggcctggtggtggggacaatagggtctatgtgggtaatctttcttggaatgtcgatgactcagctcttgcaaacttattcaatcagcaagggagtgtcttgggggccagagtcatctatgacagggagagtgggaggtcaaggggatttggttttgtcacatatggtaccagtgatgaagttgagaaagcagtatctaatcttgacggctctgacttggatggaagacagatccgtgttacagtagcagaagtgagacaacctaggcgagaatattaaaaatcctattttagatgatgcgaagcggaactatgtaatgctgccaggtttttgccctctaagtacacgtttcggtgacgagcctgtagagtttgtttcctcgcagtgcgtggactcccttccctccttcccggtctcctgtaacagaatctgctaatttcctgttatgcaccctgttcaaaaaatgaagatgccgctaagacaaaa

SEQ ID NO: 21257 - DNA, 1305 bp, Triticum aestivum
  Clone ID: PAT_TA_21257
aagccgccagaatagttacctccctgtgattggcatacaaaaattgtaagttctgagcacccagagactttaccagcatctgtcgacttcataatctggatcttacaggcgcgagatcggaagctcagcctgcttgagcaagatccatggcttccgagcagacggtgcacatgaacggaggacaaggggacacaagctatgctcgcaactccagtctgcagaacgctgagcagaacaagatgaggcccctcatagaagaggccatcgccgatctactcagcaccggcgcctccttgccgagaagcatggtggtcgcggacctgggatgctcctccggcccaaacgcgctcactctggtgtcgatctgcgttgatgccatccgcagccagtgtcttcgttcccggcagccgccggtggaggtctgcgtcttcctcaacgatcttcccgacaacgacttcaacatggtggtgaagagcttggtggcgttccagcaaagccacaggtcagtcgtcaccggtgttatgccagggtcattctacgggaggctcttcaccagtggctccttgcatctcgcctgctcggccaatagcctccactggctctccgaggctcctgaagaactgaggaggaacaagatcccggcatacgacatcgatgagcatgtcaggcgagaaagacggcgtgtggtcatcggagcctatgcgcggcagttcaggaaagatttcacccttttccttgagctgagagccatagaattggccgcaggaggtcgattggttgcctcccttgctgggaggcgctctgaagaacctgctgccgaattcactcatgcctgggaatcagtcgcccttgtattaagtgagatggcctcaaagggtatgattaacagagcgaagtttgatactttctacataccgatatacggaccttccgacgaagagctgagggagatcattcaagcagagggttctttttcaataagggagatgcaagtgcatgagcctgcaagcaatgtggaaagcacgctgatctccccgagcaagatggccaatctgctgagagcagggtttgagccgataatagtccagcattttgggtcgtctgggaagatcatggatgaatttgtgaggactgcggaacgacgctggagccggcggggcagcttggaagccgagctggctagaaaccccagagttatcttggttgtgtcgctaaaaaagaaggtataacgtgttagggcatctcgacccgcaaatttgctccggcagcaatggataatttgaaattcaaataaaagtctgatcc

SEQ ID NO: 21258 - DNA, 675 bp, Triticum aestivum
  unsure (1)..(675): unsure at all n locations
  Clone ID: PAT_TA_21258
gtgtcgccctaaaagaccagactaccccgctgccccgaagtcagagcctcagaaggggggagaggaggctagtagggatagcgcatcgtcatcgcacctccacgcgccggcgagccagaccaccagaggcagcgatggcggtggcggagctgtgggagacactgaagcagtcgatcgttgcatacacggggctgtcgccggcggcctttttcacggccgtggcggtggcggccgctctgtaccatgtcgtgtccgggctcttcgcagcccccgcccccgccgccgccgcgcccgcgggaggagcccgaggcggagccgctcccgccccccgtgcagatgggggaaggtctcaagaggaggagctcagccagttacgacggctccgaccctaagaagccgctcctcatggccatcaagggccagatctacgacgtcacccagagcagaatgttctatggacctggtggaccttcccccccacgcgccggcccacaccccgccgagcccctccgaccatggccttcgggcctccggcctgcccgcgactcaccgccgacgccgttttactcatccctgcgtgttgcgaattacttatgacaatacgtgagccggactgtcccacggcatcgcgttgagacgaacacgcgcaagcaanccctgaacatgaggcgcacc

SEQ ID NO: 21259 - DNA, 683 bp, Triticum aestivum
  unsure (1)..(683): unsure at all n locations
  Clone ID: PAT_TA_21259
ggcataaaacatcatcaggtgaaacaaggcccaatgcagtgcaaaaaagaggaacacagtccagcttatatccgaccgtaaaccctacatgagaggaggcaaggaagccttggctccacattttcccttccttctattacaaaagtctgttcgttctatgctctcttttttcactgaatggccacagtggctgcacatcaggacttgttggagaaaacaagccaacatgtgcaccggacggcgacagaacatgcccgccgccgccttcctgagctccatccagcaccagttcctccttaggcaacaaataaccaaggtggcccaaaggggtgttcgcgggctgatttgtttgggagacccgaaagccaatcattgtgcaattttcctggcatttcatgtgaaaggaacaagcttgatgtacatgtggcaattgttggaaaggtgcttctgaaccatggtcactgtcattcaaacagtaccaggggactcttgccctgcctccactactgaaaaggtacacaaggttaaattgattgggtttgttgaacacgacccgantctcagtatgtgatcgcanacatnanggatttcacaaaaatgaatanggttacggaagngccataatgngaaacagtatgangcngnttactgtttnncagnggtcnaaaaaanttgcatttttt

SEQ ID NO: 21260 - DNA, 640 bp, Triticum aestivum
  Clone ID: PAT_TA_21260
cgagctcgagcgatcccactcccgatcagcagctgatcgctcactcttgcagctcgatcattctttagctgctctagctctagccctagctagtagctagccactcggtcgtgtagtcatcagccttctgatcgtcacccatggccactgccgaggtccagaccccgaccgtcgtggcgaccgaggaagcgccggcggtggagaccccggctccgcccgccgtcgtgcccgaggaggctgcccccgccgccgaggccaaggtggaggagccagctgccccggcggagaccgagccagctgccgccgctgagcccgaggcggcccccggtgggaggcggaggaagagacccaaaaggaggcggagccgggagccggcggcggctggagaggtgaaggaggaagcggaaacgcccgctgccgagacagaagcagaacaagcagccgctgagcccgaggtgctgctgcggaggaagagccgcggcggccgaaccggccgctgaggagccgagaaggcgaaccggccgctaagtggcgacaaggcaacagtgagcctccccttcgccacccggcgggcaagcgccggaatcatgtgccccggccgctgacgccgggtgtgtaccaccaaggtgcccccgccggg

SEQ ID NO: 21261 - DNA, 584 bp, Triticum aestivum
  unsure (1)..(584): unsure at all n locations
  Clone ID: PAT_TA_21261
gtttgctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggactcagctccagctgcagaccaagctgcagagcattcaagctcctgactgagccaaatgatccgaagcctgagaatctggctgggctggaggacaaaccagangagaggtgacaaaactggtgtcaggcaaggagtcaactgggatacc

SEQ ID NO: 21262 - DNA, 643 bp, Triticum aestivum
  unsure (1)..(643): unsure at all n locations
  Clone ID: PAT_TA_21262
gtcctgccgccgccgcagccgccatcgcacggccatgggtatcgatctcgtagccggcggccgcaacaagaagaccaagcgcacggcgcccaagtccgacgatgtctacctcaagctcctcgtcaagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaagggtgatcagatcgccgtgattgtgggcaccgtgaccgacgacaagaggtcagcgaggtcccggcgatgaaggctgcgcgctcaggttcaactgagacagcgaggccaggtcatcaatgctggcggagagtgcctcacttcgaccactcgcgctccgtgcccaacttgggcaaaacacggtctgctgagggncctaagaacctanggaacttcaagcattcgggctgcacaagatgctcacagcaacaacctattcccccaanggtagaattgaaagggaaggaggggacacagggctcaggcaatggcatgcttcatcagcgtttgccntatnaaaacnttgggcaatntagtttatncgacccntattcgaanacaaaatttcctt

SEQ ID NO: 21263 - DNA, 871 bp, Triticum aestivum
  unsure (1)..(871): unsure at all n locations
  Clone ID: PAT_TA_21263
attgataccaactagcaacatacatagtgaagtacactagcaacatcttagcaccaatgggagccaagatttttgccctccttgccctccttgctctttcagcaagcgctgctacctcgacttttattccacaatgctcacaacaatacctctctccggtgacagccgcgggatttcaatacccaactatacaatcctacatggtacaagaggccatccaagcaagcatcttacggtcattagcattaaccctccaacaaccatatgctctattgcaacagccatccttagtgcatctgtatctccaaagaatcgcggcacaacaactacaacaacagttgctaccaacaatcaatcaagtagttgcagcgaaccttgctgcttacctccagcaacaacagtttcttccattcaatcaactagctggggtgaaccctgctatctacttgcaggcacaacagctactaccatttaacaacttgtcgggagcccttatgccttctactgcaacaacagctcctgccattccatctgcaagctgtggcaaacatgggcgccttctggacacaaccacagttgtccccatttgtcccactaggcgcgggaagcctttgtcccctcctgcagcggcaacgtgcgctaccattcttcccactcaatgtggcaaccctcgtggccctcttgcaacaacaacaattgctgccatttagccaacatgctttgacgaatcctaccaccttattgcaaccgcccaccattggtggtgccatcttctagattttttatgatttatactgtataataaagttctcatgctgatatgtgcgacctccagtaataaagtattagagatcatatttaaatcannaan

SEQ ID NO: 21264 - DNA, 641 bp, Triticum aestivum
  unsure (1)..(641): unsure at all n locations
  Clone ID: PAT_TA_21264
caacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacaccgcctcaacttcgacgcctccacggcgacaaggacacggggctgcacgacggacgcgtcctgtccgggatgtgcaaggcaaaacaaactgaagtctcctgggtccaagcaatcctcgcggcaagcggaggccgacccttccccctcggagcgccgcggatgactagcggcggtcacggggcggttctggncacaacgggacatncaca

SEQ ID NO: 21265 - DNA, 676 bp, Triticum aestivum
  Clone ID: PAT_TA_21265
gcgttcttcgacggcgggtcgcgggcgctggtcgaaatcttgacgagagctctgagaggccagtgccggtggaccacagatcacacgtgcttcgatttcggatcagtccgataccatgctcggcgtcggaccccgagaaccgagaactgtcattatcggatatcgccctctcccccgaggcgtcgacggcgacctgcctgccggagttcacgctgcaggaggtgaggaagatgtaccacaagttcgcggagctcgtggagccggccgccgagcaaggaaggctaagctctgaccctgaagctcaacgcctccggcggcacccggacaaaagatcgcgcctccggcgttaggcagggctgcaggctatcgtcctcgggtcgcaggtcgcgcatgtggcacctgctggggagccctccggtcccaggcgccaccaagctaaccaccaaccaccgagaccccttcttactcagcaggacggtacgtacgtccccgccggagattggtggagacgaagctcggcgtgtgcggcacgctgacggtgtgggccattgcagccggtgaagatcaaggccatgacccccatgcgttctcgggacgacacgaacatagccgtcgccacctgcttgatgcaggacgcagggaactcgcacgcgaaggcgcccaagcgcacatggtc

SEQ ID NO: 21266 - DNA, 638 bp, Triticum aestivum
  unsure (1)..(638): unsure at all n locations
  Clone ID: PAT_TA_21266
ctgctctgctgccgtggcccgtgcgtgggatttagctcaggaacccacgcctgacatcccctcttcctccccggccggcgatgtcgtcttcgtcttccgcgctggccaaaggcaagtcggcaatcggatccgcagccggatctgccaaattcgaggccaaggggaaattctcctcctcctcctccccagctgcggcagctaccaagcgtggaaccaccaccagcagcagcagaggtagaggtagagggaaggccgacaagaaggtctactccttgcccggccagaagttcgttcctccggaggagagggagcctctcaggattttctacgagtcactgtccaagcagttccctccagtngagatggctgaattctggttgatggggcatggtatgttgtctccctgaagagacaaggaagcatatgaaaggagcaaaaccgcaacacaagtgaggatgggtcccaatcaatctggtcagtgagaaaagatataaactgaaattcaagaagcaagcattatggatcaaggaaagagagattgttatgtacacacacatactcatgtaaataaaatagggatgcattactgattttatataacagtagtcaaanaatcttaaacaggncatattacccga

SEQ ID NO: 21267 - DNA, 398 bp, Triticum aestivum
  Clone ID: PAT_TA_21267
tttttttttttttttttttttttcaagtcgccagcgctgaaactttgtggatacgagttgtttggctgcttcttacctcaaggccaaatattttaaccttcatcccctctaggtgtccataaacaattacttaagacgacgtgtttatgaatttatgatacaagacgaaaagaatgcagggcacacgtccttcatgcatttatacacgacattattatatgtacagcacagcacttgttcacactatttctgaccactgctaaaccgctccgtgtgttcttcttcaaccttcaagccaggcgtcactccacaacgctcccttcaaacatcgagctgaacgtcttcctactgctcgctgggacaagcctggtgcgagcgcgcaagacgtcgttcttctc

SEQ ID NO: 21268 - DNA, 566 bp, Triticum aestivum
  unsure (1)..(566): unsure at all n locations
  Clone ID: PAT_TA_21268
cagaccgggagtagtcgacgcgccgtcactgaatcctcagatcacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctggacaccgtgacttcatcaagaatatgattactggcacttcccaagctgactgcgcggttctggtcgtggacccactactggtggtttgaggcggtatcccaaggatggcagaccgcnacatgcctcttgcttcaccttggagtaacanatgattctgttnaaaaatgatgcacaccca

SEQ ID NO: 21269 - DNA, 688 bp, Triticum aestivum
  unsure (1)..(688): unsure at all n locations
  Clone ID: PAT_TA_21269
ccagccgccaccaggtgcagagtctttcgtcatctcttctccggcgaagaacccccagtcgcccaccagatcacttgttaaactttgttgaggggtgatggcggtttctttcgcaaacctcagctccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcattccttcaaccccaactccagatgttgctgaagcacaagccccagttgctgaggaggacgacgacgatgatgttgactttttgggtgaggagaccgaagatgagaagaaggtgctgaaaacgtgctgcaactgcaaagctctggcaagaagaaagatctgggaatcacagtttactgattgaaccatggacatagacgcatgcaactcaggaactgtagattcaatgaggttcgtgggccacaactgccattcgatgggacaacagaaaagcacagcacttccacagccccccgacccggtcacctacgcctcattcgcatatgccccgacgngtacnccgg

SEQ ID NO: 21270 - DNA, 566 bp, Triticum aestivum
  unsure (1)..(566): unsure at all n locations
  Clone ID: PAT_TA_21270
ccaaaacccagaacctgagaatggcgcagttccttcgcggcaaggccgccgccgccgccggggcggcggtgctgcgcgcgtcgtctccggcgccatggcggcggacggcctccgcgtcgtaccaccacacgatccaggctgtaccgcgggagacagccggcccgcgcgccgcggcacgcgagcgccgccacggccgcgtcccggcggtcctgctcacgctcgcgggcgccgcgccagggaacggaattgcccaccggcacctccttaccgccgacaggaggcagctcgcggagatgctcaagcagtcgccctacttcctctccacccccgtccgcctccaggtccgcgcgggcgagcgatccaacgccatcctccacgccggcaccgtcctccccatcaaggtgcatagagatgaaaattctgggaatatactgaatttggtaatggtgaaggcagatgaaggaacaatgctgaaagtggattgcctgtagattcaagggaaaggatgctgccctgggttgaagaaaggaggcttttgagaaattggcgacctctgtcttcnctgc

SEQ ID NO: 21271 - DNA, 586 bp, Triticum aestivum
  Clone ID: PAT_TA_21271
ctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcctcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcctggtctagttagtctgtgttgtctttatcggtgctgttttctgtggtggttgtactgcatcgttctagtttctagtccatgtgctgtaatatctcgctgctgtaatcaatggaatgtcctcgtttcaagcctcaaaaaaaaaaaaaaaaaactcgagaccagttct

SEQ ID NO: 21272 - DNA, 516 bp, Triticum aestivum
  unsure (1)..(516): unsure at all n locations
  Clone ID: PAT_TA_21272
tantcaagganggtattctggttatggnnaatcttcnactgctggnggcatcngtgggggtggangtggaggacaagctgcaggcgcatggaattccaatgctcaaggatccggtagtggaactggttctggctctagctatgctaacaggtattggtacggatcaagtgaagcaggtgcaagtgctaatggcaatggtggtggcacaggaaatagtcaaaacggtggaagtggtggtggctcaggtgctggatctgggtttggcaatgcctacccctaatttctatatctaagtcaacctatagttgggagcccaacagtatttgtcatttcaagttgtggnattagttagttgtttgtacctctattacacttttgcctagaactaaataaataaagggcccatctatcctagtaatgggccgctttttgtgtggtctccccgttgtttggttgttgctggtcatcttggcatccaatgaacgccttactaacttcccttttaaaaaaaaaaaa

SEQ ID NO: 21273 - DNA, 1953 bp, Triticum aestivum
  Clone ID: PAT_TA_21273
ccctccccgcccggacccgcccgcccctccccgccgccggcgaccggaggatcccccgcgtagggctccgcatcggcgtccgcctcgtcatcgcctccctggccgccggttcgaccccgtggcccgtcgccggcgagccgcggcctccaccgccggctccgaggaagaaggcaggcgggggcgctctactcgctgactgagatgactgcttaaatgggataattataacacaaggcagtctggtgtatatactgaagaatcaggttttaaccacaatcaccagaaactagaaatggaggatggccttgagcttagtttaggcctctctttgggtggtgggtcttctgggaagtctaaggcaagagatgcttctctagagcctaaagcagaacctcaagtggaagagagcagtagcaaaggtgtctcgcaacctcctgatgctccttttgcgcattactatcaagcaactgctgagaaccaggaacacagttgcaagcagaggcatagccctgctaccccgccatttggaaacttctggggacaacacggtggctcctctgcagtgaatctagctctggaaagttgccgcatagaaatcccttctcagcatcgacagtatcgattgcgcactatcaagaaataatattgggaaataattccgaggaaaacatgccagtctcaagtttacgctccaagctttctgatgcatttggttctccccgtacacatcggactgctgctccagaccctgagcggttcagtccaggtttcttttggttacccaacaggtcagctaccaatacttgaaacgagctctgttcaaccggtgaaaatgaggcctcagccgactccgaagctggctgctcagcctctcggttgggcgcacggcgtgaaggcagtgccaagggcgctgtggtaaacagaggacccgatataaagagatccagggaggaggtggtaagttgatttaaaaggtatagcctctcgtgggctcgggctctggtataaggccgggcatcgccccgaatgtcaaattcggagggtccggatcataccctgatcttccctgggtatccacaaccggggctggaccaaatggcaggaccatatcaggcgtaacatacaacttcggcagaaacgaagtgaagatcgtgtgtgcttgccatggcacacacatgacgcctgaggagttcacgcgacacgctagcgtggacgcaacaggccaggagaacaatgctaccatgtcggcgtttcctgtcgggaatcaagcggcctcagcccaaaactaattcagcggcatgcgtgctggtttcatagtgtgcttgctgttccctttgtgtccatatcatcagttcagtatattgttgctctgttgattcaaaccctattaatatacattatgtagacatgtgtcatgttgtaactttggctccattgttgtgaacgaaactgatgtatttattatatcaaattcggagggtccggatcgtaccctgatcttccctgggtatccacgaccgggtctggaccaagtggcaggaccatatcgggcgtaacatacaacttcggcaggaacgaagtgaagatcgtgtgtgcttgccatggcacacacatgacccctgaggagttcacacgacacgctagcgtggacgccacgggccaagagaacaatgctaccatgtcggcgtttcctgtcgggaatcaagcagcctcagcccaaaactaattcggcggcctgagtgccggtttcatagtgtgcttgctgtcccctttgtgtccatatcatcagttcagtatattgttgctctgttgattcaaaccctattgatatacattatgtagacatgtgtcatgttgtaactttggctctattgttgtgaacgaaactgatgtatttattatagctccctttgtgtcttcaaggcaagaataatactcccttcgttcttattt

SEQ ID NO: 21274 - DNA, 181 bp, Triticum aestivum
  Clone ID: PAT_TA_21274
gtttacacaagctgttgaactgctgctgcagctttgtaaccttacagagttagagtggtcatcagaagcgatgctcacttgtcctctctccgtattaccgtctcccatgtcctctaatcatatcaacaagagccaggcgctgtaaaaaaaaagtagtagtaggaattggaaaaaaaaaaaa

SEQ ID NO: 21275 - DNA, 630 bp, Triticum aestivum
  unsure (1)..(630): unsure at all n locations
  Clone ID: PAT_TA_21275
actagttctctctccgtccccgggtcaagtcgtatcgagcacatccatctccattaccgccgccgagagagagacccaccccgctcatccaccaccatgtggcgccgcctccacaccctagcacccgccttgcgcagggctactgccgccgctgccgggggccccgcggtgcccgcctcctctgctgcccgcgccgcgccgctctcctcggcggccgccggcttccgccgcactagccctctcctctcagaggacaagccggcgagggtggaggacgtcatgcccatccgccacggggctccgagcgggaggagctagaggccgactccaggggaagaagcggtttgacatggattccccggtcggcccttncggtaccaaggaggaacanctgtcattgagccatactataacaagcggatatccgttttcctggtggcgggggtggacacgtacttgttggtcccgggtctggttnaaaaagacaaccgcatgatgtcagtcgctccaatacttgtgctaaagnaatgggatgtgaatcaaatgcatgacatgagatatgctacaagatncttngtcnaaataaaattgnaggaatatcatcaantcttttntannaatgaggaacct

SEQ ID NO: 21276 - DNA, 1400 bp, Triticum aestivum
  Clone ID: PAT_TA_21276
ggcagaaaaaccggcgaaaggcgaaatttctcgaatcggacgtgagatccggatttcgacccagtcccttggcctggttccgtcacgggctagggtttcgccgtctctccagcgttgcgggccggggcggcgaagatggcagggaagggcgccaaggcgacggccgccaaggcggcggagaaggaaaaggggaagaaggcccccggctcccgctcctcccgtgcctgttcccaggaggagccagttccaaagaaagatgtgtatcaattgtttgctgagaaggttcgggataacaagcagctggaatcgagatgggctgtcatgcaagaaactcgcgttgagtattttcgtggaaaagattttactaccttcatcaagaatcatccagaagttggggaaattttagggccggataaagatatggaagctgaagatattgtcaacactttgcttatcaagaacctcgtaataaggtgtgaccgagtttggaaaactgtgagaccaggaaagaaaaagttatcatcctggcctgctcatttggagatacatcaggaacaagtattcactgaaaatgatggtttttacgcttggatgtttctcaaaagacggaccttgtggcagacgattctttcatttatctggcctgtctttgcgttggcagtctgcttatttccagtttacccataccaatgcaagattgtggtactgtactcttgcgctggagctttactgttcattgtatccctgcttttattaagagctgccatctttggcgtactatgggttcttcttggaaaacgggtgtggttcttccccaatataaatgcagaggagaccacatttagagaactcgttcggttttggcctgtgaaggatgagggagagcgaccaaagtggacgtcaagacttttctatgctactgttgccttattggtgatattgctgcttagacatcacgctccagatgaagcagctagagcgaggtaccaaaagaaggtttctaatataattgatgatgtccttgagtggtctccgaagttggctctgtctgggatgatggataaacatactgaggataatgcgacagaaactagcaattacaccagccatgccacaacgagtactgaagaatctacagatgcagccgaggatgaggatgcagatgaaacccaaggtgctgctgatgatacgagaacaagatctagtgaagtttaaaacggaaatcaaacttctaaatttgatggaaatttcataagtactctcgtgggttctaattatacggatatagaaaattcggggtgttcaatctgaccatgttttgttcgtatattgccaccgatcagctgtactcgtaaaggaagtgttgtcaaaacctaaagcacattaccttttttgcttgc

SEQ ID NO: 21277 - DNA, 535 bp, Triticum aestivum
  unsure (1)..(535): unsure at all n locations
  Clone ID: PAT_TA_21277
gttagctgctctaagggtgcttcttgccgatgatccagaggctgtgcacaagcatgacctgaatacattgatgtctcttgacgtgcaagttcctttaggtcccactgttgaagcatcagcactccggacagttcttgcgctttgcgccgattgctctccaacactttccacacaaaaaataatgggacgaccaggccatcctaggcggtgggcgcgcctcttatcacgcaactggccgtcccanttttagattgccagaagaattccacgattcgttgaccttgatgccagaatatccagcaggagaccaagatgttaccgcccgcagaatccacgggtaagtcctttaacctgtccgtcagacatccattacattcccgttactggtaactggcagatacacaacccattttgtccccgccangttcctggtnagacttnccatgcctgccattgaagttacaccncttcnaaattatatccccgntncgatntggcttnaanatatccgattgatntgtcnaaaaaaaaaaaa

SEQ ID NO: 21278 - DNA, 446 bp, Triticum aestivum
  unsure (1)..(446): unsure at all n locations
  Clone ID: PAT_TA_21278
gaaaccttaaccttattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttgggaaagacctgggacaagcttcagttgggccgccagggtcatccgttgccattggagaacccgcaggacattatccgtgcagcctgctagccctatggccagaggtgtcctcaagtttgcgcatacactggngcccatccattgctggcagcaatccctgggaattcacaaccatttcaactccttcatgagcacncttctatcctgactgacccgagntnttatcacccattagatctgccttganatccc

SEQ ID NO: 21279 - DNA, 750 bp, Triticum aestivum
  unsure (1)..(750): unsure at all n locations
  Clone ID: PAT_TA_21279
ctccggcggcagcaccctccactataacccaacccgcaagaaaaaacccgcagcagagaagaggagtcgccgcgaccgagagctccagagcacgccccccccccaccctccgccgatggatccgaagatgacagaggtgacccagatgttcgcccgcttcaaggcggcctacgcccgcaacgacctcgacgcctgcgtcaccctcctctccgcagctcaaggtccatctcacccaattccccagccttccgccctctttcgagcagacaccgaacgccgtggaggagctcaaacttngcaagggacatttatgagcatgctgttgttttgaagtgtgaaccttgaggaccagggcgcttgtcgccgtgttgctgccggcctttgcttcttgcttcgtgtcgtgtgccctctccccccctcaaccaagaggagtaccaattttnggactcaatcttctgaaggtggttggttaagaatagattgccgagtccaaaatgaactggacttttaccgtcaaggactttacaccttgaacaacatgctgtaaactntacanccttcatggaggngctaaacgatgttaacgcccgnaacttgcacagagactagttactaaggctctcccaagaatttanataatncgggtgaacaaanggnagatccacgtatgtnaaaaatgctagtcantcncagttgacatntcanggancgatgactanaggctttntcaagagntcnaccaagnttccc

SEQ ID NO: 21280 - DNA, 552 bp, Triticum aestivum
  unsure (1)..(552): unsure at all n locations
  Clone ID: PAT_TA_21280
cgacttcctgcagtcctgcgctgcgcccctcctttccgcctccacgctgccgacgtccaccacacagcacggtcgactcacccgatccctccatggcggcggcggtggcgggcggtcgcggctgccacgacggcggaggacgaggcgcgcctgctgcgtctggaggagcaggcggagcacggcggcggcggcgcctgggactacctctgcctcgcccgccggctccgcgcccgccggccccgcccacgtcctccgcgtcggcctcgctctcctcaacaacgcctccgctcgctccggtctcgcctcagaacagtggacgctctacgagcaggtggccacggcggcatggattgccagcgtctcgatntnggcaaaggactgtattggagtcctttcaaaagcaattccctggcaacaccgggttgcccggctagaactcttctgtttgaagcgaaagtgaatgggctgaagctgaaagacttacaccaaatctggaaacaatcattgacaaatttcaaaagangaaaatgctattgaaaaagacaagnaatn

SEQ ID NO: 21281 - DNA, 642 bp, Triticum aestivum
  unsure (1)..(642): unsure at all n locations
  Clone ID: PAT_TA_21281
cccccccaaggccccaaccttccaggaaaaaaaacccggaatccgcacccatccatggccgccgccgccctgctgcgccgctcgccggcggcgcgcgcgctcctctctccggcgctctcgtcccgcctcgtcgcgtccaagccccactcctcctcccccacgcagccgccccccgaggcaaagggcgcctccagcacgaaagaccttctcgatctaccgggggggacccggactccgccgtcgaccaagccgcacctcaanggactaccaggtgggacctgtccgactgcgggcgatggtgctggacgcgctgctcaagatttaaagaacgaccgacccccctcgcctccgcccgccgcccgctgccggcggcggatcgcccggggtggcgccgggaacgccccccgggganaacggcttcgcctgcttaacaaaatttcctccgctccctccgggttcaacgtnttngcggttgcccaaattttcgtcaatcaaggacttgtggtcgacatgacaacttttanacatttnaaagaggtccagccttngtcaaagcgcaaggaccgccnccgnaactagnaaggagnccncaaacnaaggcgacggcaannccacggatnncaatgaatcnctgnccgcnnc

SEQ ID NO: 21282 - DNA, 451 bp, Triticum aestivum
  unsure (1)..(451): unsure at all n locations
  Clone ID: PAT_TA_21282
catccgctcaggccaatcaacagaagtgacgcgagcacgagcacacatcccctcccttcttcggttattcctcgccgcgtgccctcgccgcagacctctgccatggcggaccagctcaccgacgagcagatcgcggagttcaaggaggccttcagcctcttcgataaggatggcgacggctgcatcactaccaangagcttggaacgggtgatgcgctcccttggccaanaaccctaccgaggcagnagctgcatggacatgatcaaacgaggtcgatgcggatnggcaatgggcaccatcgcccgcgcgccggttcctgatgcctgatggctgggggtaggccagacggcggccgcagttgcagggttctcaaggaagccttccgctgcgtccacaccccaccaaaacgntttaatctctgnctgcccanctncggccangtcangatnn

SEQ ID NO: 21283 - DNA, 627 bp, Triticum aestivum
  unsure (1)..(627): unsure at all n locations
  Clone ID: PAT_TA_21283
cgccgctgcacaagacgaggaagaggttccccgtcccggcgccgccactatgtcctcgatgatgaacgcgctgtcacactggctggtgaacccgcgccgcaacccgctcccgcgcctccacatgcacaccgtctcctcgcgcctcagggaaacacggcctgacgcaccatgacctgtacaacccctacttccacctggtacatcaccgacgccctctgggaggctgccagggggcgctccccgacgcccccatccgacgccggtccgaccgccgcggcacccccctcatggcaccctatggaccccccccagaaggcccccttagcacaccggggcccacccatggacgacatgttcctgacatgttggtcttggttgacatgagggcttccggtgagaaagcactcgccccccttcattcaacgagagccttcccactatcccactgaaacttcccatatcgcctggataacgtggcccaattttcgactcttaacgtaattttctctctccattcatcaaggctaattcccttttgctcatcctcgctgacaccccaactgtgtggtcacaccgccttcgggctctcatgtgctacatttccgtaatctaangcgggggtgatnn

SEQ ID NO: 21284 - DNA, 588 bp, Triticum aestivum
  unsure (1)..(588): unsure at all n locations
  Clone ID: PAT_TA_21284
gcttgctctagctagctagctgctcctggcccatatccactaggagtacacaagtaggctagcagcaatggcctcggtgacgaggttcccggccgtggccctcgtcctgctgctcgccgccagcgccttcctggccagcgaggtggcggcgtgcggcggctgcccgaaaccaactcctcctccatcgccaccgccgccgtcgcccaccagcacgccgtgccctccgccgccgtccagctccggcggcaagtgccccaagaacgcgctgaaactgggcgtgtgcgccaacgtgctgggcctcgtcaaggtgtccatcggcaaggtgcccaccgactccgtgctgcccactgctggacgggtcgccgacctaaaggccgccgtctgcctctgcaccgcgctcaaggcaacgtgctcggatcaactcgacttcccgtcaagctaacctgctcctcaactactgcggcaagagcctcctcaaggcttctgtgcgcctaatatatatacattggtaattcctcactgctaatgnnattggatcctcctcttcttcattaaaatttttctcccccccggtntttcttggatnct

SEQ ID NO: 21285 - DNA, 630 bp, Triticum aestivum
  unsure (1)..(630): unsure at all n locations
  Clone ID: PAT_TA_21285
ctgcattattggctatagagagtgatcgcgatcgtggtagctcctggctttgtgatcgagacgagcaatggcgtgcaaggcatttgcgctgttcctggccgtgaacctggtggtgctgggcgtagccagcgcctgctcgccctactgcccgaccccgaccccgaccccctccgacgccgacgacgcccacgcccacgccgtcgtcgttcggcaggtgcccccgcgacgcgctcaagcttggcgtgtgcgccaacgtgctgggcctcatcaaggcgaaggtgggcgttccgcccgccgagccgtctgcccgctgctggagggtctcctccacctggaggccgccgtctgcctctgcaccgccatcaagggccaaatcctccggatcaacctcaactgcctatccatttcaacctcatctcaactactgcgggaggaccgtccccaccggttcaattgctgactcaacgcttcgctcccttgcatcatatgcaccacacatatatgatgatgagcagataaggttggtccattcacctcgcccacatatcccatatcattccatgtccattgctccccccggcccgcttacccccattaattccgtcaatacagtttcgnaaaaaaaaaaaa

SEQ ID NO: 21286 - DNA, 694 bp, Triticum aestivum
  unsure (1)..(694): unsure at all n locations
  Clone ID: PAT_TA_21286
cgccactgcgcgtagcctgaaaatgcagaagtgtaagctcaaaactgcagaagatgcactcagaatcagatggagcaaagtactcaacaaccgcaaacaaatatgggcggcagtcaccacacaaagagctacccgaagcgaaagctactgcccgaatttgatgaggaggccttagagctcccgcaatcaaaaaacaaagaagccatccggtcggatagacgacctcatggccaacatagagcggcaaacggcgcctcacacaagccagcacgcgatncacacgaggattcacatcaaaaagatggccagccagatctatctacgggcaaaaaagcaagctctagcaagcaatgcaacccacaatttccgaacaccacgcacacccaaatacangggtgccgcacacccctatgttcaccaatgaggngctnggacatgatcccancaggttcaaacccgtaacatagaggatatacggactacaacccggggtctaaatagaggttacatcctcatatcccatggtcaagggatacccacccctcaatcctacctcaatccggcggcggccgggcttgggcctcccttccattgcttggaattccaggggccgaccattnccaagatcntacccccangctcttaancnacggaaccnntncattaccttaaanccttcangtacaagcccctt

SEQ ID NO: 21287 - DNA, 503 bp, Triticum aestivum
  unsure (1)..(503): unsure at all n locations
  Clone ID: PAT_TA_21287
ggagtgatgttgcccattttcatacttnggagcagcatgccaaagatgagcattttgcacccacttttnggagccaaatacccaagttaggatgaggcactttacaatatcccagttttgaacagccattggctagaggccccaaactgaccgtccaagcaatatttgaacggagaacatgagcagggagggcagtccacaaggcactcttcggagtcggcggcactgatcgtgcccagcgtcatcccaggtctatctcctgcgccggctcttcggagcgcaagctggggacgtctagggtataaggctccacttggtatccaactctcccttgtagtagccaccatgatcgtatcgacataaccgttaatgggtcgctagatcagctaatactgcttccttgtgggctttagttacatgtaatcctttgtggtgccacagatgagaactcctcggatttaaaaccgtcaatctttcagccttcattttgtctctcgtgaaaa

SEQ ID NO: 21288 - DNA, 580 bp, Triticum aestivum
  unsure (1)..(580): unsure at all n locations
  Clone ID: PAT_TA_21288
cccagctcgagtaaccacagcgagaaccaatcgccaagcaaaaagcccgagaaagaaagaacaaacaggagacacagatggcggctgcagcgaaggcgtcgtggatggtggcgatgagcgtcggggccgtggaggcgctcaaggaccaggccggcctgtgccgctggaactacgcgctgcgctccgtccaccgcgccgccaaggccaaacgctcccagcttcgcgcaaggccaggaagctggcgccgccccgccgcggacaaaggccgccgccggaggaggggatgaggaccgtcatgttcctcagctgctgggggccctaactagctagggctccgctatttcggctcctgcaaccgtaccgaactcgggtcaaatctgatcatgactggtgcccttccgaccactgttaacataggatatacaccacgatgatgatgatgaaattctgccacttntttaattcctcaaaatctgaatcctangctacgtgctggntggaataaaagaagatgattcngtcaaaaaanaaanaaaanaaaatccaggggggccgtaccattgcctaaanganctatacc

SEQ ID NO: 21289 - DNA, 590 bp, Triticum aestivum
  unsure (1)..(590): unsure at all n locations
  Clone ID: PAT_TA_21289
tccgtgcgctcgggccccttcggccagatcttccgccccgacaacttcgtcttcggccagtccggcgccggcaacaactgggccaagggccactacaccgagggcgccgagctcatcgactccgtgctcgacgtcgtgcgcaaggaggccgagaactgcgactgcctccaagggttccaggtctgccactcgctgggaggaggtactgggtcaaggaatgggcaccctgctcatctccaagattcagggaaggagtacccggtccggatgatgtttgacattccctggcttcccgtcccccaaagtgtcccgatacgtgtttggaccctacaacgcaacgtctccgttaacaacccgttgagacccagacaatgcatggtgcccacaacgagtctccctgaatctgcttcgcacgtcaactttcanacaactttgggnttcaacactcatctctgcaacatgatggtgttacatctgcctcgttcctggtcantgaatctgacctcggaaactcatgaactgatccttccgcgctgcactttttatgttgntcctcatactacggctcaaantacgtcctacgtcaacta

SEQ ID NO: 21290 - DNA, 577 bp, Triticum aestivum
  unsure (1)..(577): unsure at all n locations
  Clone ID: PAT_TA_21290
ctcagcagctccagacctcaccagaggcacctaccacaccgcccgccgccgatcccgtcacccgtctcctccccgctgcggagcgtctccagccctgcccggtgcccgcccagatggcaaacgcggcgtcagggatggccgtggacgacgactgcaagcgccggttcctggagctcaaggccaagaggacgcaccgcttcatcatctacaggatcgacgagaagaagaagatggtggtggtggagccaggtggggcaagcccgtgctcggctaccgacgacttcgccgccagctccccgccaacgagtgcaggtacgccatcttcgactacaattcgtcaccgaggaaaatggcaaaagacaagtttttcttcactcgcctgccccctgacacgcccgccttaggaccaagcttttcccacgccgggaatgtcgaacgggccgggtaggtgctggcatcccacgcacgcctccccctgtggctgcctcgcctaggccggcatccgacgttcctccatcacgccttccagacgctttacacacatttaataaaattanggnggcnttaaaacgctcac

SEQ ID NO: 21291 - DNA, 697 bp, Triticum aestivum
  unsure (1)..(697): unsure at all n locations
  Clone ID: PAT_TA_21291
aggagaaatatgctctgcgaagaggtggcggcagcagcagcggtagtgggctgaggctcttcggggtgcaggtccatgtcgctgcgggccgcagcaccggcctcggcgcctccatgaggaagagctacagcatggactgcctgcagctcgcggtggcccctagctccatcgtctcgccttcgtcggcggcttcctcgtcggtgcttctgtccatcgacgagggcttggagagggcttccaatgggtacctgtctgacggtcctcatggcagattagtccaggagaggaagaaaggagttccatggagcgaggaggagcaccggctattcctccgtgggcctcgagaagctcggaaagggcgactgggcgaggtatctcccggagctacgtcacgactccgaaccccgacgcagttgccagccacgcgcagaattcttcctgaggcagagcagcatggggaagaagaacccgtccacctctttgacatggtaccgttttgcgaaaacggatcgctttctgaccgctgaccaacaacagcggagngctccactctctgccgcggtatanccccgacatgctcattgtctcaancaccaggaggtgacatggcatgcggctcacttttcgggtccnaggccatccggatttatggnnaactctacgcangcacgtacatgtccctgactgactgggattn

SEQ ID NO: 21292 - DNA, 637 bp, Triticum aestivum
  unsure (1)..(637): unsure at all n locations
  Clone ID: PAT_TA_21292
ccccgatccatttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtccaagataaacaagcaggtgaatggtcgcatcatcaggaagcgtatccatgtccgcgtggagcatgtgcagccatcccgctgcacagaagattccgcctgaggaaggtgaagaatgacaactgaaggcggatgcaaaggaccgcggcgaggtcatcaacaccaagaggaaccgttgggcccaagcctgtctcatggtgaggggatacatcgagacgtcatccatccgtacattggcatgatctaaggaagtacaagtttttgttggccttcaactgtccaatcgggtacccatgctaaatttcccaatgacattttgtctcattcagtttccgcantctccttcgtccactanttaaaanctagct

SEQ ID NO: 21293 - DNA, 357 bp, Triticum aestivum
  unsure (1)..(357): unsure at all n locations
  Clone ID: PAT_TA_21293
gttcgagtttttttttttttttttttgaaaaagtcgcatacctacccaagaaatacctcatggtaaagcctattcttttgttcgaatacacaatatgagtagaactagaactcaatgtggaacaattggacaaaatagataagatatgacaaaaaatatgtgtggggatataaaagagacctgatcaataggttgcttcgtccgttctgatatatgcacacaatactgttgccggcatcgacgaaaaaaatatcttcatcttgaaaccaggcttcatttcctgacgccgccactgtaggtagcctgcgatggggttgggccggatccgtgcccgaagtggcccctcnaagggggggc

SEQ ID NO: 21294 - DNA, 434 bp, Triticum aestivum
  Clone ID: PAT_TA_21294
gtcataccagtgttggggaaaaataaaacaaaacctaccacggtgccccccgcccgtaacgttgttgtccctgcagctgctctgatgtccgccatctacgaggagaacaaggacgaggacggcttcctctacatgacgtacagcggcgagaacaccttcgggctgttctgagtgggagccgctatggatccacattgggcaatgcctcctgtaaatactaaacatgcatcacaagaatctgtgtccatagcataatctggtctgtctgtcattacgcaacttgacgtgcaatgctaaacacatttaagtaataatatatactactctgctttggggatgcttcaagaaattatgttaccttctgtatcctccgtgtgcctgtcgacgtgacgagtaacatgaaggctctgccggtggtccacccaaaaaaaaaa

SEQ ID NO: 21295 - DNA, 660 bp, Triticum aestivum
  unsure (1)..(660): unsure at all n locations
  Clone ID: PAT_TA_21295
gcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccaagcttcttcccggcgatgaccaagatcgtcggcacgctcggccccaagtcgcgctccgtcgacaccatctcctcctgcctcaaggccgggcatgtccgtcgcccggttcgatttctcgtggggagacgccgcctaccaccaaggagacgctcgagaactcaagctcgccatcaactccaccaagaagctgtgcgctgttaccgtgcaacggtgggccgacgtagtgctgcgcagaaggagcccaatcctctcccccacggagggcctaacccgcactaggcccaaactctcagctcccgcgtttttccatggtcccaagnttncacaagtgaacanatttggcaanatntcncggnacagnactcattggtgagttcnaattaagaaga

SEQ ID NO: 21296 - DNA, 689 bp, Triticum aestivum
  unsure (1)..(689): unsure at all n locations
  Clone ID: PAT_TA_21296
gggatgactggtccctgcaaaataatggagtaccgttagggatgcaaattatggtttgtgcattccgtttgtaatctcccgtaccataggatggcaaccagatgaaacaagtcccctggctcgtcgccccgatgttgatcgggggatgactggtccctgcaaaataatgggagtaccgttagggatgcaaatgatggtttgtgcattccgtttgtaatctcccgtaccgtaggatggcaaccagatgaaccaagtcccctggcttgtcaccgcgaagatgcggcctagatggcgcacggcgtcttcgaacgtgtaggggtacaattctgccatcgccaacatgcgccagcctctgccgttactgcgccttgcattggatggcaatccttatgtccgaacaccgcggatgagatagtaatcgtccgtagccgcgtccctttgtcggcaggtccgcaattgctactcctcctctctcgcaagcacccatccgcattcaacctaccatccaagaagccgntccaaggtggagaaggnctaccggaacggcgcacgctgtggtttgtgcaaangaggtggatccggccgagtatcaaccaactcatgggacgaccagactattaaagacgtggcacanagaatcggatggaatggatacaantcaatgttaactcatacgactgccatcgcaa

SEQ ID NO: 21297 - DNA, 241 bp, Triticum aestivum
  Clone ID: PAT_TA_21297
ttttttaaacaggttgtaccggctacagatttattagcttaaggattagccattatctcatcagtggtctatcaatgatgattccaaacaattgtcttctttctcgtaatgattattgaactctcctaagaacctccaacagaaacaaatgaactcttccaccacgtgaacgtggaatttctataaatgtaaaaaaacaaatcaccctaaagtccaaaactgcagtcataaaagggggggg

SEQ ID NO: 21298 - DNA, 605 bp, Triticum aestivum
  unsure (1)..(605): unsure at all n locations
  Clone ID: PAT_TA_21298
caaccgtctattcaggaaggagtactacacaagataaatcccaacgctccagaagcatgtccttcagccctgaacgtgtgcgtgttaggggaagatctccagcattcactgcattggctgctaattttgaaagttcaagcaacagaaatctttccactcctccacctgtagttaagaaactttacccgaaatctgttacacctgatccgtccgaatactgcttctaagtcacctgcaattgctgctctgggctgggtctttgggtcacccttctcaaactccctgctcctagaattcatgaaaggtggccccgagtcaagagaagccaaaacaggagggagatggtaaagaangtgtttgatactgtggccacaagagttgaatctccgactataaatgaagatgttaaagaaaacgaccaagaagatgacgagggcctccgatttaccggatgaacgtctgaagacanaccgcgatccgttacggaattgattcncaagcgagaactactactcaacgggtcaaagaaattgggatgcaaaggacttacaactccaatggaacaaaagctaaattgcccactttaccgatacaaatccaagtnn

SEQ ID NO: 21299 - DNA, 743 bp, Triticum aestivum
  unsure (1)..(743): unsure at all n locations
  Clone ID: PAT_TA_21299
gcttggttcaaggaactgttgaaaatccgggtactgaagtttagagttggcaaagtaaggaagttacccgagagcatgggcaactcaaagcatctgcgttacttttgtttactggggccttccaacttcggcaccctaccttcaacggtttgtcgtctgcataagctcagaattatagagcgtgccggtggtgtcattaaaaggtttccgacaggcttcagtgaccctcatcagctttgcagagaattaattcaaagggggttcactttatgacangggaccaatcctgacaaaactcctgcctagaaatnggccctttgagggttnggagcaacctagatagtngagaacggtgagaatgattgggaaaaccagaatngggaagaattnaccccactgggaatatccaacatttgcatgttgggagtttcgacggtgaatcttgtcctagttggctcaagcccaacctcctgccagggttacgctcgcttaaatttcgtangtgtggcaaaatcaagagcataccattttttgtcccgtcanangagtcacncnatatgcacaaagaacanataaccttaacntcttgaagagttattgtgcangcttgtgattaatcaattggcaaggtccatatcctacctantcctaggangctaaaatttttcccangctgtccaangatacctntagctgctcgtnactcactcccatcattggaaaaagtcggaattatgcccctc

SEQ ID NO: 21300 - DNA, 620 bp, Triticum aestivum
  unsure (1)..(620): unsure at all n locations
  Clone ID: PAT_TA_21300
ggaactggcacacttcacacttggttactagtgtcgtcgcatcctagagggcggtgggccagaagaaaccttgtcgaaaagccttgccggcaagggcccttgaccctatgcgggagccacatatgcctccatgtatctctgccaacaaccttagtccttcctcccgggagatgcacatcaatttcaccccattcggtcttcttctgtacaacatgttatcaacgaattggtacagatagattcggcgggctactctttctgcctttcctgctcctcaaggaactcccccttttggaggaatcggatggtctgctgtgcccatgccggagcctgttgctccatggcaaggaccaaaggcatttcctctgccacgggaatggccgcctccccggccaggcccgggcccccagccgccgtcgctcctcccacgatgggcgccccagcgaaacccccccccggcgccggcggcgccgcggggctccgtcccggcctacctccccgctccttgcttgccccccttggtgacgcctgttgatggacccaaagacggttcagtctacgtacgnaccacccctcgcgtaccggattatctccccggaaacccctttaaaaaaannccc

SEQ ID NO: 21301 - DNA, 410 bp, Triticum aestivum
  unsure (1)..(410): unsure at all n locations
  Clone ID: PAT_TA_21301
gccttgtggaagcaggtcatatccagtcatcttggggttcgtatgatgctgcagtgctgttcctggaaagatttacgtgttgatttgtctggacccacaccacgagtcattcaattgattgttttttgttgctaaggtggagactcttcagaggttaaaccgttcatctgtgccattttgctgccgtctgtgttcaagaaggcaatttcgtcgtctccagttcgtgttgtgcgatatatattctagtaaaattgtagaggcatcatttccccgggatatattattttggtcgtgtatggtgtgattctggtgataaaatagtgtcattaatcttgtgtatatttgtttccgggtggattatggagtatacaactataaaagcgttantttgttcaaggaaaaaaaaataa

SEQ ID NO: 21302 - DNA, 648 bp, Triticum aestivum
  unsure (1)..(648): unsure at all n locations
  Clone ID: PAT_TA_21302
ttcaggaggctcttccgggcgacaatgttggcttcaacgtgaagaacgttgctgtcaaggatctcaagcgtgggttcgtggcctccaactccaaggatgaccctgccaaggaggctgccagcttcacctcccaggtcatcatcatgaaccaccctgggcagattggcaacggctatgccccagtgctggactgccacacctcccacatcgccgtcaatttgctgactcattaccaagatcgacaggcgatctggcaagggctccgagaaggacccaantccctgaagaacggtgatgctgggtatggtgaagatgatccccaccaaacctatggtggtgggagaattctccgcgtacctcccccggggtagtttgccctcccgcgacatnaagcaaacgttgctgttggancatccagantttggagaagaagncccaaccgggccaaagngaccaagnggcnccaagaagaatatcatncctgtccgcttttcaatgcccngataatnccacnaatntgtatccgtnttgcgntatgcctgacgttnccgcgggtcccgttgttgggtaccactcggctctagngtcgttgncgtgcttaaanataggccnaacttntcctttggccaaggattcaaaaaaaaaaaa

SEQ ID NO: 21303 - DNA, 798 bp, Triticum aestivum
  Clone ID: PAT_TA_21303
gatttgcgagcgccgcatcgacccccaccgccgacgaacgccgcgccgccgacgtcctgccttctcctcgccggcgagcgccgttccgctgtaccctccgtgattccgccccaacctctgcgtccgaatctcccgcgaaacagtcacggcgatggcggcggccggtggcgtttcaactgacgatgtcccgatcctgcaggcagagaacctcaccagcaacgtcaagtccgtctactacagtcgaacattcttgtcaatcattggtggagttgttgctggaatctggggattcacaggcttgatggggtttgtcttctactttctgataatgatggttgcatctattgggctcttagcgaagtcaaagttttcaagtccaggcgtacttcgatagttggaccaggatttcaattgaaggagtttttggtggcctgatgtcattcgtgctgttttggacatttgcttatgacattgttcacatcttctgacggacatagaaagagctacactccggaggaaacacggaatcgtcgacatgaacatccccaattggctttgtcaacactcatggtttgtattggcgtttgatatagccggtagcgagcctccatcggcgtggacccttgcgaagctcatgaactttgcatttccttggatgatccgtagcagttgcaatttttcatttcaagtgatggatatgaactttgatgttttctggcacaatgttttgtaccctcgagttttctggcacttcgattgatgtacacacttctcaatgcttcaaaaaaaaaaaaaaaa

SEQ ID NO: 21304 - DNA, 655 bp, Triticum aestivum
  unsure (1)..(655): unsure at all n locations
  Clone ID: PAT_TA_21304
caaacgccggcgcaaactctcgcccgagcccgacagatcttcaattccccattccgcccaccgatcgaccttcacgccagtctcggtctcttccgaaggcgtcgcgcgcggtgtgagaaaggagaaggaggaagatgagggagtgcatctccgtccacatcgggcaggccggcatccaagtcggcaacgcgtgctgggaactttactgcctcgaagcacggcatccagcctgatggccaagtgcctgggagataagaccgcgggacatcacgatgatgccttcagcaccttcttcaaccagactgggtgctgggaagcacgttccccgtgcatcttcgttgatctagaaccactgtgatcgatgaggtccgcactggcacgtaccgccactcttccaccctgagcactcatcaagtggcaaggaggatccgctaanatttccccctggcactacacaattggcaaggatttgttgtctgtgccttgaccgtatccncaacttgctgaaaatgcacgggctccaaggctcctggtcttaaagccttggnggtggactggctcngcctgggtcncccccttaaccccgtcgtngatnaggaaaaatcaagcgggttatgtgtncanccccaagntaactcgtttgggctaaaaaggg

SEQ ID NO: 21305 - DNA, 712 bp, Triticum aestivum
  unsure (1)..(712): unsure at all n locations
  Clone ID: PAT_TA_21305
gcagaatcccacacaagtctcgatgctccgccgcatagcggccctccggccgccgtctcgagcggccgcgccattgggggcgattgcggcgccctattcctcgaagtccacatccatccctcagaagcagcagcgcgtccgagaccatgccttcgacggcgtcatggaggtccagaagcgcgtccgccgcttccacgccctccacgctctcatcctctacgccgccgcccccaccgcgccctccccgcgcccggcggaagcggcgccgtgtccgtccccttcacccgcctccggcncctccgcgcgccgccattacgcctccgcgcccctcgacgctgggcgcttctcctgcgccacgcgcacgccttccactcttcctcaacccgttcaacgcatgctccacatcccctcaccccacgcgctgcagcggtgctcgacgctgaggcgacccctcgccgccgaatccccggactccgtctangctcgcaagctctctcctgcgccccgcacggcgtctcgcctcaacaatcaactctcgcgcgacttggttcagccattcgccagcataacacattcacctccctcgctacctaggtttgcaattcgcttccacaccgcctttgtccgcgctcggccccgnggcaaacgagaagnnccgtcncagagaccnttcntcatnttcnagtaatgatantcgttcgtgaagncccca

SEQ ID NO: 21306 - DNA, 515 bp, Triticum aestivum
  Clone ID: PAT_TA_21306
cggtcgccatattctctcaaatcgaacgcggaatgcgtcgttgcgacaatgtttgcccgccgctcttcggcagctgacggtcgatcacggcatgccaccggcttcggactctctggttatggagaaggtcattgaacctgcattgcaggaactgccagcagatcagctcgaccgaccggcatcgcaagaggtcttcttccaagaattcaagaagtatttgggagtgattgcccggcgactccaggagcgcccgataattgtggcgcacactgagaacacctttgatggggctggcattaggaagatactgtccaacaagttcgagttcgagaagctgctggattccgtctgggtagatgtacccaaggaacacaaagatagaacatcgaagaagtaccttcgcgtcgcgcttgacaagttggccgcctcagtaaatctaccaccatatggagctgttgaccacgtggatgctgtggtgaatgaggcgttcaagatggcgaacgccgacgatggga

SEQ ID NO: 21307 - DNA, 223 bp, Triticum aestivum
  Clone ID: PAT_TA_21307
gaacgccactgatgaactgcctctagactcgagcccctggtcttgtagtttagccttttgcagttctgcatagcttaatgtttaatgggctatggaagatgcctaatttacccccctctttgggcacttcaatgtctgctctgtatttcaaccagtacttggggcgccgttgttgccttctcgataagtttatcaagctgactgtttttgcaaaaaaaaaaaa

SEQ ID NO: 21308 - DNA, 543 bp, Triticum aestivum
  unsure (1)..(543): unsure at all n locations
  Clone ID: PAT_TA_21308
ggaggttgaaggcgaattagagagaagaggaagatgttggcggcgacggatccgatgctgtggcacaaggtggccgccgtctccggggttgccgctttggggctcggcacctacggcgcgcacatgttccgccccaagaaccccgcgtacaaagaggtttgggcacacggcgtccctgtaccatctcgtccacaccgcggcgctgctccggggcgcccatcaccaagcgccccaacgttttccggagggctcctcactgctgggatttgtgctcttctctgggaacgttgctacaccgttggcttaccttgaaagacaagaattttcctcaaccgggcaccattggggggntttgcctttatggccgcttggggcacactcctcctcctgattaaatggtgcttttccaaagaaaacaaaaaaatcataaactcccccaaaagggggttttcaaggttgtgaaaaatatacttgtaagtgtatacaatggacagtatcgctctgttaaaaatcaatcgtgatncaatgttnaaaaaaaaaaaa

SEQ ID NO: 21309 - DNA, 1203 bp, Triticum aestivum
  Clone ID: PAT_TA_21309
cccgctcgcagccccgtccgcccgcccgcctcgtccgcctcccccgcacccgcctccgggtcgccgccatctcctcgtccccctcgcccccctcgcggcgcgaccgcgccgcggccggcctcgagcggtgcctggccgcgactccggcgccggccttcgccccgccggagatgaagggcgggaggcagcgcgggtcgttcggggccgccacgctccagaaggccaagctcgacctctcccaaaagaggctcaaaggcgtccagcccgagctggcaactggtggtggtggtggagacaatgggaaacgaattggctatggtggtggtaatagtggagatgatgatggtgatgatgatgattactttgaagactctgacgatggagatgaagaaagtggatttttcagaaggcgtattattatacaagagctttttaagagggagtttgttgatgccgttcttcaagagtggtacaagacaatgagtaatttgccggctggtttgcgtcaagcttatgagatgggtttggtcagctctgctcagatggtccaatatttgtcactgtttggaaggcccacaaaggctagatatttctctcgagcctttccagactttttctcaagaggccttgttggaagaatgcttgcagatccatctttcctgcataagatgacctttgagttgctagctaccgctagtacatctgtttggtgggagatgaaaaatcgtaaggagaggttccaagaagaatgggatttggtgtttctcaatgtagttactgccacagtttgcaatttagccgttttctgttcacttgcgccatgccgttcatatatgatccagaaacttccaaataatatatttgaaaagagctatcctatgagacagtttggtcttctaggaagaacccagtccctctttagcaaggctgctgagctttgcctaggtgggctaattattggctccattcaaggtggtctatccaatgtcctttctgctggaagagaaagaaggttgtcgatgactgttccttctatcagcaacaatgctcttagttatggagcttattatgggctttatgcaaatctgcggtatcaatttttatgtggtcttgatagatcaatggcgaaccattttgatgtccttggtgttgcaatctttttcggcacagcgatgagattgatgaatattcaaattggggagc

SEQ ID NO: 21310 - DNA, 700 bp, Triticum aestivum
  unsure (1)..(700): unsure at all n locations
  Clone ID: PAT_TA_21310
cccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagccgttcctccctgatgtacgaactccccttggctacagcatcgaaggatatccgccctgcaggcggcatcaagaattctcccgctgcttaactccgaactgcgccaggaaccatcctggatactctgtccgtcatccccatcctaagtagcgttagaaacacctgcattttcatttggatctccctaaccctccggctaactgcttccaagtgaccaaaagatatcaaagacactcccgtctcctcccgtgggggtcgtaactggctctgaaacatgnagtctgcaagttctgcgctgccctccccgtcncgtaattggttcaggganttaaaacccttagattanttccnagnaactgttggtacccacgaagggantgntccccccctncaattaaccntttacttcccggacattttcncccaaagttcacctattttacagcaccgttttacanaattttaacgnaaaaactt

SEQ ID NO: 21311 - DNA, 722 bp, Triticum aestivum
  unsure (1)..(722): unsure at all n locations
  Clone ID: PAT_TA_21311
agctcctcatctcaagtgtgtagacgagagagagagactgagagagcgccatggccagcctccaagtcactcctacttcggcgttcactcagtggaacgagctgaagttcgaaggcctgtacctgttccacacgcccctgggctcaggcgccaaccaagctcaggtcatagacaacaaggcgccgattggcatcggtgccaccgtagttaacaactgggcagtgtacgacgggccagggccgaacgcaaagctcgttgcccgtgcacagggcttgcatatccaagccggcaactgggtcaactccttcagcctagtgttcgtggatcaaaggttcagtgggtccacgcttgaagtgaccgggatagtagttgaatccggggagtgggctattgttgggggcaccggtcagtttgccatggcaaacggtgtcatctccaagaatttcatgagcagagaagcgaagggaacatcatacaactcaccatccatgctttctgtccggtgctcggaccgacaaacgcgctcgtccacttgggtttggacggtcgggggtgcgaagcggcgggaccccgacggaaatcaatgcggagccctcccaccggacccgagtcaccctccatactgtcaaccccggggaccgcgatggcccgctccttcggccactcccgcctgcaaaccgacctgcgcctcnctggggcggtccggtggagaaactgagccg

SEQ ID NO: 21312 - DNA, 706 bp, Triticum aestivum
  unsure (1)..(706): unsure at all n locations
  Clone ID: PAT_TA_21312
cagagagagagagccccaagccaagatccgcgcgaagcaagtcacccggcgaagcaccggctcccatggccgtggacctgatgggctgctacgccccgcgccgcgccaacgaccagctcgccatccaggaggcgggcgggcggccgggctccgcaacctggagctgctggtgacgtccctgtccacgcaggccgccgcgccgcacagagccgctgatcaagccgttcggcgagatngccgggccaaggccgtctccaattccgcaaggtcatctccatccctcggaccgcacggggcacccccgcttccgccgcgggccctccaagccgccgccgccgacgccgccgccgcctcctgtcgtccccggtcctgcccccctggcggccgttagcgtggcgcaaccgccgcaaancctgacctggacttnacaaaccgaacctggccgtgtcggcgcaagtcctnactccaagtcctccttctgtcggcaaggccggcaaggaacgttccaaggcggagctagtctccggaaagcccgcttccggcaaagcggaacctgcccggngcaatcgaggcacaccaagganccttcatgtcaagaaaganaaccttaaggcacatatgcccgtttcttcggccccaatcttgcatanctgngatnggaaaccanaggncctacaggnanaagaacntgggaccgagaatgcgn

SEQ ID NO: 21313 - DNA, 531 bp, Triticum aestivum
  Clone ID: PAT_TA_21313
aaacgataagtattggatggatgtcaacgacgagggtcccttgcattttccctccgcgagctggcagctcggcggcgggacgagacaaacgcgacgccccggttcgttgctgctcccgtccacacgcggccataccaaccaacgcctattagagaaagccaagtggaaaacaccgcctcgcccgtaaatccaatcaggatccgccacgcaccatcgccgtctgtttctccctgtctcagtccctagctaccaccaccgcagcgtgcgcagccatggacgcggccacctcgacgacgctcctctacggggcgctgctcgcggctgctttcctctacgtcgccaccatccggcgtggccgcggcaggggcgaaggcggcctgccgccgggccccaggggcctgccgctcttgggcaagcctcctgtccctcgacccggacctgcacacctacttcgccgggctcgccaacaagtacgggcccatcttctccatccgactcggctccaaactgggtaattgtcatcaactcccc

SEQ ID NO: 21314 - DNA, 687 bp, Triticum aestivum
  unsure (1)..(687): unsure at all n locations
  Clone ID: PAT_TA_21314
gaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctagctagccgcgactcgttggctagacgattcaagcagcagcgcaggatggtggcgccggtggtgattgcgtcggccgggctgggcatgctggccggcgtggcgatggccaaccggtccctcgggaacgggtccccggcggcctccaaggtgggacccgcgcccgcgctgcgccacgtgcggcggtccggccgcgtggattgcatctgcaacgctggtccgacgggatccggctgccggactgccctgggtcggggaggatcctgccgnactgcggcggtccggaacggccgacgtcctgacggtaacgtcaacacaagaccgcgcgcgcgcgccggtaaactgttcatgggatatagggactgcctggtaatctccccggcttcatcccccttcaggagcttgtaaccattgtcccacctttacaanaatanancccntatntggaacattattaaaaattccttaanaaacnttttngnaaaaaaaaaaaa

SEQ ID NO: 21315 - DNA, 713 bp, Triticum aestivum
  unsure (1)..(713): unsure at all n locations
  Clone ID: PAT_TA_21315
gtcgtccgccgccgccgaaggacggaaggagaagagggtacggccgtctcctcgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttcgagagcggcatcaagctcaaggagtaccagctgctcagggaggagcttcagcgacaccgggtgctttggtttcggcatccatggagcacatcgaccttggtatcaagtacgatccgtccaacacgcatctacggcatggacttctacgtcttgctggaactacgggctaccttttgcacccgcaggagtgaattccgcgtcgggtatcaccaaaggtgacaaggaggactccatagagtggatcaagtcaatgcaagggtacctaccaggaagcaaacattgtttcccccgctgaagaaatcccccccctccccccactacccacccccacaccctcccttaccacaccgattcgcgcttgttgtgccccgcatttncaaacnaaccanatatttgctaaccgngtn

SEQ ID NO: 21316 - DNA, 461 bp, Triticum aestivum
  Clone ID: PAT_TA_21316
ggacaacgagttctggtacgatgtttgtggatgggtgatccttggcgcgggcatttgtgcttgggttggattggcaagagcaagcatgcctcccccatcggcaccagccacgtgaagctgatcgagtgccaagaatgctttgcaaatgttgttaacatgcccccatgttaaggtgcctcaggcatgggatctttccaggtgttagttttccatggagaggagagagtggtgtttccatacgggttggatcaatttttcatgcttgttcttttcggagcctcgatgaggtttcccttataatcggcatatgctgctgggataattttgtacttgcttataccgttttgagccttaaaaacgtcacgacgttgcgacgttacactgtgttcgctatgaacctgaaatggtgcccatgcataaatggcaaataaatgtatccgctgtttgttaaaaaaaaaaaa

SEQ ID NO: 21317 - DNA, 698 bp, Triticum aestivum
  unsure (1)..(698): unsure at all n locations
  Clone ID: PAT_TA_21317
gccgactctgccgtctccctcgcctctttcccctcgtctcgtctgcatccgcctccgccgccccaagacctcatcacctccccttcgccgtgaaccctaaccccgcgcccctcgccccctccttctcgtcgtcatcgccgcccgcttttccgggcccccatcgcctcttctcttccacgagtggttcaagcatggtggtcgtgggctccgcggactccttcaacagcatcttttccaaggtgcaagatgaaaagctaccagctgtcttttactacacggcggtgtggtgtggaccatgtagggcgatcgcacctttagtatcaaagctgagcagccagtatcccaagataccggtgtacaaagttgacattgaattggaaggactggggaaacaaactccgtgatctaaacatatgttcagtgccgacgttcacttctatcacaagggcagagaattagtgaaatcgtgggtgctgatgcaaagaaaattgaagctacatggaaatctcaaaagcacagtagaattcagagcagacctcacctcacacaatggaaggttaaccactcccagagaatgtgccacttggatcnnttttcttagttaaccgttaacncacttctaaaangtttatcgncgctnttagtaaaacaatctgttctcgttttgattggctactaaaaaaaanaaaaaaaaaaaa

SEQ ID NO: 21318 - DNA, 680 bp, Triticum aestivum
  unsure (1)..(680): unsure at all n locations
  Clone ID: PAT_TA_21318
tggcatcggaggccgcgattgctcgtgcgcagtgcctccttcgcttccgccgctggtcgccactgccgcttcttcctctcccttcccctcccgctaccacacgagcagcttcctgccgccgcagcgtacgcatggcctcgtcggacggctctgccgcggccctgcccagcgctaccgtcgatgtgcccggcgccggggcccctgtcctcgtcgtgggcgcgccggggctccccgaggctgacttcaggaacgcggtggagtcgtcgctgttcaagcagtggctgcggaacctgcatcggagaagggcgtcctcacctacgggaggctgagcctcacgcnggttctcaaccaaggcgttgacatttcgggaaacgggtgggcttctcaaattcaaaggctgatatcgtggacgaggaaacaaaaacaaaggaatttcttgcaagaaggccccggttccgtgttgatctttggatccaatggagaaactatcttgctaacgaaaagtaaagtcccattggaaattccgttgactcctgctggatctaagtacaaaaaggattggtgcaccatccttagtgaaaaaaangttaaccgaangaaatgtattangatgtgcctnacgagtatnacacacgtgtcaaaaattgcgtctaggccttnagacanattccaganacgtn

SEQ ID NO: 21319 - DNA, 636 bp, Triticum aestivum
  unsure (1)..(636): unsure at all n locations
  Clone ID: PAT_TA_21319
ccgctcctcaccaacggccagatggttgatgacatcccgccggagcagcacgcgctcgtgccgtcctacatgagcggcggcggcggcgggggcaagaggatccacccgctccctttcgcagatcccaaccttccagtgcaaccgagatccatggacccgtccaaggatctggccgcctacggatatggcagcgtggcctggaaggagagaatggagggctggaagcagaagcaggagcgcctgcagcatgtcaggagcgagggtggcggtgattgggatggcgacgatgcagatctgccactaatggatgaagctaggcagccattgtccagaaaatccctatatcatcaagccgaattaatccctacaggatgattatcgttatccggttggtggtttgggtttcctcctccactaccgagtgatgcatccggcgaaagatcattgcattgtggccatactgtaactgtgaatccggttgcaagtctggatcctgataattccaaatggctcaatcagagagaactactggacgtttgcacaaggttgcaaggaaggcaacctccacttctcaacacttcttgcatacgtgatcaaaggacccccttgtnaacaaangtcttcacctccgtgnta

SEQ ID NO: 21320 - DNA, 343 bp, Triticum aestivum
  unsure (1)..(343): unsure at all n locations
  Clone ID: PAT_TA_21320
catgcgaacaagctcgttgctgccttctcggctcgtgcaccctcatctcaagaagtgaatcgcctcaggtgatacacaagggattttcatcaacaagtggtcgccagaagaactgaaacatcaagatggcgtttgcttttaggtcatgccattcaggagatgatgttttattattatgcactgagactatgtttgacattggtcgtgtacactgagactgttttattatgatgcactgagactatgtttggtgtacactggagactatgttttattatgaaaaaaaagggggggggcccggtaccaattcgccctanaaggganccntattacgnngcgctca

SEQ ID NO: 21321 - DNA, 758 bp, Triticum aestivum
  unsure (1)..(758): unsure at all n locations
  Clone ID: PAT_TA_21321
ttttttttttttacggaaaggccgtatcgacggaagatcatggntgtttggaaccgttatttcctgggaaatgaaccctggaaatgatttcnaattaccctaattttaaacctccgagaaaaaagatcatgtttcttccatacacatctagttccaaacaacaaaactgcatgcatattcatccgcttcctaataatgtaaaattgggagagcacagaaagtttcttagaacacaatagagcttgatcgtgaacctaattcatccttttgatgagctcgttgatgtaattcctcacggttaccggcatcaccaccctccacatagtggtcctcttcttcttcaggactcccagcggtgccttcagcttaaatggccaaaggaagttgttcgcctccttgaagtgtgggccggacagtcatgatctcatgaacaagatcctcaatgcaaatgatgttgtgcttgcccaagccctcctcgatgacttggtggttagacagagggatcctccgctggttcagttttccgtaccccccctggtagatcacctccctgacactcttcaagttcgggtacccatatgcaacataaggctcccccccgacagttaanggacctggttgantnagggaccccatgatactgccnaaagcagaactgaaactctggctaagagatgaatgtcacgtncggttaaaaanagcttgctagacgnataaacacctaanggccagctacgtcattcttccggacancccgg

SEQ ID NO: 21322 - DNA, 628 bp, Triticum aestivum
  unsure (1)..(628): unsure at all n locations
  Clone ID: PAT_TA_21322
cagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggtacggcggccgtgggggatacgtggtgcaaaccgccgcggcggtacggaacaacgacgggaactggaggaacgaaccgtgggtccgctaagccaattacctgtcgctcgccacgtgtcacctatcaaaagggttactctcgtggccccggctccttcgtcctccgtcctgcctcggcttcccgttcccccaacctagn

SEQ ID NO: 21323 - DNA, 582 bp, Triticum aestivum
  unsure (1)..(582): unsure at all n locations
  Clone ID: PAT_TA_21323
gagaaggagcggcttaggatggagcagaaggctaaggccaaggaggccgaggagaggaagaggcggaaagccgagaaggacaaggagaaagccgagttcaaagcgcgcaaggaagctgaaggagagggagaagaagaaagccaagaaagacaaaaggagaggcacggcaccagcagattctagcctcactggtgacgggcacgccgcggccttggccacagcagacactgacagcaacgcatcggacaacccgagggaagctgaggctcctcaaccgngcgngcgtgctcccaagaggctgtctaggcccgcaagcggcaatcaaagcagctgaacagggtgcagcccatgccggcgccgctacgttacaaggggcaagaaggagactgccgcagttcatccctgatncgcggcgccctgctatccgggcttgcttgtccttggcaggaactattcccaagctcattcggttcacccnattttatctgtgggaagggtctaatcttcccggtaacnggtgtatcnataatccagtatccccnttggttgacaattttttaccagaagttgttnaaatggggt

SEQ ID NO: 21324 - DNA, 574 bp, Triticum aestivum
  unsure (1)..(574): unsure at all n locations
  Clone ID: PAT_TA_21324
aacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaaggggaggcatgcagtttttcgtcaagaccctcactgggaaagactatcacctcgaggtggagtcttctgacaccatccgacaacgtcaaggcaaggttccaagacaaggaggcatccctccgggaccaacaccggtcatttttgccggcaagcactccaggacggccgcacctggccgactacaacattcagatgagacacctccactngggttgctctcaagggcggatcantctcctggagatctgacggnaagatatcacctgaggcgaatctcgatacatganatgcangca

SEQ ID NO: 21325 - DNA, 593 bp, Triticum aestivum
  unsure (1)..(593): unsure at all n locations
  Clone ID: PAT_TA_21325
tcccagccgtcatcgcttcacgtccgctacagaccggcgaggagacgaaaggagggagttttgagaagctcaaatggctcctaaagccgctcctgccaagaagggtgatgccaaggcccaggccttgaaggtggccaaggctgtgaagtctggggcaggcaagaagaagaccaagaagattcgcacatctgtaacatttcaccaagcccaagaccctgaaagaaggccaagggaccccgaagtacccaaagaatcaagcactactgggaagaaacaagcttgatcaagtaccaaattctcaagttccccctcaccaacagaatctgcaatgaagaagattgtaagataacaacactccgggtctttatggttgacctcaaggcaagacaagaaaaagtcaaggctgccgtccaagaagatgtatgacattcaagcaaagaagtcaacaccctgattaagcctgatgggaagaagaggtttatgtgaaactgacacccgactacatgccttgttgggcaacaaaatgggatcacctaagttatagnaactggatcgacatccgttccacaatccggcatacaacagatttcatt

SEQ ID NO: 21326 - DNA, 868 bp, Triticum aestivum
  Clone ID: PAT_TA_21326
caaagcaaattacattacatgggaaaaataatgaaaaacaagttcttgctgattataactactatcggctcccacgcgtccgcccacgcgtccgcccacgcgtccgactaaagaggcatccaattatcttgtgcaaggctttcagataagttgttagagagaacagaagaaatcaaccagcgcaaccagaccatcatacagatgactaaagaggcatccaattatctggaacaactgcatgctgcatcagacaagatccatggtcttgctgccactgccttagaccctactgccagcctgtctctttccactctaaaacaaactattttggcgattcaagattcacttgttgctcttcaaagcactaccgccgctgcacgtgcctccctagaggaaaagggcatgtactcagaggatgatgtggctcaaccaacctatgatgggcttcctgatgaagaaaccgatgaagattaccatcaagacatggatgatgactacgctcactatgtgcgatccccatgagcactgtctaaggcctgctaactgatcagcaagtgaagctttctatatatagcttcgtgatgacaatgctcactatgtccgatccccataaatgtcatattgagcctgctaaactgtctctttgccatgtcaagctgtgtatgtatggcttccccgctaggaagcagctctgtgtctgctgtgtttagtttcctaggttgcttaaataagatgcgaaactatctactcatagctttggcctagaaatctttatcctttctgaacttgactctggtcatgtataagtatgaagtctgtgttgacgtgttaagacaatgttatttatctatgctacgcctttgctttt

SEQ ID NO: 21327 - DNA, 1192 bp, Triticum aestivum
  Clone ID: PAT_TA_21327
ctgtctgcttccccgttcttatctccttcccacatctgctcaccccccgccccgcacccgcgtctgctctgtacctgcactgtacccgcggtcgcgtggatcccccgcaagcagaggagctcccagccagccaagttgtagatcccttcatctgttctgatgctcaccaagggcaacaagatcctccacccaggacaaatctaattaccaagccctctgagtgtatcttgtggatctattctcatggagttggttgagctatccagcacatcactgggctgaagcaatgttcatgaaactcggtctccctaaaccagtgtactttgtgcatcatcttccacaagatcgatttagaacagagattcagtttcaccgcacaaaaagcacggtaccatgcttcagcgcaccggacaaaattatcaagccgtatatgtcgcaatggggtagcatcaatgaatcatgcagccgagaaggccatcgaatacatgcagaacaaagagggtaaggtgcttgtggactataactattatcagctagagcaaatgaagatggcacacacaagactatcagccaggttgctagaacagtcagatgaaatcaaccagcacagcaacaccatcaagcagatcactaaagaagcatgtaactcactgaaataagtgccaaagacaacaaagagatctaatcaccttgctgccgttttcttggaccctgttgcctcgatgtgtgtttctaatatgaagcaagctattatggagattcacatttcaattgtcgcgcttcaaagctctacaattacaacatctaagttcctagaggaaaaaggcatgtactcagatgatgaagtgcctgaacaaggctacagtggctactcagatgaaaattcagccgatgatattcatcaagacatggatgaggactatgctcactatgtccgatccccatgagcgtcatattgagcctgctgaactgtctcgttgccatgtgaagctgtatatgtatggcttcaccgctaggaagcaactctgtggttgttgtgtttagtctcctaggttgcctaaataagatgcgaagctgtctgctcatagcttcggcttagaaatctttatcctttctgaacttcgctctggtcatgtataagtataaagtctatgttgacgtgttaagacaatgttatttatctgtgctacgc

SEQ ID NO: 21328 - DNA, 571 bp, Triticum aestivum
  unsure (1)..(571): unsure at all n locations
  Clone ID: PAT_TA_21328
caccacaccacaccacaccaccggcggcggcggcgacccagtcgagaacacgaaggcgatggcgacagcgctgaaccgcgggctccgcctcctcgccgccggcgccgaggcgtccaagccagcttctccgtggattccatgccaccggcgtgaagagaatgggagggcatggccatgatgagccatactacatccatgccaagcacatgttataactttcacaggatgaacatcagggttttgaaggtgacactctcccgtgctgggagcggtttgcatccgtgtttggatccctgttgttatgcatccatattcccagcaagaagaaactgcctcctggcttaagatgatcctcctcgctgcctgcatatggaacttatttttgagcacatttttttgaatttaaacttggcttcatcctacttggttgttgcctgatactgattttccttacataattgttactccttcctgccgtttggtgttagaacattttccgttaataagtttggcttaactccaagctgtggaattgggaaaaaaacaaaacctttnttttaaaaaaaaaaaa

SEQ ID NO: 21329 - DNA, 605 bp, Triticum aestivum
  unsure (1)..(605): unsure at all n locations
  Clone ID: PAT_TA_21329
aaacatccatacgtgcttcctgtcttgatagacgtaactgatacacactttacagggtcaacgggtgacctctctgtcgaccatgagcactctcaggccgttgcgcggtggctgccaatgcggccgcaaccgttacataatcgctgttccccagaatggcatcaatgaggcacaggttctcttcaacacagagtctgcacatcaagataccccttgcaactccactgggccgcctacatccgagttccgctttcatgggatcatagtaccacctactctttcttccccggnacgagacacacgccttgattcgacgagtttatacacacccctagccaacaatactcaaaacgtcactttctgcggctactgtggcacaccactgtcctactggtcccaaaaccgcataccgaggccgaatttatcaacctgccgcgcgctaccttgcgggacggcgactgcgggatatgggacgtcctgggacggatccggaacacggaggcggcacacccgccgcaggcaatcacacccatctaggatcctgttntgatgcaaganccnagaaatccccatanntaaatncagngcagtagncatgaattnaa

SEQ ID NO: 21330 - DNA, 672 bp, Triticum aestivum
  unsure (1)..(672): unsure at all n locations
  Clone ID: PAT_TA_21330
ccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggattcgggcgctacctcaagaaggggcggtacgcgcagcgccgtgggcaccggcgcccccgtctatctccgccgccgtgcttgattacctccccgccgaggtgctggagctggccgggaacgcggcgaaaggacaacaagaaaccgcatcctcccgcgacacttgctccctggcgatcctaacgacgtttgactccggaactgcttctggcgtcacatcgcgcacggcggtgcctccccaacacaaccggtctcctgcccaagaagtggcggagaagcgtccaacgggccgcacggggacaatcccccctaaggcgcgcatccccaaagaaggagcaatcccgaagagcttggattntcccctactacgcccgcggtccttcgcggttaattggggacttggggccgccaattcccctgccgnggcccgaagttacggttttcccgtggtccctgccgattttctcactctgtcttcacgatacaatcgtaaatntttc

SEQ ID NO: 21331 - DNA, 534 bp, Triticum aestivum
  unsure (1)..(534): unsure at all n locations
  Clone ID: PAT_TA_21331
gaagcatgattggaccaggtctcttcagcggcattgttgtgtcatctgccaccgcagcaagcagcatgacgaacgagcactcgtcctctggtgtcagcaccgcttccgactgcgacggcactgtgaggagccaatcaatgattcctccacaggtgctggttcctcgctctatgatgccttcttggtcgactgagcctgtagatggaggcagagagggaggtcatgttgttccccgaggggagggccatggtggtggctcctgtcactcatccggtggcacttcaaggaacgccgatttgggagaacctccaaagctatgcttttccatcaaccagttcngtcatttgtttgtacataaacagccgcgtttccggctatggatcctaatggactttcctgtccaaataaattcaacttcatgtactggtttatccattgtaatggtgactgccatgttgtgaacctttggctgtggtcaacgtatcaatacgcaatcttcttgtgttaancgcctatgttgtcaaaaaaaaaaaa

SEQ ID NO: 21332 - DNA, 609 bp, Triticum aestivum
  unsure (1)..(609): unsure at all n locations
  Clone ID: PAT_TA_21332
gcggagaagcccctcctcgtccgggctctccatggactcgcattgtgcatgcataaaaggctcgaaggtccaactgttttcgagatgctggagaaagctttgcaacttgcagtatccgaggaaagggtcccagaagagcgcaacataaagcttctgattgcacagatgcatgttgtcaaagggtgacctggttcttgcatcaagagaagctgagacccttattaacgaggattccaaagggttttccggctcatcctttgccaaggcatttgtatatcacttcctgggacaanaaaggaagaagcagacgacatttgacgtgtacagaccttgtgcccggatgattccccggacagattttaccnatgatttaatacnatcngncaaattggatccaaaatttggtacagagatttaattaannaccaacctaaaannaaaccgagnttcccnanacctgaanggcancanattangaggantccaaatntttgcctattctgccananattcacaancacttgcanaagaaatattaagnaatngattccgtaccaacagttcanatttaccattttacccaancttcaaacatatncantgcnaagt

SEQ ID NO: 21333 - DNA, 687 bp, Triticum aestivum
  unsure (1)..(687): unsure at all n locations
  Clone ID: PAT_TA_21333
cnnnnnnnnnnnnnnnnnnnnnnnnnnnnnnngttttgggctgggtgatctcgtctggcgtgcttttttagaagagaacacaaagtcgcggttcggtggcgggggtggcgatcggccggccgatatatcggggggcttggcctcgtgggtgtgctcgttttgtttgttctcttgcgctgtccggggaatcggtcgtgagtgtggccgtgtggtgttttgggttgggtgatcttccatggcgtccacggcgtacgcgcgcgggtccaagccgccggccggccccggcgagcggaggcagccgcggctggccaaggagctgagcaggatcgagcctaagaagctcgggattgggctcgtcgccggctgctgcctcgccctcctcacctacatctccttcgcccgcctcttcgccatctactcgccggtcttcgagagcacgtccatggtgatgaagaacgcgccgcctgcgtccacggcggtgcccagcacggaggaggccgtgccggtacagaagaagatcgaagtcgagggcggtgaagatctggctggagggggcacggagccgaaagagcccggctttccagaagaaacaaagatcgaaaaaaaggaccccgggggatccagaaagcacccaaaaggaggagaccggngggagggatttccaaaccgggngaanaaaaaagcaac

SEQ ID NO: 21334 - DNA, 562 bp, Triticum aestivum
  Clone ID: PAT_TA_21334
ctcgagttgcagctatcctgtgcatacccatcctctttgcctacccctacatgacgtacctgtcggaacctggattatcaatcgttttgaatattgcgtcagtgataaagaataatctcggtgtcaccatcattacaggcactttcatccttcaaaacaatgccgtgcctcaggaccagcgaggcgctgcgaatggactgtccatgactgggatgtcctttttcaaggcacttgctccagcaggagcaggcattgtgttctcatgggcgcagaaacgccagcatgcgttttccttcccaggtgaccagatggtatcctccctcctgaacgcgtcgagctggccgggttctcctcaagttcaagcccttcctggcaagtacaagacaatacgatacgagatagtagacgatctacccacccatacaagttctgggaacttcaagacatcatctgtgcggtgtacatttaaggagaacgccaaacgttgcctttacccgcggaagtctacaacaaggacataccctatttgggggtcaatccaagccgtgggtccttttgtggg

SEQ ID NO: 21335 - DNA, 691 bp, Triticum aestivum
  unsure (1)..(691): unsure at all n locations
  Clone ID: PAT_TA_21335
ctcttctcctcgcgccgccgccatgtcgaagcgcgggaggggagggacggcggggaacaagttccgcatgtcgctgggtctccccgtcgcagcgaccgtgaactgcgcggacaatacaggcgccaagaacctctacatcatctccgtcaagggcatcaagggtaggctcaaccgcctgccgtccgcctgcgtcggcgacatggtcatggccaccgtcaagaagggtaagcccgacctcaaggaagaaggtcatgcccgccgtcatcctccgccagcgcaagctgtggcgcccccaaggacggagtctacatgtacttcgaagataatgctggagtcattgtgaaccccaagggccaagatgaaaggtctgccatccactggacctattggcaaggantgccctgacctttggcccaaggattgcaattgcagcaaatgctaatgtcctgatactacggttgggagctggtttagatattttatgtgatccatttaaccttccgtactcaacatcgtggaattactnattatgtctaaggaaaaacctagccacattaaatagccaatgtcactcgtacatttanattcggttnatctttgattgcctttaaggncatanaccttcaaattaaggggccgtacattnccaagnttttacccccnggctttttaattnggaaccggtacatta

SEQ ID NO: 21336 - DNA, 728 bp, Triticum aestivum
  unsure (1)..(728): unsure at all n locations
  Clone ID: PAT_TA_21336
tcgagttttttttttttttttttttttttttttttttttaaaaagccaagaaactttgggataaccaattcaggatatataagacagaaaaactctggttcacgagtaaatcccaaccagcatagcaatctacggctgaattaccaaatataaagacaagtagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgccagcagcaggtgcagctgccgcaacagcgacaccgccgccaccacatgggactgaagcaaactctccctgcccgcgggcaatgactccgtgatgccttaccgctcaattgggacacaggatccatctttcatggcaactcacagcaacggacccanaatggatcaatcgcagcggaggggcggcgtccagcaggcacaacagtggagaaaaactcacggcccaggaacgtcacgcaaacccagggggccgaccaatcccaaatggtctataccccccaggcgtctttaactcgacggaaaccgggttccantacctganaccccttccanggancaagccccgtcctcaatgcccnangaggcc

SEQ ID NO: 21337 - DNA, 385 bp, Triticum aestivum
  Clone ID: PAT_TA_21337
ctccaactcactagtactcagccgccgcaatcaggggggcaggtagctcgagcgcgcgctccacctgcgccgacgcgatgcgggccaagtggaagaagaagaggatgcggaggctcaagaggaagcgccggaaaatgaggcagagatctaagtaggcgcatcttgtgaccgaggatggcgagcttctcctgcaccatggctgtgacgcgttgggatgattgtctccctttgtagacgtgctttgctgtagacgttaggcgatgtaaaccgtcctttttgattaattcccaagtatgttctgagactgggtttatattgtaatttgaggataattatatgatgctctaagtttattgatatccctgtcactccgaaaaaaaaaaaa

SEQ ID NO: 21338 - DNA, 640 bp, Triticum aestivum
  unsure (1)..(640): unsure at all n locations
  Clone ID: PAT_TA_21338
cctcgtcaaatccacgcgaccgcgagagctctcagaaggccctagcacgcaaaaaccccacgagagagacgaatcttccgaatctctcggtggcgatggcgctctccgaccgctcccgcgagtcgctcctcccgagcttcctctacggctcctcggcgcgctctttcgctgccacaggagccgccgcgcgcctccctgtctcctccccggcgcctgccgcggctggagcaggaggcggcgtgccgttctcgatccaggcgcccaaggagaagatcgagatgtactcgccggncttctatgccgcctgcactgccgggaggaatcgccaagctgcggggctcacccacatggccgtcacgcctctcgactcgtcaaagtgcaatatgcagattgacccaacgaaatacaagagtatctcatccggatttgggatcctgttaaaggacaaggggcaagggtttcttcaaggggatgggtgcctacttgctgggttacatgcccaaggggttgnaatttgctccataattcttaagaatttaccggaatgcaggctgatagccaaagtacagatctatccctccccggttggtccgccgagggcttgtgnccgccttnacttaagnatntcaaaaactgattt

SEQ ID NO: 21339 - DNA, 506 bp, Triticum aestivum
  unsure (1)..(506): unsure at all n locations
  Clone ID: PAT_TA_21339
tccgcgccgacaacccaggtgtatggttcatgcattgccacttggaggtgcacatgagctgggggctgaagatggcgtggctggtgcaggacggcagccttccgaaccagaagctcccgccgccgccggcagatctcccgaaatgctagacgtgaagatcaagatcgatcgtcggtgaagaagatttgtcgcttcattgattcgcttccgcctcacgttgttttttcaagcttttgctctcgcgtgtccagcgagttcgtcgtcattatctccactacagtgatgtattctttttttacgccaattaattttccaggcgattcgccgtgcttgttacatgcactttattaattgccacggtgttgtgtggagttcccttaattggctgagcttccttgtaagttgtaacagaaagcttgtgtgtgccttttccccccgctgtacctatctgcagtcgatttcgacctaaagcctcgtgtcgttcantgncaaaaaaaaaggggggg

SEQ ID NO: 21340 - DNA, 632 bp, Triticum aestivum
  unsure (1)..(632): unsure at all n locations
  Clone ID: PAT_TA_21340
gttaatactaagggcaggcacacctctgcttcgcgctagtgatcaagcaagtgcttctgtactctgcagcaatggcaggcaaggcatcggtcgcgctgttcctcgccgtgaacctggcggtgttcgccatggccagcgcctgcggtggcaactgccccacgccgaccccgtccaccccgtcgacgccgaccccgacgccggcctcgttcggcaagtgcccccgcgacgcgctcaagctgggcgtgtgcgccaatgttctgggcctgatcaaggccaaggtgggcgtgccgcccacggaaccgtgctgcccgctgctgaagggactcgtcgacctcgaggccgccgtgtgcctctgcaccgccatcaagggagangtcctccgaatcaagctcaaccttgcccgtcgacccaagctcatcctcaacaacggcggnaagaccttgcccaccgggattcaaatgcctctaagctagccccaaccgcaacatgcggatangtgtctttggggcgctcccccangntctgtcttcantactataacattgnacttcatatatactcttgatttatacacttncttgggttgtttggaatctcccctgnaaaattcaacattgcgtatcttttcaacn

SEQ ID NO: 21341 - DNA, 1247 bp, Triticum aestivum
  Clone ID: PAT_TA_21341
ccgccgccggcctagggtcgccggcttcgtcttctacaagtacaggctcaggtcatacatggactcggagatcatggccatcatgtcccagtacatgccgctcgacggcaagctgaacgagcccccgccgctccggcaccattgcccagacgcctaaagggagaccaaggcgctagtcttcgtcatggcaggttcatgggacttcaaccataccctgcaaatactttgctatgatgcttttcaacgattctttttagttactacaacttccctttctatatatagacgaaacaagagaaccacggtttgtacaaaagcaggccgcagacgacagcgacgggtacacccactgcaaagctgttggtccgggcaggtgcgcgctgaaccacggcgggtgctgggcggagaccaagggggagcgcaccttgtccgcctgctcggacacggcgctaagcgggtgccggtgcccgccggggttccaaggcgacggccacaaatgcgaagacctggacgagtgcaaggataagctggcgtgcacctgcccggactgccactgcaacaacacctggggcagctacgagtgcggctgcaggggcaaccaggtgtacatccgcggggaggacgtctgcgtggccaacagcatgtccaggttcggctggctcgtcgccctcctcgccgtctcctgcgccgccggcctaggggtcgccggcttcatcttctacaagtacaggctcaggtcgtacatggactcggagatcatggccatcatgtcccagtacatgccgctcgacagccagaacaacgagcaccagccgctccggcagcatgctccagacgcctaaggcaatagatggaaaatggatctgggaatgaaagcttgcagagttttcatcaaccatacccggcagatactttgctatcatgcttttcaatgatttttttgttactacaacttcactttctatatatagaagaaacaagagaaccatggtttgtacaaagcaaggcacaggggtgagctgtagatacatagctaggtaggcatttctgctccccttgtggctgtggatcacaacacattagacagaatactttcactaagaacatacaaagtgtgatgtacaatggattataaccaataccagcactggtgtttctgtcatttttaaggtctgttttctagaatgccctcatcggaacaccgggggctctactgtgacatgtatcaatactgctgtaagtgctac

SEQ ID NO: 21342 - DNA, 650 bp, Triticum aestivum
  unsure (1)..(650): unsure at all n locations
  Clone ID: PAT_TA_21342
tctagctctgcctccaccagcttcctgcccggctacgcccccgacttctgcgtattcgtggcgctccgtccgatcaagccgcccgccaccgccgtagcgaaccctcccgcctctccatctccgctggaggaggagcaccggcagcaggccgccgttccatggcacagcgacgacccgccagcaccatccgttcctgcgccgctgcgggtggggattcgtcgggttcggcaactttgggacagttcatcgcgggcggcgtgcagcggcagggccacaccgtgctcgcggctccaagaaccgactactctgcctactgcgcccaagcatggattcgcttcctcaaggagcgtccacncgctgtnccaaagagcaaccngacgtgctgctcatctgcagttcatcctgttcaacggaaagctcctcccgagcatccccnttcaaaaattccgccccacacatctcgccgactctctccgtccaggattccccgcatctcctcctcgangtctcccaacaagatcgggatatctgaaacaccgattttgggcggaagtgnaaaacgntgggnaacttcctctctnanaggtcgttccgacangggatagcgaactcacgntctacaattacagagtnttganngaattttcacn

SEQ ID NO: 21343 - DNA, 556 bp, Triticum aestivum
  unsure (1)..(556): unsure at all n locations
  Clone ID: PAT_TA_21343
acaatgctacaggaaaacactagttcaggacatgtggcgacaaggacacatctgctggatagttcagcagtagaactcatcatcaggtcttccagttcagacggcatgactttgagaacttcatctccaccgcggacctggttctaattcaaacagaaaccatatttcattactacctccgttcaaaaatataagatgatttccgatattatactccatatatgactacatatacgcacagaaatgagtgaacaaagacactacaacatgtcttcaaaaggcatggagagcaagagggattacatgcaatatccataacacaatttactggaggcaaatatacctccttaaaaggagcattgatgttcnataaatccccctcccgtcccaatctcctgtctannttggtccnaaatacggntgtttcaatcacattttaatattagatacatccgtatctagacanctaagacaagaattnggacanaggagtattnaaattatcnataagancatgtnactcncccagtttggcaaaangattaaacctcattgg

SEQ ID NO: 21344 - DNA, 644 bp, Triticum aestivum
  unsure (1)..(644): unsure at all n locations
  Clone ID: PAT_TA_21344
ctgttgcagtctagccagtcacaggacaacattttcgaactgaaacgaagacggcaagtcctcctggaaggtctagctgcatcattgcagtttgttgatcctctcggacccagcaaatctggtcattcatctgggtcagccctgaaggacgatgttatttttctgcgcattgtttctctgcccaaaggacgtaagtttttaagcacgttaccttcggcttcttgtccctgggcagcgagtttgacccggatagtatgcatggctatttttcgccatttgaggtcttgtttggggggttgccatcaagactcctaatgcagcaagaaactacagttgctccttgcgaaagactgtttcatccttgtgtgcatcacaatggnacttgggtgctccttaaatgcctgccttgctgcngttgtttggtccgtccngaacaaccactctgcgccctccttgggaactccgctgggtgatgggcgcccccgtggtaacatacggaccgacaacgantacgacgatgcaagctcagcaactaacgtgcaaacgtctcctgcaggaacaatnatgcttcttggctcaaaaanacgtgtatagttaatancacaanttgaaaaacactagacgccaggtcacacataggagcg

SEQ ID NO: 21345 - DNA, 616 bp, Triticum aestivum
  unsure (1)..(616): unsure at all n locations
  Clone ID: PAT_TA_21345
ccagatgtttaggcctggttggaaggacatttttcgaatgaatcagagtgagctcgaggctgagatttgaaaaggtctctcgagattctactcttgatccaaggaggaaggcctatctgatccaaaatctcatgaccagccgttggatagttgctcagcaataatcaccacaaccaagcgtcgaaggacataatggatgtacacgatgacctggatgtgttccttccgtaccgagacccagggaaacaaatatttggctgtngagcattacaaaagaaactgcaacttgttgcctgcatgctgcaataantatcacttgcagatcctgcacgataaatttagtgaccatacaagggcaatacctcaccacaaccatcatttacctccacactttcctgcggaggagcttcaagattcattttacatcnaacaatacaattaacatggcatttattgggaaaatgttgtggggtgcaaggaccgtgctcctgtnaatgaatgattccgtcatgaattccacgaagctttcatcttgattactgacncctaattgatgatatttacaatgctccccccctantaaancaaatanttaccacgaggtnaagatggtgnt

SEQ ID NO: 21346 - DNA, 510 bp, Triticum aestivum
  unsure (1)..(510): unsure at all n locations
  Clone ID: PAT_TA_21346
ccatccgcccctcgctgccgctgcgtctcgtctccaccaccccacttgcccccggacccaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactggggaagcatggtcacgcaaagtgtcactttgttgccattgacatctttaatgggaaagaacttngaggatatcgttccttcatcccacaactgtgacgtcccccatgttgaccgccaagatatcaactgatttgacataactgatgatggtatgtcaccttctaactgagatggcaacacgaaggatgacctgaacttccaactgatgagttctgcttggcagttaagacgggtctgctggtggcctggcctctccttcgttattccgccagggtgaagaa

SEQ ID NO: 21347 - DNA, 671 bp, Triticum aestivum
  unsure (1)..(671): unsure at all n locations
  Clone ID: PAT_TA_21347
gcgaaaagatcatgaatgaagctgaaattatgactcccctaaatgaaagaaatggtcaaggtaattcttttgaaggagtgataagggcatcaaaggaggattatgagcaactccctccttatatgaagagtctagcatcatgggaggagttgcaggagggaatatccaaactaaattcatacttggggtgggtgacaagttgcaggggaagtgttcctttgaaccaggaccgtgttgcaagagataggttggggtacatgcacttgctatattttttttttgataatgggaaacaagattcccggctttagcatgaatgtaggtaactcctagcancctcaattccttgcatttgagcgccatccaatgattgcaaagactccatcgccacactttcaaacgcttgacaaacatcgaaggtttgttgatgtgaccctccttccggaaaatctccaagatctgaacaagcgcaaaggaanaccgtttgctgatgcgttgcaccaacagtacctaggaaaattgaggctcacctttacaccgtcaagaaaactgtaccgatacggcacgcaaacgtgcagctaagtttcctttctttcagtcagncggaaaaatgaccggtagtcnncattcagcaaatnntttcnatcggnatgttatcangaaaaggntgg

SEQ ID NO: 21348 - DNA, 730 bp, Triticum aestivum
  Clone ID: PAT_TA_21348
atctaagtccaactcgccatcctcctccttgtctctgatctccccaaatacccctcctcctcctctccgatctccccaccaaatcccgccgcgaagacgcctgttctttccgggctccccgattcccgccggcggcggcgcgaccccgacccggcgagccaggcctccctccaccggcggagccttccctcgtcgagcggcgccgcgcccccgcccccgccctcactcgactggcgccgcactgacgcggcgcggagatccgtctgcccgggctcgcattgggtttgttctcctctgggtttgttgaacagtaacactatatgggatcgtactcgacaagtgaagtgcttaatgctgccgcggttggcgtccatcatccagcactccgttttcacgagctggacctgaaaggttccatgtcggcggaggaactaccgacgacctcaagcctggagaatgggtacaaggactgtttggtaattgatcatccaggagcgaggagcttagcgtgtaattgtggttactcaggtctctttacctcgactcagtctccgcgtaccaggatattattacgacgatccaagcttttcacctcacaaagcctctactaccgccttactgttgtttccttttgtaaaatggcaaatggtaagcattcatcattcaagcatcctctttccctccctagttattttattgtcatcatacgctgtgtacaatcttgcaagca

SEQ ID NO: 21349 - DNA, 685 bp, Triticum aestivum
  unsure (1)..(685): unsure at all n locations
  Clone ID: PAT_TA_21349
ctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgccgtacgccaagcagggcgccggccgctccgccccggggtcgattaagtccagggaccgtgaaggcgtcgtcggcccgtctacgaccgtttcacgccgtcccgctcgactcctcaattcatcgancgcaaggttggtgattccgttgaggaataaacgccgcgtcctcaatggtgaaggaacccaaccttggccgctcggtgccaaggagtcncaagccggctgtgggacgccatggcctccaatcagcatcgccgcgccanccaaggccggagttaaccgtacaanctgtgaaacgggtccccaggccggtggcctaacttccccngggcccggnaaaggtgtttccatgcgaatccccgcagatcgcggggctgctcggcccctgctagtccagccccggccccccgcccc

SEQ ID NO: 21350 - DNA, 701 bp, Triticum aestivum
  unsure (1)..(701): unsure at all n locations
  Clone ID: PAT_TA_21350
gccggcgctccatctttcgctccatcccttactcgcgctcggcacaccggctctcagggcggcggcgctcaggctcgggctctcaagcgacggcgtcaacggcttcccctcccgcctccggtcctccgcacaccggccggtgaccctgctgaacagtcttatggcggcgagcgcgggtgaagagccagggggtggaaagactcctctcctatgctgaagatctccgtggctgtccttttgcgtcaagcaccgactgcgacgacaatgcacaggccggtgcccgggagtgcaagagctgctgtctgcctgtccattccgagtctgacgatctccgaatgcactcnaaagagtatcagggaaaatacatccctggcaaagaaagattgacaaagcaaaggtgaaacattactgacgatgaatcaatgcactacaaaccagatgggagaaaactgcaggaagagacactcccccaagagtaagatgtacatgatgactggatgactaanaagcaaagatttataaaagaagaaggacctgtaagaagaaaagaagccaagaagcagaagtagcttccgtgtgtcgtcgtacccatttccactgtgagcttggtggttccgtagatgcacaattagtaaancccccattattacaccgaaattcgntaattnttagggaacttcnaatcngggnttcccnaantt

SEQ ID NO: 21351 - DNA, 635 bp, Triticum aestivum
  unsure (1)..(635): unsure at all n locations
  Clone ID: PAT_TA_21351
gccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactgggtactacatcagggctgcatccattgcaaggaagatctacctaaggcaaggcatcggtgtgggtggtttcaagaagatctacggtggccgccagaggaatggtcccgcccacacacttctgcaagagcattggtgctgttgcacgcaacaccctgcaccactgcagattatgggcacatcgattccgattccaaggtggacgctcatcaacaaacaagggaaggctggtctggacaangtggctggaaaggtccctgttgaacctgacatgtcaccttggttnaatggtgtatttgatggtganaaggcncgctcaattctctttggtaggattcanttaaagacttaggttattnatcacttgngcaacatttcccntacnagtatncagaccanttcaaccaaannnttcaaaaaaaa

SEQ ID NO: 21352 - DNA, 674 bp, Triticum aestivum
  unsure (1)..(674): unsure at all n locations
  Clone ID: PAT_TA_21352
gctaaatccgctccattccctcgccctcgccgatcgccggatctctccctccgcctcgcttccgccgcacgccagggcgcacggcttcttcctccgctccctcgcctcagcgcagttcctatggggttcctgcaaagcactttttcgctgttgatcggcaccggctgcggcatctacattgcccagaactacgacgtcccaaacataaagaagctcatgaggagcctggtgggcaaggccaaggaggttgaggagtcatacaagaagacgggcaacagcaagaacaaggataacgaatagcgttgacccgcagtctgcggtccaccatctaggaaagctaattgttgcaagattatctgattattgggaggtatactaccttgtacgttgtaccttggtaataccttctgtcnacttatttttcccctaaaagaaaatatgagatggatactggaactgcggctaccctgccccggattgaatcngtcaaattggaatacaatttgaggtgaaaaaccggcggggatcatgctttggatataagtatgtgattatttaaaaaaaaaaaaacnggtccaaaaccaaacangaanaacggcccactcngggtttcggggccggaaatacctgaaagggggnnnacccaaaaatntnccggggacntnattagtntg

SEQ ID NO: 21353 - DNA, 587 bp, Triticum aestivum
  unsure (1)..(587): unsure at all n locations
  Clone ID: PAT_TA_21353
caagggcgcaaccaataatagcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggattcggagggaaaagctgctggctgccattgcctgtattcggttggatccgtttaaatataatttaagtactttaattgggtccaaacagtcattgatccatcattcattgcttgccattctccttttccgttaattccatattaagaggggagaatgggagaccatcgttgggcatacagtggaatcataataccatggtagtaaaaaaaaaaaagntaaacnagagcccacgattcctccaanatnccancgaatggaagg

SEQ ID NO: 21354 - DNA, 823 bp, Triticum aestivum
  Clone ID: PAT_TA_21354
cttctctagtagctaccactttactgaccagtactctagttgttttctccaggctctccctcctttttccttgttcgagatgatatacctgcctatcgtaacttctcttccagcatcagaaacacttggcctcagctccatgctaactgagttctccggacccaacggacactttttgcactcacggtcctgactgcagttttttcatccgagaaaagttctggacgatcgagagatgtcctaaaatcactgcaacatcatttccgttgaactttacgagcctttcgtctctcagagtgttgagaatatcatactgcccagagctccaatctttaccagcgtacggtccgccatcctcattggaaacacttgatattattgggtgccacccggagttgtccaagccaagaaatgaccttgtgacgaatgatcccggcggccggcccctggcgcccacacatgccactcacccctccagccccccccggctgcgggtgatggtgaggcagccggcgcggcgcccctcgaacccccacgcatccctcccacccctcgtagcccctcctccgcctgctattgatgtcaattacgttgaaacttgctttggtacctagtgtgctgattcagtgacagacttgctttgggacctagtgtgctgattcagtgacagacttgctttggtacctagtgtgctgattcagtgacagacttgctttggtacctagtgtgctgattcagtgacagaatattttgcagggagagatggcactgcaaacagcgaggccacccaaacacaaccttggagcatctctagtagaatcta

SEQ ID NO: 21355 - DNA, 580 bp, Triticum aestivum
  unsure (1)..(580): unsure at all n locations
  Clone ID: PAT_TA_21355
cagggacagcaggggtacggccaagcgccgaacgtgcagttccctcctgccgcttctcctccatacggccaggcgcccaacccgcactacccacctcctccggcacaaggctacgcacccaaccaccaccaccaccagcagcagttcccacctcctccggcgcaaggctacggggcgcacgcgccgaaccagcagcaccctcctcccgctcatggctacggagcgcacgcgccgaaccagcagtttcccccggcttctcctcctcctgctcatggctatggaccgcacacgcctcctaatggacacgaacaggtgtaacgcgcgccgtctgatcaaccatgcatccgccgtgctacattccgtgatttccgattgttttttccccatgtaacatgtgtatctcttgtactctccatctccaatgggaggcctgtattcctgtgttacttgtagaggttcagcaaagcttgtttacttcccttcgtctgcagtaaatattctggtttataatcttcaanaggagagtaaggaacgcggcaattaaatatacntggcttaataatgtctttgtactaaaaaa

SEQ ID NO: 21356 - DNA, 534 bp, Triticum aestivum
  unsure (1)..(534): unsure at all n locations
  Clone ID: PAT_TA_21356
cctccctcaaaccagacgctcgccccccatttccccatctctcttcttcttcttcttcttccccatccagaggaggaaggaagaagaataagcaggaggcctctcccccccagcccagccaccccgtagcgacgacggagggcggaagaggatgagcgcgtccaggttcataaagtgcgtcacggtcggggacggcgccgtcggcaagacctgcatgctcatttcctacacctccaacaccttccccaccgactatgttccgacggtgtttgacaacttcagtgctaacgttgtgggttgatggtaacactgtcaacctcggcctctggggacactgcaggtcaagaggattacaacagactggagaccactgagctatccgtggagctgatgtttttccttccggctttctcactgattagttaaagccacctatgagaatgtttctaaagaatggggacctcaactgaaccattatgcactggtgtgccaataattctcgtaaggacaaacttgttcttcnagatgacaagn

SEQ ID NO: 21357 - DNA, 589 bp, Triticum aestivum
  unsure (1)..(589): unsure at all n locations
  Clone ID: PAT_TA_21357
aaggcttagcagtaagcatggttctcgcgtctagaggggtgtccccccaaaaggcaatgatgtggagtatcattacatctttaccacaggtgcagttcttaacttcattttctgagttgaaatatgaaataatctcatcagtttattgtctttattcttgaaacattatgaaaagcgtaccaacttttgagttatcttgatctatttgcaactatgaagggacaaaaatcaacctttgttttgtgggaattttaaattaactatgttgttttctttctcccgggtgtctgtgactctatttattcatgttcatgtgcttgtttgtgcaaacgagtgatccagtgtagagtgtggatagacaggataacttgtaaagtggtgtaagattaaggtgtaactttgctgtgtattgatgaacgtgcctgtgaggctttaataattaaccatatatccaattacaaactgaaccatagtggtattaattagtagcacaacgtaatatatgcaagggcaatgggtgtttctcaacctaaagcactccaagaatgtcgtcctncggtccgnaatntcaaaaattncagtnaaaccg

SEQ ID NO: 21358 - DNA, 865 bp, Triticum aestivum
  unsure (1)..(865): unsure at all n locations
  Clone ID: PAT_TA_21358
tgctcctctaatctcacatgctcatgcatcctcctaatgtaacctgaagctttaagaaaacaaagtgctcccggaagactccaagctgcagctaccggccttcctctcccccattccaattccgagaacaggggcggcggagtcaaccaggtacgatgtgctcggtagcgaggctggcgtttgtgcttgcactggccatagccgcctcatcaattacggttgcggagagcagagattttaatatctttgctcagggcagcttgcctgatgcaaccaagggatcgtcaggtctagctgcaaccagtggaaagttgtgtcagttatgcgagcagtactcatccgaggcgctcctctatctcacacaaaacgagacccagactgagattcttagcattctacaccatgaatgtgccagccttgccccactcaagcagcagtgcatcacgctggttgactactacgtaccccttttcttcttggaggtctccatggttacccctgagaagttctgcgagtcgatgcatctctgcaagaaggggatgaagattagcctacccccccgggggcggtcgtggggctcgtgccgccttgttgctgctggctttctcctcatcccggaagtcccccccatgcagctgggagttttcgacctacgcgccaaaacatgcagcaaggcgcagaactatgaacagcagtgcaagcggctggtcctcaagtatattccactgattctggtgaagggcaaaaattccttgagacaacggatgtctgctctgtgatacatgcatgcaaagcaggcacacaagcatcaatggaancatgcctcgtctgcatgttgtgaaggtgatgcnatcanaataagntn

SEQ ID NO: 21359 - DNA, 594 bp, Triticum aestivum
  unsure (1)..(594): unsure at all n locations
  Clone ID: PAT_TA_21359
cgtcacactctcgctcaaagctcaatcttgcttttctgcacttcactcgtttttacaagtcagaacttaattaaaaacctccccaaatccttcaaaatggttgctatcaaggttgctgctgctggcctcctcatcggagctgccaccgcttctccctactacgcccctccctccaacggcaccacccactacaccactgaggttgtcaccgccatcacaacctactgccctggtgctaccactctcacctacgggtgacaagacctacaccgtcacctcctgaagaccaccttgaccatcaacgactgccctttgcacactcagctaccccgtcaagcccacaaagcccgttgtcctcaacccgntctacacaaccgaggtcatcaccgccgtgactaactaatcgccctgagcccacattctgacctacggaacaagacgtcctgttacgcccccggaacgtcacgtaaccgccgcactttcccacccccccgcttcgagcaccttacctanncaatccgggaanccggtaacccggtaacnntccgcntccggaagctacacgntgtccgtccttctacngaacggtacaat

SEQ ID NO: 21360 - DNA, 641 bp, Triticum aestivum
  unsure (1)..(641): unsure at all n locations
  Clone ID: PAT_TA_21360
ctaagctgtatggggttaagctaaccatgttccacggacgaggcggaactgtgggaagaggtgggggccctacccatcttgctatactgtcacaacctccagaaaccatccatggatcacttagggtaaccgttcaaggcgaagtcattgagcagtctttccggagaggagcatttgtgctttaggacactgcaacgtttcacggctgcgacccttgaacatgggtatgcaccctccaaatttcgcccgaaaccaagaatggcgtgctttngatggatggagatgggctatcgtccgccacaaaggaataccggtcaatcgtatttngaggaaccgcgctttgttgaatacttcccgccttgcaacgccaagagatgggagtatggcaggatgaacatccggagcaagccaccgaaaagaaaccgagtgcgggcatcaatccctgcgcgcaacccttggttctcgcttggacgcaatccngtccaactgccggtgtgccgggtccgcgcgcgtcaaacattctggacaaaggcatacggatctcagacctcaagaattcaacatggcctttnagggacaaaactgtcaaatgggtcncaaggtgtctgaaccggcttcaaaantngnccaagttgtggata

SEQ ID NO: 21361 - DNA, 535 bp, Triticum aestivum
  Clone ID: PAT_TA_21361
cagttttacagctgaaaaacaggacccatgctatctaccagtggaatagaaacgatgatgggaatcctgttccagcagacaccgtaatgttccataaccaatattggacgagcagcacgcgccgcaggaggctgaagaagaaccatctccatctcgaggaccttgaggatttgatctccctattatagaaaaccgggttcgcaggacgcatgaactgtgtgtgggggaataatcgcaggttagcactgttgctagtgtgcccgcctctcttggaatggaagcagcagagccagctatcagactgggcagttgaccaccacctcctcaagctacctgggttgcatgccacagttctgaaattctgaaatgctgtgactgtgactgtgaggtatgaaaaaacagtgtaaataccgcggttgcctccgtacatgtgtgacatttatacacgtgcaagaaacatcggtgtcaccgttgtccgtgaacatttcgcttgtatcgctggtgccaatggaatccttcatctaaaaaaaaaaaa

SEQ ID NO: 21362 - DNA, 726 bp, Triticum aestivum
  unsure (1)..(726): unsure at all n locations
  Clone ID: PAT_TA_21362
tcccctcccaacccactagctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaagatcagggagctcacctccgtcgtccagaagagttcaacttccctgagaacggcgttgagctttatgccgagaagtcgtcaaccgtgggctctgtgccatcgcgcaagccgagtcctccgttacaaactcctccgtggccttgccgtccgcaaggctgctacgtgttcttccctagttatggaaatggtgccaagggtttgaagtatcgtaatggaaactaaggccaaagagcaatcataatttaagnggggacttgcttcggccccagcatgatcatcaactccccgtgtaaaacttcttcaanaggggttcttgatcagggaaattagttanggaccagggaaggtggcccttaacccttcggctggaatcaanccaggaagaaacncccccgtttgacccgggtaggcaattctaagattttggcaaagtttctaagna

SEQ ID NO: 21363 - DNA, 751 bp, Triticum aestivum
  unsure (1)..(751): unsure at all n locations
  Clone ID: PAT_TA_21363
tttttctcaaatcccaccgcttgttccaatccaacggaccagatcgctccaactaacccccacacacaaaccctagtcagctccacctatatagcctcttcccctttcgccgcgcctccattcgcaccaccgccgcgccgcccaaaccctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggccaccagacgtcggccgatcctggggtaccggccgcgccgtgtctccgtatcccccgcgtccccggcggcggcaccaccgcgccggcaagggagcgttggaaattcccgcgggggcgcatttcccgcccaacaagattgtgcgcagattggaccgccgcgtcaaatcaactccgccgcgcgccgtngctccgcgctcgccgcaacgccttccggcctcttcaaagcgcgcggcacgatcatcttcccnagccccctgttctcccggcccggatcatctcaggctccggnctaaattggcgaactgccgcagccgccctaggcccccgcgggatcgcccgtaggtaaggcctctctagtacgtaggccgttctatccggcaggtcaagctag

SEQ ID NO: 21364 - DNA, 368 bp, Triticum aestivum
  unsure (1)..(368): unsure at all n locations
  Clone ID: PAT_TA_21364
caatgaggagatcatggagattccgaagctggcaactgccatcaacgatctgatgcagagccatttctcggagttcctgccttactctaacgcttatctggaggtagagaagctgaagaagtcgttctccatccccctgtaacagcctgttgccctcactcgtccagttgaatggacgaggaagtaaataaaggtgcccaaatactagatgttttgcgttgaaatctaacttgtgctgggtttgatctgttacgtcccaaatttttttgttcattgttgttgttgagcatggggacacgtgcaggaatgtcttgtgtccttttacccaataaaaaaaaaccaaatatgcnaaatgttggnaaaaaaaa

SEQ ID NO: 21365 - DNA, 725 bp, Triticum aestivum
  unsure (1)..(725): unsure at all n locations
  Clone ID: PAT_TA_21365
agaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttgggctgcaggaaccctgaggagatcccatggggttcggttggcgctgaatatgttgttgagtctactgggtgttttcactgaccaggagaagctgcagctcacttgaagggtggtgccaagaaggtgtcatttctgctccaacaaggatgccccatttcgttgttggtgtaacgagaaggatacagtctgacataacattgtctcaatgcaactgacaacaacgcctgctcgcttcaaggcacatgcaagtcgggtgggtgggccagacccctgttcgcacatgccccagacgttgtgggcccctacgacgggggggaggggcacttataaatctccaggggcnaagggtgnaaantccnccccanatanggantttttcacannntttttttnnggnaacccccaaaanagggnggg

SEQ ID NO: 21366 - DNA, 865 bp, Triticum aestivum
  Clone ID: PAT_TA_21366
gagacccaaccataccagcggcgccgcaggctgacgaggaggcggagtagagtggccggactacctcgacacctccactgcaaccatgggtatctcacgtgattcgatgcacaagcgccgtgccaccggtggaaagcagaaggcgtggcgcaagaagcgaaagtatgagcttggccgtcagcctgctaacaccaaactgtctagcaataagacagtgaggagggtccgtgtccgtggaggcaacgtgaagtggagggctctccgattggatacaggtaactactcgtggggaagtgaggctcttacccgcaagacccgcatcctggatgtggtctattttgcgtccaaccatgagcttgtgaggactcagactcttgtgaagagcgccattgtacaagttgatgctgctccattcaagcagtggtacctcactcactatggagtggacatcgttaggaagaagaagtgcctgttgctaagaaggatgcgactgagggacaggaggttgaggctatagcttgaggaaacaaagaagagtaaccatgtgcagaggaagattgagaagcgcccgcggcgccgtccacccgacacgcctattgaagggcatgtggccggtgcgcctctggtggcccgctttgctgcccgtcctgggccctgtggccgacctggtggctacggcctcctgcgtctagagctcgactcccgcgggtagacgctccagtggcggaagggcgcgccccctgcttcttagagcattcttttagctagaactgcaaaatatcttctacttgggggttttgttgttagtctttatgcatatcatttgcggacctgatgaacacttcataagtgaatcaactctcga

SEQ ID NO: 21367 - DNA, 623 bp, Triticum aestivum
  unsure (1)..(623): unsure at all n locations
  Clone ID: PAT_TA_21367
ccgcgagccacagctagcaccaccaccttgcaccgcacccgcaccgagacgaacagatcgaccatggctgccggcggcgacgacaccaccatcgcgcaggtccacagcggcatcgacagcagcaacaagacgctgctcaaggagcgaggccctctacaagtacgtgctggcacacgtcggtgctgccgcacgagcccggagagcatgcgtcgagctgcggttgggtgaccggacaagcacgagtgggggtcattgcatccgtcccccgcacgaagcctccctgctgcggatctgatcaagcttagccgggcgccccgcggacgctggaggttggcgttttcaacggttatcccctgctggcgacgtcctcgcgctgccgcgccgacggaagtcacccattcaacgtcacctccgactatacacatcgccgccattcatcaccccccgggtggcggcaaggtggcttccggaaagggcccgcctggccactggcccactccccccggccccggcaacaccggcccttgcctccttcgctatatcggtcacagaatgtcnctgtcctcgggtacncttcaaaaacntggcgtagtggttcccaggcgtagctnacgagnttccca

SEQ ID NO: 21368 - DNA, 514 bp, Triticum aestivum
  unsure (1)..(514): unsure at all n locations
  Clone ID: PAT_TA_21368
cgcccctctgcttccttttctctgtcgctcaaaagttgctggagccctcttctctctctcctctccgagccccaaccatggatgaggcgcaagttatggagtcaaaggatggaaccatctcagttgcttctgcatttgctgctcatcaggaagctgtgcaagacagggatcacaaattcttgacaaaagcagtggaagaagcataccgaggagtcgattgcggtgacggaggtccatttggagcagttgtcgtccgcaatgatgaagtggtagttagctgccataacatggttctgaagcacactgaccctactgcgcatgctgaagtaactgcaattagagaggcttgcaaaaagctcgggaaaatccagctcgctgactgcgaatttacgcngtcctgcganccatgcccgatgtccttggggcaattaaccctccccaatcnaagagcgggttatgggccaaggcggagggtggcatcccattgggttcacaacttatgcaaagccccgaa

SEQ ID NO: 21369 - DNA, 735 bp, Triticum aestivum
  unsure (1)..(735): unsure at all n locations
  Clone ID: PAT_TA_21369
atcgtaggcttctctacgttcctacccatctcagctcgatcttcaagaaagaagaagcaaatagagcacacagtcgagtgtaaaccatccaaccaatcatggcttcgagttccaggagcaccgtgttttcacttctcctcctggtggcgctgctgctcagctgcagcggcatgagcagcgcggcgcggttgctggaagaggcgccgcccaaggaggagcacccacatcctgccgtgccggagctgccagaacctgagctgccgccgcaccctaccgacgtcgtgccgcctgagctgcccaaacccgagttgccaccgcacccggccgttgtccccgagctgccgaagcctgaggtgcctcatccggtgccggagcagccgaagcccgagctgacaccgcacccggcggccgtgccagagctcccgaaaccggaggtgccgcacccgacagcgtccctgaactcccgaaacagagtgccgcaccaatgccggactgccaagccgagtgcacgcaccgacacctcctgactccgaaacctgagtgcgtacccgtgcggactgcccaaccgaccacgggcgcccccgccgcttgcgggcccccagtcgcagccagccccgaccacacccccaaccagccaccccgctcaccgtcccccggtcacgctcgaggccccgcgccatccacccccgccaaccgcagtccgcatcaggaccctgcccacgcacgcggcggtgn

SEQ ID NO: 21370 - DNA, 615 bp, Triticum aestivum
  unsure (1)..(615): unsure at all n locations
  Clone ID: PAT_TA_21370
tccgcctgtcgcgcaggcccattcgctactaccaggctggttcctcggagatgttcggctccacgccgccgccgcagggcgaggacacgcccttccacccgcgctccccctacgccgccgccaaggtcgccgcgcactgggtacactgtcaactaccgcgaggcctacggtgtcttccgcctgcaacggcgtgctcttcaaaccacgagcccccgcgccgcggcgagaacttcgtgacgcgcaagatcacgcgcgccgtcggccgcatcaagctcggcctgcagaccaaggtcttccctgggcaacctctcggcggcgcaaggactgggggtttcccgggggactacgtngaggcaatgtggctcatgctgcaacaagtttagccggccgactactcgtcgccaaccgaggatccaaacagtcnaagattctgcaagctgcctcgggtacccggctcaatggaagataagtggtcattacaagaagtantcgcccgcagaatcacactcaaggagatcacaagnnagaatgctaaatgaaccaaggtggttagaactcttaaagangntnttcacttacnccagaggnaagnctgtgatctggtactaccaacag

SEQ ID NO: 21371 - DNA, 811 bp, Triticum aestivum
  unsure (1)..(811): unsure at all n locations
  Clone ID: PAT_TA_21371
ctcgtgccgaattcggcacgagatcgcattaggattgctgtagaagcagcaggggcacttgcttatctacactcggctgctgcaataccgattttccatagagacgtaaaatcgtctaacatactaatggatagcagcttcgctacgaaggtttctgactttggtgcttcaaggtctctttccctcgatgagactcatgtggtgactattgtccaaggaacatttggttacctagatccagagtattaccataccgggcagctaactgaaaagagtgatgtctatagttttggagtaatacttgcggaacttttgacaagaagaaagccaatttttgtcaatgatcttggtggaaaacaaaacttgtcccattatttccgtggaaggattgcaacagggagcaatcatggaaatagtggatcctcaggttgtcaacgaggcaaacccggaagagatgatgatatttcctcacttgcggaagcatccttgagacccaaaggaagagaccgacctactatgaaagaatagatatgaggttgcaatgcccggagaactaagagctagatatcgacatcccctccaatgggaggaccgtcctctcagccttcccggttgcgctgcctgggcagcacttccgctctccacttgcacctaatnataccgggatacacagtgcttgttcagtatcatcgaatacaattattcatggagttgatagtattataaangtcattaacaatagtcagatttcctcaaaatcaagttattgancagtnatggtacgttnatttttgcanacctnagagcttan

SEQ ID NO: 21372 - DNA, 702 bp, Triticum aestivum
  unsure (1)..(702): unsure at all n locations
  Clone ID: PAT_TA_21372
tagctatattcgattcatgagtaacttaacaaccaacctggacggcaaaagtttacttcacttggtaacatgaggtggacaccgaaagcttgctatctaattttcttctctgtagaggaaaacaagtataccgatagttggacactgaaagttttctaaaattatttttagagttgtatagtgtatacatttataacgtagatccttactcatgttacacctttcttgttcttatggcgaaaacattagcatattaaccatttctatatttttctgttattttcttttaatacagtagtgtccatgcttatagatttctatttaagtgtcaatcctagcatactcatgtcactccccgtcccattttagctctgttgatgggatgattcctgccatttaattttattcccattttatatatcctgattattgcttcattatttatcaactgatgaggatgactttgtgtgcactcttcctggtgatccgcctgttgttgtgagaagacgagacgnntgagtgatattaacctanttgtcattataanggatgagtactaatgacgatatgtgtagaggaancatagnaattacaaacaattcgtgtataggaagctccgtccaacaanttccagagtttaccagcattancgggaattgaaatactggtcnacaaccctagnttttnacaaaaagntntttt

SEQ ID NO: 21373 - DNA, 683 bp, Triticum aestivum
  unsure (1)..(683): unsure at all n locations
  Clone ID: PAT_TA_21373
cttggtgatctacgaagaggatgaattccaggatctccctcctctgcgccctcgtcctcgcctcctccctcctgcactgcgccagatccgacggcaatgacgcgcagctcctcaagggcatcaacagctacaggtcctcgctcaaggtcccggcgctgtccgagaacaagaacgcggcgtgcctggccgagcagctcgcgaggcagttcaaggggcaggagtgcaccaacacgacgggcgccaacaccgtcatcggcaccgagcagcagttcccggactaccccaggtacctggaccgctgccacctcaaacgcgtcggtgaccgaggacggccaggtgatgccggcgtgcgtgccgggcctcgcccccgccgtcgtcctcgccaactacaccaagtcgcaatacaaccggttcctcaacgacagccagttctccggcgccgggattccagcnaaggcactgggtcctggcctgctaacacaacacggatccgggactatcgccggtccgccggctcaatgggcgtctcgcggtcccgccgtcgggtacgcgccggtccgggggggtgggtgggtgtttctgngattcatgtcatacctcccctacnttaattaagncctggttaaaanttttcctaagtgttnaaaaattntttttnaaaannccccnccatttggaaaaaa

SEQ ID NO: 21374 - DNA, 750 bp, Triticum aestivum
  unsure (1)..(750): unsure at all n locations
  Clone ID: PAT_TA_21374
agtgcaacttccagtttgccaaaacttctgccaaagagaacaagaagtcacttgggttagacttcaaccccggtccctctgctcctcgtgccgatggcacacacgatgctgaacccaatattgttgggcccttctacaaccttgaaggtctcatcactcacattcaggttcaaggggcagccgtggatcactctgcagatgacgttgattctgacgaagcgcctgcaccactgaagcctgtgaagcaaaagaaaccaaaggcttcaaagactccctccgcaccaaaggtctcacgggcgaacctctgggcactgcactccctgaagccattgttgcattctgaagatctctcctcgcatctccaagtctgacaagatgaagaacccatgcaaccaactgggccaagcattgaccctgctgcatactgaggaatgataacgaaccattggtcgtctaacgacgacgatcttggcgatgatgccctgaaccgcttataaagagaaacaacgggcggaatctcaatgatctcccgtattgatgtgagatctgtcaaatcaatgataatggttgcaaccaaactcagtttgtgatctcaacccaattgctcagtccctcaaggtgcagtgccccaattgccctgaaaaagtnttactaaccaggtgttgtaggcgtttttccatccatgcaactactganctcaattagggancgntaccaggggatcaanaactaaacaagtcagggggcgtc

SEQ ID NO: 21375 - DNA, 645 bp, Triticum aestivum
  unsure (1)..(645): unsure at all n locations
  Clone ID: PAT_TA_21375
gagagagagagagagagagagagagagagagagagagagagagagagagagagagagagagagtgagaggcactcgttcccataaaagcatcagagtccacaagtacncattacncagggaaatgtacattactcagcgaaacagcagctgagtttcgatacgacgcgatgccaagcataaaccccaatccaaatccgtccccaacactgcccccaacaaacaaacccaagctaaattattcactgcatgcaatacgccaagtacatgcacgagctcacggattacagaaccaaatgaggcgcaaactttggtgcccaaatgaccaaaacagaacatgacgaacttttagaagccctgctccgtcaggtaatcgccgagcctctccaccaccatgttgcattgccctggatcattggtcgtcgtagacaccaataatcaaggacatccggtttcttganaataatgccccagtgccttcttcctcgggtgacactccaggtcacttgggntacatgtacttgtcctcaacgaaaagacattgggcaaganacaggtcacaagtcttagatacagaactcncaggttaccgggaactccgcnggccaagctgctttacgacatgnggggctaaacgtctccttccn

SEQ ID NO: 21376 - DNA, 1718 bp, Triticum aestivum
  Clone ID: PAT_TA_21376
cagtccctacttaatgagcttcaaactgtagaggaaatgaagcgacagtgtgatgaaaaaagagaattgttcgaagtcttgctaaatgcgcagaaagagaaggggagatctaagaattccaaaggcgatccggctgcgtcacagcaattgaaacaagctcaggaagattatcaagaggaagcaactctttttctgttccggttaaagtcattgaagcaaggacagtttcgaagtcttttcacacaagctgctcggcaccatgccgcccagttaaatttattcagaaagggtgtcaagtctcttgaggctgtggagccacatgttaggcttgctgccgagcaacaacacatcgatcatcagttcagtgcacttgaagatgaggattactctgttgaagatgaaaatgatgacgactaccatggcagtcatgatggagaactctcttttgattatggagaaagcaaggaaactgcagaagctggtcatgcttcccgtagtcctacagaggatttttttgatagaagcaacggagattattcctcttttcctggtgaaagacaaagacctgtaagccagtctgctccactttttcctgagaaaaagcttgagacagcagaaagagtaaaagagctgcggcgttctgcaacgaggaagttacatacttatgttttgcctactccaaatgatgttcaagccacctctcagacagtcgcgggaaatcctacgagtggatctcctatagagagcaaaagtgttttccattcatctccgctcaacccaagcacacatatgggagatttgagagacaataagctaccaagtcctgccagattatctaatgcacagtctgtgctgaaagaaagcaataccaatacagcagaaataaggacaatgctcccagttgttgatccggctttaccaggctataacaatttgaagacttcttctgacaacaaaaaagtgaagagggggtccttttctggtccgattcctctccgatcaaggtcaacagagaatattgatgccgccgccgcaaggcacagttctgcacatcagccaacagttcatgtgagagtgtcacccagttcctccccgccacccatatcgtcacccagaattaaggagcttcacgagctaccacgaccgcccactggtgcgtcaagaaatacagcattttctagtttagtcgcccactctgcgccgttggtaccaaattctgccccgttggcatccagaggccactcagggcaggaccattttaattttagggccaggcaaacaccaccaagtgctccacaaactgcatcgcctctaccaacaccgcctgggcctatatcccgtagtttctctataccctctaggggcattagaacaggtatttcagatggcaaagaaacagaagatcatcaagataaaggggccgctagaatgagtctctcttctcttccttcaacacaaacattcttggaggatcgtcaacctttgccagcagctgccgagtcagttagcagaacatagggatatttggtgttaaggtgggattttatatgataatataatatgtcatgctaatcgagaggcttggctacttttttcatggaaaaacaatgtacatactagtatgagaactaaacccatattgcgaagtagctggtggtggttggtgtcccctatggttgagtgtagttgtgcaaataacgagtttgttgaataaaatt

SEQ ID NO: 21377 - DNA, 518 bp, Triticum aestivum
  Clone ID: PAT_TA_21377
gtgaacgcagcccagtcagtgagccccccgatcccgactccggcgatctccccaaccccatggcctccgccggcgaggcccccagcacgctcctccgcttcctctacttcgtcggcgccggagtaatctgcaccaaggccatcaacacctatcgcgactacgagcacaagaaggagtccaccgccgccctcgccgccgccgaatcggcgttggctgctgccgcggcggccgagcccgctcctgcaaccgccgccgcgaagccctgattgtggacgagggctgtcttcggcggttagggtctcggaatgttgctctccataggggagatagatatttcttttgtttctgatgtttcaactacgtgtatgtgctcctttggcttgaatcaatcaattaataatactctcttcctgtctcgtgatcatggtaccgctggcttgaaatttgttacacatagttccctatgatgattaatgttattgcactccgtaactaattatccaaaaaaaaaaaaaaaa

SEQ ID NO: 21378 - DNA, 897 bp, Triticum aestivum
  Clone ID: PAT_TA_21378
ctttcataataatcctacttctgttattgcaaagaccacccacagtcttcattgtgccaaggtctgtattctaccccgcacaagttgaaccccgagatgtacctcgacggggatagtgagggcaagacatactctaccctcagatctagcacaacaaaattacagcaatcaagtaatgataatgctattttacacatcctttaattactaggcgtcatcagcaatcttacacctatgcacacagttaaaccagcagagtagtagtagaaagagccttattgcatctgtacacaaatactagtacgtagaggcagctgctcgagtaccagaatggaaatttccaggtccaattccaaattcgattgtgccgaactagctaattcgatcacttcacttgtagtagtaccatggtgggaggatcactgttctgttctcctcattgcagatcgtagacgttggtgtccgcggcgtagcagccaagaactcggacgaacacggcgaatttctcgatctccttgatggcctcgcggacgagcgggtcgtcggcggcaccctcgcagtcgacgtagaggacgtgcgggaacgcgcgcagcgtcggcgcaccgcgggcgcccgtgtccaggatcatcaccgggggccgcggctcgccgacgcccgcttcgttgttgatgacctccagcttggacatgttgatgttgcgggaggagaaggcggagagcaccttgagcaccaccgccatggacccgccccggtgcgcgaccaccatgctggtcttggcgtccgcgtccacggggaccgccaccggcgacggcggcttggagagcagcaggaagcgggtgacgttccaggactcgtcctgcaggccgtgcgcgaggacgtcgaggccgtagaggtcgc

SEQ ID NO: 21379 - DNA, 657 bp, Triticum aestivum
  unsure (1)..(657): unsure at all n locations
  Clone ID: PAT_TA_21379
cgagaatgaaggatttgtgctgttcacttaacagtgattcattttgtgtttgtgcaggggatcttggaccctgcgttctccaagcctcggggtgctctgacaatatgcacctgccttcagaaagacaccagagtgcgcaatagcccaccccacagtgggctaacagccatgggcccggtccccacaccgatccggggcgccttcacgaccgcaggcgtggttctggagatgatcaaggacgtggaggctgcggtctcaggccgcaagggcaggagcggcacggcggcgggcgacgtcgccttccccaaaggggaaggagaacctggcctccgtgctgaagcggtacaaccggcggctccccagcaagggccagtagcgcgcgggtgtcagacaagcaagcgatcgcaagcaatgttaggaggacctgactaatggtccccaaagggggctgcactggcgccggctcctgaaccntggatttttcgtgcacgacttcctaaggaacgtggtgcccatggccgcctggcccttcagaaggtttttttccttcctcnttcggggttctttgggcttgtaagtttgagggcacanggantccaagnccantttaccaaantncaancgcaanaanttaancaaccnaggaacctttgccaa

SEQ ID NO: 21380 - DNA, 1227 bp, Triticum aestivum
  Clone ID: PAT_TA_21380
cccacgcgtccgctttttttttttttttaaaccaagaatataaccttcctttattagtaggtatacatgagtatagactggggtatacatacaaatatatatcatgtcaggacatctggtaagtgcaccctatgatgatcaatgagtttgacatatcttttaggtacgatcatgatgatccatggcgcactcaagaggagcgtgtgttgccatgagccaggaactctatgaggttgcggttgaagacacatggcctctccagttgtacaagatgccctgctttgcttatgcgtcgcaggttcgccttctcccctagcttgtgtttcagacactcagcatcctctatgggccacatgttgtcattttcaccccacaacaggagtatgctctgctgaaaaacaggggcaaatgcttctgtgtccccgaggactatatcttctatcatctcagctctctccttttggttgaaatacatcaccttaagaaagtccctgagaaggcgatccggaaaccacggcttcatgtgcatggcgtggagtacagcaacctgagctggccaaccgactccggcaccaagagctccgtcagcgattgggcccagccaagcctcctcagcaagtcatccctcatggcgctagtgtacttgacggtgctgccggaggcgacgacggagcggacttggtccggatgcacggccgccagctcgaatgctacgaacccgccgtagctccagcccaccacgtcggccgtaccgactccaagcttccgtagagccgccgcaaggcaccgtgcctggaaggccacggagcggtctggcaacggcgatgtggagccgccgaagtgcaccaggtcggggacgtacacgtcgtagccacgattggcgagggcgctcacctggagcacccacgtcataatgccgtcgccggcgaagccgtgcacgagcaccacgggctggtgcttcttccgctgcttctgcttcctgtccggtgcatcgtcattatcagggagccagaggtttatgacagtgcccgcgtcatcgacggcaacggcgtgctgccggaggccggcgtttgtcgccagacgggcgactaagtgttttcttagcacttgtatccagttcaccatcctatgtatgcacgtacgtggttgctgcttatttattgcttaatggctgttggcaattttatcggggtttaggtaaccacatttttcccgaaaccggccggc

SEQ ID NO: 21381 - DNA, 620 bp, Triticum aestivum
  unsure (1)..(620): unsure at all n locations
  Clone ID: PAT_TA_21381
gatccagatccaccgcaccggacccggacccgcccaacgactccggccactttttacttactagccagcggcggcgaaatccagatctccatagcaccggacccggacccgcccgccccgctggaacaggatgttcggacttcaggcgagcggcgcggcggcctcgtgggtggtggggcggatgggcaccgacgcgcatctctacgacgaccccgacgacgcctccatccccgagctcctcgactcccgcttcgacgcccgacaagtcgacgccctcaagcgcctcctcgccctcatcgcgcaaggcgtcgacgtcgcgcactcttcccgcaggtgtccagaatgtggcgtcgcaatcgctcnaagtcaagaactcgtctactctactcctcaatacgccgacaagcgccaaaacaaccttcnttcnattaacatctccagaagtttatcggtataaaccactggtgaggctgggcctgccacaaggcggcattgcacacttgttgctcgctgtttgggtgcataagaaattgcaaggatcgtcgctantaggaatgtgtgctagcacttgaaccgtcacttattcaanaaatgggtttgngaattgaactgtcacaaat

SEQ ID NO: 21382 - DNA, 703 bp, Triticum aestivum
  unsure (1)..(703): unsure at all n locations
  Clone ID: PAT_TA_21382
ctccccccttcgccgccaccgcgatcttgttctcagttctacggcggcgatacccccctccactccccaccctgtcacccccacaaaataagttctgcggcggcgatggcgctctcctcctcccggccgaagcacctcctgcgccccatcctgcggggtttccacgcctcagcgcgggccctggcgcgggtggagccgcacgagttctccaagcccagcgagtacctgggcagctgggagcccgcggcggagcctcgggaggcgtgggcgcggctggaccggctgcgcaaggggtacgcgagcgaggtgcgggagctgcggcggcagtacgcctacgaggtgcagctgttgcaagccgagcggcagcggaaggccgacccaaggccgaggccgcccgcgccgccaacaaggagcgcaaggccgccaactcgccgccgccagacgcgcgccgccgaacgccgcgcgttcaggaggactcgcaagacctcatgaaagaaaggcgagaaactggagactggcggagaaggagaaccaaagaggagaaagggataaaaaggactctccaagaaaacagttgggtcttaatagatgagacaattaaatgcatatcaacaccctcatagggtgttcagaactaaaatactgcctcatagaggggggngataatangccntacttaatanaacgccganttgtgaagctt

SEQ ID NO: 21383 - DNA, 430 bp, Triticum aestivum
  unsure (1)..(430): unsure at all n locations
  Clone ID: PAT_TA_21383
caccagcagggtgtcccggccctctctagtttctaccccggcccccaacattggcctgatgctgctgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccaactctccatcatcctccgtgggagagaagatggtaatggagtgcgtgtgtatgtatgtgtatgcccaagggcgcgcgccccccgctctgggcgagtcacagtatgagatgcaatatcatgtttccaagtatctttcttacaacacaaacagtggggaaattttttnaaaaaaaaaaaa

SEQ ID NO: 21384 - DNA, 631 bp, Triticum aestivum
  unsure (1)..(631): unsure at all n locations
  Clone ID: PAT_TA_21384
aacagatcctaaaagtacgataactacacgcgcccctgcaaaagacgccatcatcaatagtgggccgtcaagcaccggcgccaaccccatccagatcagagtcggcgacggcctgacgagcccgccctgctctaggagcagcgccggctcgggggctccgtagctgtccgtggctcgtctcaagaatccgcgaaagagtccccggagttgctgggaacctccgacacctctgccgcttngagcagcccgccaagggagccgattcggcgggccatcttcaccgtagcagggtcccgacactttcccccgggtaacatccaaccggcgccgttcccatcgaagacttgtaagaaatcactgaacacatctacccaagtggttacgaagccccctgtcccgctaaccggcatttccccccccccgggggccgccccgttcccctccccctcttttccccctatggcccctcaacgcctacggtaaccctcccgactgccctgctggcccctcccaatgacgcccgaaccctccctccgcaactgccacactgaggccccccgtcgccttccggggccgctacccttcctcccccgccggcatctccggcccgttcggtccctcatcccaattn

SEQ ID NO: 21385 - DNA, 644 bp, Triticum aestivum
  unsure (1)..(644): unsure at all n locations
  Clone ID: PAT_TA_21385
ctcgtgccgaattcggcacgagaagcatccaagcatagttcaggtcataacttaaggtatataatagcagctgattgatcctggtgcctctcgtcgagcgacatcaatggcttctctgtcgatgagcgcggggtggacgccgaagcagaacaagctgttcgagcaggcgttggcggtgcacgacagggacacacccgaccgctggcacaacatcgcccgggctgtcggcggcggaaagtcggcggacgatgtcaggcgctactacgagctgctcgtccacgacatcgcccgtatcgaggccggcaaggtgcctttccccgcctaccgtccaccatgccccggccccggccacaacgccagctacgaggccgacaggttcgaccacttgaacttttagcctgaccgggatccgggtaatggcaaagggatgtcacacgctaagctggccgacccgacgaaagcccttgcatgcgggacgggccctagtaataccgttgcccggggccgatacacactcaatcgtacgccacgactaaccacactagccgggcaagggccgaacttgtatgtcatatatcctggcacccgccgcgacgcccgtcattaacncanggttactaaccnagtacaagtnattaaattac

SEQ ID NO: 21386 - DNA, 741 bp, Triticum aestivum
  unsure (1)..(741): unsure at all n locations
  Clone ID: PAT_TA_21386
acgcagtcggctgccgcagactggtagtagccggcgcgccgtcaccgtatcctcagatcagaggcgagcagaaaccacaccactctactgacgcccgacgagcagtgtaacattttccttcagccatgggtaaggagaagactcacatcaacattgtggtcattggccatgtcgactctggcaagtcgaccaccactgggccacctgatctacaagcttgggaggtattgacaagcgagtgattgagaggttcgagaaagaggctgccgagatgaacaagcggtcattcaagtatgcgtgggtgcttgacaagctcaaggctgagcgtgagagaggtattacaattgatattgccctgtggaagttcgagaccaccaagtactactgcactgttattgatgccccgggacaccgtgacttcatcaagaatatgatcactggcacttccaagctgactgtgctgttctaacattgactcaaccacgggtggtttgaggcggtaccccaaggatggcaaaccctaacatgctcgcctgcttcaaactgggcgtgaacattgattcgctcaacaagatggtgcacacaccaagtatcaaggcctttataaatgtagggccccccccactagtgggtccnaacccatctctcantcgtcaacccggttagggaactntttaggcncaactntnggaaggcaacccttgggcggtttatatcaagnttaaaaccgggccccnaggt

SEQ ID NO: 21387 - DNA, 610 bp, Triticum aestivum
  unsure (1)..(610): unsure at all n locations
  Clone ID: PAT_TA_21387
caacatctgcaggccagacaccacgacttaaatcttttgctaatgatgtggaaggtggactaaaaagaccgttgaactcctagggataaaacaacgggctcatcttgggaacctaaatcctgtagccaccgttctctttgaagcatagaggtttgcacaccgcagcagtttatttctcaagaccagcgggaagggggtgtccaacgaaaggagcttgggcaaatactgtaacggcgactgcctgtgttgccgagcatccacagcagcatccggtgccatttttgggagcaccgttccgtactcaagcgagcttgagccggatgtttccgcaaatagctgtccaaatgttgggggttgcatatcgacctatgccatgcgatagttaacngcccacatgtccatttttcagactccctccggttccttttaactaccaaaggaaaatgaccatgttgtcgttaatccttaatcacttagttatttcaaccgtaggcggcattgctccctcaacattggccatgtcaaacattgtttgcaaggaacagntncanatatgaaggaacaatgtagttcatcgtcaaaaaaactggntccattgaaaaaaaaaaaa

SEQ ID NO: 21388 - DNA, 673 bp, Triticum aestivum
  unsure (1)..(673): unsure at all n locations
  Clone ID: PAT_TA_21388
gtcgcctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatggcgaaaaagctgttgtgcaagcctttgaaggaacttctgggatagacaacaaatacacaaccgtgcagtttacaggcaagttttgaaaactcctgtctcacttgatatgcttgggcgcatttttaatggtctgggaaactaattgacaaggcccccgatattcccgaacctacttggatacccgggaattctattaacccaatgagagaactaccagaggacatgtcaaaccggataccactctgatgcatggccgggccatggccacgtcacgggggcgcccaggcaccccggcaatgccccggggctcacagtgggctgaacccctgggggaacntctaggngtaaaaacttcattttcnatgattaatgaaa

SEQ ID NO: 21389 - DNA, 695 bp, Triticum aestivum
  unsure (1)..(695): unsure at all n locations
  Clone ID: PAT_TA_21389
gtcatccagtgcaagctcccagtcccagtcccagtcccagtcccagggtagtagaggactagaggcaggctagagcaaagcacgcggattgcgtggctagcgcaacaatggcgatggccacggccaagctcgtccttctcatggtcctcgtggccggcagctccagcggcggcagcgcgtgggggccgctgatgagccgcctccggatgccgacggcgcggtcgcccgtcgaggtggcgaaggagcgcctccaggaggactacgtcgtatcggcggctgcgccgctgatccacgcgctgcggccgctgctgggctccgcgggggacctgggccggcgcgccggcgtgccgtgcgacagctggcgcctggccgtggagacgtacaacaagcgcgattggacgacgttcccggcaactgccaacgctacgtcggcactaaatgctcggcgggcactaacgccgggatcccgcgtcgtcatcgacaangcatcgcctagcccaagggctcaaactgggcggnaacggaaaggggtctggtctcccattacaaaantctctcaactccanatgcancaggntncgacaactttaagcacaactnaacatactctgnggaccccgntcccgancanggtttaaacnctnccggaaaacggttttaggcccnggnaagggtccctnnaccccccggtttgg

SEQ ID NO: 21390 - DNA, 681 bp, Triticum aestivum
  unsure (1)..(681): unsure at all n locations
  Clone ID: PAT_TA_21390
ttccaggtgtccaccttcgcattgaacttgtggggccagcagttccaaggccccgggccggtgtcggcgcgaggatttccagctatccaaattgttccggtgagagctgccagtgtagatcttctattgcctctgagaacttgaattgcagtgcggtgacactgagaatatggaaaggcctctatcatgagagatatggtgatatagtaaaggattcaaatcctcatcttatacttgccccaaatgcgggtgtagctgcttatcctagttggatgcctactattgaaatgattagggggattggagttcctgcaatctttaccgacttctgcgaagaacntgctcatctgggcctcttgctgcataaagctccataaactgggtcaacccctggggactccctatacanggtaaatcctttcaggccgccccgggcggggagcgatactgcgcaggcgtgcccgctactcaccggcgccgttccggaatgggtttttcgttttgccaaagtccttcggcnaatatgtttaatggatgatgtgctctgggtgttccggtatcatgtgtcaaaanagtcgttanatnaccatcaatcatantcnacttgccgttgnaattccanttctctcaaaaaaaggggccgnaccantnccaatgatcntaccccangctcttaatcga

SEQ ID NO: 21391 - DNA, 742 bp, Triticum aestivum
  Clone ID: PAT_TA_21391
cgcctgcaggcaccggccctgcactgtgcccggtactgaccgagcgcgtccgcctttaccgctgcgctccttgcttcgaacctactttaacgctgcctcacctcacctcacctcactcactcaccaagctcccctctctccccctctcgctcagtgagcttgcggttcctgccacacacacgcttcccgccatatatgcccaccaggcagccgtcgatcggaaggaagcaaccgtcgctccatcttaccgatcgccgttacatccgtccaagctcgtcggagtagctacggcgccaacagctgccgggaagatcagggacacgctcgtccagcgtcaatgggacgtccgacgtctgggggcgtgcagctggagcagcccaagctccgcaaggggctgtggtcgcccgaggaagacgagaagctctacaaccacatcatccggcacggcgtcggctgctggagctccgtccccaggctcgccgggctgaaccgctgcggcaagagctgccgcctccggtggatcaactacctccgccccgacctcaagcgcggctgcttctcgcagcaggaggaggaccacatcgtcgcgctccaccagatcctcggcaacaggtggtctcagatcgcgtcgcacctgccgggccggacggacaacgaaatcaagaacttctggaatagttgcatcaagaagaagctccggcagcaaggccttgaccccgctacgcacaaacccatggccgcc

SEQ ID NO: 21392 - DNA, 637 bp, Triticum aestivum
  unsure (1)..(637): unsure at all n locations
  Clone ID: PAT_TA_21392
gctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgccaagctcgcccgctacaacaagaagcccaccataacctcccgggagatcagacttcggtgcgcctcgtccttcctggcgagctcgccaagcacgccgtctccgagggcacaaggccgttacaagtttactcctcttagattgccgccgcacggagcgacggtctgtttcgttcctcgcacttaaggcaatggaaatagttcctcaagggtgccgggaaatcaaaaaatcaatggccgaaaaattatcaacctnggagggtgtttanttggtcaaactaaatttggc

SEQ ID NO: 21393 - DNA, 644 bp, Triticum aestivum
  unsure (1)..(644): unsure at all n locations
  Clone ID: PAT_TA_21393
cgcgtttacacccgccgccactcctgccttggcgccgtagctagcaaaggcgatatccatggcgagccctgcacggatcgagctggacaagctgagcgtggagcagctcaaggggctcaaggagcagacggatctggaggtcaacctcctccaggacagcctcaccaagatccgcaccgccgccacccgactccgagaacgcctccgccgcgctccaggacctatccctccgcccccaaagggaagaagatgctccgtgccgcttacggcgtccctctacgttcccggttcaactgggacgacgccggagaagtcctcctccatgttccgcaccggttacttcaatccgagaaaaccatggcccaaggggaaagaatactgtngaaaggaaatttattttattgaagccaatttttgatgaatgggttaagtggctaacnaaaaagaaaccatacagacgatatgggtttgctactacaagccaacttgagnaaacgtcaccggcccagtcaatgagactggatcaccctcgctcctcnactatgttgtacaaacacattataatttgaatgggtccncacactaaatgtatcttgaacttcgtccaagaaaccttatggttaatttcccgcacacctgactta

SEQ ID NO: 21394 - DNA, 678 bp, Triticum aestivum
  unsure (1)..(678): unsure at all n locations
  Clone ID: PAT_TA_21394
catctgcatcggcaatggacgccgcgccacccaccataaccaagtccccgccgtccctggttccaccagcggggcccactcccggtggttccctcccgctctcctccatcgacaagaccgccgccgtccgcgtctccgtcgacttcatccaggtcttccccgcccctacgtcggggaaggaggaccggagcccctcctccgcgatcgcggccatgcgcgagggctttgccagggcgctcgtgccgtactaccccgtcgccggccgcatcgccgagcccgtgccggggtgagcctgagattgagtgcacgaggggaagggggtgtggttccgtggaggccgaggccagctgctccctcgaggaggcgcggaacctccgagcgcccgctgtgcatccccaaggaggagctgcttcccccgtccgccggccggggtgcgcctgggaggacaccctgctgctcgctcaagttacaatttcattggtggtggcgtgggctggcgcgattcgcgtcttcacggtggggctccatgggcaacgtgcggcacgcttgcccgcctaccggcgggtgcagctggcctagcgccccccgcgcaccgccaggccctcgggtcccgatantttaaaaatnnnaattctgaaananctaggtttnagaaaccaatttcnttngggcccntta

SEQ ID NO: 21395 - DNA, 735 bp, Triticum aestivum
  unsure (1)..(735): unsure at all n locations
  Clone ID: PAT_TA_21395
ctccaaactcccattcactcctcgcgcctcgagatcccatccaaatcccgatcagtcgccgcccaagcctagcagatccgccggcgagcgcgcgggggcaatgggtgtcgtctcggcagcggcggacgcgattgtcgcggttttctccctcaccatcgtcgtcgcggcgccgctactcgacgcgcagtccgtcctcccgcataccctctacccggcgccgctcctgggaactcaaagcgctgggtacgccgcccgagtttggcgactacctccgtggcccatccccccgcttcttcccgtggccttgtttgcctccgagtcccctttccnaatggccgcccgccgtcgccacactcctacggatcctcaacccgccgccgnctgggctgccacaactccctcaatggccggcgttggaccctcacccccttctccaatctccggggggagtttgtgctcgnaatcaacacaaattgctcagattaagttcctaagcgttttgcggcattgcnatcactggacttgtaagctcggaccacnatgcnggtaaaactgggcttcgccgagaaaaggtcaattacatgacnttgnaanttcgttnaatgggcaaanatagnnggaaanatttcgggtagttcaccggattaccgggtaacccaaagtaggggntcaagttggtcntccnagaaancggctatcattcctnnagtnccaaatnttntggcgccccgggtt

SEQ ID NO: 21396 - DNA, 662 bp, Triticum aestivum
  unsure (1)..(662): unsure at all n locations
  Clone ID: PAT_TA_21396
cgaaaacgcgagcgctgcggaacaacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcgcgccgcggcgatggtcgcgatggcgaagagggagcaggagctggaggagatccgggccatgacgacggaacagatggaagaggaggtggtagacctcaagggggagcttttcctgctccgccttaagcgctcggcgcgccaggagttcaagaacagcgagttcagccgcatgcgcaagaggattgctcgtatgctaaccgtgaaaagagagcgggaaattgaacaaggaatcaataaaagattgtctaggaagctgataggaaatggaacagacatggtgtcagacacacatctctaanggggaacaaagaggagttaaagcccaaaaagaggcatgtcaaaatcgtcatgcaatgttcagaagtcctcagattcaacctaatgcttgtaagtatcatgttacatttcaacatgcaccgatccaattattgtaccctcgtaatttctatatttctctcccgtttcataaaaaaa

SEQ ID NO: 21397 - DNA, 777 bp, Triticum aestivum
  unsure (1)..(777): unsure at all n locations
  Clone ID: PAT_TA_21397
cctatccactgcggcctggacgcgtgcgagagacttgacaaagcagcagcagggatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctcaaccctttcggccagatcccggctctcgtcgacggagacgaatcctcttcgagtcccgcgcgatttaaccggtacatcgccagcaattacgccttccggagggcacggacctgctccccgcgacggcgtcggcggcgaacctggaggtttggctggaggtggactcccacaacttcaacccgaacccgtcgccgctggtcttccaactgctcccttggccgcccccccgcggcgcccccgacgcggcggtggtggaaaaccacgcggcacacctcgcgaaggtgctcgccatgtactccccgcacatggccccccacaactacatcgccggggacaattaaagctcccgggcgccttccccccccctcaagctctgaccacccgcccccgcccccgcccgcaagccctcccccgcccccgctctggtcgcatcacgccgcccgcttccaaaanacgtngccgcatcccttccccgcgcctctcctcggtnactcccttcctgctggtccgtnttcgaccgatcaaaaaagcgacttcgattcgcgccattgnnaaactttaaaaaaggngttcgng

SEQ ID NO: 21398 - DNA, 523 bp, Triticum aestivum
  Clone ID: PAT_TA_21398
tcagaatggttgccgctaagcacgtcaagatcgtcaagaagcgcacgaagcgcttcgagcgtcaccagagtgatcgcttcaagtgtgtcgaccccagctggcgcaagcccaagggtatcgacagccgtgtccgacgacgattccgcggcaccattgccatgccctctatcggctatggctccaacaagaagacccgctacatgaccccctccggccacaaggctttcctccgtcagcaacgtcaacgatgtccgacttctccttatgcacaaccgaacccacgctgcccgagattgccacaacgtctcgtcgaggaaccgagtggacaccattgcccgcgccaaagcaactgggtgtcaaggcaccaacccaaaggcgaagttaccaccgaggtttaaaaggaaagggatcggttattgggccgcttacggtatcatccggaaggggttgcgttactgcggtctggacatactccatggatgctagagaataaaaaaccgccgttgacgacaaaaaaaaaaaa

SEQ ID NO: 21399 - DNA, 606 bp, Triticum aestivum
  unsure (1)..(606): unsure at all n locations
  Clone ID: PAT_TA_21399
cgtagtggtacncaaccncggttatgccganggggtcnttcccttagtggaatttggaggnaacgtgggcctttggtntanccngtgggaagggnnttttcaaggngtanttggtannccggtttccngttaggacttttaaagacgccnntgnggggttaataggnctntttacgcaatcagctccgcatctagatggtggtaatggaagcgccatgtctgcgcctggctctgagctagagaatgctgcagcagccatgaccaatggccacgagtcatcgagtagtggtgtttaatccagcgatggggtaaaagccacgaggagcatcatcccggagtgatctctgcagtaggcggtcagctgctgtactataattgagttggaggctgcttagatatggaatccttccatttaccttggtgccctgtagttaaagagctatgacagtgctttatcccgtgtcatgtttgcagccgctgcgtctataacgaactatttcttgtcttgaggcgtgactgttaagaaccgttgaagtccactcaaatataaccgtgcagcaacgtcttcgatcaaaaaaaaaaaaaaaaaaaaactcgcggcacgag

SEQ ID NO: 21400 - DNA, 468 bp, Triticum aestivum
  unsure (1)..(468): unsure at all n locations
  Clone ID: PAT_TA_21400
gtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggccgcccggcggcggtgaaaaaaactctcggttgganggaancgcaacctgctgtccgtcgcctacaagaacgtcatcggcgcccgcagggcctcgtggcggatcatctcctccatcgagcagaaggaggaaagnccgcgggaacgaggcgcacgccgcatcaatccgcgcctaccgctccaagatcgaggccganttgcccgcatctgcnacgnatctcgcgctctcgatcnaactctccatccgccg

SEQ ID NO: 21401 - DNA, 700 bp, Triticum aestivum
  unsure (1)..(700): unsure at all n locations
  Clone ID: PAT_TA_21401
gtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaaagaagcggttccgcaaaggcgcaatgcccgattcgtccgagcgcctcaacaaactcgctcaatgatgcaacgggcgcaacaacggcaagaagncatggctgtccgcatcaatcaagcataccctggagattatccacctgctcaccgatccaacccatccaagtcgtcctcgacgcgttatcaacagtggcccccttaggatccaccctatggtcgctggtttgtgaggaggaagcgtggctatccaccctgacgaggtgaacaagcacctactctacaatggtgcaaggaagtgcttcggaaatcaacaccgcaatgctgaaatactctaaacctgcaaggtatcaaattcgcacagaaaggcaattacctttcaagaaccctacttccggtccgggacccgcgatgtctttccctgcgacgtcnttcagtaattttncaanggttgttatataatcggagttt

SEQ ID NO: 21402 - DNA, 599 bp, Triticum aestivum
  unsure (1)..(599): unsure at all n locations
  Clone ID: PAT_TA_21402
tggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcgggcagcgtcggcagcccgttcctgggccagtgcgtcgagttcctgaggcaccagtgcagcccggcggcgacgccctacggctcgccacagtgccaggcgctgcaacagcagtgctgccacagatcagcaagtggagccgctgcacggtacaggcgacatacgtgtggtcctgcattcctccggcatcaacancgcaaggcgaactcccgcgctatggngncaagtanccacaactgacgggatgtcggctgaactgcacaacaagtcccgncntgaagcaatgccgggngtcacacgggaananntcgtgaaaagtntg

SEQ ID NO: 21403 - DNA, 802 bp, Triticum aestivum
  unsure (1)..(802): unsure at all n locations
  Clone ID: PAT_TA_21403
gtctctacccttgacgaaggaaaaggcagccttctcaccgtcggacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgatttgcggaccatggcagtgctgcttcggctttaacacaagcttgtcatcaattgcggttgcattctccgtgaacgtgcattatccggtcagagttgttcttgaaggttatgaagcaaaacacagaggccatcacaagctacgaaatgcttgatgcggttcgtgttgctcttggtatcctgctgcaaatggtggttatagctacaactaccagactcctgcagaatatgtctcctcccaagagagcttcatgaatgctatgacattttagctttgtttcaangtangtaagggatacaaacttccgagttaaaaatattggccaagtgcgatagcctgtaccgaagatgctactggtgtacaactgtcaagaaacngtggtttacttggtttcctccttttggttttggtttctctccccccggttccgggatcttgcgttggccnctgtccttggcaactttgcaagctaaagntaaaaaaacaac

SEQ ID NO: 21404 - DNA, 553 bp, Triticum aestivum
  unsure (1)..(553): unsure at all n locations
  Clone ID: PAT_TA_21404
taggcgggcatggcccgtntttagacnccatcccccagatccccgtcggttgaggaatcccgacngcatngacaggtncttgcggtgttggaccccaacatcctctgggtgacccccgactgcgccctcaggacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactccgtctgtggttaggttagtagttttcttgatctcgcccccacgcggtacctgttttactactctctgtttgggtggtttctgaggaagttgcccgtgtacttgtatccgtaaaaaccgagtgggacatctgcatcgtttcatctgccaacaatcccccgaggtgtgctgtttcaccgctcaaaagaaagatgtcctatccggcaagctaaatgctccaaaaaaaaaaaaaaaaac

SEQ ID NO: 21405 - DNA, 485 bp, Triticum aestivum
  Clone ID: PAT_TA_21405
ccagcgctcaagggtctggtagtggcgtcggttctggctctgcctattctaacaggtatccgtatgggccaagatatgcaggtgcaactgctaatggcaacggtggcggcacggggaacagccagaatggcggtgctggcggcggtaaaggttctggatctgggttcggcgatgccattccctgatttctgtatcgagtgaatctaaagctggagcccatcgccctttcttgttttggagtcacaggattactgtttttgttttgttttttttcttttctagctgtgttgtgcttttgttagaatttgaattaataaagggcccggctgttcaagtaacagtagcagtctaagtgtaagcctgtaaaggtgcagcttaatgcgaaagatgtaagcctgccagtttaatgaaaagaatccatacccctttgtcatttgggccactatatatatcctgaaattttttttaagaccaaaaaaaaaaaa

SEQ ID NO: 21406 - DNA, 568 bp, Triticum aestivum
  unsure (1)..(568): unsure at all n locations
  Clone ID: PAT_TA_21406
ggtccgtaataacggggccacnggtacggctgcaagaagacgacagaagtcgagggcatcctagaaggagtccaccctccactttgtcctccgccttcgtggtggcatgcaaatctttgtcaagaccctcactggcaagaccatcaccttggaggtggagtcctctgacaccattgacaacgtgaaggccaagatccaggacaaggagggcatccccccggaccagcagcgtctcatctttgccggtaagcagcttgaggatggccgcaccttggcggactacaacatccagaaggagtccacccttcacttggtgctccgtctccgtggtggccagtaagctcctggcgatggagctctgcttctgtttctgtcttcggtgtcctccaatggagtctggtctgtgtctgtcgttgcctgaactgtctttgtttctatatatccgtactgtgatgcagtgttattgtttgtaagtgcaaacttctgctggtgtgcagcagctttgatgaacttaaagaataagtgagccctgaattcggtccaaaaaaaaaaaaaaaaaaggccccta

SEQ ID NO: 21407 - DNA, 878 bp, Triticum aestivum
  unsure (1)..(878): unsure at all n locations
  Clone ID: PAT_TA_21407
accatccgatccgatccatccaatccagcccccctacgatctcaccgggaaacctccgatccgagcgaagcgaaggctctctcgtcctcctcctcaagatgcagatctttgtgaagaccctcaccggcaagaccatcactcttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgtagatctttgtcaagaccctcaccggcaagaccatcaccctggaggttgagtcctcagacaccattgacaatgtgaaggccaagatccaggacaaggagggcattcccccggaccagcagcgcctcatctttgctggtaagcagcttgaggatggccgcaccttggcggactacaacattcagaaggagtcaacccttcacttggtgctccgtctccgtggtggccagtaagctcctggccatggagctgcttttgtctctgggttcacaagtctcgtcttcggtgtccttactaggagtctggtctgtgtctgtcgttgcctgaactgtctttgtttctataccgtactgtgatgcagtgttatcgtttgcatgtttaaacttctgctggtgtgcagcagctttgatgaacttcagaataagtgagccctgaattcaatcccnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaa

SEQ ID NO: 21408 - DNA, 1850 bp, Triticum aestivum
  Clone ID: PAT_TA_21408
acaatccgatccgatccaatccaatccagcccccctacgatcacaccggcaaaccctcgtcctccagcctcctgagggtggtacgcagatttttagtcaagtaaccactcaccggcccaccacccttaccctcacagtttggagagtctctgtacactattgacaatcgttcaagcccaagatcccggagaaggcaagggcctttccccgtcacccaacggacaatgttaaggatccacgaccaacggacggcagaccgccgtacccgccacgcacctcgaatatgccgaagatccgctcgacaatcgcccgcgccctgtcccccgcccccctttcggactacgaaactctggccgacgacgccaacacccccaacttcccagggtgcatgccgaggttggacatccaccctgtaccggcagcatccatcacctgggatggcaaccagcgcccgagatggagtcaccctcgcccagcaacgacatcggggagggatccacactcccccggagaatcgaaggctccccggtggcatgcagatcgctcgtgatccgccccggccgtcacgctctacaccatggagggaccctcccccctcaaccccatcccacctggaggtcgaggcccgcaaaccatggtcaggatccgtcggggccagccgaatatcttggagggctggccccgcagcttgaggacacgcctcactttcgcggactacgacaatggaggagcactcccgggcgaaccttgcaggaccgtcgcaggcgagtggcccagtaatggccgcgcccctgcatctgctgctatctactgggtgtacgagcgtctcttggtgctccgtgtccttcggatggaagtctcgcttcggttttagctgtgcctctgtcgtctgtagtttgtttcccgtaatggagttgtgtctgtcttttggtttgcattttctatttttgtgtcttgtttaggagtcttgtgttggtcttgaagttgaatgatctgtattgtgtgttcatcagtactatgatgccgtgttatttttggtatcctgcaaacttctgtctggtgtgcagcagctttgatgaacttaatattaagtgagcccttaattcaatccaaaaaatagtggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatggccgcaccttggcggactacaacattcagaaggagtcaacccttcacttggtgctccgtctccgtggtggccagtaagctcctggccatggagctgcttttgtctctgggttcacaagtctcgtcttcggtgtcctccaatggagtctggtctgtgtctgtcgttgcctgaactgtctttgtttctataccgtactgtgatgcagtgttatcgtttgtatctgcaaacttctgctggtgtgcagcagctttgatgaacttaagaataagtgagccctgaattcaatccataatattgtttgtcttgccagttgtgttgtactgtggtttcttgctatctttctgatgcatttgatggtacatgttttctggttgatgtaaaacttgattacctctgtgctcagtcctttacgtttgaactgattttgtatttctgt

SEQ ID NO: 21409 - DNA, 399 bp, Triticum aestivum
  unsure (1)..(399): unsure at all n locations
  Clone ID: PAT_TA_21409
attctagggtccactatagagccgaccccacttgacaataaaacgacaataccgcagaccaaggagtagaatgtctgaagaggctttcttctgttgaagttgttcagttgggctggtttgtgaatgtgtacatgaaggttttcttttatcttagagagacaccttgctccagctgtaaacttaagagcgtgcatatttacctgaatgtagatgtggtgctgctatttgcaaatcttccatgtgccagaattgctgcttggatgccatgtcagtgtgtttgtataaacaataagtagatgagaataaacaccgaccatgcccgtgaaacatttgacattgtatagaaactgcgtcatttaatccggatganaanaaagcaanaacctccnagggggggga

SEQ ID NO: 21410 - DNA, 585 bp, Triticum aestivum
  unsure (1)..(585): unsure at all n locations
  Clone ID: PAT_TA_21410
cttcagagagttcatatgaggcttgtgctcgctagtgccatggctctttgcttcaagcagaaaaactatgcaactgcggcacactttgctaggatgcttcttgagaacagccctcaggaggcccaagcaaagaaggcccgacaggtgctgcaagcttgccatgacaaggacgattcccaccaactggaactatgactccagaaatccatccgttgtttggtggcgctacgtatgttcctatctaccgtgggccaaaaggatgtttccgtgcccatactgtggttcccgatttgttccttcccatccgaaggacagctttgtaccatatgcgagcttgctgcggttggggcaagatgcatcaggcctcctctgctctccctacacagtccagataagcgatggtaattagaggcccctatatcctttccaacgcctcaagtccaagtttcatccatatatanttaccaagagtttactgattgtaaggataagtttatcatgcgttgagtttccttcctttggtccggtacaaaaatttgttgctangggtgcgtatcccgccctaggttagttaaaaaaaaaaaa

SEQ ID NO: 21411 - DNA, 702 bp, Triticum aestivum
  unsure (1)..(702): unsure at all n locations
  Clone ID: PAT_TA_21411
cgaatccatcgctcaactactcgaacccgactcaccggcgcctactcccgcctggctcccgggcccattcgtcgacccgtcgccgggcgaaagcgcgccactaaggtctccaacctccgcccgttgaagcgacggcgccgcatcggaggaactgtagctgttagtccgcctcttctcggcagcgcggggcggagatccgaccggacttgggatcgattccttcccttttctccgattcaagggcgctaacagttcctgagggaagcttctggggacatggacatggcattgcccctttgtgaatgccacagcggcggtgctcccccgtgtctccgctgcctttcaatggnccccttgccccgcgcagtcgcctttggggcccatattgatggtcacttggccgtggaaaggctcctaatgccatcatagtgtccaactctccanggaagagtacaaaccaccaaagaagccaccaactgaaaaggaattgataactagttatgatgggagcaannccctatgcctcaatcaagggggggcaaattaatcccaacatggaatgccctggccacatacatgttanggnaaaaatngaatttgataaaaacaccggtnattgaacaaaanttggtntgccattttggaaaaggtgngnttggccagggtttagaatngncccttgggacaaaaanatttgggncc

SEQ ID NO: 21412 - DNA, 588 bp, Triticum aestivum
  unsure (1)..(588): unsure at all n locations
  Clone ID: PAT_TA_21412
ggacttaactactacaggtgcatagacaggagttgggagctttctgcggcatggactggagctccgataaaagttccgtcgaaattcattgttggggaccttgacattacatacaacgctccgggggtaccggactacattcacaagggtggcttcaaggcaagcgtgccaaatctagaggacgtggttgtaatggagggagtgagccacttcatcaaccaggagaaacccaacgaggtctctgatcacatctgcgagttctttaagcaagtcctgatacgtattgggaaaaatctcaaaggagccgttatatgatcctgagctactccgtgtttttaatgtccaaaaaaatgcggtgccgagtgtcaaatatacgatccaaattaaattcctctctggctcacctttttacacagctctaccaagaaactgttttgcctttggtgggaaacacatatggggtgattcaaagaacaacttccaagcgcaacggaacttgggaatgcatgataattcctttgatgtaggcacacgtanggtgaggccccatatatggattaaggtaaaacttccggtaaaaaaaaaaaa

SEQ ID NO: 21413 - DNA, 812 bp, Triticum aestivum
  unsure (1)..(812): unsure at all n locations
  Clone ID: PAT_TA_21413
ctgctccgccccaccctaaccgtctgctccgccaccttatccaagcaggcggcctcctccgacgccgctccccgtccgccggacgcactggtcacctcgtcggagggtgaaatatccttggttcaggttgttaagctatatcttgagatgttggcgcatggtctagcaagcaatcccttgagggctactcgatctccacttactccgaggacgtaaaatgcgccgcaaggactcttctcaacattgggattaaacagtgagagtaaggaaaatataaaactttttgagaagatagggagatacacaaattacaatcctgagatcagtacacgaagatgctgcagctgagccatggagacaggtgcatcctctgttcggattgcgggatcagaacatccgatttgtcatgagaacgagatgaacgataggtatgaaaggagtagaatcggagaggcagattctgaagaagcaaggggaggagccggggaatttcgcatgagcaagtatgcagggcagaaacagcatgttgatgcaattgagtaggagcatgacgaaagcgtgatgcggggaagcgttgaggtactggtagcggcggtgtggatggatgatggtggattcggggaaggagaagaagatggtggcgctggtggatggcgcaaggtggtgatgtggtgggaggtgctggtggcgcgccgccacgccggcctggccgcggcggcggccggtggtggcgaaggcggtgtgagggagagagttagtgccgctttcagcgggttaaaagnggtnggaaatattcttttatnggttcggct

SEQ ID NO: 21414 - DNA, 516 bp, Triticum aestivum
  unsure (1)..(516): unsure at all n locations
  Clone ID: PAT_TA_21414
cttgctccgcctccggtccggtcacaaccgcgacaccgaccagcccatcccggatccatacatggaccaaacacagcggcggctcgatgaccacggccacgcgccggtggtcagtgcccacgcccagcaggccggtccagacaagagccggcagcaggagcagccgccgccgccgccttcttcgttgaaccagacggcggcgaggctcctgcgcnaagccaccgtctccccgccccggacggcgagaagccggcgccctccggacatcctggccttcgcgcgctccgttcgaccgcgtgggactcgcctctccgagtagcttttttttggcttgcccactctcaatcaagctactgggctcactgggctttgttcctttcctaaccaccttgggttcgcaccgttataaaaaaggcaccaattccccccccctcgattgtcaatttgtttgtaatcctgttaagncaaggatactgcaggctgtaatcaattcgcgattcaaaaanaaccacannn

SEQ ID NO: 21415 - DNA, 625 bp, Triticum aestivum
  unsure (1)..(625): unsure at all n locations
  Clone ID: PAT_TA_21415
tcccggccggacaacgaggccatctatgacatctgccgccgttcccttgacattgagcgcccaacctacaccaacctcaacaggcttgtctcccaggtcatctcatccctgactgcctccctgaggttcgatggtgctcttaacgtggatgtgaccgagttccagaccaacttggtgccctacccgaggatccacttcatgctttcgtcctatgctccatgtcatctctgctgagaaggcctaccacgagcagctgtctgtggctgagatcaccaacagcgccttccgagccatcctccgatgatggccaagtgcgactcccgccatggtaactgacatggcgtgctgcctcaagttccgtggtgatgtggtccccaaggacctgaaccctgctgtgggcacagtcaagaccaacgcaccatccagttagtggaccggcgcccaaccgactccagctgcgggatcaactacaaccctcctaaggtgaggcccagagcggtgatctggccaagcgtgcaccgtgctcgtgtgtatgattccaccccacaatgttgtggcgggtccccgcggtgccancatcgaccccgtcgcacgcgcccttcngcctancntatngcaantgccg

SEQ ID NO: 21416 - DNA, 608 bp, Triticum aestivum
  unsure (1)..(608): unsure at all n locations
  Clone ID: PAT_TA_21416
gatgctgcaatgggcaagaagagtaagatcacaagggacagggatcgtgatatcagtgagaagattgctcttggtatggcaagcactggtggtgcaaaaggtggtgaggttatgtatgaccagcgtctgttcaaccaggacaagggaatggactctggttttgccacagatgatcagtacaatatctactctaagggtctcttcacagcgcagtccacgatgtccacgctatacaggcctaagaaggatggggattctgatgtatatgggtgatgcaagatgaacagttggagaaggttatgaagactggagaggttcaagcctgacaagggatttactgggtgcttcaagagaggactgggcaaccgagacaggcctgtggagttcgataaccaggaagaaaatgatccatttggcctggatcagttcctgactgaggtgaagaaggtaagaaactgtggagaaattggaggtggaggaaccatgaaggcaantggtgggtcctcaatganggatgattttgggggtggggcgggcccgtccccttcggcgcctagggggcccgctccagggcccgctcncaagtttgaagcttccaaatactcaca

SEQ ID NO: 21417 - DNA, 790 bp, Triticum aestivum
  unsure (1)..(790): unsure at all n locations
  Clone ID: PAT_TA_21417
ctcgtgcccaattcgacaccacgctcaaacccacacagccacctaaaacccacaccgtcgaatcgaacacccaagaaaagccaaaaacaagttagagattctagttcgagtatctatcaatggcgggtttggccaagaccgccatggaatggctccaagatccactgagctggctgttcgtcgcctcggtggtcttcgtggtgctgccgcggcgccagcggggcaagccgccgccgtttcctccggggccgaatcagctgccgatcgtcggcaacatgtcgatgatggaccaggctgacccaccggggcctcgcggcgctggcgaagcagtacggcggccttctccacctccgcctcggtaagctccatgccttcgccgtgtcgacgccggagtacgcccgggaggtgctgcaggcgcaggacggtgccttctccaaccggccggcgaccatcgccatcgcctacctcacctacgaccgtgccgacatggcgttcgcgcactacgggcccttctggcgccagatgcgcaagctgtgcgtgatgaagctcttcagccggcgccgtccggagacgtgggtcgctgtgcgcgatgaatccgcggcgctcgtccgcgccgtggctcggcggagcggcgagtccgtgaacctcggcgagctcatattcaaccttaccaagaacgtcatcttccgcgccgcgttcggtgcgggcgccgncgcggacggcgacggcggcaagcaggacgagttcatcgccatccttccagagttctccaagctgttcggcgcgttca

SEQ ID NO: 21418 - DNA, 644 bp, Triticum aestivum
  unsure (1)..(644): unsure at all n locations
  Clone ID: PAT_TA_21418
atcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctggggccttcggcggcatgatcttcgtcctcgtctactgcaccgccggatctccggggggcacatcaaccccgccgtcaacttcggctcttcctggcgcgcaaggctccctggtgcgcgcgctctctaatcctggggcatgctcgggcaattgcgggtcggctctcaagggttcaaaaccctattcaaaagtacggggggggcaatccccgctcgggttcccgcggccgcgcgcgcccctattcggcctcggtcgcaaccgtttcccccaccaccaagccgagccaatccggtccgtccccan

SEQ ID NO: 21419 - DNA, 378 bp, Triticum aestivum
  unsure (1)..(378): unsure at all n locations
  Clone ID: PAT_TA_21419
tgtgagctgtattgcatcagtgagtgctagcgccaacacactccacctgtgactgtgacagcctcgtgtgcggctacgacaaatcggtcccgactccgggagatctatcacgacagaatgagcatcaagaaaggaagcgtacgttgctgcactggatactgaacttcacagctgcactgcacacatgcaagaacagacaacgagttcaaaggctagcagcctagcactaagtcagaaagctagcagcgtgccctacccangaattcctaattaaaatgtcaactgttttcccggtacttccggtcgcatcttgctcccnaatcnacagatgcccaagttcagtcagttcgccaacgcaagtatattttttttttttnn

SEQ ID NO: 21420 - DNA, 688 bp, Triticum aestivum
  unsure (1)..(688): unsure at all n locations
  Clone ID: PAT_TA_21420
acaccagagatcttacctacctaccttaggcttacatctacttatctacacacaacgaatccaagacattctccacgaattgctcaaaacaccgtcgcaaacttcttcgcacgtctccacaacttgttcctcccacattcgccccaaagcaaacaacacacagatttctttaaaaggatttccaacccgctggtctcaagagtcatctcaagacacgctatcaatcaacttctgccgttcaatatcctccgacccttaccgacctatatcaactcctagtcgacaaccccgaaaccatcatcaagaaatggcgccaaatgaataatcaaaatttggaattacagtagtaattacggcgaggccgctgcccaagaagncaacgtccttgcctcctggctactccgtcgactcctgccgncaacctcaaagggctccactactgcactaccgggttgcaggatgtttcccccttcaagggcaatcctttcaaggngctaatctatccaagggccagtggtatcctgagncctcctctaggctaccccctcaaaagccccctcgcggacacccgccagacacccccgccgcacaacacccaantcagcgggccggtnacanggggacattnttagaaantaatttttnatcaganaatttcngnaagtttcagagncgccttggnttttaa

SEQ ID NO: 21421 - DNA, 592 bp, Triticum aestivum
  unsure (1)..(592): unsure at all n locations
  Clone ID: PAT_TA_21421
gcgacgcgcgccatgttctgttgcagacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgccgccaataatgtgtgtccatgtgtccatcggttaccggcctgagccaagcttatacctgtgggaccgacgacttgttgacctttattcattcgatggtgatactgtctgttatanatgctataaaactacacttgcttaattaggggncaacgcaantattt

SEQ ID NO: 21422 - DNA, 460 bp, Triticum aestivum
  unsure (1)..(460): unsure at all n locations
  Clone ID: PAT_TA_21422
cttggaagttggaagccctcgccgcgacgaacagactcctcctccactccacggcaccttccccgaccgcgcaagcctcctcgacgaggtcggacaaaagaaaaaatcgcaaaatccggcggggaagggagggagagggaaccaaccgacggcgcacacatctccccagccggccggcggcgatggcgtcccgtacccgtaggggcgccggccccctaccgcgcctctgtctcctcctcctgctcgtgctggccacggggctgccgcggggcggggcgttggggctgaagctgccgttcagccccggggacgtcctcccgatcctgccgcggnaggtggcgtgggccgtgatgaacaccctccacagcgccgtcgacctcctgccctccttcgtcgcnccgtngncccgggcggaaccttccccgncgtnngaaacggncctgcttcccnnttaanaagg

SEQ ID NO: 21423 - DNA, 475 bp, Triticum aestivum
  Clone ID: PAT_TA_21423
ccgtggcctctcttccgtaagccctagcccctagccgccagtgtcgtgcattcgtgctgaggctcaactgctgatccgtcttccaagctctggtatcatccctgagcactgatttaagatgtatctccagtactacatcaacgagaagggggacaaggtctacaccaccaagaaggagtcacctcttggggtgccaacgcagtctgctcacccagctcggttctcaccagatgacaagtactctcgccagcgatacctgttgaagaaagagatttgggacttctgccaacgcagaatccaggaccgaagtactgaagcttcaagtcaactgtccaacctgcgatgttctttttgtgtcaatgcttgttggttggaatgtactatcttcgttctcgaatatttgtggtccacttgttcaattttgaactaaaccgcgacaaataaaaaagacactcatttgtccaaaaaaaaaaaa

SEQ ID NO: 21424 - DNA, 2009 bp, Triticum aestivum
  unsure (1)..(2009): unsure at all n locations
  Clone ID: PAT_TA_21424
cctcccgtccgggcgggtgccgctctcctggttccgggccccctggtgggtgcgcccccgggcctcccctcgaaagaatttattgatattgggaagattgcctccattgaaattaatcacaagcaagtcgatattatgcatgggcttgaaccccagacaatcgaatccctgaatctcttgaaaagtcgagatgcagtatttatcgttgctttgaacaaggttgatcgtctttatggttggaagacctgccccaatgctcctatcgggaaagccttgagacaacaaaatgatgaggtcaagttggagttcaatactaggcttactgatattgtgacacaattcaagatgcaaggtgttaaaactgctttgtactacaagaacaaagagatggaagatacatttaacattgtgcctaccagtgcagtaagtggtgaaggcattcctgatctgcggctactattggtggtttgttctcttacgccattcgaagaaaaggttgtttttgttttgatgacgatgatgactgggttggtaggtcggagagatgatgggcctataactacagttgatgttgtgctggtcaattgtatgctccataaaggagatcaaatagtcgtgtgtggtatgcagggacccattgtgacaaccttccgtgctccgttgacaccgcccccgatgacggtgcttcgtgttaagggcacctaccttcaccataagaagatcagagctgcacaaggaattaaaatatcagctcagggtctcgaacatgcaattgctgggactgctctatatgctgtacgacctgatgcagatatagaggacctgaaggatgctgtaatggaaganatgtcaagggttaggaaccggattgataagagtggcgagggtgtctatgtgcaagcatctacgcttgggtcattggaagctctgactgagttcttgaanagccctgctgtgaatatccccttctgtgatttcagcataggcccagtgcacaagaaagatgttatgaaggccagtgttatgcttgagaggaagaaggaatatgcaactatcttggcgtttgatgtcaaagtgatgcctgatgcccgtgatcttgcagaagagtctggcgtgaagatctttgtggcagatataatataccacctttttgaccaatttacagcatacattaagaacataagggaagagaagaagaaggacagcgccgaagaagctgttttcccttgtgttcttaagatcatgccgaactgtgtcttcaacaagaaggatccaattgttttgggtgtcgatatccttgaaggcatagccatggtgggaacgcctctgtgcataccctcgaaagaagttatcgatattgggaagattgcctccattgaaattaatcacaagcaagttggtacagccacaaaagggcaaaaggtggctataaagatcattgggagcaactctgatgagcagcagaagagcttgggcaggcactttgagatggaagacgagcttgtgagccacattacaaggcgatccatcgaccttcttaaggagaactacagggatgacttgacgatggacgactggaaacttgtgatgaagctcaagaagatactgagcattccatgagtctgttaacaaaggcaagcccggcgtgaccccgtcagcaaagagccaccagaggccacctaacctcgtggtcgcgggtcggcatgccagtgagagtgcgtgtataaattgacgagggcggtggttcctttgtttgcttccttgggccacagatgcagtggttcgggtctgttgaccttgctgatgttggccgtggatggtggtttcagttttgacgattttgtaattaggtatctcggcgttacgcctaactttcggaatcgatcctgtaataacagcagcagtagatgatggcgttttgttgcactgtgttaacctgatgaagaagctggcgttgtttgcggaaaaaaaactttttcatgtgaagcgtttcttctaaaaaaaaaaaa

SEQ ID NO: 21425 - DNA, 808 bp, Triticum aestivum
  unsure (1)..(808): unsure at all n locations
  Clone ID: PAT_TA_21425
tagcgtggtcgcggccgaggtaccgtgtacaaaggacagctgcaagatgagcatgcgaccaacatggccgtcaagaaaattggaaagctccagcaagagactgagaaggagttcatggtggaagtgcaaaccatcgggcagacatttcacaagaacttggtcaggctgcttggtttctgcaatgacggaactgacagactgcttgtatatgagttcatgaccaatggctcgctgaacgagttcctctttggtgatgctcggccacattggagtctccgtgtgcaagttgcacttggagtggcacgagggctgctctacttgcacgaggagtgcagcacacagattatccactgcgacataaaaccacagaacatccttctcgacgacaactttatggcgaagattgcagactttggcctggcgaagcttcttcgagccaaccagacacagacaaacaccggcatccggggtacccgagcttacgttgccccagagtggttcaaagaacatagggatcactcccaaagtccatgtttacaagctttggggtgatcctgctggagcttgtttgccgcaggaggaatgtggagctagagatcgccgatgaagaacgtgcgatactgacttactggccaaacgcgtgtcacaccggaagtcaatttctggtggaagcacataggaaattcacataaaaaggaaacgatctggtgtcccttggggcncaagaggacnacntnggcaacatctaagngaaaatctngtgacatgaattccanctccgatccctctaaattaatcgnaggcngtg

SEQ ID NO: 21426 - DNA, 641 bp, Triticum aestivum
  unsure (1)..(641): unsure at all n locations
  Clone ID: PAT_TA_21426
cgactcccccaagggagtccaggagcgcctgggcttcttcgccatcgccatgtccaccatgttctacacctgctccgactcgctgcccgtgttcctcaacgagcgctacatcttcctcagggagacggcctacaacgcgtaccggaggtcctcgtacgtgctctcccacaccatcgtcggcttcccgtcgctgatcgtgctctccttccgcgttcgcgctcacgacgttcttccgccgtggggctggccggcggcgccgacgggttcttcctcctccgtggccattgtgctggcctccttctgggcggggtccgggttcgcgacgttcctctccggcgtggtgacgaacgtgatgctgggcttccccgtgggggtgccgacgctggcctacttcctccctgttcagcggcttcttcatcaaccgggaccgcatcccgcgctactggctccgggtccactacctgtcgctggtgaatatccgtacgaaggantgatgcagaatgagtcagcgacccgcgcgtgttcctgcgggctgcaangtnnacaaacncgctggcgtctccggggtgtaaggtcgggncnccncataacaatcctgggtgaaatgganggcagtcatacacgggcggnttctgcnaagg

SEQ ID NO: 21427 - DNA, 641 bp, Triticum aestivum
  Clone ID: PAT_TA_21427
tggcgatgagcagtcagaggaagacgcagacgacggaccaccggagctgctgttcgttcatggaggccacacagacaagatatcagagctgtcgtggaatcctagcgagaaatgggccattgccagcgtgtctgaagacaacatcctgcagatatgggagatggcagaaagcatatactgtgatgacctctccatgcaggttaactgactccgtgcctcgaagcataaaggtgagttacctgaccaatgatgcaagcgtatctgggaggggttatatacctgtatgatttgagagatttcaatttccctatttttgttcactgcagccagagtgggcatctataagaaccctttaatccgtgacatgcattaggtatctccaagcaatttcctatcacatcctttaatgttatcccctattttcaaacttctctccgcaaagaccatttggctcgtgtacctcctgtccgctccaccggtccttctgcagatttatgttcttggaggctgggtcacgctgctcttgcgactgcgactacaagggggccgggcccgccccaatcgccttatcaccctcggcctccttcagcgcgtcggaatcctgggacacctggtcccaattccccccgaaaaacccttca

SEQ ID NO: 21428 - DNA, 642 bp, Triticum aestivum
  unsure (1)..(642): unsure at all n locations
  Clone ID: PAT_TA_21428
ggcaggtatatctatctatatagtagagtaggctagcaggtaccgcgcagctagccatggctgcctctgcttcttgcctgcttagcctcttggtggtggtggtgctggcggcgctggcctcggcgcagctttcgtcgacgttctacgacacgtcgtgccccagcgcgctgtccaccatcagcagcggcgtgaccgcggcggtgggcgcaagaggctccgcgtgggggcgtcgctgctcaaggctgcacttccacgactgcttttgtgcagggctgcgacgcgtccgttctgctgaacgacacgttccggggagcaagaaccagatcccgaaccagactcctgaaccctaaggggttccatgtcctttgacacatcaaggccaagtggagcngtgttcccgggatctctcctgcgccgacacctccccgttaccgccaaggacggatggtcccctccgcgggcttcctggacaattccctgggaagaccanccactgttcntcccngganaaacaacgactccgctccnagtcaacctcaaaaactctgccgctntacaaaanatcnaacaaacgantggtgccncnagtgccaacatngcagngaatgttacttaagacaatnaaagaacaaatancccctn

SEQ ID NO: 21429 - DNA, 499 bp, Triticum aestivum
  Clone ID: PAT_TA_21429
gccagtggagcgccccgtggaacctatcaatcttgatgagccagtgaaatgcccgcttcctgagccgtctatactgcacgacgggaggatatggaaggagaaaatgtcttcagtcagcacgagggtgagaacagacttgccggtcgtgaaggaagggtcgcagctggagcctgacggtagcagcgctaggtcacgatctgcagttccaaggcgcgccatactgccctccgtaagcgcgcccgagcacaacatcctaagcgctgcttgacgaagtgcgacgtctccgggagccgtggctctgctgaatgagctccaagtttgggcgtcgccaagcacaattgttaactaaaactgcgttttgccacgagctgatctgagcacaggcaaaccttacaagtatgtccgaaaagaattgggactacgcaacagttcttttggccgggattgtttccataaatacgaatggaaaccgttttggggaattgccccccccttgtcg

SEQ ID NO: 21430 - DNA, 233 bp, Triticum aestivum
  Clone ID: PAT_TA_21430
ctcgtgccgcgagcaagttcagtcgtttgtaaatatgctcctagtaggaagtaactgaattattcgcaaaaaaaggaagtggctgaactattgtgccttttgcacgatgcttcgtttcaaggattagccatgaattaacgtttatgtactctaagaggaggtgatttgcatctcaactaaacatttgagtatgcagttaagtttgatttgtccagttaaataaaaaaaaaaaa

SEQ ID NO: 21431 - DNA, 660 bp, Triticum aestivum
  unsure (1)..(660): unsure at all n locations
  Clone ID: PAT_TA_21431
atcacagattcacagccagccaggctccttgttttccaaattaaagcctttttcttaatttccctagctccaagtcgagtgtgtgtggtcgagagagctagcctagcagatcgagcgcgcgcatgatgacgacgacgacgaggagtaggccgatgctgctcgccttggccgcggtggtggcgacgctgctggtggtggccgcgccggcgccggcgtccgggcaccccgggcccccggcggcgtcgtcggaaggcgccatgtcctgcacggcgtcgctgggtcaacaccttcaagccgtgcctcaactttacaacaaacggnaacgcctctccctaaccgacgactgctgccgggtcccctgggggcgccgatgaaggcaacaccggtgcgcctgcctcacctcaacgggagctttccttcggcgtgcccttaaccggacgccccccttccggtggccaaggggtgtaatccactctcccaactgaatgccaaaccttctaagtnaaaaccaattcaagcccnttnaaatggcctggcctcccgtcaggcccccttcaaaacaanaagggggggaacccggacnaaaacacgggccggcaggcangacccnccgtacaagggaaaaagcacgtntccggctcncnccccnaanatngaggn

SEQ ID NO: 21432 - DNA, 613 bp, Triticum aestivum
  unsure (1)..(613): unsure at all n locations
  Clone ID: PAT_TA_21432
ggggactccggtggctccgtcgtgtcggtcgacgttgagcgcatctcctttggcggcaaggaacaccatatacaaacgaatcatggacctgtatctgttgcagtgtatggtgaccatgacaagcctgcccttgttacttaccccgatattgctttaaactatatgtcctgcttccaaggactattgttctgtcccgaagccgcttcgctgctgcttcataatttttgcatttaccatattagccccccaaggacatgagttaggagctgctccaatttcaccaaatgctcctataccgtctgttgacgattgggcagatcaggttgcggatgtcctcgatttccttgggattaagctccgttaagtgcttcggtgtcaactgcaagtgcctacattctaaccctgttcccggcaaagtataaggagcgggtacaagcctanccttgttcacccccgtgtaaagcccacttggacgatgggtatcattaggaacaccaaccgccgtatacaaggagttgggtattaaggggccactaacggactaacaaggatgcaggtcccgaatcccaacaaatatgagnttaaaccgtaacacggaacatacttggctctn

SEQ ID NO: 21433 - DNA, 592 bp, Triticum aestivum
  unsure (1)..(592): unsure at all n locations
  Clone ID: PAT_TA_21433
gggaaccccgtctttaaaaagtacaccctcgactcgtcctccgcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcacaattggcaagcgcctttccagcatcaatgtcgagaacgtggaggagaaccggcgggctctccgtgagctcctgttctgctgccctgggtgccctccagtacatcagcggtgtgatcctcttcgaggagacctctaccagaagaccaaggatggcaagccttttgtcgatgtcctcaaggagggaagcgtcctccctggcatcaaggtcgacaagggcacattgaggttgttggnaccgacaaggagacacaaccaaggcacgatgactcggcaagcgctgcgctaagtatacaaggccgtgcccctttgcaattggctgcgttccaagatggcccaacaaccttaanntgcaatgacnaatgcaagg

SEQ ID NO: 21434 - DNA, 622 bp, Triticum aestivum
  unsure (1)..(622): unsure at all n locations
  Clone ID: PAT_TA_21434
agaaccccagcgggcaaacgcctccctccccctgcctccaggccccagatccggccatccgggtagctccagaccttctccaatggcggtcaaggtctacgtcgtgttttactccacctacgggcacgttgccaagcttgctgaggagatgaagaaaggcgccgcttcagttgaaggcgtggaggtcaaagtatggcaggtcccggagattctgtccgaggaggtgctcggcaagatgggcgcgccacccaagaccgacgcgccggtcatcaccccgcaggagctgggcggaggccgacggcgtcctcctcgggtccccacgccggtcggcatgatggcggcgcagatgaaggcttcttcgacgccaccggcggccgtggcgccagcagacctggccggcaagcccccggctcttcttcaacaacggtccaaggtggcggcaagagacacccgctgacgnggtgaccaactgaccacacggatggtgtcctcccgtggggtacagttcgggcaaatttccacatgaaacgtgacggggaaccctagggcgggacttcccgggcggccccgctcccacgaanggactggaanctcacaggantattccgatcaaaggtaaggg

SEQ ID NO: 21435 - DNA, 483 bp, Triticum aestivum
  unsure (1)..(483): unsure at all n locations
  Clone ID: PAT_TA_21435
gttgatggagggattgtacttgaaacagaaggaagagagatagctgaaaaggtgtctggtcatggattggagggtgcttcatcagctgagcagactttagtcaacgccctaacgcaagcaagagagcatttggcgaagtctcttctcatgtgatgctatgctttatatattagggtgacgatggagtatctataactgtgtctggatgacacagttttttttggttagcagtggacccaaaaaaaatgtctgaaatctttgaatgtgtagaatgggcatgttgtgtccaaaattttcatttgtaagccttccaaagttgtgtagcatgtttttcctccaattttgactgggtttagttatcggtcctttggttaatctcccccggttgggaacggtaaaatacatgcttgatggcaggttggaacttaacaaattaggccacactttgtttaagatggtataggccccccnaaaaaaaaaaaa

SEQ ID NO: 21436 - DNA, 668 bp, Triticum aestivum
  unsure (1)..(668): unsure at all n locations
  Clone ID: PAT_TA_21436
gaaaattccaagacatttacaatgtggataagttcgtgaggagcctggatggtgttgtcgaagtaatagaggatatacctgatgaagtgagtgctaagaagccagcagtcatcagagtaccgaaccgtgtgactgaaagcttcatcacaggcaccatccagcccatcttccaaaaaaacaagtacttaagactagcggtcattttctcttcccgtaagtttaaggccaaaggagacgaacaacaaggacatggacgcaactgcttgccttgcgatgtttcggtggcctccgagctggaagcacgaatattctgaagtggccaagaaaaatgccgggatangcttccaagaatttaancaagaatccagatgggagggccttggcgattcatttnccggaccgacttncctgggaaaagaagatttccaaacaacccgccgggctccaaaaaaaggcgttataccccgaataggcccggtttcccgaagatgttggtccncggctaacaaacatctactnacaaaactcctnggaaaaggctgatttctgaaggaaatcccaacccggggaaggggctctcctccaccagaaaaccgnttccnaatcacatgaacctanagggctggccttnattttccaaaaatttnccccgncngggntaagaataa

SEQ ID NO: 21437 - DNA, 631 bp, Triticum aestivum
  unsure (1)..(631): unsure at all n locations
  Clone ID: PAT_TA_21437
ctctaatacacccaaagcaaatacgcacgcagtgatagccatggctcgtggcggatctggttgccgtcttctcgccctgctcctagtcttgactgccttcaatggcagctttgcagctcgacatctcttggacacagcagctgcgccagaggccacgcctgctcaagccgtccattccagcggttccaaccaaactgcctccagtgccgaccataccangcggttccaaccacgctgacgctgcctccaatgccttccattccggaggtccccaagatgacaatcccaccaatcccgtccattcctatcccaaaagctagccctgccaccaacagctgctggcgcaatcccatctctcccaaacccggtggttccaaccaccgtaccaagctattcctgcagtcccggttaccctgccacaatgccctcgattcccactaccttgccatccattccaactacgattccaacaacaaccctacaatcccggatccaagtgccccattaacggcccatcccacaaccacagccctgaagtcgatgtccaggggacttcctacgtgctgccggcggtgggcncgncgtggcgtcaaggggtncnattnttcccatttggaaaggganaangggg

SEQ ID NO: 21438 - DNA, 634 bp, Triticum aestivum
  unsure (1)..(634): unsure at all n locations
  Clone ID: PAT_TA_21438
gccatagccatcttctctgaattccagtccaagggccggaataccgtcgtcagagggagtgggaggggggaaaaaaagatggtgaagctcgcatttggaagctttcgcgactctttgagcgccgcgtcgctcaaggcctatgtggccgagttcatcgccacgctgctcttcgtgttcgccggcgtcgggtccgccattgcctactcgcaattgacgaagggcggcgctctggaccccgccggcctggtggccatcgccatcgcccatgcgttcgcgctcttcgtcggcgtctccatggccgccaacatctccgggggcacctgaacccgccgtcaccttcggcctcgccgtcggcggcacatcacatcctcaccggcatcctctactgggttgcccaacttctcggcgctcccgtggcgtgcttctcctgcagtactctccagggncagctatcccaccacgggtctccgggattacgagatnaagggttggtgatgaatnnggataactcnctctggtgtanacgtgtagcacggcggcgaccnaaaaggtcctggnacaacgcccatggcacggtnatctcgggcaaanctggcgcggccttaanggggtcanaacggccgtcttggccgcg

SEQ ID NO: 21439 - DNA, 610 bp, Triticum aestivum
  unsure (1)..(610): unsure at all n locations
  Clone ID: PAT_TA_21439
caactcccaaggtccctttttttttctcgatctggaagcgccgcagtagcaagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtctccccaacatccacactgtgctcctccccaagaaggtggccgagaaggcggccaaggagcccaaaaagggccgctaagtcccccaagaaagggatgtgccgcccgtcccatatacatttcccctcttcaacnatnagttatgtatccaattcttccncacatcngacgttacaataanctgncttctgcnaaaaaaaa

SEQ ID NO: 21440 - DNA, 617 bp, Triticum aestivum
  unsure (1)..(617): unsure at all n locations
  Clone ID: PAT_TA_21440
ttctgtcaaagcatgatcagatggtttcggggatagactggagtaaatcatccaacaaaatcgtaacagtttcacatgatagaaattcatatgtttggacacaagaaggatctgattgggtacctaccctggttattctaaagttaaatcgtgcagctttatgtgttcaagtggagcccaaaagaaaacaagtttgccgtgggaaagccggtgccaaaatctgtgtgtattggttactatgaaacaagaaaattaactggtgggattagcaaagggttaccaggaaaaagcatgatcctccggtcactagccttgcatggcatccaaccattatataccttgcaccatcgtcctacggatggtaaatgcagagtgttctctactttatcaagggtgtanacacaagaggtnnaaatcnagacttcaaccgatncaaattcggnganaatcctcacttatctacaccactgggtattgggtgtaagtggcacaatgggaaaattggctatcaggacacccagattatcacganatcnacacccgtgnaaaattggacgctgatcgcnccgtagtctttgccnaccnatgatggtcgatgcgancagatttcgcgtaag

SEQ ID NO: 21441 - DNA, 639 bp, Triticum aestivum
  unsure (1)..(639): unsure at all n locations
  Clone ID: PAT_TA_21441
ttttttttttttacggctgtagcaaccccaaattaaaacagcgcctcctcaaggtttgaagctttttttttcagcacaatttggaatatattagaaatttccacactacattgttcctcgagcaacctattagcactggcctaaaagtacgaggaaacgaaacagagccgtcgctccgtgcggcggcgatctaagaggaagtaaacttgtgtaacggccttgggtgccctcggagacggcgtgcttggcgagctccgccaggaaggacgaggcgcaccgaagcctggatctcccgggaggttatggtgggcttcctgttggtagcgggcgaccttggcggcctcggcagccagcttctccgaagatgtcgttgatgaaggagtccatgatggacatggccttgtgacgagataccaatgtccggggtgcacctgcttgagcaccttgaagatgtagatcctgtacgtctcgaactcttctggcctctctcccttctctcgccgcctcctgccggnancgcttcncggcctgggtctctcngcttccctcgtcggttctcnccgcgggctctccggctggcncacngaatcataatggcgnaatcggatgancgcgntggaattttatnagncgacangg

SEQ ID NO: 21442 - DNA, 626 bp, Triticum aestivum
  unsure (1)..(626): unsure at all n locations
  Clone ID: PAT_TA_21442
ccgacgaccaccggtgaaagtgaaacgtcggtgtccggcgacgaccgagttcccatcgccggaaatcatggagaagcttccgtcacagcagcaggttgtgctgttggcgagtcctggcgcgggccacctcatcccgatggtggagctcgcgcagcggctcgccgctgaccacggcttcgcggtcacgttggtcaccatccccggcatgtccaacccggcaacggaggccgtcgtgctgtcctccgctgccgtcctacgtcctgaccgcggtgcttcctgctgttcctcttgacgacctcccgtcgggacatcggcttcggggccctccgtgttccagttcgtccgccgattgctccccaacctccgcgcgcgtcatggaggacgccaaccgcggcccggtgaccgcgctccgtaggtgacttcttcggaactcnggcgctgccgctcgccgcggagcccggcgtcaagggtactctccttgccgaacacttcccangattcaacaatngcaatcncgggtcaatgggaaccgctgcccgggnaatactgactccggactggtccggtccaacngnggctggtctacangcgactcccaaggtcagaccgnagaccgtgtaccntan

SEQ ID NO: 21443 - DNA, 778 bp, Triticum aestivum
  unsure (1)..(778): unsure at all n locations
  Clone ID: PAT_TA_21443
gattacgatttgaggntgttgacgctgattcaggtcacatttttactatcaacggagggcatgcatttacaacacgaattgatataaaccatctacaagagatgccaactactccctccggtttcattttaattgacactttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtctatatttaaagttattgatggtcaaagctataaaagtttaacctcaactttgtccaaaacgtcaattaatatagaaccaagagggagtagacaatttggatgatatgtgggtgtgtttaggttcaaactttgggttccaaagtttgcaaaatccatcacatcaacctggcatacacacacaacctttcaagtcacatcatctccaatttcaaccaaaatccaaactttgggtggaactaaacgcagccatactaggaggtctgatgctctcatcaccggntgctccatgttaagtggtggctggtggtggcctataactanaggcccctcctcatagcataacatagatacacagcgggcagctggaagtcatctgcaggaaccagacctggggcacccaatgagtnggacaagntacggangcgccangcacgccgtatnccggtaatggnaangnccacggtaggatng

SEQ ID NO: 21444 - DNA, 653 bp, Triticum aestivum
  unsure (1)..(653): unsure at all n locations
  Clone ID: PAT_TA_21444
cggcggtgtccacggcagcgcttctagccccaatccgagctccaaccagcgcgtttatccggcgctcccagctcacctgtcatcgcctccactcactaaaatgccgccgcgctgggtccatcgtccccgcggccgctgctgccgcggcgggcagcagctcgccgtcgtcagccgttttccacggcgagtgcttccgtggtgggcgacaatatcgacaccgaccagttcatccccggccgagcacctcactctgggtgccctccaaagccggacgagtaccgcaagtcggntccttcgccttcgcggggtcccatccgcggcctacccgacgccgttcgtcgccccgggtgaagatcctccccgctacccatcattgtcngngggaccaattcggggcgttcctctcgccaagaagccccgttccgcttggggccctggngaaccgcatnttgccgagggtaccccnacttttcgcaatccctggcactggaaagggtacctccggaccaaggacttgggctgnaagatgaagaaagggaattgcacgtggacttgcaatcgttttataacaaactcggaaggttaactaaccatggggcgccgccgtgtgaggggtgcaccgacaaccgaaaagatnttctcaaacgcgntag

SEQ ID NO: 21445 - DNA, 476 bp, Triticum aestivum
  unsure (1)..(476): unsure at all n locations
  Clone ID: PAT_TA_21445
cgtcttcttcgctaccaagatgatggcggaggcgtggacgccggtgctgttgccggcgacggcgccctgcttctggcagcaggacacgcactcggttttgtggcggagaggagacgcgtggacggcggaggagaacaagctgttcgagaaggcgctggcgcagatcgaccggaacgcgccggacaggtgggagaaggtggcggcggtgctgccctggaagacggtcgacgacgtgaaggaccactaccacgccctccgagaaggacgtgggcgtcatccaangccggcggntcctgccgttcccgcgctaccacggtccgtccccccgccgtccgggttcgccctcccaaggactggggccgcgcgacccccgtttaaggccccgcgcngtccggangaatcaagagcggagaaggtgtcccctgaaccggaggaggacacaactttcttgatgggntgaagatggantggngntt

SEQ ID NO: 21446 - DNA, 648 bp, Triticum aestivum
  unsure (1)..(648): unsure at all n locations
  Clone ID: PAT_TA_21446
cgccgtcgctgtcgtcgccgtccgtgctagccatggatctaggcgctcccgcccgacggcgcctaccgatccgcctcttgctggtgtcgctcaccgtcctcgtggtcctcaccgcgcgctccagtgccgaagtcatcaccctcaccgaagagaccttctccgacaagataaaggagaaggacacggtgtggtttgtgcaattctgcgtcccctgggtgtaaacactgcaagaaccttggaacactatgggaggacctgggaaaggttatggaaggtgcggatgaaattgagattgggcaagttgactgtggtgtcaagcaaaccagtatgctcaaaggtcgatatacactcctacccaacattcaaggtgttttatgaaggcgaagaattagtaaaatataaaggacctaaggatgtggatccctgaagaacttcgtgttgaatgaagctgagaaacaagcgaagcaaacttgaactgattgaggaagggagtttaacaagcatgtggcgagtggcgtagacaaggaaaatgtttcaaacactgtctcaccctgtaattacaaagcagttaaggaaagaatatcacacacctacacatcaccctcaattaccctccatttnaaatgcaancccacataaacgtccatc

SEQ ID NO: 21447 - DNA, 595 bp, Triticum aestivum
  unsure (1)..(595): unsure at all n locations
  Clone ID: PAT_TA_21447
ttttttttttgaaacaaattcctttgagaaccttgggagaacgcgtattctcctcaacactgagaaatatctttgtatgtacatcacttatagaaagtgagggaatatgccgaatagcaggctgatatgcagtccactgtacaacagtctatgtacaagctggatttcatctaatcaaactactagtcaaacgtgctctcggtataatttacctagctgggaatcaatgaatcaagaatctacagttggtaccatctccacataggtccaccatattcaacttcacatgcgcaccatctagcgtatactcccagtaccacgttccgctgtccatcatttccttgcctataggatctaacttaacagtaaaacctgcttcgtcctgaatgatgcacattctatgaccatcgggtactcaaacatatggttcccttcaaagacgacatccttcgcctcaaattctgcatttccatgaagaatatccttagagatctgatcttcaacatgggccgccatagacattacngggagaacccaactgttccttcgtcacattttacattgcaccggccccccacactggtcntatgtatag

SEQ ID NO: 21448 - DNA, 635 bp, Triticum aestivum
  unsure (1)..(635): unsure at all n locations
  Clone ID: PAT_TA_21448
ccggaacagagcgaggcgacgccgaggcacctcatctccggcgaagggaaatggcgaccgttccaggggatctgatctggcagattgtgaggaagaacaactccttcctggtgaagcagtttggcaacggcaatgccaaggtgcagttcaccaaggagcccaacaacctctacaatgtacactcctacaagtactctggcttaagcaaacaagaaaactgtaacgatccaaccaagctgctgggaaaggactccggctgtggcctctctactaccaaagaccaaagaagcaagaacacacccgccgaagctcaaccacaagtctgttatgcgcaaggagttccccaagatggccaaggctgtgaaaaacaagtttggcgacaactattacagcctgatctgaccaagccggccttgggtaggcgactctgtgtaccgcacctccaagttgccaagtctggtgtcaagaagaagaacaggacctacccactaacctgtgttcgtcttggtgccattctcacttaattttccatgtcccaacatttggaactgttaaacaacaaaccctttaaaattcccttggccctcacaagaccgtcaaatttctggcctnatgcgcttttnaaaaaaaaaaaa

SEQ ID NO: 21449 - DNA, 599 bp, Triticum aestivum
  unsure (1)..(599): unsure at all n locations
  Clone ID: PAT_TA_21449
cagggtttgtgtgagtgtgttagtgagagagaaccatggcgacgcagcggttcacggcggcgctggtggcctgcctcctcctgctcctggcgctgccggcgcgcgggcgcaacatcacggccatcctcgccgggtacaaggagtacaagctatacaaccagtacctgtcggagacgaaggtgtgcgacgagatcaactcccggcagtccacgtcgatgtccgtcctggtgctgtccaacgacgccatgacgacgctggcctccgacgccggcgactcgctcccccgccatcaagaacgcgctgcgcctccaacccggtgctcgactactacgaccgcaagaaggggaagaagttcggcgccgagcccccccccacgctgtccccggccacccccgacgccgccggcaccacggggtgcccaagggggtggtccgtgtggacgcgacctgcgccttctcgcccgccacccgggcgccacgttatgccccccacgggggccggacaccgcccttcatgttcccccctccgcttaactctatgaaactggtacactanntnaaaacccttccacggtaacaagccncattcttcaatccnca

SEQ ID NO: 21450 - DNA, 1359 bp, Triticum aestivum
  Clone ID: PAT_TA_21450
cgatttttttttttgtccctcccgcccgcatcggcaaagcaaaacagggtgcagtgttcgcttttcaggtgggctcggtcggagccgtcggaggagatcgccgccatggagacactggcgagcgtcatgcggcgggacaaccgccgcttcaagcccccgccctcctcctccgccgccgccgcctccgcctccgccggcagggcccccctcgtcatggccttcctcgcctgcctcgcctgggtgtacgtcgccggccggctatggcaggacgcgcagacccgggcggtcctctccggcctcctgcagaagagcaccagcaatctccccaaggagatctcggtggacgacaagctgagggacctcggatgcactgggattgggaggaagatcgccgaggcggagatggacattgccaaggcgaagagcgagggctacttgtgggggaacgggactggtggtactggtactgagggttccggcaggaagaagttccttgcggtcattggagtttacactggctttggctcccggctcaagaggaacaccttccgtggctcctggatgcccagaggtgatgctttaaagacgcttgaggaaaagggtgtggttattcgttttgttattggccgaagtcctaatcgaggtgatagcttggaccgtaatatcaatgaagaaaacagaaagacaaatgatttcttgattctggaaagtcacgaggaagctgcagaggaattacctaaaaaagttaagtttttcttcagtgcagcaatagaagcttgggatgcagagttctacgtcaagattgacgataacattaatcttgacttggctgggttaattgagatgcttaacgtccgtcgaggtagccatgggttgtacatgggctgcatgaaatcaggagctgtcgttagtgaagaggagcaacaatggtatgaacctgaatggtggaaatttggagattcaaggacgtattttcgccatgctgctggttctttatttatcctctcaaacaatttggctcgctacatcaacataaacagtgcatcgctgcagagctatgcgcatgatgacatatcagttggttcatggatgatggggcttaatgccacttacgttgatgacgaccgtctgtgttgcctcagtgcagtacaagagaaagtatgttcgtttggatgagcggaaggaccagccgcccccccttctgatggtggcgtcctgatgaagaggtgattttgtacattagccattttgtacacacctatagcaggcagcctatgtgaatgattgaatgaatgcaagaaatatatgaagaaactactttgagatgccacattcttttgcggctttagctatcagcat

SEQ ID NO: 21451 - DNA, 454 bp, Triticum aestivum
  Clone ID: PAT_TA_21451
cagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcactcgtgccgcaactggcgagggtctgtatgaaggcctggactggctgtccagcaacattgcgagcaaggcttgaggcctaccttgaatgtcaaccgcgaactgactaggagctccggatgtatcatggaaactcaggacagaatcgcagttgcaacctgttagatgtcttctaccggcactatatatattttttgtttgatgtgtaatgatgttactgttcaacgtttattaccctactatactgttgggatgttctttgggcctgtttcaatttcgcacaaaaaaaaaa

SEQ ID NO: 21452 - DNA, 395 bp, Triticum aestivum
  Clone ID: PAT_TA_21452
tgggcacttcctgttgcgtgcgtgcctgctgaactggctgctcgcttgttgctcgacgctggtgctctgctggcttgctgccgctctatagctttgcttttgagtttctgtatagtgttgttgcttgctgccgctggcctgctgatgctgttgttcacgctaggaaatgacataccaacatgggatatagcatctctgagaccgtaccacaaggacttgaaaagagccatggatcctacaaatagggcagtgtttttatctcatctcacccaatcaattattccatgttttattgtatgccattttgttaactatttttatatatcttgagtatcgatgtaaaaaaaaaattaaaaattgtctgatcctgctgctctgcttccttatgggcgggc

SEQ ID NO: 21453 - DNA, 668 bp, Triticum aestivum
  unsure (1)..(668): unsure at all n locations
  Clone ID: PAT_TA_21453
ctcaccacctcccccattttcgccgccccctccgatctcgccgttctcgtctccttccgttggattagggctcttcatctgttcgccgcacttcgtcagtcgcccatggcggatgaggaggtcactgatccaaaggcgctcctagaggatcgttcaaaggctaagtgtgtgtcgcagtggtatgattatcagaaatgtgttaaaaggattgaggacgatgagactgggcacaagcactgtaccggtcagtactttgattactgggaaatgtgttgacaagaatgttgcagagaaactctttgagatgttaaaatgacaatttttccctccatttatccacttaaagttggtaataattgtatcacttgtgaggcctatagactattaaggcacttaatatttgtcagagaacttttgcctcctggggtaacacaaattttccactgccaagtttgcatttcatttctgctactagtattgaaccagcaaggttcctcaatgctggataaaatcaatggatatcccaagatgtggctaaccgttaacaaaaagtactaaaggctacgagggcaggcaaccggcctaccatcagactaatactgatanaggatacagttcatactcagctggggaagatncataaaattgttacatgatnanatgaaana

SEQ ID NO: 21454 - DNA, 629 bp, Triticum aestivum
  unsure (1)..(629): unsure at all n locations
  Clone ID: PAT_TA_21454
gcgaccaagtcccgctaagcaggtccacgaggcggggcggacgagcaaacccccgccgagcaagtctgcgaggcggggcgaacgaccaagtccccgccaagcagaccaacaaggaaggagcccaggacgacgctgctggcctacgtcagcacgacaagacagatcatcaccaaaccacgaccggatcatgggagcagtgccgaagggcctctatcaaaacatgactcagggtacgttctcaagacatgcccccactgaccgggtgggaccagtcaaccccagtcgcagggacctcagcatcggggtctctacagtgacccgtactcccagaaggggatagaacagtacgtcataccgagcatgtgcctacgcatgctggaagatgacgtagaggggatggcggaagatgaagctgtactgaagacatccctgaacctctctgcaagtctgctctgcgggacccgccaagtaccgctacatcagcatcagaatagctacaggagcccgtntggcaaacggacaaaccngtgcatacaagggtacgacgaccacaaccggcaacattcagaggagccgcgcanatcaggaacagcaatcccccttatcatcccgtaancaccttgcanaag

SEQ ID NO: 21455 - DNA, 619 bp, Triticum aestivum
  unsure (1)..(619): unsure at all n locations
  Clone ID: PAT_TA_21455
taaccaacgagacaccaatggcggtcgcaagtaatagaccagcaaccactctactgcccctggcggcccttgtggccgtcgctggctccctcttcctcgccggcccggccgcggccgcggggaagaccgggcaggtgactgtcttctggggccggaacaaggccgagggcacgctccgagaggcctgcgacacgggcacgtacaccatcgtcgtcatctccttcctcaacgtctcggccggccccggcaacagcccgccgagcctggacctctccggccacccgtcgccggcatcggcgccgacatcaancactgccagtcgaagancatcatggtgttcctctccctcggcggccggcaacatccctgccgagcgccgaagccgccgcggactcgccgatactctgggtaccctacttccggcgccggcgccgcgccccggctacgccgccgttcggcgacccgtactcgacggctcgaatctcctcaacgcggggccccccccccggacactcaaccctggcgccnctgtgactaaacggaattccnccgacccgttaacntcggaacccgtccttccccgacggccggntcgtncccaaggtttaccctaatagnn

SEQ ID NO: 21456 - DNA, 635 bp, Triticum aestivum
  unsure (1)..(635): unsure at all n locations
  Clone ID: PAT_TA_21456
agcagtgcgagcaagggccagagcagtagcagctcctactgatgtggacgttgccgccgagggagcgacgctgtggaggaactggtcggtgccgccgccatagctggagccgcgccatgtcagctcgggaccaagcgctgggggtgtagctggttctctgtccaactgggtaggggtacaatctgtgtgagcctgggttatgtgtggtggggctggctcttggggcaacaaccgtggtctatctgcatccgacgagtaacgcatccttttcctgaagaccgtgttttttacccccatagatacccctccaattccaatgccctgggtaaacaagaaaantattgaatgtacatgcattgttagataacatgttgcaatggatatttgggaaggaaacatgggatggaatatcccatttaggttgcccaaccaaacaggtacatgacatatttncctatatgatggtaatgaacatgatacatgccctttcccttttgtagggcctcatagagattacctntcctctatgagatactttcacatgcctatttcctccagttcacaaatgtncatcatacccaactcccctggattttggcttttcagnngggcttaattgntttccataacggngg

SEQ ID NO: 21457 - DNA, 933 bp, Triticum aestivum
  Clone ID: PAT_TA_21457
cttcggctccccgcctcgcgccgccggtcgtttcttcttcttcctctgtcattgccgcaatcgacggccggctagcaaagctgcacggccggcaacgccattgagcttgagtctgcgtcatctcagttggcggcatgtcgaagtggccgggagcgacgaagaagaggctgaagcgcggcctctggtcgccggaggaggacgagaagctcatgaaccacgttgcccagtacggctacggctgctggagctctgtcgccaagattgcaggccttgagaggtgcgggaagagctgcaggctgaggtggatgaactacctgacgccggaccgtgagtggggcgccttctcgcaggaggaggaggacttcatcatccacctccactccatccgcggcaacaagtggtctcagatcgccgcgcacctgcccgggcgcaccgacaatgaggtcaagaacttctggaacaccatcatcacgaagaagccccgcccgcgcgccaccaacccggcctcccccagcgccaggccgctcgggccacccaccacccccgccccccccccgcccgtcagccgcgacgccgtgttcagcgaggccgagctgatactgtcgtcccccgtggggggaccgcacatgccgccgctggtgtcggcggagagctacgtgtacagccggggcagcatggacggcgccggcggcgtggtgggcgggtgcagcgacgatgggtcactgtcctcgctgtcggggtacaacaacaacaaccagacggcggacttcgccgggtacctggatgcggacgccctgcacggcgcagtcatcccgtcggtgtcgagctccagcacgcttaactccatggccggcgtgagccccggcggcgtggccaacggcaacgctacggacgagctgtgctgcaacaactacaacaagaacaacccgagca

SEQ ID NO: 21458 - DNA, 662 bp, Triticum aestivum
  unsure (1)..(662): unsure at all n locations
  Clone ID: PAT_TA_21458
ttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattgggtgtggaagttcatccgttgggatttcaccactaactgtggtaagatcaggtctactgctggggataccgcagggcaagagaatttgggtggctcagggatggatactatatccatggccagtgtgcgatcatcatgtttgatgtaacctccaggcttactttacaagaatgtccctacgtggcataaggacctgtgcaaggtccgtngaaaacatccccattgtcctccgcggtaataaggttgatgtgaagaacaggcaagtcaaaccaagcagttacttccacaggaagaagatctgcaatacaatgaaattctccaagacaactacaacttgagaaacttccgtaccccaaggaactggcgggatcgacctcacttgtgaaccgttgcctanctccgagttcatcaatgcagccaccacataactactncganagtgnaaccntcng

SEQ ID NO: 21459 - DNA, 459 bp, Triticum aestivum
  unsure (1)..(459): unsure at all n locations
  Clone ID: PAT_TA_21459
ttcaccttctggccgctcgccgtctacttccccgtcgagatgtacctcacgaggaacaaggtggcgccgtggaccaaccagtggctcgccatccatgcgttcagcctcgtctgcctgctcatcagcgcgttcgcctccgtcggctctgcggttggcgtgttcgggtcggagacgagctgattcaaactctgcaaatgcaattgccggccacttttcggacatgcatgttctgtgcatatactgcgctttgtacatttagccgttatacctaagtactgggaacggtcaggccgggccccgagcctcgtgcttaagctcaaaacgggtctgggcccagaaggtccaaatttttttgggtnataccgtgtcagcctaaaggtgtaaatatggttggcctggcctagctcctccacctcgttccgccccctcccggggctttgcccacctatatcctntaan

SEQ ID NO: 21460 - DNA, 658 bp, Triticum aestivum
  unsure (1)..(658): unsure at all n locations
  Clone ID: PAT_TA_21460
catcgtcctcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtccgggggtcttccggcgccagcccgcgctacgggcgcttgcaagccaacggcggcagttgaccctgaagatatccaattggagaaggtcaaattaaacctcaaggcatttctgccatagtttggcttgcttgtttgggggcaatccgtttgggttacatcctggtgtggcaatggccactggatactcccaaagttttgggatgctgaaatcgtcttcaagggtggtggtacanacctgggtggtgaaccaagtcttacggggtccttggaaaaaatgggggcaaaaatcaccggagatccactctcagggaatctatcaaatcagaacnnaagatatgcatctcgaatgaccggncacgccn

SEQ ID NO: 21461 - DNA, 750 bp, Triticum aestivum
  Clone ID: PAT_TA_21461
aggagttcatcgcggaggttgtcagtatcggccggctcagacaccgcaaccttgtgcccctgcttggctattgccgaaggaaaggtgaacttcttttggtttatgactacatgtcaaatggaagcctcaatcagtatttatactttaaagatggcaagccatcactgaattgggaggagaggttacatattatcaagggtgtcgcgttcggattgttttaccttcacgagaagtgggagaaagttgtcatacaccgagacgtcaagccgagcaacgtgcttctggacagtgaaatgaatgcaagactaggtgactttggtctctcaaggttgtacgatcatggcactgatccacaaaccacacatatggttggaaccatgggatacctggcgcctgagtacgtccgcacgggcaaggcatccactctgacggacatgtttgcattcggcatatttctccttgaggtcacttctgggcagaggcctatcaagcagaacccatttggcaacaaacatacattggttgactgggttatagagcgctggcacaacggatcgctcatggagactgtggatccgagactgcggggtgactacaacatcgatgatgcatctttggtgctgaagctagggcttctatgctcgcacccttttactagcgcaaggcccacaatgcgacatgtcatgcagtacctcgaaggtgatacaccactcccagagctaacaccagcacatttcagcttcactatgc

SEQ ID NO: 21462 - DNA, 677 bp, Triticum aestivum
  unsure (1)..(677): unsure at all n locations
  Clone ID: PAT_TA_21462
gttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctccgtgcaactaggaaaaggcacaaggtccgtcccactgcatgcgtcaagagactgtctgggtttcctgttccgatttgtcatttgctgggtgctcaaaagcggttggttccctccgaaggatcagcactacccctggatggtgggacttgtcgcacctggatacaactcaataacctttacccaaagatggcgctgcaaaacatgggtgctcaaacaaggatgatcctcctacaagtacaagagcccanaagattccaagatagaagccgtggnaagggacaaagacaangttgtgaacagggtgacatacaaaanactgcaaagcaactccacaaacaaatacttggtgtagctggtcaaatcaaattgtgagagcagggattcctgtacgggccaggtacgaactggcggcccctggatccagattggccgtgtgaggngtctactgattctcccgccaaccttcgccggtccgngtcccantaaaga

SEQ ID NO: 21463 - DNA, 995 bp, Triticum aestivum
  unsure (1)..(995): unsure at all n locations
  Clone ID: PAT_TA_21463
gtttcttcctcgaatagctaccacctaccagtcactcccccacgcacccatccacccacaccaccaaaaaaggggcggcatggctctggccgccgccgtcgccgtaccgttcctcctccacgcccgcctgggaccgcgcttcgcgccggcgctgtccccccgccgcctgctgccctgctccacgaccgcctacgagccccctcactccgcgcggccgccggcgtcgaagcaggccgagcccgtgtcccaggtgccgtggagggccgcggaggccgagatcctccgccacgtcgaacccgtcgtgcagctcatcaaggacatcctccactcgggacagatacgcagacggcgaatgcctcggtcccgcggacgaaatcgtcgttgcggaaaagatccttgcctatcatccacgcgctgaagataagattggctgcgggcttgacggtatcatggtcgacaggcacccgcagttcaggaagccgagatgcctcttcgtcgttcgcacggacggcgtctggatcgatttctccgtaccagaagtgcctccgtgagtacatccggagaaagtatccatcgcatggggagcgatttatacgagaacatttcaagcggacctgaagntatttactgatccttantaatgcgaaaaatgttgtatgttttgaaaccccttgtcnatattaatggacaaattactttgnttggttggttggttccaaaacaanataagagggtaggatcaaanggaaantaaaaaaaccccaaggggggccngtaccaattcncccaanntgatccnantacngcctcacggcgtcntttaaaactctgacnggnaaacctgggttaccaantaacncctncaaaaaccccttcccanctgggtatacgaaaggcccacgatgccttcaaaattccactaanggatgaacnccntcggcattacncgggggtggtcccantgcgtaattcagccaagccgccttctttctctt

SEQ ID NO: 21464 - DNA, 653 bp, Triticum aestivum
  unsure (1)..(653): unsure at all n locations
  Clone ID: PAT_TA_21464
gccctcgcccgtgctcgcagttggtagggttgtagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcactaggcccttattctcaggccatcaaagcaaataatcttgtgtttgtttctgggagtcttgggcttgaatcccgagacaggaatttatctctgaaaatgttgaggagcaaactgagcaggttatgaaaaacatgggcgagatattgaaactagtgggtgctactatcttaatttgtgaagacaacgatcatgttggctgatctgcaggatttcaataaagtaaacgagatctatggcaaatattcccggggcaacaactgcacgattaacctacaagtggcgccgccgcaactcccggntaaatgatgnaccncnccaanattacaacnccatantctcataccccagaattnggaangnactgncattatnntaaanggggnaaacctttnccgaaaaanttttttttttaaaa

SEQ ID NO: 21465 - DNA, 518 bp, Triticum aestivum
  Clone ID: PAT_TA_21465
gactaacgatgactagacaaagcttactaggggggctactcttttcagcacatctctcgatattcagactaaagacgaaactcgttttatggcctgttgagaaacaggcgttcgatgagcccctttagaccgtcgctgaacgtgaacgcgtccttgttgtcaccgtacatcaacggcatgctggcggttatgtcggcaactcgctgcactgctggaagtagtttgctgttctcaaagcgtgctccgtttatagttttccatgcatcttcaatcagggagcttatctgtgcaaaggcaacctcagctgtgacgccatgctcactgatgtagcattcgaccgagctgtccacgtcctttttgttctttccacgctgcgaaagaacacatccatttatttatttatttattactgggcaacaatcccaaaggacaaagaatacttaatggtcctaataaagaattaatcaaggacatgtaccaatcctacttatacgaaaaaaaaaaaaccgtacaattgc

SEQ ID NO: 21466 - DNA, 1650 bp, Triticum aestivum
  Clone ID: PAT_TA_21466
ctccccggttcccgcttctctcccccctgatgccgccttaattagccgcctggcccccctaatcctcctgtttgcacggcggttacccggctcctcgtcggcgagcggtggcggcggcggggggcggagggatgatggcgtcggagccggtggcgcgggccgtggcggaggaggtggggcggtggggcagcatgaagcagacgggggtgagcctgcggtacatgatggagttcgggtccgtccccacggaccgcaacctgctgctctcggcccagttcctgcaaaaggagctccccatccgcatcgcccgccgcgcgctcgagctcgagtccctccccttcggcctctccgccaagcccgccatcctcaaggtgagggactggtacttggactcgttccgcgacatccggtattttccggaagtgaggaatcgggacgacgagcttgctttcacgcagatgattaagatgatcaaagtgcggcacaataacgtggtacctactatggctttgggagtgcaacaactgaaaaacgaacagttcagctcaaggaagcttcccccaggattcgatgagatccacgggttccttgatcgattttacatgtcaaggattggtattcgcatgctcatagggcagcatgtggctctgcatgaacctgaaccacagcctggcgtcataggcctcatcaatacaaaattgtcccccatacaggtagctcaaattgctagtgaggatgcccgttccatttgtatgagggaatacggatcagctcctgacatcaacatttatggagatcaaaatttaacatttccatatgtcacatcgcatcttcatctcatgctgtttgaactggtgaaaaattcccttcgtgcagtacaggaaagatatatgaattctgataaagatgttcctcctgtcagaattatagttgctgatggaacagaggatgttactattaaggtcagtgatgaaggcggtggaatacggagaacgtggggctccctagaattttcacatatctttacagcactgcaaagaatctacctgatatggagggccctagtgaaggagtgactatggctggatatggttttggacttccagttagtcgcctttatgcgcgatatttcggtggcgacctacaaatcatatccatggagggatacggcaccgacgcttacctccacttgtcacgactgggagactcggaggagccattgccttagtgaccccttctgtcctgatacagtttctgtaattaggttgctcttgttatattgtaatccttgttctggtttgcaaatattgtttcaagggccagccatatatagctgttaaacctgtatcttctagctataattatctcattgtttctgcttttctgcctgtgttgcataatttggcattgttgttcgtaagcacaatcatatgcggtagacggtacctcggccgcgaccacgctatctcattgttcctgcttttcctacctggtgttacagaatccggcctcgctcgtaggatggtctttcatccgcggtacccgggaccggcccgggcgcccgctcgggactggaagttgcatcttgtatgccctgcacgcgactattcatgccattatgtgtcttacactctgatcagtgtactcaag

SEQ ID NO: 21467 - DNA, 651 bp, Triticum aestivum
  unsure (1)..(651): unsure at all n locations
  Clone ID: PAT_TA_21467
ctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatctangcgcttaagaaggcgcgctggccgggtgggatgacgatggcgggtggcgggggactgaaccggtcttcatccaaggggcaactgccgccgcaaagactgcttgacatttctgcaccngtccttctgaatgtgcccaaggaggactgganccttccacggttctgttcccggctggacaagcgactggtctatgaggcaatccgttngacanaacccaactcaaatcctctccttcagggatnaatccctcatgtcaaagactgcacgctcccggcctaaagccgcactggttgttatcgccgcactcaaaactcgatgccttccggcccggcatatccttcacacgctctgggcgtcttgggatgaggtgggcactgnctttcc

SEQ ID NO: 21468 - DNA, 542 bp, Triticum aestivum
  unsure (1)..(542): unsure at all n locations
  Clone ID: PAT_TA_21468
ccgcctcccaactcccaagtcccacccccactccctcgctcaccagaggaactagcggccaggcaaagccgagccgcaaccgcgaagatcttgcgtggcctccttttcccagctcgtcactgtgccgctcgtgtccttcactcccggtccgcccaaccaataatccatcgatccatccaccaccaccaccccgctgcggcgatgtgcggcggcgccatcctctcgggtttcatcccgccgtccgggttggcggcggcggcggcggcggcggccaagaagaagcaacagcagcggtgccgtgtgactgcggacctgctatggccggggcccggcagtaagggagctccccaagacaaggaggaggacttcgaggccgacttccgcgagttcgaacgcggctcngcgaagatgactttgacaacgccggngaaggggggaacccgaggtcaagagcttctccgccgancgacaagttgcttgcacgnggcaaggaaaattttgngtangacaacatcaaaggtttnaagggatnacnttaaaag

SEQ ID NO: 21469 - DNA, 707 bp, Triticum aestivum
  unsure (1)..(707): unsure at all n locations
  Clone ID: PAT_TA_21469
gcaggacggccacatccgccatattcaggcatggaagcaccggctgcgaagcgcgtcctccgcgtggccgccatcagcggctccattcgcaaggcctcctggcacagcgggctcatccgcgccgccgcggaggtgtgcgaggactgcatcccggggctgcgcgtcgaccacctcgacgtcgccgacctgccgatgctcaacaccgacctcgagacgaacggtggtacgggcttcccgcccgccgtcgaggcgttccgcgccaaggtccgccatgccgactgcttcctcttcgcctcgcccgaatacaactactccatcaccagcccactgaagaacgcgctttgactgggttctaaaggagttaactgctgggcagacaagccggccgcatccgtcagcgccggaggaacttcggcggcggaagtccaactacatctgcccaagtccggtgtcttggcatcattcatcaacaagccggatttcctatccctttcctccacccgcaattttcgggagcagccggactcatccacgcccaccaagaggcccctcggctcggccctngcctttgcctggtccgcagtccgaggtaaagctcggcaccgtgcccggattcctgctctaaaaaaactcggtgcntctaaaaattgcacctaagcgctgtaatccaattattgncaacaaanaatnatgaaattctaaaaaaa

SEQ ID NO: 21470 - DNA, 607 bp, Triticum aestivum
  unsure (1)..(607): unsure at all n locations
  Clone ID: PAT_TA_21470
cttgtctccttcccccggccatctccggcaccggatttttcgtcgccgccttgtcctggccccttccgcgaagacccattcccacacaccctttatgccaacttgccgcccccgcggattcgcgcgcaccgcggtcggtgtctaggcttgattggccctggcccaggagcacggcgaaaggcggcgtcttggtgtgaagcggccgcgctggattggttgccgccggtggtgctgatcgttgggcgtgtttgagagcgcgccgaaggctctgccttgtggggagcggtcgacaggcagggtcaaaggaggcggtctttcctcctgtcccgatcgcattgttgatctgacacggtttcctgggaaattcaggttagggataagccgggggagtggggtcctcgtgaangaggaacaacggttcgcgtggatcaaggaagggatttattgcgttgggatttggtagtggtggcgctgctcctccgttcttggataacgttgganatgggacggnctacacaagtctcagggggcggaagcacgaggagactaanaatctacgccggtggcataggggaaccanaaanctgngacntaaaaggaccgggaa

SEQ ID NO: 21471 - DNA, 815 bp, Triticum aestivum
  unsure (1)..(815): unsure at all n locations
  Clone ID: PAT_TA_21471
cgagagaatatgggttacagtcatgcagatatcaactatatcctgaagctcattcatatcctctgcctaccggaaatgaagctcttcttggatacgattaggctgctagccaaacatacagataatttgtcagatgaggtctgcaattacataattgatgggaagcttatccaaacagccgttttgctcctagcagctcaagagcagatccgtggtgtatcttcccccaagaaagacctcaatagtaagccagatgagtttgctattatcactaactgtgttgtgggcaaaattacctccatacaattggagatgtgtcaaaaaggaaaggaactggagccactagaggcgaaaaagaagcttttcgatatgacactgacgcttgttcatgtaatttcccaagctggtgaagctcttgattcttacattcgggatcatcccaagctggccgcgtcattctatcaggaccgggctctaacatggaaggtgccctgtatcattccaatttcccatgtggaggtccttgaacacgtctcgttgatattaaaggattatggtctttgttctggagagggcatagatattggaaatctctgcccctatgagaacgtggtttcttctgaagagctgcctcgcaaacttggaccgatggccaggatgaaagcaggcacagatgagccttgtttggaaaatgtaaaggctaaagggaagaaaggtcctcggggatgggagctcaaattggcaaggagaagcttcttcccatactggagatcagtgttaacgtcccagtttcatgtgannnnnnacatcaatag

SEQ ID NO: 21472 - DNA, 686 bp, Triticum aestivum
  unsure (1)..(686): unsure at all n locations
  Clone ID: PAT_TA_21472
tttcatctcccatgcaggtgattgaacctagtcttgtgagcgaatcttctattagtccaagtgtatctccctcgacttttgtcagcagttacattgcagatcaatgcttggcctttaaatagtagtcaccttgccccatttccagtcatgcgtatttctgtaactagagtaacatttagctttctagagttgtcgttttgtatggagcaaacacttctagttgaactgaagtactgaactctcagatgctggctcttttgcttccaggatactctctgtttcttgggattaattattgaccgattacatcactatattagagagttgagaatgttgagggaagacatgggaggctgtaacagagcaaggccggacactagaagcagcaaaatcccggaagcactggacgagttccaggataccaaaaagaggtgcgaagtttgaaggacaagtgcaagactccaagaacaatcacaanagaaaacagagcgactaaaaacgccgaaccatcccggtgctttccgagaaaccggaggttactcctgaatagacgtccaatgcgnnaacaggattggggacactgantaattaccncgccgtccattcggggaaaaaaannnaacaattcgantttaaaaangatttcgnnnttctcaaggtanggnccgtttcataaaaacncaggn

SEQ ID NO: 21473 - DNA, 692 bp, Triticum aestivum
  unsure (1)..(692): unsure at all n locations
  Clone ID: PAT_TA_21473
ggcttctcctggagttccaccgccgaccaagtcacgcagggcatctccgccgccggcctcaccgccatcgtcactggggcgtccagcggcatcggcgcggagacggcgcgaacgctggcgctgcgcggggcccacgtcatcatggccgtcaggagccttcccgctgcccaggccgtcaaggacgccgtcctcgcccaggcgccgggggccaagctcgacgtcatggagctcgacctctcgtccatggcctctgtccgcgctttcgcgtcccaattcatcgacaggggtctccccctcaacatccttatcaacaatgcaggagtaatggcaataccttttgcgctttcaaaggatggaattgagatgcagtttgcaactaatcatgttgggcatttcctgctcacacaccttctattgggatacatgaagaggactctcatgaatcaaattggaaggaagaattgtcaacgtgtcatcagaggggcacagactgcatatccggaaggaatccttttgacaagattaccatgaatcaatgtatataacattgggcatatggcaatcaagctgcaacatatgcatgcaatgaactncaagcgattnaggaaatatgcacatacngaaatcctcaccggtcatnacaaactttcgcacattcnccatcctccaccggtaatnggtaaatngaaagg

SEQ ID NO: 21474 - DNA, 563 bp, Triticum aestivum
  unsure (1)..(563): unsure at all n locations
  Clone ID: PAT_TA_21474
cccacgcgtccgctttccctgctcccagctgcgcaccatggaccacccagcaaatatgtatcttcacatactatgatcatctctctctctctctctctccctcatgatgatgatcctctcaccgcggcaatggctgctgctgctacctccgttcttcctctctactcttctcttctcctacctgtacaccatcctatggctaaggccggagaggctcaggcagaagctgagaagccaaggagtgaagggtccaaagccttctttcctcttcggaaacataccagagatgaggagaatccagaaacttgccacgccttatcaagaagagggagcagggcctacagatcgcttctcctcaaattatgtggccattctgttcccttacttcctccactggaccaagagtttatggttccatctactggtatgctactgggaagcatacaaactctacatgtcataantcctgacatggtgaaagagctgggcaattncaatcttggatcttgggnaagcctanctacttcaaaaagnnatggagctcttcttgggaacnggaattt

SEQ ID NO: 21475 - DNA, 362 bp, Triticum aestivum
  Clone ID: PAT_TA_21475
ctaacctgtgaagacatggatcaggcactgaaccgtgctggtggcaaggctggaaacaaaggagctgaagctgctcttactgccattgagatggcctcgctgttccggcatcacttaggctgacaccttgtgtattctgattttctatacacgaggcggcagcatttcctcctatcaagagttttggctaatagagagcttttccgccgcggctagtataatttatttccaagtctgttggtccggtgcggattggttgctttccttctatgagacctgaaaagctcacaagacatatctgtaatgtaaacctgacaccatgaataattgtcgccacgaacgaaatatggcatgaaaaaaaa

SEQ ID NO: 21476 - DNA, 697 bp, Triticum aestivum
  unsure (1)..(697): unsure at all n locations
  Clone ID: PAT_TA_21476
ccgatttaagcccactgtatgaacatcctggcaaggcaaacatactggagcagttatttcttaaactagaagattcaattagggattctggatgctttcctggatgtccacagaaggagcctccttccacactgttgtggaccctgtttttgatttctcagcactacgacagaagagggcaatatgacattgctttgaataaaatccgatgaggctatctccacatacaccgactgtcatccgatctatatccaagtaaagggaaaagatattgcaacatgctgggaattccacagcagcacccgcattagcaagatggaagctaggcccatggttcttggctgatcggtatttaaacagcgagggtgttaggcagatgctttcaggctgaccaagtttggccttgccgagaagacggctgtcctggtttacaaaagatggggatcaacacattcctctctggacgcgcgatgcgggtggtatggcctcccggctggggtgtcccgtcccggcatgggggccgcccccgggcctgggaaatgctggataccggaaacatacccgatatgacggaagtaattgcntcaatcanatgctncggaaatgcactnagcanagttcaagcgaanttcagatcgttgatccangatactcaaaggctcgcngagcanagngaantaacaatatccaaaaactc

SEQ ID NO: 21477 - DNA, 522 bp, Triticum aestivum
  Clone ID: PAT_TA_21477
cagcagcacgcctcctcctctttcagcaaacacagctagctagcagcacctgctcccttcgcctgtaatcatggcgtattgctgcgacgacggctgcaactgcccccctgactgcgggtgcccatgcgactgctgcaatttgtaccctgaagtggagaccgccgccgccagcggcatcctcgctgcgccgaccaccaaggccagcgccggcggctgcaacacctgcaagtgcggcggcaccagctgcaactgcaactgcagctgagccggcccaatggtggcgcacgagaggacgacgacgacgaggcgtagtatatatgtatgtagcagcgtctaaataagatcctgtcaagagtcaactgcacccgccattgtatggtcgcctgcctcgccttcgtctcctggtcctggggttcgttcatctgaacgttctcgcggtcctgtcagcctcgtgccggatcaatattatatatacacatacacacgtaagttacagtgttgttattaaaaaaaaaggggggg

SEQ ID NO: 21478 - DNA, 635 bp, Triticum aestivum
  unsure (1)..(635): unsure at all n locations
  Clone ID: PAT_TA_21478
gtttgcggtttctgcttcacactgcctcctcagtcctcaccaccacagccgtcgcgcgcaggagggtagggaggatgccacgtaagatcaccttggtcaaggagggggagccgcagccggtggacgctgctcaaggggagcccgctccggcaccggcggcaccgacggccgcgttgacggaggcggaggtggacgagctgcccagggccatcgtgcgccgccttgtcaaggacaagctttcccacgtcgccggtggggaaggagccgaggtcatcgtcaacaaggacgccatggccgcgttcgccgaagagcgcccgcatcttcatccactatctctccgccactgccaatgatatgtgcaaggaatcaaagaggcagaccatcaacgctgatgatgtcctcaatgctcctgatgacatggagttttcggagtttgtanaancccttaagacttcactgcaagagtttagaaacaaaaatgcagacaaaaggtcacaagcaaagaacaacaggaggaaaagagaaggaattaatgagaaancttccagaaaaaatntcacnatnatncaagnaatgggtactaaccagaaaanagatgataaataantccgngggggggatacncncatcaaaca

SEQ ID NO: 21479 - DNA, 595 bp, Triticum aestivum
  Clone ID: PAT_TA_21479
aagcagacgggcggtctgaactgatgccatgttgatatgtctgcatcatccgtgcttcccttgtggttggcatctgagagaaaaaatgtccatctttattcttctgcttttcttgtcatgtttgcgcttagcttctagtgtccctcttagttgcactcggctctgagggggccatagcaggtgcggatagagaaatggtttacttaccaaccctttgcagcgtttgccattgctcttgggtcaaatggtctaaccaagattttctactccgatattgttctcaagattttagaattatttgaattttcgagctggcaagtgatgatctgatatcctacactctcaatggaaaattccatgtgtggactattaatctcatcttattatctgatgcacaaagcgctctatttgtcttgcttgtttttttatatcaagactatcaaacctcgggtggcaaatgatgttaaatattatatgctaaacactgaatctttcatatgtttactaaactccgcttattatctgatgtcacccatcaacttcaaatgatttttatcatgttatcttgtctgcacatatgcccatctctcatgtg

SEQ ID NO: 21480 - DNA, 723 bp, Triticum aestivum
  unsure (1)..(723): unsure at all n locations
  Clone ID: PAT_TA_21480
cagactcagtgtgtcattgacaatcaagcacttccatgccttttgaacctactgaccaccaaccacaagaaaagcatcaagaaagaagcatgctggacaatctcaaacatcacagctggtaacagggaacagattcaggccgtgattaatgcaaacataattgcacctctggtgcaacttctgcaaactgctgaatttgacatcaagaaagaagcagcctgggcaatttcaaatgccacttctggtggcacacatgatcaagatcaagtaccttgttgcccagggttgcattaagccactctgtggatctgcttgtttgcccggatcccagaattgtaacagtttgcttgggagggtcctgagaacatcctgaaagttggcgaagcagagaaaaatcctggtgcaagcgatgtcaatgtttacgcacaagatgattgatgatgctgaaggcctggacaagattgagaacctacagagccatgacaacactgagatatatgagaagntgtcaagatctcaatctacnggctanaggaggagatgatccatgcctccggganaacccaagatggttcacttgggaacaacctcgtcacaggngatcacttggngaaatccattgaagcgnttcatgtctgccaangtggnatcaattgggaanggctccaaactgtcgcatgcggcaggttgagtatcataaggatctgcgacatgggnagatng

SEQ ID NO: 21481 - DNA, 493 bp, Triticum aestivum
  Clone ID: PAT_TA_21481
ctaagagccaagcggcagcagccagctaataattaagcagccaaattaagtgcgacgatggcgtcgtccatcgccagaaccgcatgtctcctcgtgctcacactgttcgtcgtctccgcggcgatcatcttgcccagctccctgtgccatggagcccgcggcgtcgggttaggtatcggcggcggcgctttggaccctgaccgtccagcgtgcgtcggggtcggggcatgcccagttcgtgggcgcccctttcctatcgtcaaaccgtcccccccatccaacggaggggacccacatcactgatgcctgcctcggatcacgcgccctccgtcgtatcggtctgtctacgatggaacgatgcaccgtgcacgagcacgactgcatgctactagctactagctatctccgtgtacctgtacatcgtccgtgcttatgtacgtacgtatggtcaattaataaaactgggtggggggttgggtagaaaaaaaaaaaa

SEQ ID NO: 21482 - DNA, 665 bp, Triticum aestivum
  unsure (1)..(665): unsure at all n locations
  Clone ID: PAT_TA_21482
tggatccgtcccagacctctttcttccaggtgcttaacatccccaccaagattaacatgggtaccgtggaaattatcacccctgtggagctgatcaagaagggtgaaaaggtgggctcgtccgagtctgccctgctcgccaagctgggtatccgccccttctcgtacggcctccaagtcaccaagtgtctacgaagatgggtccgtgttcagccctgaggtgcttgacctttccgaggaggacctgattgagaagtttgccactgggtgtctccatggttgcctccctgtcactgggcgatctcgtacccgacccttgctgctgtgccccacatgttcatcaatgggtacaagaatgtgcttgctgttgctgtcgagacagactactcgtaccacatgctgacaagatcaaggagtactcaaggacccaagcaatttgctgttnccgccccggttccgctggggacccggcgctcagctgctccaaggaagaanaaaggcgccgaacctgaaaaggatcgacnaagaaatggctcacctcttcaagataaaacgcggttctcaaacgcgcaatttggtttttttacaccacaatangtccaaattttcacaattaccgttaacacatgttcctaanttanacggttgtnccgtaaaaaaaaaaaa

SEQ ID NO: 21483 - DNA, 503 bp, Triticum aestivum
  unsure (1)..(503): unsure at all n locations
  Clone ID: PAT_TA_21483
cgccagtcctcactcctcaccatttcccaaaccctacccatacccccgccgccgccgccgccatgccgcccaagctcgacccgtcgcaggtggtggaggtcttcgtccgggtgacgggcggcgaggtcggcgcggcgtcgtccctggcgcccaagatcggcccgctcggtctctccccgaagaagatcggcgaggacatttgccaaggagacggccaaggactggaagggcctgcgcgtcaccgttcaagctcactgtccagaaccgccaagccaaggtctccgttcgtcccctcccgccgccgcgctcgccaccagcccgctcggagganccgaaaaggacaggaagaaggtcanaacatcancacagcggnaaatcggcctcnacnacttctccaaattccangacatnaggaanagtccatgcaaggatttgccggaacntnaaggaatttcggnactgcttacttggtgacctnaangnaaggcccangactgaaaaga

SEQ ID NO: 21484 - DNA, 703 bp, Triticum aestivum
  unsure (1)..(703): unsure at all n locations
  Clone ID: PAT_TA_21484
ttagaggacatttaaatagcgtggtcgcggccgaggtacagcaacttacaaaagacacaatctacgtcgacatcgccagatccggcactccagtatgcacatttcaattgcgtgccgcacccgcaggtttttctgcgacgccttgacgaacaccggatttccaaaactattgccattaatctgtacagagctgcatccaccggctgatcctgaagctacttctcatgcgacagagcgtgctcgggccgatgggtgaactcgtagtcgaggtgggacaaaggcgcgctcgatctcaggcaggcccgcccgcgccgccccgcgaggcctcgccgatttcgtgcgcctcctgcagcggcatgcccgccgggcagcacgattccacctccacnaattantgcaaccgaacgtgtaggccgcaccgtgtcaatgtgcctcacggcttgtggtggtccagcaaagnangnaacttctgaagnatctgggaancgantgcccacaatgatggctttcaacacgtaacacattctgatggtgtnatgcagatattccaaagtcatcacctcaaanattcagtatgacccagcatnttatnnaacaaatnatcggnaacctacatttgnactcgaataaccggaatttcagcngaaatngtcaacattcgcctcaacatcccaaaaantntttcanttagcctcacggaaan

SEQ ID NO: 21485 - DNA, 427 bp, Triticum aestivum
  unsure (1)..(427): unsure at all n locations
  Clone ID: PAT_TA_21485
cactccaagctcaccgagtagcagaaagggtagtttgtgtgaacctggtcattaggtggttctatggtttccggttgcccgacgaatacgagtgccaccgaatctctctaggtgagctcaccgtggctgagggagcagagtttttcgccatccttaaccgtggagctgttcacacggtattccttctccggatcagtctggtgaacgtagacaagtgaccctaaagtacaaaaaggtacacacggccacacgccataattagctgcctggcttgttttgcgccctttggtaaatatgtgtaagcttttgttccctcgccccccccccccccccctggattcnaatatggagccattaagcttcgttgcgcantaaacttataaatactaatgtaaaggttgcctgttggttgtgccgcaaaaaaaaa

SEQ ID NO: 21486 - DNA, 748 bp, Triticum aestivum
  unsure (1)..(748): unsure at all n locations
  Clone ID: PAT_TA_21486
ctctgatctctccctcgctctcgcagccgccccttgtagaagcttcgaggctgctgctgctgcgcccatggccgcggaagccaagacgccgtccctcgccgaggagtattcacttccaccacaggaagttccagtggaaaaggcagctgaggagaagccctctagtggtactgagtctgaagctgctccctcaaccaatgatgagactcctccatctgtagaagacaagaatggaacgtctgaagtacaagatgctgctgaaaagccagacgcaagaagaaactaacactgctgcagaggaaacacctgctgtanaggaagcaagtgagactgccgaaggaggaagaggctgagaaacctgagatcaagatcgaaacagctccaagcagattttcgtttcccaacaacaaaccaaacgaggcattgtttcacaccctatgttgaatacacangtgtgtggctgcaaaangtgaggatgcacctgagtgtgataagttcgccaagtactatcgatcccgtgcccagttaatgggtgatcgctggaacaacaaccnaaaacggaacttccngacctcgtanctaaatcaaanaatttaccncaantntcggntcctcctgaacggccaattactttttggccccaaaaaaaaaccctttgttaaaacccgtgcccccangaatttnccntaaaangccnttaatttttactnaaangtctcccaaaaaaaccnggggccacntccaattt

SEQ ID NO: 21487 - DNA, 743 bp, Triticum aestivum
  unsure (1)..(743): unsure at all n locations
  Clone ID: PAT_TA_21487
tttttggttggatctaacgcgacggcaaagacggtgtatcgaagggtcgacaatggttacgacgatcggtagtccatagcagcggcgggcgcaacttcgacccggttttcttcccatatatctgtcaaatccttctccggttaccctccatcggcagcaatttccgccatagataccggcgatcgagggcctcggacaacccaatcgacggagcagcgcggcggcaggagagggcaaacccttttcttctcagtacgcctctcccctccgcccgggttccccccgctggtagataagacatgggtcaagcactcggcttgattcaagtggatcaatcgacagtagccatcaaggaaacttttgggaagtttgacgaggtcctagagcctggatgccacttcttgccatggggcatagggaagcaaattgctgggtatccgtcactgcgtgtgcagcagcttgatgtccgctgcgaaacaaagacaagggataatgtcttcgtcaatgttgtgggaatccgtgcaatatcgtgccctgcccgatggggccctgctgcttttggcaggcctcggggcccctccgtccaagctttcagtccttgctgtgtcctcagggctgggttcctttctaacttggtccagccgtnagcgactaatggatcccctggcctttgcctccctttataccgaacntcaacttaggtacgaattgtcaaacccgattttnaattgcccnaanacatt

SEQ ID NO: 21488 - DNA, 419 bp, Triticum aestivum
  unsure (1)..(419): unsure at all n locations
  Clone ID: PAT_TA_21488
cttgggcgcacctttgcgaataagagcatggacgtggccaggagtttcagcaggttgtacaggcaggacacaaaggaagatacgggcaaatccggttgagaaaggcaacgcaatccatctacacttatcctgcacctgactgtatgtgccaagggatagngctactgggtttcaaaatttcagaaaaccaatcggttctgcagcacatgacggtcgaggatcgccgtctcaaatgttgcattgcngttagtacattccaagctgccactagatatgcaagtttgatttttttgggacaccgcctgtgtccggtttcccccccccctctctctctctctctctctctctctctctctnctcntctctctctctcnctctcttcaaaanacagtttggtgcaatngagctnatntattatc

SEQ ID NO: 21489 - DNA, 666 bp, Triticum aestivum
  unsure (1)..(666): unsure at all n locations
  Clone ID: PAT_TA_21489
caagtacctgcgccggccagctatagacaagaggcggcttggagaggcaggcaccatcatccatggcgccctccggtgacaccattgccctcgtccacagcggcatggacagcagcaacaagacgctgctcaagagcgaggccctctacaagtatgtcctcgacacgtcggtgctgccgcacgagccagagtgcatgcgtgagctgcgcctcgtgaccgacaagcacgagtgggggttcatgcagtcgtcgcccgacgaggcgaagctgctgcggatgctgatcaactcaccggcgcccgccgcaccctggaggtgggcgtgtacacgggctatcgctgctggcacggcgctggcgctccccgacgacggaangtcatcgccttcaacgttaaccgcatactacaatcgcgccctcatcacgcccggcttgcggcaaggccagtccgcgaggcccccctggaactgacagctcccgacaccccacgcgcctcctcctcgctcgtcnanccacanccaattcnnatncacaacantgtcgctgtgcctcggggacatctntcaaaaaancctgtgngaacntgatcacgaaanccatttgnanaagagtccgccatagnacnagttctccngaaaccttagtgtacccaccnggtcnatnccccctt

SEQ ID NO: 21490 - DNA, 620 bp, Triticum aestivum
  Clone ID: PAT_TA_21490
accagcgccgccgccgccgccgcccctctccccgagttctcagcggcacgtaccagcgccgccgccgccgcccccggaagcgagctcctccaccggcgtctgccccgaggcatgaccggcgctgcccccgccctcctccaccaccacggagtttcaagcagaggaacgttacctgtctatcatggcaattgcagattcgtcccaggatcttgtttcctcagcaaatcaactattttgggaccattgactgtgtctttggtttgtggtgctacccccaacaaccatagaccaaggaatccagatatctcacgacaacagaagaggggttcatcatcaagggggaaaagcaagccattccaagaaagggacgactctgccaataatgatgaatttgatagcgatacagtatcccacaaaaatggaccacctatatctttgacaagcaacacgtttctccatccaacaaaagctgcatgggaaaacaaactgctaagccaagggaaaaagaacgggaggcacgagcaagcccgaacctgcggaaaaggcagggaggacaagaagcctgaacctgcaaaatcccagggtgagaggggaagtgtggattcccttcttaatttgct

SEQ ID NO: 21491 - DNA, 651 bp, Triticum aestivum
  unsure (1)..(651): unsure at all n locations
  Clone ID: PAT_TA_21491
ctgacctctctctacatccttttgtttgttgccctcctccccatatcatcctcccttgttcgtcatcgtctctccctcagctccctccagccgccgattaatcgatcgatcacctattcacctagctagccggccagttgctggttctcttcttccgcatgctgccgattaatttattccacgctccgattgcggtggcggctttagttaatattatagggagcttcaaagatagcaagcaagaaacggtgcangattaattgggaggaatagagttcaattcaagatagcactgcaggctgctgttgattccgcgattcggccgattcgaggatgtgcacgaagggccactgggagccgtccggaggacgagaactgaaaactccttgcgctgttacgggccgcacaactggacccctcgcccgagaacttcaaggagttaaggaaaactgcaagcgcngtggtcaacaactggacccangataaccggacccttctcggaggaagagaggactgccctcctccacgggtcacggaacgcnggcgtaccaagttccnggggacgaaanncgtaaaacacgnattatatgnccgngtgaggacgatcgtntcaaaagctccggggctcncncgggcgncctctcccacggc

SEQ ID NO: 21492 - DNA, 928 bp, Triticum aestivum
  Clone ID: PAT_TA_21492
ccgctcgaagcgacgcataccactacttcacttcaacgcatacgactacctcacttactcgaccggccaaagcaagcaggtcaccatgggcggcgggcacgacatgcacggcggccacagcggcggagtgaagggcttcgtgtccagcctcgtcggcggcggcaaaagccacgggtacggcggccaggggcacggttgcgaccagggctacggcggccacgggcagcagcagcacgggtacggcggccacgtgcagcagcacgggtacggcagccatgggcagcagcaggggtacggcggccacggccagcacgggtaccctccgcccgccgccggtgcttgccccccgtacggcggctacccggcgcaaggctacgcgccggcggcgtaccccgcgcagcccgcgccacaccacggtgggcacatgggatcgtaccacaccgggcacggcggcgggcacgggcacggctactccggcgggaagcacatgggcggcggcaagcacggcggcaggaagtggaagtgaagtggccgataggcgatagccgccggtcggtcgcccgcgcgctcacgtaagcacctgctgcgtgccttagctaagtataacaacggatgctccgtatgtacgtatacgtacgtaaataaagggcaacgtacgcgccacgcgcgtgtgcgtacgttagcttatcgcctgagctggtggttctgtgtagtgatgctgtgagcgtggtgtgtgtgacgacccagtacaaaataaagcctacagctcgtactatatgtaccgagcaatattgtaataacaccgtgtcatgtgtcgtgtatacgatccgagtgtactaaagaatacaaaacgaaaacaaactaaatactcccctgctaaaaaaaaaaaaaaaaaaaaaaaaaaaataaaaaccaaacaaacccccac

SEQ ID NO: 21493 - DNA, 542 bp, Triticum aestivum
  unsure (1)..(542): unsure at all n locations
  Clone ID: PAT_TA_21493
tttggtttggttgtttgtttggtggacgccttgcttttcacttcaccggaaaccaaaatggcagccagcaggatccctccttgccatcttcacccttcttcttcttcctcctcctcctcctccatggccacgatctgcccaaggccaggcacaaggcagtcgtcggccttcaggttcagggcctctgctcatgggagcggttcctcaccaaacctctcctccttcactgctgtgacaggcaagaaggttaaggtgttcgaggaccagctgagagggatcgtgtgctacagagacgacgacggggagatggtctgcgaggggtacgacgaaggcccaggctcggaatgcggctgccggagaaggctccttcccatggcctgtgggggttcgggtaacggactcaccaactgggcgacctccaagtcttccacgacgactccatctcctcaactcaacggtgacaagactaaagcatttagcatangggtcctataaattcatgatgggtatatcaanaatatgctggngttcctatttgtggt

SEQ ID NO: 21494 - DNA, 610 bp, Triticum aestivum
  unsure (1)..(610): unsure at all n locations
  Clone ID: PAT_TA_21494
tctagtctctagtctagctaggcactactctagctcccaagtggccaagtatactcgccagagtacgtagagtgtagttgagcgtcgtccaaggatggcgtggacctcccgccgcatggtcgcgtccgcgctcgtcttcctgctgatgctgctcgccgcctcagagatggggacgacgagggtggcggaggcgaggcactgcacgtcgcaagagccaccggtccgtcggcgcctgcatgagcaaagagcaactggcgagaacgtctgcaggacggaagggttcccgtggggcgagtgcaagtggcacggcatagagcgcaagtgccactgcaagcggttctgctaagtaattaactagccgggctgggcaagcgcatgcatgcacgacgaccgacctacctgctgctgggccgtttgcgtttggttcctggcctttgggccttgctgtggcgcgcatcttccgtacgtccgtgtcgtgtgccttcaagttacctcaattancatacaaacttcgtggtgcaactgtgtccgttgatgataaccggttctccgcgtggggtanagttcganggnttacnanccatanaatataggcctctcanaaaaaaaa

SEQ ID NO: 21495 - DNA, 607 bp, Triticum aestivum
  unsure (1)..(607): unsure at all n locations
  Clone ID: PAT_TA_21495
cagagactcaccagtcaccaccccaggccagccgccacgtttagccgggctaaacaaacacgggcgcacaatcggaactcgctgcactgcttggaatccaacgagccaatcattcaaatcctccccggaaccgcgttgagcagggcacggtcgattggatctagggtgagggtccgtcgccgaagaaactcgcaggcggtcacgaaggaggcggcgggggagggcgggggagatggcctccgaggacatgagcggcgacggaggtggctgcgctgctggacttgaagccgcacccggagggcaggcttctacaccgagaccttccgcgacggctccatcacgctcaccacgtcccaagctcccgccccactacaaggtaaaccgtgctgttagcaccgcaatctatttcctacttcccgcaaggagtgtttcccgtctccaacgcattcctgtgctgaaactggcacttctacaagggagagctctcacggtcctcgagcttcacgacgacgtcacattgacctactgtaatgggccacacntgaggaagcaacgccccaatatacgtgcaacgaactgtggttggtcttccanataaagtcaatcn

SEQ ID NO: 21496 - DNA, 216 bp, Triticum aestivum
  Clone ID: PAT_TA_21496
gtttctttaaagtctgttatttgtttccttaaaatcggttatttgtttcctaaagcaaattgcattgatgagatggatggttgatttgaataaattaggaaagttagatctgtgactttttgtatagtaggaaagtgtttgtttacaaggaaatagtggacaaaaaaaaccggtggggggctggggacgaaaaaaaccggacgaaaatggtgggac

SEQ ID NO: 21497 - DNA, 599 bp, Triticum aestivum
  unsure (1)..(599): unsure at all n locations
  Clone ID: PAT_TA_21497
cgccacccgatccgcgtccgcgcctggccccacccggaccccagcgagctcctcaaggcgcaccgcatcctcgccgccgtccagaacgcgcagcgcagcaccaagcgccgcggcgcgggacccgcgaggcccgtcatcgccgtcaccccgaccaccacctccgcgctccaggtgccgtcgctcacgtctctggcgcataccctccgcctcgttgacgcccagctcgtgtggatcgtcgtcgagccgggcaaccgcacagacgccgtcgccgcgggtgctctcccgctccaacctcgacttcctccacatcaccggtcctggcgactccaaccgcgagcctgcgaatccacgccctcaaggagattcnggacgaagcggatggacggatcgtggtgttcgnccgacgagaacacatcctccgcaccgaactgttcgacaaggcgcataaagtgacaacgttggcgccgtgccgtcggggccgggcnagganacgggccanganccttctaaagngcgtnctncnaccgaaggaattggngntacgctccngaggaaacntcnccgggaacggacaatctatgcacaagtggatggccggt

SEQ ID NO: 21498 - DNA, 527 bp, Triticum aestivum
  Clone ID: PAT_TA_21498
cgctagctcgctcgctctccttgcttattctcactggtcgatctgctaacacaaacagcagcagctcctcctcactagctagccttctctatttttgctactgcaagtgtccaagtctgcgacgacgtccgagatgtcgacggtgagccgtgcatcccttgaccagaagcttgccctcgccaagcgctgctcccgagaggcgactcttgccggagctaaggcggcagcagtggcgactatcgcctccgcgatccccaccctccgcgagcgtgcggatgctgccgtgggccaaggccaacatcaaccccaccggccaggcgctcatcgtctccacggtggccgggatggcctactcatcgccgccgacaagaaattctgtcgctggcgaagcgccactcgttcgaggaagctcccgagcaactcaaagaacacctccttcaagggaacggcgcccccaaccggcttctcaaggcatgatgacattagtatttatagggcgggccgtcaactcataatcatagaccaac

SEQ ID NO: 21499 - DNA, 661 bp, Triticum aestivum
  unsure (1)..(661): unsure at all n locations
  Clone ID: PAT_TA_21499
ccgagactcttctattcatataggcgggtaggcgtccgaggcctcgtttgttctcggcttctcgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgtgtcctccgtttacgctgcctacaggtactgctggggcangcacaggagcagcggaggcagtgggcgcccaagggaactgattccccgccgactgcgtggctgatctcgctgttgttgtatcatccggttggggtaaaattttgggttgttgctgtctaacaaatggggttcttgggacatggataggtgtagttgatacgttacacgttaccgattgattttggttgtattctccctttataaaaaaaangggggcccgtaccaatncctanatgatctataccnnctacnggcgtctttaaactcctaatggaaacctggtaccaantaacnctgngaaaccctttccaacgntatacaaaggccacntncctcaaattccaccaaggaatgaacccttncggataccgggttngtac

SEQ ID NO: 21500 - DNA, 573 bp, Triticum aestivum
  Clone ID: PAT_TA_21500
cgagttttttttttttttttttaacgagagtagtaccaaatagcagcacgtagagttgacgttggaatacatgtgtaacaccataacagtactttatttcaaacaaacatagaacatataatttttttttttaaaaaaagaaaagaaacatgtccactatgcctaaggacggagcggcggcaggccaaatacggcccgcctggccttggtatactccagaagcctgtccacgtccgggatcagccccttgacaccctccagcgcgcagaaccgctccgcccacgccgccagcagcggcgtcctgccgccgccgaggcccgtccccccgcagcgggcctcggcggcggacagccccccaacacggccgcccagcccctcccggcgccccccgcgccccccctccgtgccagccctcccgggggcccggccctgtgcccctgctcctgccgccccaacgccgcggccgctgcgcgccccccccgcatcgctcggcgtcggccctggcctgggtatccaccgctgtggggccgtcgtccactgggcaggccaggacggcgatggagcgtcgggggg

SEQ ID NO: 21501 - DNA, 531 bp, Triticum aestivum
  unsure (1)..(531): unsure at all n locations
  Clone ID: PAT_TA_21501
tttttttttttttgacatgacacatacgggaatgccaaatatcattaataaaatcgttattacagaccacattaacatggtaagaagaatgattgttcaaaacagaaaggcggagacaaaccgcctgactcatatgactttccaacaagaaagtaccaaacttaagataggaccactttattagactcaaacactaatttgagaccctgtccgaagcaacagcgacacagatatgaggtcccggctcatccgaggcacatagagcacgtccttcagcacgagcggcttccctgaaagtttacttccaggagacctgtccagtacctccaactgctgcctgaanacaattccaaccaagaccggtgcgctgttgtgcaccgtgtttncaactgtccccaagggttgactgccacctttaagggcccgaacacaaggaggaatnanttacgagagaccgagtttaaccttaaatccgggtacaaaaagctcccgtcgcccaaaacgctagcgcanctcgcttatccgtaggac

SEQ ID NO: 21502 - DNA, 692 bp, Triticum aestivum
  unsure (1)..(692): unsure at all n locations
  Clone ID: PAT_TA_21502
gcagaccacacaaaattaacaacacaaacaggatcgatcgagcaacgtacaatggcagctctggccccatccattgtagttcccacagacgccgagctgctgcaggcacaggccgatctaatggcgaaacagcctgtgctacctcaaatccatggctctcaagtgcgctactgagctcgggcatacccactgccatctacagcctaggcggtgctgcctcgcttcccngacctgatcccctcactgcccctcccccaaggctaaccttccttgccggccccgcctcgggcggccgccgccggccgccgccccgcgtcgccgcccttggagccccttgcccccccctactccctcacaccactgtcatacctcctgggtgggacggatcgctgccgataacatcacatggaccatgcacctttcctactcactgtgacgtcagacactacattgacctgggnatagactactgactggtnannaaggaagcaagacactcttcgatacancaccagatcctgttcaggagagtatggncgaaggtccggntcaaagatgtaaacaggttgtggcatnnaatttaacagaatgcgtcggataaagactntcagggggatntacgagcngtcatggatgananangagctccagnttcagtantaaaggcttcaggatcagnacgtgnggttant

SEQ ID NO: 21503 - DNA, 693 bp, Triticum aestivum
  unsure (1)..(693): unsure at all n locations
  Clone ID: PAT_TA_21503
aacaagcccatcttcgatgctgctgctgtttattgccttgatatcgggatgcaatgccatggctgctgcgtcctgcagcggtgtattgcgcgttcgacgggtgagcacaaggagaagctggttgccgcaatcgctcgcaatgggttcgaacttgcacaagatgcctatggaaactatgttgttcagtatgtgatagaactaaaggtcgctactgcaaatgcaagtctgggcagcgtggtcgcggccgaggtacatccacctctccatgcagaagttcagcagcaacgttgtcgagaaatgcctgaaagttttcaaggaagccgacaaagccaacatcatcctggagctcctttctgcgccgcagttcgagcggttgcttctgcacccttacgcaaactatgtggtctacgcagcacttcagaattccaaggggtctctccactcagcactgaccaacgccatccggcctcatgtggaactactcagaaccagcccatactgcaagaggatctactctcgagctttgctgaagaagtgatggcctgatgagaccatctcaccatgtaacaataaagattgtttgtcttgtgctattttttcggattcaaaagggataaaggtgatctcgccatgtagattttgtatagatcaaaattatttggtcatgtacctcccccgccggccccccaagng

SEQ ID NO: 21504 - DNA, 670 bp, Triticum aestivum
  unsure (1)..(670): unsure at all n locations
  Clone ID: PAT_TA_21504
gatggattacttattcaaacgatgaacaacatcgtctcaacaccttggttggctggtacaacatgcatgatgtgatctcacaattttgtggacgaagtagaaagattacaaacttaattaacgactgaaagcaagccccctgttagatagtgtgcaccgccggccgaccttcttattagttggttattaattaatttgacccttctgcagttcttcctaatctgcccaccggagccagttaacggagttgatgtcacccatcttcaccatgccccgtcacaaagcccgaagaagaactccctcctgggcaactgggcgttagactgggaccaacgcgtccgtggccccgccatttgaaagactcccgggccggatgcaagagcccttccttgcaanacaaggtcctggtagaagttgtcccccaaacgtccgggttgaaaggccaatggcgctagttcccccacctctagagccgaggactaagctttccgacgccgcctcctttcgccccttgtcgggcccgagtcggggcccttgccggggctgcccccatgggtacncgaaagcgacanctttgaaagctggcgnaaacactagtgagccaccgggggantttttgccctanccctcggtccccccgtttancagngnacatnaantccgggangng

SEQ ID NO: 21505 - DNA, 553 bp, Triticum aestivum
  unsure (1)..(553): unsure at all n locations
  Clone ID: PAT_TA_21505
tttcaccctcgcgcacctaactgacaagccgacgcctggcctgaccgcgaggagagaggttcatggtgcagtggagcagcgggcggcagcggagcctcgacccctcctcctcctcctcccccgcgagacgggcgccgagagatggccaaggtgcccgatctcggctccgacttccgcccagaagctgctcaagggacctccgccgccgccgggagccgctccgcttccgactccaccgccgccgcgccccgggcccgggatgcttattccgaatgctcaagaaacacctcaagttcaagaagccacaacaacaagnagtcctcgggctccgggtggcgacagtttagagcacaaacgagcgttattacaccgacaaggaacagcaagatctcattgccagacaanggacgccgcgccgcaatgacccccggcatcgccgatcccaagcaacgtgccgttacaaggaggacaaggaggaacaaacgggccgcggngacccggggggtggacttnaaatgggctggcctcccctcaacacaacgggaactcaaaa

SEQ ID NO: 21506 - DNA, 621 bp, Triticum aestivum
  unsure (1)..(621): unsure at all n locations
  Clone ID: PAT_TA_21506
tcatggcgcttgggaggcaagcgagttttactaggctggtggggacacacaaccacatccgcccatataaggggataaggatccacctttttacctacgccttcttcctcctttgcctatccatctcctgcgcactcaagctccagcgcccaagcccgcacttcccacctcaaccttctccagcaatgtccggagcgggaggcaagtggatggtctcctccgtcacagagggccatgtcaaaaagctaaggaaggccagatacttgtccaaagacatcgcgcaccggcttcccggggaaggggcagcttctccccaaccccaaggccccatgagagggtagtattccttcccaacttcctccggcggactaggtttcccactccaccaatttgtccgggggtcatgttctactatgtcctggatttcaatgacctggccccaaacttaacctcaaatctcggggttatcgtcctgtccaagctttctctgaatccccccaattcgggctctgggtcaagacactaacggaagccaaattggtgccggaacaagcgattccgaggccatggggcaaatggcacgcctnatgcccagggggccggtacaatcnccaaagggtc

SEQ ID NO: 21507 - DNA, 624 bp, Triticum aestivum
  unsure (1)..(624): unsure at all n locations
  Clone ID: PAT_TA_21507
ggagcggttatccaattgcaacatgtaattgtctttccaaatgtcttggctctccacgcaaaattttagtccctccacgtccccactcgtcgaaaccctagtttttagcaagttgctcgccaatctgcaagtttggtggcgggaacaagtggcagcaactaatcgaggtcgtctcatggcgataccacgcgaaaaaaagaagaagaggacatgggggaagaaaataggatttactgctaggagcgttagtgtggaactcacttacgcgcgcccaagagatttccaagaagcagtgggtgggagtaccacgcgacggagggaacgccggcggcttggcgcgctctggttctcccgcaaagaccgcaagtccgcaagattccggcgagagagaacaaagggaagggatttgggccggccgggccacacgacctggccatcaaaacaaatcgacatgggcgggcgctagcaactccaaaagncactaaggctaaaggcgagntccaaatgctcggctccgattctccaatgcattggtcggnaacggagcacttctgcgcgnctggaganatattacgnagacatatcacggattacgggcgaacccgattgttccctgccanaagg

SEQ ID NO: 21508 - DNA, 1800 bp, Triticum aestivum
  Clone ID: PAT_TA_21508
tcggcacgagggataaatagaggaccggccatcccggccggcggcgactcccccccagacgcacgccacgccactcagcgccttggcatcaccgcgtccctactcgtctcgtcccacccccggcggcccacaggatccgtccggctgcggtgagcgaaggaggagggagtggagatttgatttgatttgtgatttcggctcgtgcggcggcgatgggggtgctgtcgcggccggaggaggtgccggcgctgctcaggctcaagctggcggcggggcggatcaggcgccagatccccccccaggaccactgggccttcgcctacgacatgctccagcgggtctcccgcagcttcgcgctcgtcatccagcagctcggaccagacctccgcaatgccgtgtgcgtcttctacctcgtgctccgggccctggacaccgtcgaggacgacaccgccatccctaacgaggtcaagctgcccatccttcgggacttctaccgccacatctacaacccggactggctcttttcatgtggagcaaacgactacagagtgctcatggataattttaggcaagtctccacggctttcctggagctaggcgaaggataccaaaaggctattgaagaaatcactaggcgaatgggagaaggaatggctaaatttatatgcacggaggttgaaaccattgatgactatgatgagtactgccactatgtagcagggctagtaggctatggactttctaggctctttcatgctactggcacagaagatctggctccggatcatctttcaaattcaatgggtttatttctacagaaaaccaatataataagggattatttggaggacataaatgagataccaaggtgccgtatgttctggcctcgggaaatatggagtaaatatgttgataaacttgaggatttaaaatatgaggaaaattcagaaaaggccgtgcagtgcttgaatgatatggtaaccaatgctttgatccatgcccaagattgccttcaatacatgtcagcattgaaggacaattccaattttcgattttgtgcaatacctcagataatggcaattgggacctgtgctatttgctacaataatgtgaaagtctttagaggagttgttaagatgaggcgtgggctcactgcacggataattgatgagaccaaatcgatatcagatgtctattctgctttctatgagttctcttcattgctagagtcgaagattgatgataacgacccaaatgctgcgctgacacggaggcgtgtggatgcaataaagaaaacttgcaagtcatccggcctgctgaagagaaggggttacgatctggagaaatcaatgtacagaatgcctatgctgatcatgatcatgcttctgttggtggctattatcttgggtgtactgtatggcaagtgatccggtcaagatggtcctcttatgttcttagtggcaccgcctcccctatgtggttttgcacgtgtacttcctgactgcagatggatggctggtttgcatgtagtattgtgctatgtaccctgctggtgccatgcatgctagttctttttgttctttgtttctgtcgtcccgtatgttgtttcagcttgtaatttgtttgaatctaggagagacttccttagtgacatgtatcctatgaatttggcgtggcgccttggttgtcaatgattctacattttgtttatttgtgacgaatgtatgtgatgcatatcgttttgccgtgccacctgcgcaacttgattataattgtccaacaggcttgtcaaaaaaaaaa

SEQ ID NO: 21509 - DNA, 624 bp, Triticum aestivum
  unsure (1)..(624): unsure at all n locations
  Clone ID: PAT_TA_21509
gggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttcctaggaaacatgtagttgcttgtgcagctgtctgcaagaacatggagagagatgtgtacgagagatttgtcaaagaccccagagtttcctgggaaaaacacttttcctgtttccttgaagcagcctgggcctccagatggaactattcagtgttttaattaagagggatacatctaccccaatctacagtccgtaccttagtttaactccgccctgcctgttcgaaaatggcaaattccttctaaccgcaaaaaggaactgccgtgcaacatttacagaatatataatacaataaattcgggtgatcatcaagtgtcaagtnacaaccatacattgggaaattaagncaatttcctgggacaaaattgtaatntcgntaccaccgcataaangacagcaacatggaaggaaacaatnangatcacncagaaggataacaagntctgnggggaa

SEQ ID NO: 21510 - DNA, 1140 bp, Triticum aestivum
  Clone ID: PAT_TA_21510
tcagcttcccgcgccacgcatccgtcccagctcgcagtcacagcagcatccgtcgccactaattaattgcagatgtagcaccgcccgcccgctccgtggagcttacaagccaccagcgaggagagtcgaggcgcgcacgtgggtgggtctgcgcgcgccgtccgtcgtcgtcgtcctcctagatccaacagcctttgtccctgctcgcagccgtgcgccgggcggagggacgcgcgacgatggccaccggccgtgggctcccgctcctcctcgtccgcgccgccctcctggtcgggctcgcctccgcctcctccttgtcctccgacggcgtgttccaggcgggcgccggatctacttgcggggaggaccttgctgcaggccaagaggaattgtcctgtgaacttcgagttccaaaactacaccgtcattacaagcaggtgtaaaggttccaaatatcctccttaagcatgctgtgattctatcaaggaatttgcatgcccaatttaataactacatcaatgatgaaagcaatgactgtgcatccacaatgttcagctacatcaacctctatggccaagtacccaccaggcctgtttgcccccgagtgccgagaaggcaagctaggtctttctttgcgaaggcgtcccccaagaaagacgtccgttaaaagtggtgtccgaaaggggccccaaagcagctcgcttgctttggattactctcaatgtgtggactaggtagcattgttctttccaaatagacggtgccgtgggtggtggtgatacctttatttctacccatgtttttcaaagtgatgttcgagaccttgaatccggttgctgctccttaaggtggctcttgaaaattttccttctctgcataaatcttgtaatttgaaagctttcgtcagattaaatatccttgggaatttcgacccggtggccaacttagaattctctgatagtctctgtagcttgccaacttaagaattctctgattgtcgttgtatcaaacctctcaaactgtattatgtcgcactcgtgtgtaatgatgataactattttttttttggctcacaggaaacacgtgggttgtatgtgaatcatcaggacttagttcattcaagtctcaaagcaaagtcgg

SEQ ID NO: 21511 - DNA, 445 bp, Triticum aestivum
  unsure (1)..(445): unsure at all n locations
  Clone ID: PAT_TA_21511
agctgtaccgacttcaaaagggcaggctcttgctgacgagtatggcatcaagttttttgaaacgagtgcgaagaccaacctgaatgtggtgcaggtttttttctccatagcaagagatatcaagcaaaggctttctgaatctgattcaaagccagaggatcgcacgatcagtattaacagacctgatggcggtgaggcttcggcttcacaaaaatcagcttgctgcggatcgtgagggggttacattgtcacaaggaagataaatagtgtgataccatgcttggtaatttacccttcctacctttttancctgggcttaaccgtccactttctaacttttaattgcaatcccttggaatcagactcctgtgttggtaatgtgaacaattttagttgtacccccctgttaacaatgcaangctcctaagtccanaaaaaaaaaaaa

SEQ ID NO: 21512 - DNA, 520 bp, Triticum aestivum
  unsure (1)..(520): unsure at all n locations
  Clone ID: PAT_TA_21512
naancttttctctaattgcatgttgaactcagggagaaagtaccagaggcagcactagcaatcagactgcgagcagccgtgggagttggagccctggagaccatgccacttcatcaagttgcctctaaaaatagtttactgaccaagatttggtgaggttggggatttgccgaagcagcttgtctgactatgctccgaaccttgtccgtttcacatccgacgactattttgcatttaaaggcagagtgaggatccccccttggngaccggggggctgcaagaaacaaaggatcgactcctggcggctatccctgtgcaataaatccgacatattgttanaagtgcaaccaaatagtagtnatgggntttnagtttanacnaaaatgcctggtttttaacctttaactgccaaggtcctgccgcccaatggtgtttanatgcatgcattananttaacaaattggtactttttttaaccttcaaccnggattaaaaaattatttttttnaaaaaaaaaaaa

SEQ ID NO: 21513 - DNA, 535 bp, Triticum aestivum
  unsure (1)..(535): unsure at all n locations
  Clone ID: PAT_TA_21513
gtgtctctcctttgccatcctcctctctttcagctaagtccctgccccctctctttttcttacattcaggtcctcgcagctcctctcttttttcttgtttctttcgatctgcgagccgtcnaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccacacagttcctctgacggnacgccgtgctccgatgaagctgagcgtgntccgtatccgccgctcccactccttctccgtcgccttcctctacgggttctacgtcttccaatgaaacgcatcgcccctctccaactgcgggatcctcggcgtctctccccaacactttcccctgaaaaaagccttcgagtcaancncnagggcccggnttnccaatnntccccatnnaaccccacnantnagttaacctcaaagacntaaccagtcattt

SEQ ID NO: 21514 - DNA, 674 bp, Triticum aestivum
  unsure (1)..(674): unsure at all n locations
  Clone ID: PAT_TA_21514
cgtcacttagcttcactcggttctgcttctacacatctatatatcgttagtttggcaaagaaaagaggcaacgacgatggctgctgcggcggcgatgatggtctccggaggacgggcggcgctggcggtggcgggcgtgctctgcgcggtggcggccatggcggcggcgcagcaggcgtcgaacgtgcgggcgacgtaccacctgtacaacccggcgcagaacgggtgggacctgaaccgcgtgagcgcgtactgcgccacgtgggacgccgacaagccgctgtccgtggcggcagaagcacggctggacggccttctgccggcccgccgggcagaagggccaagccgcctgcggcaagtgcataagggtgaagaaccttcgacgggcgcgtccatcgtggcgaagatcctggaccatgcaacaacggcggcctggacctggactacgagacgtgttcaagaagatcacacaacggcaaggctaccaaatggcactcaactccactacattctcccctgctgacaacagactcaccagatctccggtgtagtatcatcatcatcaggaggaaatcaaaaacgactcttgaaaccgggcttcttgtttatacccctgactcggctggcctgcaggcactacgatctccggctcatggntgacggtggcactcttg

SEQ ID NO: 21515 - DNA, 597 bp, Triticum aestivum
  unsure (1)..(597): unsure at all n locations
  Clone ID: PAT_TA_21515
gttgagctgagccgagcagggagaaggacgcgagagcagcatggagacggcggagaggggcatcaccgtgtgcgtgaccggcgcggggggctttgtggcatcgtggctcgtcaagctcctcctctccaccggccgctacaccgtccggggcaccgtgcgtcatctcggtgatggcaagaatgcccatcttaagacactggcacatgctgaggagaggttgcacttggtcaaggctgacatgctggtctatggcagcgttgcctccgccgtccccggctgtcaaggtgtcctccatgtcgcgagccctgtcccctccgggaaatcctccaaccctgangaagattcataactcctgctgtaactggcacactgaatgtgttgaaagcttgctatgaaggcaaaaccaaaaaaattgttgggggancttcantggcgntgtgtcaataatcctgactggctaaggcgangcnttactgaagataactggcaaattgggatatgcagaaaatgaggaatggtattccttcnaaacttgnaaacatangctttgctatcaaccaaaatgggtanacattgaacnattccacatgggaattg

SEQ ID NO: 21516 - DNA, 826 bp, Triticum aestivum
  unsure (1)..(826): unsure at all n locations
  Clone ID: PAT_TA_21516
ccctagcgctcccgacgcgccgcggagcgatggcgatggacgcggagcggcggcaggcggagctgatcgcgcagttctccgctcaggcggcggcgctttcgtccgcgccccagctcgccgcgctggtgcttgaggccacctcccacccggccctcttcgccttctccgagctcctcaccctcccggccctctccaagctcactggcacgcagtacgcgtcgtcactggacttgctccggctcttcgcctacggtaccctgaatgactacaagagtaattctggattccttccagcactgttgcctgaccaggtccgaaagctaaagcagctcagcgtgctaactctggcagagtcaactaagatactaccatatgatcagctcatgcaagagttagacgtttcaaatgtaagagaactcgaagatttcctaatcaatgagtgcatgtattcgggtatcgttagaggcaaactgggattagctgagaaagtgcttgggggtacttgttccgggctgggatgcgctcttacccctgattatgctaaacttcccgattggtcgggtctgattggtnggggacatcagatagacgttgcatcanatcangagaaaacaatgggctgacacaatgannaggngaacaagaacaccagnaagattttagacanatggaagaggcaaaaancaacaagaanttaacatttaaccagnanacattactncggggnagacaattccccnaaccgggganaaggttnaaaagacnctcgcaaaagggggnacacgggtattactacctacaaccncaaangacgcgaacttatgna

SEQ ID NO: 21517 - DNA, 585 bp, Triticum aestivum
  unsure (1)..(585): unsure at all n locations
  Clone ID: PAT_TA_21517
cgacgacgtctgccggcagtgctcctgctcctcctcctcctccttcccggccgccgcgcgagcttggtgggttagtgtctcttcttcgcggagacctgtgagaggagccatcatcatggccgccgttgagactgttgtcctcaaggttgctatgtcatgcgagggttgcgcgggggcggtcagaagagtgctctccaagatggaaggagtttgaaaccttccgacatagacctcaaaggagcagaaggtgacagtcaaaggcaatgtcaagcctgaaggacgtcttccagccggttgcacccccggggaagaggaccccctactgggagggcgaagccacggccccnggacgctgcggcggttctggagccgaagcaactcccgggaacgcggaaaaacgcctcctgctgctgctccgggggggccaaanattacccagcnaagctgaccctgattgtcaccctatatcacncanagtgatgctgcggnggnacccnaaccttaaatctaaaaaaactgggattggttgaattcaacntgttttccggtcnacaatgacatanaataaggattaaaaaaaaaaaa

SEQ ID NO: 21518 - DNA, 841 bp, Triticum aestivum
  unsure (1)..(841): unsure at all n locations
  Clone ID: PAT_TA_21518
cgcacgcccactccgcccttcctcccgcccgcccccgccccccgaccctacccgccccgccccccccccccgcccgccccccaccggccgccgcgcgcggccgccgcgcctcgcgcctcgctcgccgccgacgcggtccggcggtggtgggggcctcgccgcgatggattgggcggcggcggcgtacacggcggcggcgctgctgtgcgccgcggcggccaccgtcatcacgctcggccacatctaccgccacctgctccactacgccgagcccatcttccagcgcttcatcgtccgcatcatattcatggtcccggtctatgcagtgatgtcatttatttcccttatcctaccagacaatgcaatatattttacctctatccgagaaatctatgatgcttgggtcatctacaatttcttttcactctgcttggcatgggtgggaggacctggggctgtggtggtgagtttgaatggccgaacactgaaaccatcgtggtttctgatgacttgctgtttccctgctattcctctagatgggcgttttatacggagatgcaaacaaggctgtttccagttgggttattcttatgccatcctgggctggttattaaccttcacaccctttgagcgcgtaatagataaaaactgactcactggctaccctnccgtcgtccccgccgattccctcctgttgtcaccggctcctatttttggctaacccgcctctcccagtctccgggtgcggcggttgntccggcnccntggcatntggttccnatnccgggaattgcaaanaanatncaaatnccggnncaagnttaatccctgtcccnaaagg

SEQ ID NO: 21519 - DNA, 678 bp, Triticum aestivum
  unsure (1)..(678): unsure at all n locations
  Clone ID: PAT_TA_21519
ggaaactgtacaagtctgagcacaattgccctctatgacaataatctagttggccccattcctgcaacaattgtgaaaattacgaatcttcagaagctatacctttacaggaattcattaaatggtacaattccatctgacattgggaatctttctcttgcaaaagagatcgacttttcagagaatttcttaactggagggataccaaaggagctggccgacatcccaggcttgaatttactctacctcttccaagaaccagcttacaggccctattcctacagagttgtgtgggttgaaaaacttgagtaaacttgatctgtcgatcaattcactgaatggcacgatccaagttggatttcaagtacatgaggaaatctaatccaactgcaactccttcaacaatatgctttcggggaacatactcccaaggtttggcatttaaagccgtccttggggtgggtggattcctcaaaacaacaatttaacaggggcaaataccgaaagttcttgcgggcatcaaccttattggtgaattggggccaaaagctnaaggaanatcctngggatacaacgtaaanatgggcactcnccangaaaatcgaaggatttccacgatccgnatcggaattncacattacagcaaaattgggcatccccaaagannagcctaggggn

SEQ ID NO: 21520 - DNA, 606 bp, Triticum aestivum
  unsure (1)..(606): unsure at all n locations
  Clone ID: PAT_TA_21520
gttttccttggcaggagccatttgcgccgtatttgctggaagtgctctacgaggatgatgacatggttgcccttaataagccttctggcttgcaagttctgcctaaaggactgtttcagcagcgaactgttttagcacagcttcaattgaaagactggaagatggcctcatcttgccggttcaagagaaaagatgtgcagtcacatccagtacctgttcatcgtttagggaggggaacatcaggcctcctgctttgtgccaagacaaaagttgccaaagttcgacttgcatcttattttgccgaaagggccaaaaatgctgcaaagaaaagagtcaagtgaaagagcgaaaaattcaaaattttaccagcttaagtgaccggcatacttgatgatgatgaggtgttggtacccacctatagggttagtcatatcccggagttccagagggacttttgcacatgtccccaggaaanccacaatgacaagtaagtgtcttgagagactgccaccaaatcaacacgggcaggtgaaatcatcaggagacccacaataaggtaacntcaaaatggaccccgntatgccccccggatgggggaccanttgt

SEQ ID NO: 21521 - DNA, 452 bp, Triticum aestivum
  unsure (1)..(452): unsure at all n locations
  Clone ID: PAT_TA_21521
ggcgtggtggacgacatggacgggtacctcaactacctgtccctcgagtatgactccgtctgggacaccaagcctgcttggtgtcagccttggacaatattactgacaggaaccgttgcagttgcgtgtagttgggtgctcatccactctgctgtgattaccggagtgagtttcttttgtaatatgtgcatgngtggtacatatttctttactcctatcctaaggcatacaccgatatgatatctgagaggaggaaaaaggtggccagcggtgctgaagatacctacgggatggagaaaatgtaaccttgtttgtagtattgtttccggggatagatagaaaatggtctgcatttgcactactgatctgtagaattatccctcaacaaaatcgctacatccgaaatacggaatcatgcttcctccggctgggtcctcattttcccttccctc

SEQ ID NO: 21522 - DNA, 655 bp, Triticum aestivum
  unsure (1)..(655): unsure at all n locations
  Clone ID: PAT_TA_21522
tttcagctacgcaagctacgaagctatgaacttcgaccccagctcactggtctacagcgatgtgatcaggagggtcctggcaggcttctctccttcggacttctcggtcgcaattaccatctttggtggccgtgggttcgccaaatcatgggcgaagggtgcagacatcgattcctacatgtgcggtgatcctgtagagcaagagcttcctgggtggcggtctgctgatgtaccaagagctttactgctgttccttcctggctctgtatcgccgaggtcgacctttgcaagacggatggctgggagcagcgatggaatggagatggnctcaaaatgacgagatgtgtatttgggctgctgggatccggtgaagaangtggtgaaagaaagtttgggatgcttaaagttttggataacttaagtggtccttcaacctaagttacgaagaatcctgagactccgtcccccgtcctttgggttcaagttaagcatttactgggctaccggttatttttgctaaaatttcccggttcaaaaatacccgggggggcgccccctctgccgtaatgacgctatcatggttcgccaatgttctgctgcnatncctgtgggaaatgtctgtaaaaactnccatcccaaanatggaanttgtaaa

SEQ ID NO: 21523 - DNA, 626 bp, Triticum aestivum
  unsure (1)..(626): unsure at all n locations
  Clone ID: PAT_TA_21523
gctgaggcaactgaaaagcttgaggttattgaatgtgaagggaatctactgcggacgcatcagtgaatctctagttcaaatgcggcatttgtccttgctatctgtgaatgcaagtgatgggaatgaggttctcttgttgaatgttctcctgccaagcctacaaaagctaagattgagaggacggctagcggaaggtgcattggatgagtctcctctcttccaagctgtcggagggcagaatttgtatgaattagtcctatcttggtcacagctgacaaaagacccttgccgtccctttctcggttgtcaagcttgacgcgtctacatttcactaagagcatacaccggagagcatttgtcatttctcacggggtgggttcccaagctaaaggtctctctctgacagacctccctaatttgaaactctagagatacaacaaggtgcaatgggtccctggaacattatcctaatcagaccaacaacatgacgaggtccactggcatgattctcatccctcaaggggggccggtaccaattcgcctaaaggatctataccgcctcacggcctctttacactctgacggaaaaccgggtacaactaccctgcaaanccctcccaggggga

SEQ ID NO: 21524 - DNA, 488 bp, Triticum aestivum
  unsure (1)..(488): unsure at all n locations
  Clone ID: PAT_TA_21524
cgcccgaggcccccaccccggcgaccacggccgaggctcccactcccgacgtgagctccccgccgatgcccacggagggccccgctccgacgccctccgcggaggctcccccagcccccagcgccgccgtcgccggcgcctccccctccgccaagtggttcgccgccgccgcagccgtggccgccgccgccgccgccttctactgagagagcgggagatctgcgccgtcccctgctgtaatttatcgctatccgtgctgagccgttgattcctttttttttgttgttcttccctttcatccatattccattcggcattcgattcagtaggactgggcatatctgttcgtgttactacagtgtaggatcgtggcttggacagattggtttggctggctggctggttgggtgggcccggtggtgttgtggcttccgttcctccatctgtataataccctgttgattttccttcaaaaaaaaaaanaaaan

SEQ ID NO: 21525 - DNA, 845 bp, Triticum aestivum
  Clone ID: PAT_TA_21525
aaggccataaaagaatttcttcctcgtcgggtcgccgctctctccccgctgtcctctcgcaaaaaccctagctagctaacccctcctcccgaaaccgtagtagcagcgccgatgggagggtcgcggcgcaagttcaagcgaacccgcaccaaggtgcgcgtggggttgccgcgcaagaagccgcgcgagttcaagccggccttcgacctgcccgaggcgctcgccgccgccgccgccgcagaggccggcggccacgtgccgagctgggacgcggagggcagcgtcgtgaagaactactccgctttcggggtcgtcgccaaccccaacctgctcggcgcccactcccgcggcacgcgaggcctcgtccagagcgcctcgctgcaggcgcccgacgtcgacgccttgcgggcccccgtcgacgagttcggccccgtcgacaccggcagtgacctcgagtgcgacgatctaaaatctgcacttgggaagaaaaggagggatggcaaatctgcacctttggagccactgactaaaattcaacgactatgtattggcagattaatagagaagtatggtgacaactacaaggccatgttcatggataccaaactgaactcaatgcagcactcagtgggtacattaaaaaagctctgtgaaagataccatgttggtggcaagaccatcctctatccgatgtagcgtcgtatgaatctagatttcactttctgcatgtaccctatttctcccactaaatgtaacatgcaaattttgcctgtgaatgatgtaacttctgatgactacatataagaatgtggtttatgttgtaaaaaaaaaaaaaaaaaggccct

SEQ ID NO: 21526 - DNA, 606 bp, Triticum aestivum
  Clone ID: PAT_TA_21526
gtctagttctagatcgcgacggccgctcgcgatctagcgtgctccgtcgtcgtcgtcgtcgcggccgtcaaaggagaacgattccacacggagttgctgtttttatccgagaagcccggatactcgggattgcgcgggggaggcagcggtccattcctgcggtcgactcggttcttgataggctagtaaaaagagagagagggagggagggatggacgagaaggcagccaagatggagaagctctcgtcggcggcggctttcgtggagggcggcgtgcaggacgcctgcgacgacgcctgcagcatctgcctcgaggccttctgcgacagcgacccctccacggttacaagctgcaagcatgatttccatctccagtgcatccttgagtggtgccagagaagctcccagtgtcccatgtgttggcaggcaatcagcatgaaggaccctctgagtcaagagctccttgaggctgttgaacaggagaagaatgtgcaagcagatcgctcacgcacgaccgccgtttttagccatccaatgctcggacattttgaggtaccagttgatacagatgatgctgagcttgaagaacgtctcgtgcaacacct

SEQ ID NO: 21527 - DNA, 1685 bp, Triticum aestivum
  Clone ID: PAT_TA_21527
tgctcgcgagggccgcggcgcgagcgagagaagagagttaacgcggccatttcttcgtcgacctcgtcgcccccgcgcaggcgtgctccgtcgtcgtcgtcgtcgcggccgtcaaaggagaacgattccacacggagttgctgtttttatccgagaagcccggatactcgggattgcgcgggggaggcagcggtccattcctgcggtcgactcggttcttgataggctagtaaaaagagagagagggagggagggatggacgagaaggcagccaagatggagaagctctcgtcggcggcggctttcgtggagggcggcgtgcaggacgcctgcgacgacgcctgcagcatctgcctcgaggccttctgcgacagcgacccctccacggttacaagctgcaagcatgatttccctctctcgaccatccgtccgcccacgcggccggtgagatcaattgtacatttgtagccaagtccacttaaattcttgaattacagtcaagagctccttgaggctgttgaacaggagaagaatgtgcaagcagatcgctcacacacgaccgccgtttttcgccatccaatgctcggacattttgaggtaccagttgatacagatgatgctgagcttgaagaacgtctcatgcaacacctggccgctgctgccgtgacacgtaggtcgcaccgccatggtagaagggaaggccaccgcggaagatcaggaccacacggccgcacacaaattgtagtattttcgacaactgaaactacctctagtgaccccatttcttcagattcaccacaagtaggggacagtgagtattctcctgctataatctctgctcctgtggatgccatggaagaagcatctgccaacatactagtgcacaataatacttcatctaactgccctgttggatcaaatgatagaatttctggtgatgaagcatctcccatcaaccaggatggagctggaccatccgatccacaatctttctcaaacacactcaagactcgcctgcagtcggtttcggtcaagtacaaggactcgataacgaagaacacccgtgggtggaaggaacggtggctctctcggagtgacacgatatcgagtcttggttctgatgtgaggagggaggttaacgccggaatcgctgctgtgtctcgcatgatggagcggctagaaacgagggacgggagtggctctgggccctcatcggcttcttcggacaatgtttcttctgctacaaataatcagggggccgcgtcgtccaacttttgtgcttccgtaaatggcgcctcgtcttcggcaacttgtgcgtcgagatctggttcacaatgaaccatcttctaccatgaaagatgaacttatttttagctgcaagttgaacctggcatctggtactattagaacagtcacatgtaacatgtttgatttgtgcaaccaaagatgcagctgtaaagaactggtttcaagaatgatatgagccaaggtggtgcaacgtcaaccacacagtagctcttgttcgtttcttcgtagacctgcaaggctacgacagccagttgtttcatcaggccatcttatgagccatagtgaagggaacatcagagtcgtgatatgagattcatgtctccatgaactctctgtatagagatgcagaacagtaactgcacagataatttctgttc

SEQ ID NO: 21528 - DNA, 618 bp, Triticum aestivum
  unsure (1)..(618): unsure at all n locations
  Clone ID: PAT_TA_21528
ggcaagcctcctgttgttgtcgtccccgagcccgagactccctccaagcccgtcacccctggcaagcccgagacccccggcaagcccgagacccccggcaagcccgagactcctgctaagcctgagactcccgagactcccgctaagcccgagactcccgctaagcccgagactccttccaagcctgaggtccccgttgtgaccgccggtgctgcccagaagaccttcgccggtgtggccgctgccatcgccggtcttgctttcgtcctgtaaaggaacttgaacaagcaaaaccttcttctcctttctccccggattttgggacttttctcccatagatgccggagtctcttgcacggcaaagctcagcattcatcccgtctcttgctcctgatagcaacaaaacacgcatatgtgtaacgtttaagttcttgggttaatcctaacacaatcggttataattggggaaatggcgccggggacttcttgttcattaggaccggnccggtctcggggtcttgggggaactcttgggttggttatcaggtggtgcggctttattgggtcaganttatctactttannggtccaagtgnaaggntccccaaaaaaaaaaaa

SEQ ID NO: 21529 - DNA, 631 bp, Triticum aestivum
  unsure (1)..(631): unsure at all n locations
  Clone ID: PAT_TA_21529
ggagtttgtgggttatttccattagccgcccattctttcaaatggtaccggactgaccggtatggagcaaagaagcccggaccattagtgtacccagcatctacaaggtagtattttcctaatgtttgcaaaaataacaagtattagatattatatttacattgaaatatcataacttagttgttctaccgtaccaagacagagaattaccatgtggaactctaaaagcgtcttgtcgtgacattgcatctcgcaacactcgtgaatcagatgcagaaccttcccatccagctaagacatacaaaaactccatattccggtcacaaacaccaagcacattagtgggtcacatcttgctttctattcctgtatctgccttgcttgagagcggaaacacggacatcaacatgtgtgccatctaaagctccctaacccatctggaaacaatttcatctacnacctccgggctgctcaactgaagggttggnaccttataaacccatgagacaaggaaagncaccctaagttccattgaaatgcctacngatggncccaagggggcccggtaccattccctaaatgatctatacccnccaaggcgtcnttaaactctgacgggaaccgggttcca

SEQ ID NO: 21530 - DNA, 624 bp, Triticum aestivum
  unsure (1)..(624): unsure at all n locations
  Clone ID: PAT_TA_21530
gatgccgagatcaaggagcagaagatggcggagcaatgggccgccaagcacgcccgccttaccaagttccttgagcaggtcggctcgtcgtgccgccgctggccgcccggcgagatgaacggccgctgaccgcgcgctggctgctttcttgcacgcgcaacatccaaatctccaacaagacgatggcatcgcatgcttgttccgttgagcttctttagtttccttctcttttacaaccgttgngaagcttcacttctcactcctagtcctagctgatcaagaaaatgttagccgtttgctgctgctactgccttaattcacttattttccggcctgtcattgattatgccatccatcgtttcctaancaataaataaacatttgggaatccaagacaaattncaacaaaganattattggatcgcctaaaattgaaaaaaaccccanggggggcccggtaccaattcccccaaaaggaatcgttaaccccgtcaatggcctcctttaanacttctgncgggaaaccngggtnccaactaancgcttgnaaaatcccnttccanctgggtaaacnaaaggccgncntttcctcaaaatnccactaangnatggaccccttcggcn

SEQ ID NO: 21531 - DNA, 636 bp, Triticum aestivum
  unsure (1)..(636): unsure at all n locations
  Clone ID: PAT_TA_21531
atttaaaccactatgtatagcatggcatcgaagctaatagaattttgcattattcatcaccacatacttagatgaaaaaccacaatcgagattggcaaagaagaaaatcaccttgggcagctcagctgggggggacacatcctcgaagggggaaaactgctcctgcagggccacgggggatgtaacctcaaacggggcgttgaccatctcagtagtggccgtgagcgtatctggggtcaagctccgtggctgcctccatcttcctggggctctctgtcccctgggggatcagcctcccgtgttctgctcccaatatcggcagttctttgcctgggtctccttgggtccatcatgaaactgacgaatactaagagaccactggatagggaaacacaatcccaatgacaatgaaaccagtaacaaatgtggttcgttactgcttgcaaaagtctttttcctcggaacaanatntccaacaccacggttcgcttactccctccatgggagtgaanaacatgcaatttgatgtgncttcttgaaacgtaggggaaagggtttccaaaatgaagatggtgctttcgtaaattaacgcgggaggggttttnaanaagtcctanccccaaacgggnacccccn

SEQ ID NO: 21532 - DNA, 655 bp, Triticum aestivum
  unsure (1)..(655): unsure at all n locations
  Clone ID: PAT_TA_21532
tttttttttaacagaataataacttatgcaacattcagcgccaagctatagtacaaacacactgaaattctggcggttcatgggccaatatgccatcacaaatgtcaagctatcaacggactctgacatgtcaggaggattgcattcccagaattccacgtcccagccgtgacgagcaggcctcctgggtagacgttgccaacaaattttaaaacgcaatgaggcttgcaatcactagaatccaatcatgaagagcagggccttcaagtagatatctgcctgctgctgttgccccaatggtgcttgtccgtggacgccatgggcgtgtcccatatggccgccatgggatcccatgcccaagggcataccatagtgggaccagcaagctgcgcataacaacaacatctgggaaccatgaacttggaactaaccataaggaatatccccccaaggggggccccggcccatcccccttatggtcctatacgccgctcactggcgtcgtttanaactccggccgggaaaccggcgtcccaccttcgcgcctggagcccnccccttctcgctgggcaaagccgacgcgcccccatgcccccctattccagcgaccccatcgggccccccgcggnttgccccantacntaattcanccanc

SEQ ID NO: 21533 - DNA, 635 bp, Triticum aestivum
  unsure (1)..(635): unsure at all n locations
  Clone ID: PAT_TA_21533
gcacaacccagacgtctctttaccctaaccgacagcagccgccgtttcttcatcttcctcgcagcggcggctctccgtcttccgctcctccctcccacgacacgcgctcggcacgcaggcgacggcggcagcgctcaggctcgggctctcagcgacggtggggcagtcccagactcggcggcggcgtcagcggctccccctcccgaatctcgccaatcgccttgcgccctcgcctccggtcctccgcccaacggccggcgaccctgcgtgcgcgcttcccgctcccctgccgcctccggtgggccgtagacggcgctcgaccccggcggctgcactgcgcgccgcgtgcgaccggcgggcagcggggattcagctgctgctgctccacctaaggcggctgcccgatttggtaacgcttagccccaaacgaagtgttacccgtccgcttanggctgaaacgtgcgcttaatgaccttttagacaccaaggaattaccattggggtctcaaaccctggggagcgcatcccactgaanaggatcnagttgccagatntgagaatcaaaatgcaacnggttaccgtaaaanttcgnatgnaactaataaccantcgctcnagnaaattaaaagaattaa

SEQ ID NO: 21534 - DNA, 620 bp, Triticum aestivum
  unsure (1)..(620): unsure at all n locations
  Clone ID: PAT_TA_21534
gcaaggtcgacttccgcgagggccccgcgctgggcaacctggacgagctcctcgccgacgaggccaacctcggcgccttcgacttcgccttcgtcgacgccgacaagcccaactacgtcaattaccacgagcagctgctccgcctgggtgcgcgttcggcggcaccatccgtgttacgacaacacgctctgggtgcgggaccgttggccatgccaccggagacgcccatgttcggacatcgacaggaggttctcggccgccatcaaggacctcaacgttcgcctctccgcgggacgagcgcgttgaggtctgtcagctccccatcgccgacggcgtcccatttccccccccccccggcagggggatcattgcccagccgtggcatgcgtgccccggcgcgtgtccattcccgtcccccctctcatccgttcgtttgatggtgcatgatgcttcaataaantcgtttccttccttcgtcggtttcttttcaactttngattggaactaagtcacantcgggtcaataagtcctggttgacaataacaattaggctgtggtatacataaataatatnatgaaaataaaaattgctatgataacatatcacantnaggtaaat

SEQ ID NO: 21535 - DNA, 865 bp, Triticum aestivum
  Clone ID: PAT_TA_21535
cggccgctcgagccggcgggccgggcctgcatttccccaccttccgtccttcccccgtcgtcgcggctccagctagggtttctcgcccccgccctcccgcctcaccgccggccccgtccgccatgtcgaagcaaggagggaaggccaagccgctcaagcaggccaaggtcgccgagaaggactacgacgagaatgacctggcatacctccagaagaagaaagatgagcaaaaggccctgaaggagctgaaggccaaggcaggctcgaggagagggctgggaggatcgaaactcaagaatagaaaaaaaaaaaaaaaaaaaaaaaaaaactgttcgcctttccccacctaaccttcctcccccgtcgtcccggctccagcttagggtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatctggtctcaagaagagtgggaagaaatgagtctgcccacccttacgtaatgcccagaaaatgataatctatctatctacctatctgtgtcgcgcttcactatctgtggttgtaaaagactaccttcagttgtgttgagcattaagcattgtcgcagtcggttgctgaaacctatggcatttgagcagcctcttctgcttatctgtgatgcagatggtccctagctaataatgacatgacttgttttgtgatgaaaatctctaatgtgtgcaac

SEQ ID NO: 21536 - DNA, 1196 bp, Triticum aestivum
  unsure (1)..(1196): unsure at all n locations
  Clone ID: PAT_TA_21536
gccggccggtccgggacaaaaagcagatcctatggagagcctacctaagaccccagatacgacgaagggcatggatcgcctcgacgtgttccgggactacgacgtccgcgtagatctggacaagatcatctacgacggcgactacgactgcttggtgaatccactacgccttccagagacaagctgccaaagtgttaaattttaagaggcacaggagaacatagccgatctgacgtcgcggactaccgtcgagagaaatgcgagtgcggtgctcgagccgcggccggccgcgcgggccgcgcgggcccttccccggtcgtcgcggctacagctaggtttctcgcccccgccctcccgcctcacgtcggccccgtacgccatgtcgaagcaaggagggaaggccaagccgactaaggtgctccccccgtcctctcgcctttccccaccttccgtccttcccccgtcgtcgcggctccagctagggtttctcgcccccgccctcccgcctcaccgccggccccgtccgccatgtcgaagcaaggagggaaggccaagccgctcaagcaggccaaggtcgccgagaaggactacgacgagaatgacctggcatacctccagaagaagaaagatgagcaaaaggccctgaaggagctgaaggccaaggcaggccagaagggtgcgctgggaggatccggtctcaagaagagtgggaagaaatgagtctgcccacccattcgtaatacccagaaaatgataatctatctatctacctatctgtgtcgcgcttcactctctgtggttgtaacagactaccttcagttgtgttgagcattgtgcatcgtcgcagtacgtcgctgaaacctatggcatgtcagcagcctcttctgcttatctgtgatacagatggttcgtagctaataatgacatgacttgttttgtgatgaaaatccctaatgtgtgcaaacaagtcttccaattttggtgtgggcattaagcattgtcccagccagttgctgtaacctatggcatttgagcacctcttctctatcgtgatcaagaaaaaaaaaaaaaaaggcccctatctgggactctaatacaaaaacgacctagataaaaaaggacaaccccaaccggggcccacggttccctgcgtctgccctggccagtgcctggacttcccccctcaatccccnttn

SEQ ID NO: 21537 - DNA, 656 bp, Triticum aestivum
  unsure (1)..(656): unsure at all n locations
  Clone ID: PAT_TA_21537
gagagagaactagtctccagtttttttttttttttttttttttttttttttgacaaaaaataagaacataccataccagataccacagtgaaagatgggacgcaaactgtcgaacaaaacgtatcatacaaatccacggggggttttgttagttccaaatttccgaattccagtcacttcacccacagcagcgaggaagtaaaagcttatttcacgactcatctagcaaaacacggtgggcaagcctatcctcgaaagtccatgtgtggaggagtaaaccttagccttgcagtgctacaccaaggcccgaaacaagatgacacgcaaagctgggcagaacctgaattagcagcagcagcagcggttctaagcgtcatccgagggcaatgacaccaagtaaatcctgccttccaagagtccaactcgcaccgccgccngtcgaaatgtggtcaccttgtcgggcaaccaaccttctcgacacagccccaatcccaccccgaggatggtagtgaaccttcctggtgtaaccaactactctggcatcccccggngcaacgcaactcgggacccaacacccaaggggcgtcaaaaaatctggggggcaagctcccaaggttgggactggcgatagacacatccgctcgtgaggggcggcc

SEQ ID NO: 21538 - DNA, 626 bp, Triticum aestivum
  unsure (1)..(626): unsure at all n locations
  Clone ID: PAT_TA_21538
ccgtcccgagtcaccaactcaccaccgaccctagcaaaaccgcacgcaccctgccagcggccccccaactcccaacccaacccctactccagctagctcgcggcggcggccagcggccatggcgttccggctgagcaacaacctgatcggggtcctcaacttcgtcaccttcctgctctccgtcccgatcctgggcgccgggcatctggctgggccaccgcgccgacggcaccgagtgcgagcgctacctctcggcgcccgtcatcgcgctgggggccttcctcctcgccgtctccctcgggggccccctcggggcccgctgccgcgtctactccctcctgcggcggccacgcctcgcccgctcgtcctcctccgccccgctccggcgctgcctcctcgcccccggcctcccagcgcggccgcccgcggagcgtctcggccccggttcaaggagttcgcccgcgcccctccaaccgggccgctgcgcccccgacacctgcgctgcacggcttcgggggcccgacggcccctctgacagctgtcgacggccggacgccgacngaggtcaanctcgggcctgcaaatgcaatctcaggcgctgtggaantcaacgatgaacctccctn

SEQ ID NO: 21539 - DNA, 476 bp, Triticum aestivum
  Clone ID: PAT_TA_21539
ggggtccggggtacggctgtcgcggagcgtgcgagggcagttggccgcggcggaacggctccggtcggtgccgttcgacatggacgtcgacgtgcccgtgcgcctccagctcggcgtggtcaggacgtgggccgtgccgctgcgggcgcgctgcaccgtggcggtcgacaggctcgcggccgacgccagggtggtgtccaactcgtgcgacgtcaaggtgcgcctcctgtcgtggtggaggaactgacgatggcgccatggtggcggattacatacttgagcacttcttgtttggttttaggatgcgttttcccctcatttgtaagctggtttggttccccaatgtggatcttgtcatcgtagtatcatatcaggaacgctgtcaaatcgtcctgcgactaatgtcatgttggtgagttgctcaagatcaagactgaagaattgactaatgttttgttcaatgcaaaaaaaaaaaa

SEQ ID NO: 21540 - DNA, 377 bp, Triticum aestivum
  Clone ID: PAT_TA_21540
gcacgagcgccgcctgggagaagaaggtgcgcgcgtcggcgcgcatcaggcgctccgggggccactccgtcctcgtcacgggcgccgcggggttcgtcggctgccacgcggctgccgctctccgccgccgaggggacggcgtgctcggcctcgacaacttcaacgactactacgacacggctctcaagcgcggccgcgccgcgctcctcgcccgctccggggtctacgtcgtccacggcgacatcgccgacgcggagctcctcgccaagctgttcgacgtcgtgcccttcacgcacgttctccacctcgccgcgcaagccggcgtgcggcacgcgctcgtggaccccatgtctaatgcgcgcccaacttgccgtctc

SEQ ID NO: 21541 - DNA, 1076 bp, Triticum aestivum
  unsure (1)..(1076): unsure at all n locations
  Clone ID: PAT_TA_21541
gagagagagagagagatagatgtggtaactcaagaactgttcttatgcatgcagcagccataagcattgctactaggccaacaatggcaagtggcttccatgaacatggctgtccatgaaaaatcccccgtatgcatgctcggtctaatctcctcaagctagcgaaacgaaatttcctaaaagccggtctggtcctcgaatacagcttgttgcctgagccgctgggagtcctatggagtagtagagttcttcaccttcttctgcgcgcgattactgttagccggcttgaggagaagcgggagcgagcgggacgggcagtcagagagtcggtgtgtccccggcgcccacgcacgccccgtccttttcctcgccgccgcctgctgcgtcgcttctagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccaagagccagctcgtctgcaccgggtgccggaacctcctcatgtacccagctggtgcgacgtcggtctgctgcgccgttctgcagcaccgtcaccgccgtgccggctcccaagaactggagatggcgcagctaagtgtnccggaggatccacacctcctcaatttcatacgccgcgccacaacctccatgttccttgctgccacactgtgaactggntatgggacaatcaatcccccaatgtnaactgcgggaacgccgcatctgctcaattgtcaatcgcggctcctccgttaatgcccgtctccatttgttactccgtgggactcactggtgaaaacaaaaccaacactgaactgaaattcctaaatttttgaacactttaagtgctctgtctgtattnaaatctcctaacattttattccttcttggtccttgtcctctttggccccaaatcaacaactaatttgtnctagtttcaacccgaaanantttgaaanggtaccccntnta

SEQ ID NO: 21542 - DNA, 687 bp, Triticum aestivum
  unsure (1)..(687): unsure at all n locations
  Clone ID: PAT_TA_21542
tataatttcccctcattcatctcacagtcccaggcctcccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatggggagaagaggttggcgagtaccaaggtgcatacaagatatccaagggtttgcttgacaagtatggcccccgatagggtctcgatactccgatnactgaggcgggcttcactgggcattggtgttggtgccgcttacaatggccttcgacctattgtagagttcatgacatttaacttttcgatgcaggcaattgatcacataattaatcaagctgccagtcgaactacatgtctgctgggcaaatatcgttcctaatgtctttaagggtccaaatgggctgctgctggaatggtgccaacactcacatgctatcaacttggatcaatgtcccggattaaantcaccccatccccgcatgccagttgnnacacataggatnatcgttgtctaaaatcttnggaaatc

SEQ ID NO: 21543 - DNA, 780 bp, Triticum aestivum
  unsure (1)..(780): unsure at all n locations
  Clone ID: PAT_TA_21543
gcatcattccccaagaccctacattgtttgagggtactatcagaatgaaccttgatcctcttgaggagtgcactgatcaagaaatttgggaggcactagaaaagtgtcagctaggagaggtcattcgttccaaggaagagaaacttgacagtccagtgctagaaaacggggataactggagcgtgggacagcgccaacttattgcactgggtagggcgctgctcaagcaggcaaaaattttgggtactcgatgaggcgacagcatctgtcgacacagcaacagacaatcttatccaaaagatcatccgcagtgaattcaaggactgcacagtctgtaccattgctcaccgtattcccaccgttattgacagtgaccttgttcctggccttaagtgatggtaaatcgcaagagtccgacacgccccagagcttttagaggacaagcacctatgttcaatacagcttagtatccggtacccccacgccggcccgagctggagctagcgtgctcccccctaactcccgccccgtgcctgggtaccgtgctcgggcggccatacccgcctctgcccgctggcgccttaaacccctgcgactccgggagccgccgccgcaacccgggtccgggtccgtggtctcggccgccctggccggattcctcgcccggcttggaccgtnggatgggangacaaggaagantgggacacaagacataccgagtgtctanagtagttacacatgatatgntcccttcaangnnacaggaaaancgctataaag

SEQ ID NO: 21544 - DNA, 830 bp, Triticum aestivum
  unsure (1)..(830): unsure at all n locations
  Clone ID: PAT_TA_21544
ggcacgaggcactgcccttcagttcagcctctcggtgtcggaggtcggaaccaaacatggacgccgggcaattcgtcatcccgatcctcggcatcatcggcgccgcggccgcaaccttctacgccgtcagcttcatggagatccgggagaaatcactggaggatctggatgacaagtactccgagtacgaggagggcggcgggcggcagcgccgggcgcggcggaggtccggccgccaggcgaagaagcggaatgattgacagctacaccatcattctgggaactgaagaggctgcgtggtctctgtattgatgttattcacttcccctctttttgtgagcggcttgatgcttagcagctaatccaatctacgttcgacccgtagccagaggaaatgggcattggtcactactgctagctcttttggcctgcacttgccttcaggtgcttcagccttttgccatactcccggggtaccaggtaagtgtacccaattcgccctatagngagtcgtattacaattcactggccgtcgttttacaacgtcgngactgggaaaaccctggcgttacccaacttaatcgccttgcagcacatccccctttcgccagctggcgtaataacgaanagcccgcaccgatcgccctttccaacagttgcgcacctgaatggcgaatggagatccaattttaaggggataanggggnaaactactgatctaattggtggggattttanattcccagncccanggttantttaggccccnantcctanaagntggttatgancataatnanccttccccattggngagggtttacttgntt

SEQ ID NO: 21545 - DNA, 662 bp, Triticum aestivum
  unsure (1)..(662): unsure at all n locations
  Clone ID: PAT_TA_21545
gaccattacatttttttcatttacccaataaactggaagcacagccaaacgtacatctatgacgcaagcaaaaacaaaaaaacatcgcagtcgttattcattgttcccgagcaatacaccggagaccgtagtgataaattttaggacaacggaatctaaatttcaaaaccaaagcgacaccacggcggatgcgttgtgcaagaagaaaaacagtgggctccctccgagaatgcacatgcttgatcanttcccatcccacaggatggtggtctccggcgatcatgcccggtggacgacgttagggccatgtttggacgcccgcctgcggcctccgaagtacccttgccctccctcctcngtgtccccggccgacgccggatggatcccccccgttcgccagccccaatttaaaggtgttgattccggcgccccctggcgcccttttgggcgcttcttccctcgccctacccngnatttcccctgtctcctcccaactgtcattccgccttgntactcgtaccccggtcctancaatgggcntattggtgggcccgggcntcaanccctgatgggtcggtcaggaaagaaatcgcaccgtgttcnccagggncgancantcccaatatcntacccccaggcgctttantctacgaaccggttcn

SEQ ID NO: 21546 - DNA, 507 bp, Triticum aestivum
  Clone ID: PAT_TA_21546
cctacatgcacctttgcgtggaggactggaaatggtggtggaaggccttctttgcttctggctctgtcgcattctatgtgttcctctactctattaactacctggtgttcgatctcaggagcctgagcggaccagtttctgccacactctaccttggctattccctgatcatggcccttgcaatcatgctctccactggcgccattggtttcctgctctccttctacttcgtccactacctcttctcgtctgttaagattgattagaggtgtgccccgctgcctctttctgcaatacagtcatctgatcatggtaatagttaccctcttagaaatactacacactaaatcaaatgggaaaaaatggatacatggcaacgcccatggcttttgggcatgattaattcaatcatttagcgcagcacatcacccaattgaaactaatctaggaatgatggaatcttcgcccacctttgtgcactgcgcttgcattacttgctgcccgggg

SEQ ID NO: 21547 - DNA, 798 bp, Triticum aestivum
  Clone ID: PAT_TA_21547
cccacgcgcccgctcccgctccgagccacagtttatctacttatcttgttgtagtatttcagttctttaatttccagtaaattgtcttgttatcatactacaattcatcctggtcgtctcctctatcctcgtcaagatcagatttttgtccatctctcctcgtcagatccatcgggatcctgacagtcgtgtgtacaggcgccccgccatgaagtgcccttccgattcctcggctggctcgtgatccctgggctcctcctcccgcttctggcggtggcggctccagcgagccaggccaagaagcggcagcggacctcgagctcgagccaggctgaggcatcctcgtcctcacagcctccaccgcagcagccgggggacgcgagagaggtgccggatctgggggaggacgtgatgttcgaggtgctgcggcgggtggagccgcgaacgctggccgccgcggcgtgcgtgagccggggctggcgggccctcgcgcaggacgagcggctgtgggaggcgccgtgcgtgagggagtgggcagtccggcctcggcttctcggaacagctgctccgcgccgtcgtgctctctttcggcggcttccgccgcctgcacgccgtctccatccgggcccgacggcggtttcggcgttggctgcgggaactggcacggcgtgcggacgccgggacaggggaggaggaggggggctccgtggaccgacgacgagcacaggttgttcctcttaggcctgaagacgtacggaaaaggggattggaggaacatatcacgcaacttcgtgcgga

SEQ ID NO: 21548 - DNA, 521 bp, Triticum aestivum
  unsure (1)..(521): unsure at all n locations
  Clone ID: PAT_TA_21548
attttcttcattcagtttgctacttcggcgtgaatgctgctcctttagcaatggagaattcttgaaggctggtttacaggaactggagcaatggtgctctagaacaactgaagagtatgcaggaacatcttgggatgaactgcaacacataaggcaggcagttgggttcctggttttgcatcagaaatcgcacaagacactggaggaaatcactgatgagctttgccccgtaagtcctgaacaagacaaagttatagatgcttgaaattttggcaaacccatccaatatcaaatatttgcattttaaagcttggttctgagcactagccaaatatacccgttctgaacgatgtatcgggatgatcacatcgggaacgatgttcctgggatggtaaatatggggcacatgggcctatcccaagaagaagttgggaaacatgagaacaatgtccgaccgatgactcgatnactactccgaaattcttccttggcnagatgacgatccaagcataccgatacct

SEQ ID NO: 21549 - DNA, 670 bp, Triticum aestivum
  unsure (1)..(670): unsure at all n locations
  Clone ID: PAT_TA_21549
ctccctcgaggacaatgactacggtatcgtcacaatcaagaacggcaaggtcacaaccgaaaaggagttcgatctcttcaagtctgctctctccaagtaccccatgcccactggcactggcggtgctgccaagacctcccatggcgttgcttgccctacatccgagtccgtctgggcaggccgatcccagctacctcccaagagatgccctccgaggcagagaagtacatgaaggacggtgccggcaagggccccggcatcaaacggcaagggattccacttcgacaactgacagcggtaccgccactgccagcgttgccatgggtcctccacttccaacaagtccggctctgcctcccngatgatgatgatgacagcggcgctgctaccttggttcccgtgcctttgtactctcccgctgccgcatctcttaaccttttcggacctttgcgcgtaatggaagctgcctcccttaatggttccctggtattggggatgcctgtggcaaattatattaggccctcctggtttatacaggacaaatttgggaaaacctgataatanttggccctcccggganccggtctattttaaagactggggtccaccggaagccccaccgaattgtagggggnncttntataagaantngccnatatntntaaaaaaa

SEQ ID NO: 21550 - DNA, 616 bp, Triticum aestivum
  Clone ID: PAT_TA_21550
cccacgcgtccgcccacgcgtccgcactggcttggttatgtgcactggagccgaccttgtccgcatcttcatggacgagaactgttggtctgagacgttccccgatatcgtggcaagtgtttccgccgacaacatcggccacggttgtatctgccaagggggagtgatactgatgaaggcaggccttcgggtgctgtcgccaggggtgtcgagttgcgatgtgaagttcgtgaggcaatgccagatgatagagcaaggcgtttgggccgtggtggacgtgtctcttgatgccaatggcacatctgagctcagagcatggaacactggcctaccgggggcctgccgggtgctgccaagtgggtgtcttatcaaggacatgaacaatggctactgcaaggtggcaatgatcgtgaacgcggagtacgacaagggcttcatgcggtcgccgctccacccgctgctgagctcagggcacactttcagcgcacgccgctggctgacatcgctccagaggaggtgcgaattccttgcgcagcgcttgagccccgcctatggcatcagcagggcaggtggtgctataacgcccgaggggcgaaacaacgtcctggagctggca

SEQ ID NO: 21551 - DNA, 487 bp, Triticum aestivum
  Clone ID: PAT_TA_21551
gagaaccccagatgcaaccccaggtagcttcgtcaaaatattgtgggactttacccgcagtaccatgggttctacccagccaccccagtacgagctgttcaaatcaaggatcaccccttccacctcggaatattgggcagcagtacacattcctcccgtagaccccaaccaagatccaacggaggtttccttcgtggggaaatctatgccaaccccacgcctgggccatagaggctgctgcgaacgaagcgattgctcgccttcgatccgctgtgccctatgcccgcgagcgaggatattattactttccgagccgtgcagcgcccgggggagtaacatcttttcccggggggacgcattgagaggagcccagtgctgcccaccctccccctttacctcgcccctcgaacactgttcgacccggcgtgggttgctccatctccccgcactctcggccccaaaccgcaagcggcccattgggcaaaca

SEQ ID NO: 21552 - DNA, 813 bp, Triticum aestivum
  unsure (1)..(813): unsure at all n locations
  Clone ID: PAT_TA_21552
gaatttggnagtgggacaaaanccccgggttatccgaagggggtcnttncatagtggaatttgaagganggtgggctttgtatancagtgngangggnttntgagggatagttgtanccagtttccngtcagagtttaagtctacatacatttctttttatccattttgataacatgagacagaggaagtatattacaaccgattctcagagtaacgcatcatcatctagtcaagaaaacataggaatacggttttatccacaagccaaagccaagagaatatactactctctggctacgtataatgttacagagatattattacattattgcaggataaagcatcccgtataactcatcagtgtagcgagcgaccacttggagacgaatcagacatccccttcattagaaggaatctgggcatagtcgtcacaaggcaccgcctccttgctctccatggcttcgtagtacaacaccgtggctgccgccagatagaccagctgcagcgcaccgaacagaagagcatacccagcgagcacgcacaggcccgccgccatgctcctcctcgagggcgcgccagcaccccggcgccccggtgcctcgacggccgcccgcacgggcgtcggttcaantctgacgggaaaacctggcgttaccaactaatcgcctgcananacccccttccaactggggtataccaanngccnacgatgcctccaanattccanctgaagggaaggaccccgncggcataaccgngttgggtaccaantacgtaatncagccnagccgncttctttctctnccagttgg

SEQ ID NO: 21553 - DNA, 641 bp, Triticum aestivum
  unsure (1)..(641): unsure at all n locations
  Clone ID: PAT_TA_21553
gctaagcgtacgcgacaataacttcctcctggttcttgcaagagttgagcagctagcgacggcacagagatggcgaagcggccgtcgagcaaacggagcttcaggctgccgttcatgtgcgggcagtcggacgtggccagcccgaggggcgcggctgtcaagcggccgtcgtcgtcgtcgtcctcgtcactcggcagggggtccaggtccgggtctagctccgcctccagctccagcagcaggcacggcgagctgcagcggatcttccagcacttcgaccgggacaacgacggcaagatctccggcgccgagctgcgcgccttcttccgtgtccatgggcgacgacatgccgccgtcgtacggcgacggtggctacatgctgggacttcgccggttcctggcgctgatggagaaggaaggcngcaagaggaggactgccaagggttcactgttcaacccgtngatcncngcagatnacgcaaggctcaaaggtgtcgcantcngganaactccgtcccgatgcaagcatgattcggctacantcaaggnacgtgctcactcacgattcaaggatatactacnatccgctactgggttcctcaacttaagcgatcaatagatcattctaggatctacantgt

SEQ ID NO: 21554 - DNA, 2023 bp, Triticum aestivum
  Clone ID: PAT_TA_21554
tttcaccgacctcggccatcccactggggccccggtggacgtgattatgatacaatatctggttcaaaacgctcatatgttgagatggatgacgtgcctcctcggtatcacgacattagcgttcgtcagcccaaggcacgcttagattatgatgttggtggtagcagtgctcggtatgcagatgcttatactgagaggctcgggcggtcacatgtgggatacactagcagcagatctgtcgctggtcatgaatgaggttaaggattttgacgatttaatattggttgaggatagcaataacccagggatgaagcgtgggtatgctttacttgagttttctactcgccctgaagctatggatgctttcaggcggttgcagaagagggatgtagtctttggagttgatcgcactgcaaaggtttcctttgccgattcctatcctgaagtcgatgatgaaatgatggcacaggtcaaaactgcatttcttgatggtctccccccctcatgggaagaagatcgtgttaagaagtaccttaaaaagtatggagctatcgagaaagttgaacttgcccgaaacatgcctgcggcaaaaagaaaacatgtttggtggattaatttacatacagatggtaatagtggtggatgtgttgatgttccggcatgtttattgaatggcagccgtgccagcagtgcgacactaatagcaagatagtcaaggccagtacagagacctcctagaatgaagcatggattaagaggaaatttcaggattgggcaaagtgctcctcgaggtggccgtttcccatacactcggcctcctccacgccggcctctgccacgtcttgtacgacctgatactcgcttacctcccatcaggaggcctccactgaagaggccaatagatattagagatagacgccctgttatgtcgataccagatagagttaggcgtttgcctcctccagagagatcctatgatagaaggcccccagctcctgtttacccaaagagaagtccaaggagggaatatggaaggcgtgatgaacctcttccgccaaggagcagagctacctttgctgactacagtcgtccggttccagtggataggcgccacacttacagggacgactattcgccccgtgaatcggcctattcagacctagctcctcgcagcgctccccgtttttctgacaggagagcatatgctgatgacggctatgtagagaagattgaccgacctttgccaacctatagggagggccgtggacgtgattatgatacaatatctggttcaaaacgctcatatgttgagatggatgacgtgcctcctcggtaccacgacattagcgttcgtcagcccaaggcacgcttagattatgatgttggtggtagcagtgctcggtatgcagatgcttatactgagaggcttgggcggtcacatgtgggatacagtagcagcagatctgttgctggtcatgacccggtgtatagcagcagccgccatggcttgagttatggaggttctgcgagcactggagatgctggtggaaattactcttcaaattacagtgcagactacatgcctcgtggatctgatgttggcgggagttcatattcatcgcattactcgggtcgaaacacgggtagcagcagtggctactttggcggcagtggttccagttcgtactactaagatgtggcatcataggaggttggtgtaggccatggattgtatggagctacttaacttaaggcctatggatctggacaagtggcaagtgtgggcaatcaataaggcatgtctgaaggagccaggaacatcgagttggttgaagcagtagtcttgtggatgttccggcatgtttatttaatgtaaggctttgctttagttggtcaagagttgtgaactagccagccatggtgtgttgacatgtttacttccagtgtttctataacattgagagatatggagtatttcaataagtaatctttgaggtcgtttccttccaaaaaaaaaaaaaaa

SEQ ID NO: 21555 - DNA, 897 bp, Triticum aestivum
  unsure (1)..(897): unsure at all n locations
  Clone ID: PAT_TA_21555
atttgttttcacttcatcacctgagtataagtatccaataggtagtactaatgctcgagtaattttttctgtagacatccagcaagtgtcgtcactgatatccaaccttcaagaacaggaagcaatcctgaagcagtgcattgagcaacttgaaagtgttgatgcggcaaggataaccctgatcagtaacctaaaagaagcccttagtgaagaggaaaaaaagtcggagcttcttcgcaatcagttgcaagttggtcgagcagaggctgaacatgccgcgcaactaagacaacgatttggtggtgcccatgccactaatggggcatggtctagttctagtacgctcatgaccacaattccgtcagagcagactgctgcgatgatgcagaatgcagcaataagcccaataactccccagtttcaaccaccacatccagcaatcccgctttccgccacagccagtgctgcagatgatgagcccaagaaaacggcagcagctatggcagataaacttgcatctttggcatctccggagcaggtgctctcctccattttggcctcccttgctgcagaacaagctgcttccatgaatggcggcccgccttccgtagagctctcggaagggcctccaggcttccagataccaaagaggcctagaatcgagaatcctacgcaaaccggtgatatgggtgctccccctttctttgggcaattgctgcaggcacagcagaatggagcagcgcctacttctcttggaggcatgcagtcatcgatgcaggcaaatcaagcactgggcgcatttgcaccacttncccctccactgccacctatgctgccgccacttctgcagcaattcagtcaaaatggtggaggaatgttcggaatgggaccttttgg

SEQ ID NO: 21556 - DNA, 582 bp, Triticum aestivum
  unsure (1)..(582): unsure at all n locations
  Clone ID: PAT_TA_21556
ccgcgccgaccccgatggcctccgccgcctcatcggccgccgccgctggcaaatcgctgttccaggggctccgcaggttcctcaagaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccggagacagtctacgacatcaagtacttcacccgcgaccgccgccggagccgcccgcccgtgcgccgcaccctgctccgcaagcccgatctcgagcgctacatggccaccaagcagttcgaccccaccaaggactccccgtgccatacgtcaacacacctgtcgaggaggacgacaacacggtcggcggtggctaccagaatgttcaaggaacgtgccggttattgcngggtacctctgggtgccccgtgtgctgcgcccattcctccgcctatttcttccccttcattcccctttcgaantttcgggtgaaatacgtggggatataggctccccgagctaaagatgaatactgtaattt

SEQ ID NO: 21557 - DNA, 526 bp, Triticum aestivum
  Clone ID: PAT_TA_21557
ctcatatcctgagccagagatcaaagaaaccagagggagcgaggcatggcagcaggcttgcaggtgtttggccagccggcgtctactgatgtctccagggttctgacatgcctgtttgagaagaaactggagttcgatcttgtccgcatcgatacattcaagacgcatcacaagcttcccgagttcatcaggcttcgggatcctaatgggcaagtgaccttgaagcacggcgacaaaactctcgttgattcgagggacatctgccggtacgtctgcacccagtttccaaacgatggaaacaagagcctttacggatccggcgctctaaaacgggcgtccatagaacaatggcttcaggcggaggctcagaacttcgggccccccagctccgcgctcgtcttcaactggggttcgtccctcacctcactcacctgggcgttcgtcaggacctgccgtgatccccgagaacgaggataactgaaccaagtccttgatgtctacgacgagatacctccaaggggggggg

SEQ ID NO: 21558 - DNA, 372 bp, Triticum aestivum
  unsure (1)..(372): unsure at all n locations
  Clone ID: PAT_TA_21558
tcgcggacgagggaactagtgcagttctggcgtttccttcaaaatgcatgcctcacctataccaggggaaacgacaagttatctgagcattttatgtttgaagccatgtgactgtgaggtctgttattttttcccctgagcgcgaggtttggttgtgagcataatgcatttgcaaagttttatcttgtacgtcatccttcaacgtttcaaattttatcatgtacgtcatccttcaatgtttctgctgccagaggttttcccagtgatcgttgagtgctgagcatgttgtccaatgttcatgcctgcagtattaacagatggccactcttttcctgtgaaattgttaattgcatttgagcaaaaaaaannttt

SEQ ID NO: 21559 - DNA, 707 bp, Triticum aestivum
  Clone ID: PAT_TA_21559
cccacgcgtccgcccacgcgtccgcccacgcgtccgccattgcttcctgatcactcattcctactcccggccgggctcccggccggccggccggcaagcactacaagatgttgagctggctccgttgtttcccgcacgacggcaccgtcatggacgaggagaggaagcccaggcccgggaggagcgccactttcaggaagaagcattgccccgatgccgcaccgtctcggaaacggttcatccgctcgggcacctcgctcaccgcgtcctcgtcggcacgagccagcttcggccgccactccgtcgacgtccccaactacaaccacagcatcgtctcggcgcgctccttcaccttccctgagctcgccgccgccacggactgcttcagccatgccaacctcatcggcgagggcggcttcggccgcgtctacagaggcctcatcggctcgttggcggtggccgtcaagcagctcgaccgcacggggttccagggcgaccacgagttcctcgtggaggtgctggtgctgagcagcctcctgacccaccccaacctcgtcggcctcctgggctactgcgccgacggcaaccagcgactcctcgtctaccaactcatgccgctcggctccctcgaaaatcacctcttcctcccccgagtcccagcggacgccgcccagcggccgccaccgccggttctgccgtggcggacc

SEQ ID NO: 21560 - DNA, 802 bp, Triticum aestivum
  unsure (1)..(802): unsure at all n locations
  Clone ID: PAT_TA_21560
gtaacanaccccggtttntcccaaagggggtccattcncccccccttgtttcgggacatgggggcgttcggatacccgctggcatgcgctctcctaggctctcttctttcctcgttgaccgctcggcgctcaacaggcgcttttccctgttttttgttgaacctaacgcaaagtttattttcaagaagagcacaggaatgctcatttccgaacaattcaatgtctcgttacaagcaagcatgctcacacataggcactcaactttcgtcatagaagacacatcactgaacaagcaaacaacccagaacagacttggcttattccattcaccgattgacagggcaaccgtttcaagcagatggcttcatcagggcagcgaccttctgggacagacggctctccatcaagaccagaccaccaggcttcacatgcgggtaggcgtccgagcacagatgcgtagggcgtagcgaacaggcagagagtgacagacacatggttcaagtccggcgaggctgaggaatctccaacaaggtacttgcacttggtcaggcgtgcctcgtacacctctagcacttcttcagcttctcaaaggtctcaaccacactttccggccgtggtccccccagcataggactgatgaagactggaaaagatggatcaatgcacgtgtacgggtaaccccactcgatcaaacatcacaatgctgcctcccaagggggccgtacaatcgcctaaaggaccctataccccccaccgcgtcttaaactctacgggaaaccgggttccactaccctgannaacc

SEQ ID NO: 21561 - DNA, 632 bp, Triticum aestivum
  unsure (1)..(632): unsure at all n locations
  Clone ID: PAT_TA_21561
cgaaaccccaccccgcaccactcatggacgccgccggcgcgcgtccatcggcaccgtcggccgctgctgccgcagtcgccggggcctccgtcgcggacgagccccgggacgcgcgggtggtgcgggagctcctgcgctcgatgggtctcggtgagggcgagtacgaaccccgcgtcgtgcaccagttcctggacctggcctaccgatacgtcggagacgtgctaggggacgcccaagtctacgccgaccacgccgggaaggctcagatcgacgccgacgacgtccgcctccgccatccatgccaaggtcaatttctccttctcccaaccgccgccgcgtgaggttctccttgagctggccgcagccgaaacagaatgcccctgcccaaatcaattgctcctcctggctcaatcccctcccgcctgagcaggacacctgttggccaanaactacaaatcctgctccgtttaaccgcaactaatttaggaaaacaggtnagaatgaagatccaaccaagttgacacgaaccgggaatctaatcaactttcccaggttacgggttacttcacagaaccccacaggcagnggttattacccagcgtgaatnncngaaaggaccgntacncaaacta

SEQ ID NO: 21562 - DNA, 627 bp, Triticum aestivum
  unsure (1)..(627): unsure at all n locations
  Clone ID: PAT_TA_21562
ctcgtgcccccttcgccctcttcgaccctagcaagaagacggcggcggagatggtgtactacgcgcttttggtgggcgcagagctggacggcctcaccaacctgcagcccagcggcggctgcgacgaccccagcttcccctactacctcaagctcaagtgcgagaactgcggggaggtcaccgccaagtccacctacgtcactctcaagcgagcaagtcgacctgcccaagggacatggcaccgctcacctccgtccagaagtgcaagctttgtgggagagatgggaacaattggtgatgattcctgggtcaaggggacgccactttactattgagcaagagccaagaaagaagagaagacttgtttgatgggtgtttggactgcagaggctatgaacctgttgagttccttttgggagctggctggaaagntgatccggtgcatggaccctttggaaattgacgctccgaagatgatttcctgagtatatgacaaggaagatcccggntnaactaacaactccatcacatcaaagnggtgaagaacatggaaaggtggtaagacagattgctagtcatgactggagcggcggtttggaaccgagggaaatggaattggtaaaggtg

SEQ ID NO: 21563 - DNA, 622 bp, Triticum aestivum
  unsure (1)..(622): unsure at all n locations
  Clone ID: PAT_TA_21563
gcaaagcagcttcctttcgcctgctggactagtcgagcggcgagcgaggaggcggaggatgggccgcggccggggcgtgagctacgggggcgggcagagctcgctgagctacctcttcggcggcggcggcggcgacgaggccgccgcggcgcccgccaagccggctgcggcggcgcctgcgcctgcgccggtgccggcggcagcagacggcgagaagctcaaggggatcccggccggcgtccgcggcaaccagagccagaccaacaactacttccggggcgcatgggcagaactgcggcaacttcctcaccggaccgcccgtcnaccaacgtgcaacgccgcgccngggcggcgctcgtcgcccggctaccctcctccgcggcngactcccgggaacaaagtgatgtgatggcaccttctccgcccaaacttttccgagcaccgcctcntgggaaccttgattttacaaagccacctgactgctggatgtnantattcaatannaatgnagtcatgtgactccgttcccaaatgttantgtccccnaatncctgggcggctcaaaatccgtagtnttttancaaggattttntnattgtacacantgaaatttaatttaaat

SEQ ID NO: 21564 - DNA, 942 bp, Triticum aestivum
  Clone ID: PAT_TA_21564
ctcgtgccgaattcggcacgagcctctctctccctcctcaggccgcgatggcgccgtcgggctcgaacccgctggagcccgtcttccagaccgtcgccgctttctcccgccgcctcctcatcgcccccgacaccgcacccgacgaccaccgcctccgccccctcctctccctctccctctccccgcccgcgcccccgcccccggctccgcccccgccgccggaggtcctcaagcagaaggatgcgaaggtggcgcccctgacgaaggaggaggtcggccgggccacgtggatgctgctccacaccatcgccgcgcagtttcctgatgaaccaaccaggcagcagaaacgcgatgcgaatgagctgatggctttactttctagaatttatccttgcaaagagtgcgctgatcacttcaaggaagttttgaaagcaaatcctgtgcaggcaggatcccaggctgaattctctcagtggttatgctatgtgcacaatgtggttaatcgaagccttggaaaaacaatatttccctgccagagagtaaatgcacggtggggcaagctggattgcccggatcgcgccgtgcgacctaggaggctccaacgacatcatgccgaaccgatgacactgcccagaaaccttataaaactcccgcgccagtaacaaatttgaaccaccattggatgggcaataccaggaggataagggaagatatttcagggcaataccggtgtattattattgtttacctcctccatcctctatccctggcaaatgtaatactagtatatgacccaactaccctccccctggggccgcaatcctgttccgtacagtttcgccatctttacgatgacgcaacgttggggtgaccctataagctgtgggggtgttgggggaagttgtatcagttacaccgatttagtgctctaaaaaaaaaaaa

SEQ ID NO: 21565 - DNA, 915 bp, Triticum aestivum
  Clone ID: PAT_TA_21565
ggcgccaggacggcgcggaagcgcagcgcacctcctttctctcccctcccccccccggccagaggctttctttgcttcacgcggggctgcggatattccttgtcctcgcggctcagccaccgcggaatccatccagcgcagctcaggggggcaggaggagaggcggccgaagctggaggtggaagacgggctcgccatgggctccgagggatccgcgccggtcgtcgttcccagaaactttagacttttggaagaacttgagagaggtgagaagggcattggtgatggaactgtgagctatgggatggatgatgctgatgacatatatatgcgctcctggacaggaactattattggtccacccaatactgttcacgagggacgaatctatcaattgaagttgttctgtgatacagattatccagacaaaccaccgactgtccggttccaggctagggtcaatatgacatgtgtgaatcaagaaactggaatggttgatccaagacgatttcctatgcttggaaactggaaaagggaacatacaatggaggacatcctcatcagccttaaaaaggagatgtcaacccctcagaaccgcaggctccaccagcctcatgaaggcaccgatgatcagagagtggagcagaaagggctagcagctagatgtgtcgttatgtaagttacgcgcattgcaatgtacagtgttacactgagtagcatcagaatgcagaagctgaggaaacccaggaggaaatcatgtaatttgacagtcgctagtcgctactttcgatcgaaactgctttattgccgaaataaaatgccaatgactcccttccaaagacccccctaatccgtctgcacactcctgtatccgtttatccctcatttagcaatatcaagaggccatgtgcctgc

SEQ ID NO: 21566 - DNA, 710 bp, Triticum aestivum
  unsure (1)..(710): unsure at all n locations
  Clone ID: PAT_TA_21566
ctaggacgaggtgaccagcatcaccgtcaccggccatagccttggagcgtcactcgccaccctcaccgccatcgacctggtggccaacgacgtcaacgtgccccctaactcgaagcaaccgccgtgccccgtgacagcgatactgctggcgtgcccgcgagtcgggaaccccacgttcaagtccgccttcgactcattccacctcctgcgggcactccacgtggcgaacgccaaagacctcgtgccacagaaccctccctctgtgttgttaatgtggtacgtggactgcgcgacagcaacgattcgtaatttgacacggaccggtcaccctacgtgtttcacaaaatatcgacccaccacgtcctccgagttgtacctgcacggtgcccaaggggttnaatggcgacaaggcggacttcaaactaatggtcccccgccaactggcgctgggtgaacaagactatccacctgcctgacagacgaatacccattgccggggacctgtgggtcaatttaaaacaatcatngccaagggaaccgatggcaattggacccatactttanagaacatattagtgggttacgcgcatacgtgcctccgaccctcggcttacaccctgcctgcgctgctggtgttgactgttctggctcggtttacattgtcaaatacgctgccgttatcatttgcctcaattagcaaaaaaaaaaaa

SEQ ID NO: 21567 - DNA, 703 bp, Triticum aestivum
  unsure (1)..(703): unsure at all n locations
  Clone ID: PAT_TA_21567
cctcgctttcctcctctacccgtccgcccccgccgcccgcgtcgccgacatccgcctcgaccgcttccgcgtcaacccgccgcccttccccgcgctggacttcaacctcgcgctcagcctccgcgtccgcaatcccggcttcctcctccctctccgctaccgcgccgtctctgccgccgtctcgtaccgcggccgtctgctcggctcaaggcactgcgcgccccggattncggcgagctcgcggcgagagggtttacctatgcctcttctgaggtgtgggtaggacgctggcagggtattggacgacgtgatcgagctgattggggacatcgccgctgggtctgtgccgctggagatagttaccgaggtggtcggcgcggtcaggctgttccatttcaacatccccgtgaagggcctgatgtcctgctcggtgaatgtcagcccaggcacccagagtatcataagtcaggattgttactaaggtaaagctctgttgtcccacagaggctagagggctccattgttattgttactgttgttgttgtgaacaattcatgtgtgtatcagctatgattgagttgcagagctgggtcagtataactgccaaaatacatgtttgtaaatagttggaatttttattgtacctgcccgggcggccgcgtgtatatataacttgttaatcaagtgtgctaaaaaaaaaaaa

SEQ ID NO: 21568 - DNA, 568 bp, Triticum aestivum
  unsure (1)..(568): unsure at all n locations
  Clone ID: PAT_TA_21568
gcgcagtcgcccattccgcatctcgccctcccgtcccgtccgtccgttctccgattggccgccgcccgcctcgccctcctcgtcaacaaaagcccaccgcaagcgagcgagcgagccaccccgcccgatagccgccgccgccgtcccgcccccacccgactcctcctgaccgccggcgtggggtgcccgggctccacctccggcgacgacaccctccccgccgcgcgcgcccccaccgcctgctccgtttgcggggggtagccggggctccggcctcggcggctttcaaagccccctccctcacaacaggattcaaaatcccgtcctagactcttcctacctcccctttcaagaacttcctcttttggcatcccggacgtccattttcgaccccttcgatttcgattcatctcttcctatcgattgatcttccttccaacctatttcgtatatgcattttgatcctccttcttcccgcgccggtagctaatccaaatccaatcgaatcgatcccccggtcctgagtcccctcgccgatccagntancacgaaaaaaaattnccgcgcc

SEQ ID NO: 21569 - DNA, 524 bp, Triticum aestivum
  unsure (1)..(524): unsure at all n locations
  Clone ID: PAT_TA_21569
ctcgtgccgatcagttccacgggcacatcaactaccgtcgtagggagccaaaccagagtgtgtccctgagacgatggcagctgccgccgttggtcgccgaggctccaccaccatgcaccttcgtctccctcgccgtcgccatggccatcgctgcactctcgtcgcttcctccgagcagcaccgccgccaaggcggcaccgtgctcaangccacaccttctcgggcaccaccggcgggcagaacccctacgcgtcgtgcgcggacctgccacgcctcggcgccacgctgcactacaactacacggctgccaccaacacggtcgccgtcgcgttccgggcgccgcaagcaagggcgacaacggttnggtttgcgtgggggattaacccgagcggccgccccggcatggcgcggccaagcgtggtcgcttcaagcgtcnnangaagctcgtcnctaccgacgctgctcanagtaccccgttaatgngccncnccccnggatntgcgtcccngtccgacttncggcgt

SEQ ID NO: 21570 - DNA, 656 bp, Triticum aestivum
  unsure (1)..(656): unsure at all n locations
  Clone ID: PAT_TA_21570
ctcgtgccgctttgacaagggaaaaaaaaccaggtctgtgtgtgtgtgagaagagagagagaggcgaaggcaactcaggcgacgcgatggcgatggcggcgctgcgacgcgaggggaggcgcctcatcctctcctccaccgtccccaacccgtctctgggcggccgcttcctctgcggtgacgcgatcctccgccgtctcgcaaccggagatggctccacttggtgcacggtctatttcaactcaaatcctgaggaaccggatgaagagtgtcaaggaatatccaagaagatcacaaaggctatgaagatggttgcagcatcaaagctcccggcagttcagaacaaggactgaaaattcacgttggcttgtggcaaccgttcaccgcccttcttggggatgcccctaatgttgacgtcaagaagaatgtgattgtggcattacctccgataanggacccgtggtgggtattaatccacaccagtgaagttacaaggccttcaaaattgacatctggccagaaaagaaccaatttgtttattagagaaaggnaaatcaactgtcctgcccaggcacattgaatacgcacgaacgaaaagccttcacctaaggtgtgcccctccgtaatatgaaattgannagcccaggtttanattc

SEQ ID NO: 21571 - DNA, 986 bp, Triticum aestivum
  Clone ID: PAT_TA_21571
cccgctcgctccagccgtcacctctcgtcctctgttcctcgttctgcctcactccacccgccgctgcactgcttctgtagaccaccatgaaggtggttgttggttgagtgtgagtgagagctctagtccttcatcgatcgctcatcttgttcgtcaatgaattctgcgcctgtcatcgtcaccaagaaatcgcactaatcggttcgtcgtcagatttgccttactgtttcatctgctcaaaggatcatctttttcttgaggaattgggcgtcatcagttgataatcgagtttaccttgttatttgatctgctgggcatatcaactctgcagtaaggaaattagctgagccttctatcactaaataaaagggttgtgatgtagctacgctagctgctcggatggtcggatgggagaggtaatgcggccggagtcagtgccccgaacgcaaccgatgcgccatcctgctagtatgtgctcattttgtggtggtattgtgtactgcagaatatggcggcttcactatggtctgaagataacggttcataggattctgaaaatgcaatgccgggtatcgcaaggcacgagcgcgtccgctgattcggcccttcgtctcttcattgcgtggtgttaaccgcagaatataccagcctttgacagacctcctttaagttttgcatagtgtcagcacaatcaatttcttcagaatccaggagcttatactaccttgagcatcaaatttggtatccgttgcttgcaaactgagatagtgctgtattactggctacattctgaatgccaagaagttgtacaacaagccaaccgctggggttttgtgccgtatccaggtaccccgtacatcaaatttggagctggtaccttttgcatcaaatttggtttccgttgctcgtgaagtgaggtagtgatgtattgctggacacattttgaatgctgataagttacactttgttaaaaaaaaaaaaaaaaa

SEQ ID NO: 21572 - DNA, 607 bp, Triticum aestivum
  unsure (1)..(607): unsure at all n locations
  Clone ID: PAT_TA_21572
ccggatagggatagcctcgcccatagcagctgcctgaaagttctctctgtttcctttgtcttctccagttgcccggcttcgtctccggtaacgcactcagtcgatggcctcacccacagccgcagcagcaccggcagagttcacgcagatggaagccgcgcgccagtccctcatcgcgatctcccagtcggtcccggaggtcggggcgcccgtccgtcagcccgcccagcggcggccgaggcatggatgaagaatgggcacgaggacgtcgcgggagcggaggtacagggcgaagcttatctccatctccaaccagtcccccgacgccgcggcctacgacgtgcccccgcaacaacggcgccccctaaagagccgcgtttgtgtattgtaacgtcgccgcatgtacgtgtacgtgtactgggccccctaagtgtgtccgtgtgtgttctgcantctgctaataataccgtagccaagaacaagaacaggatatgggctaataatcaccttgactgcaaaggaacccgtgtgctgtgtcaacgtctaangcactngaaaatccattncancgagttagtcagtcacctagttcaaagnaaaagtccgt

SEQ ID NO: 21573 - DNA, 518 bp, Triticum aestivum
  unsure (1)..(518): unsure at all n locations
  Clone ID: PAT_TA_21573
gcgctccctacctctccccctccttccaccttcttccgcctccttcgccatgggcgctccccacctctccccatccttccacctcaagccgtgctggggaccccggtggccgagctgcgacgggcttatccggcgtcgattggcagcttcgacccaagatgcaacggtctgcatccggtgctggaaccagcaagtcctgggtgctaccactgggctgcagcgatgctagaaccagcacgacagcaagctgcaaccccagctgcgtcaagtgctgggaaccagcgatctccgatgctactaccgactatgccgggagctgggaacaaacttgctactttttttttgctacatctacttctttaanggattttgctccctatgatttttgccanaancagatgcgtctcgcacgccgacgtgtttttttgttggaacaacttcatgttttgcnggaacttggaaagtttgccacacnaattctcagccggtatgatggaaggttgcgcacaaaaaaaaaa

SEQ ID NO: 21574 - DNA, 618 bp, Triticum aestivum
  unsure (1)..(618): unsure at all n locations
  Clone ID: PAT_TA_21574
ccaccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaaggccaagccggtgtcgtccggcagcccgtggtacggtcccgaccgcgtgctctacctccggccgctctccgggcgaccccccgagtactcaccggtgattccccggcgactacgggtgggacaccgcgggctgttcggccgacccccgagactttcgccaaagaaccgggactggagggattcacggcggtgggcatgctgggcgtctcggtgctcttccccgaactgctcgcccgcaacgggtcaattcggcaagcttttggttaaaggcggtcccaattttaaacgagggggctcgatactcgggaacccaactctcaaagcaaacaccccgcccggggcgcacgcttgtacgggcgcgtcagggtacccgcccgggcgccggcggtttgccccccccgccgggttttacccnggccccctacccngn

SEQ ID NO: 21575 - DNA, 626 bp, Triticum aestivum
  unsure (1)..(626): unsure at all n locations
  Clone ID: PAT_TA_21575
tttttttgctaatttactacggtcactacggagttactgctactaccagaacaaagcatttatctttcaccagctacagtcccagtatggccacaccccgaacgagatggaagaaaaagggaaaaagagtagaagcaaaacttacaagagagtggaagagaagagagaacaatagggcagagagctcatctctaccccaaggcatggcgccccatgcaccggcgtcgcatcccccccataaaaaaagaaaaaaagaaaagaaaacacaccgacacggattcaaacctccgtgccctagcagcaccaggatcctgccaaccctacctcctatagctacatacccctctcctcccgccaaatgcccatgccgctctgctctgttgccttcgactctcgcatgtgctccagcctaacacagggacggaccgtacggtggatggaggcccaagccccagcggtccggcgggcccccgacgaacgaacggtgacngcaccaaggcgaccgaacaacgacaccagccgccaattccttcaaggcaagcaagtcngcacaagcgctccgtcnccgggattaanancggcaaccctggcaancntgcccncggtgcgnacnaatcntacggngg

SEQ ID NO: 21576 - DNA, 213 bp, Triticum aestivum
  Clone ID: PAT_TA_21576
tttccattccacgtcaagcccatattttatccatttaacatcgtatatgacaaatatgtaacagtacaggttgtgaccaacctgggtcgtggaaattttttgtacttgcattttgtagagagaaaatacacattttgtttcttcccaaagaaatatgtctttgttatataatccagccgggacgctggcgttgtagatctcaaaaaaaaaaaa

SEQ ID NO: 21577 - DNA, 643 bp, Triticum aestivum
  unsure (1)..(643): unsure at all n locations
  Clone ID: PAT_TA_21577
cagacaccaactaggatcgatctctcgacagcaaatagctagctagcaatggagaagtacaccaaagccctagcgtcattgctcaccatgctggtgctggcacctctcctcgccatggccaccgacccagaccccctgcaggacttctgcgtcgccgacctcaacggcaagctgtcagtgaacgggtacccatgccagccgccgtcgtcggccggcgaccagttcctcttctcgaccaagatcgccacgggaggcgaccccctgggccaacccgaacggctccaacgtgacggagctggacgtttccgagtggccggcgtgaacacgctgggcgtgtccatgaaccgcgtcgacttcgcgcccgggcggcaccaacccgccccacgtccacccgcgcgccaccgaggtccgggctcgtcacccgcggcgactcctcgtgggatcgtccggaagcctcgatccgggaacactactacccaagcgccccccccccgggcaaccggtcgcctgactccggacgcgggcccctcgggcgtctcggaacgagacccgcatgggcggcctcaccgcaggtcccccgccttctaccccccactgggcccgctgcccgttcaaacggggtccaagggtcggtggancaagn

SEQ ID NO: 21578 - DNA, 1293 bp, Triticum aestivum
  unsure (1)..(1293): unsure at all n locations
  Clone ID: PAT_TA_21578
gccccactccattatcgaaacttaattcgtcgtcatcggagattcctcacgcctgcagctgcgaagaccaaggccctgcaaggaactgagccggagccactggccggattcgccatgagaccgccgccgtctccccctttactccccttactcctgcttctcgttctcctcccgtcgccgccggctgtggccgcagcggcaggccccacctcgttggaggcgctccgcgcggcggccggccgcagggccgcgtcgccggccacgcaagagagggctgccgccggggtgctccgccggctcctcccctcccacgcgctcagcttccggttccagatcgaccccaagggcggcgtctgtggcgactcgagctgcttcaggataagcaatgttgatggctcgagcaagggcggtgcagagattctgatccagggtaacactgctgttgagcttgcatctggactccattggtacctcaaatactggtgtggggtgcacatttcttgggataagactggtggtgcacaactggcgtcagtcccttcgcctgggtctctgccacgagtgaagggaacgggagtcaaggttgagcgccctgttccgtggaattactatcagaatgtcgtcacttccagctactcctttgtgtggtgggattggagaagatgggagaaagaaattgactggatggcacttcaaggaattaacttgcctttagcgtttactggacaggaagctgtttggcaaaaggtttttaagagctttaatgtcaccgacagagatttagatgatttttttggtggaccagctttccttgcctgggctagaatggggaacctgcatgcatggggtgggccactttcacaaaattggttagatcaacaattggcactgcagaagaaaatattgtctcgtatgattgagcttggaatggtcccagttctgccatcattctcaggaaatgtaccagtcgcgtttaaaaaattgtttccatctgccagcataaccagactcggtgaatggaacacagttgatggtaatcctaggtggtgctgcacttatattcttgatccttcggatgcattgtttattgatgtgggacaggcttttatcaagcaacaaatgaaagaatatggtgacatcaccagcatctataattgtgacacattcaatgagaatacaccaccgacaaatgaaccggcatatatttcatcgcttggttctgctatctatcaagcaatgtcgagaggtaacaaggatgcagtgtggttaatgcnaggttggctattttactnn

SEQ ID NO: 21579 - DNA, 497 bp, Triticum aestivum
  unsure (1)..(497): unsure at all n locations
  Clone ID: PAT_TA_21579
ctctctctcgcctctggttggcagagctctcttgaagcctcgagactcgtctcgccgctgctccctcagctctgccgctgcgtgcctgcgttagctgttgcattgcagcactgcgagccttgagctgctagctcgcccttcaccacagtccccagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacgagaccaagatcgagaacctgggcaatctgctgtacaagaactacggnaccacgattgctgggctcaanggcatcggtacacttcnattacntgagtacaacncttcgtcaatggaaggtgccgtaganaaataaagcctgacccaattctcaagcaaatcnaanaactgggaatccggaaccc

SEQ ID NO: 21580 - DNA, 621 bp, Triticum aestivum
  unsure (1)..(621): unsure at all n locations
  Clone ID: PAT_TA_21580
ggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaatgagaaattgaaagattccgttgaaattgttccgtttgggaaattccccgaaaagctaattataggtcttctctccatccggaacaatagggccgttatgcttaattactaaacttgttgaagagatgaaatagaaccaagggccatccttttgatcnagaggtggaaccatcatcagtaagaagattaagccaaaattaggatacattcctgggaaaaggaacttccattggaagagaaccaaatgaaaccttcataaaatccccgtagaaccgagaaggattttcatccctgtcatccaatnatgaattagtacgcaccaaccccgnaaatcccgatggtccatttttgaatggganatacgggtcccatgatagataacctatccagcantcaaaatctcttctatctagnagcccag

SEQ ID NO: 21581 - DNA, 928 bp, Triticum aestivum
  unsure (1)..(928): unsure at all n locations
  Clone ID: PAT_TA_21581
gcacgagcgggcaaccgcccgctgctgctcccctctccactcccccaccgccgccccgcgcctccacccgcggctccgcagccacgccgccgccgccgctccccagctccgcttccccgcgctttccttctccgcctccgccgtgtccaccagctcgcacggccccagcggcggtgacgccggcgagggggaggatgacaagggagcgtacgagaactacctggggatgagcgacgacgagctcatggcgcagtgcgacatgggcaccttcaagtcctccgggcccggcggccagcaccgcaacaagcgcgagtccgccgtgcgcctccgccaccaccccaccggcatcgtcgcccaggctgtggaggataggtcacaacataagaatcgatcgtctgctttatctcggcttcggaccctgattgctcttaaagttaggaggccgataaaccttgataactacactcctccagttgaacttcttcagatattgccactgaagtctaccattcgatcaaaggatgttggcagccaaattgggccaaataacccaaaattttctccaggaatgcaagctttattagatcttctatttgctgttgagggtctgtatcaagaggcagcgaaaattctaggccctagcactggtgccctgtcaaggttatcctatcaagatgatccctccgagccgctgcaaatgaactgcggcctccaaaggactggagccactaagatgatgcccctttacatggtacacctctgctgcgcacagtgccaagggcccatgctcatgattcatggttgcattgggacttatgcccatccttacccgagtggcacccccagtctgctctcacgcccatctccgccggtggtgtgctgccacctgtgtgctcgtgtgtnatgnatgncttanagttcancctgg

SEQ ID NO: 21582 - DNA, 1354 bp, Triticum aestivum
  Clone ID: PAT_TA_21582
agcatgatatgcaagcgtgaacactcatcttggcattgaacaaagtcgaagagatgacttggaatctcttggatatgtacttatgtacttcctacggggaagccttccttggcaaggtctgaaagcaggaacgaagaagcaaaagtatgagaagatcagtgagaaaaaagttgcaacatcaattgaggctctgtgtcgtgggtatcctactgagttcacatcatatttccattattgccgctcgcttcggtttgatgacaagcctgattattcctaccttaagcgactgttccgtgacctctttatccgtgaaggttttcagtttgactatgtatttgactggacaatactgaagtaccaagcaatctcaaattgctaagtgccccgcctcgtgttgcaggccatggtgcaggaccttctgggttgacaccacctgtattgcagaatgatagtcaatctggtgctgttgaagggaggattagtggttggtcagcaatggaccgacgtcgtgccccaccccccattgcaagcgtggggacttcaaataagcagaaagcccctgtaggaaatgatgctcctatttctaaagaccctgcgatatccggctcgaattttttggggcggtcaagtggatcgtcaaggagagctgctgtttcaagtagccgggatgctgtggcaagtgacacttttgagccttcacgatcacgcacgactgatgcaagccctggtgcattccgtagaacctcaggtgctcagagaagcccaccggttgattctgcagaaccacagcgttcctcttcggctcggcattcatctaacccgaagaactacgagtctgccctcaaaggtattgaaggtcttaatttcgatggcgatgagagggctcagtactagtagcactgagaaaacgattcctcttctacgtgtgctgtgtataaattataatctgaagataagcacagcatttcctgttgagttttggatcacaggagatgttacgaggaggatgtgaagtgctattgccagatgatggtggtggtcttctggacacggtaaataagtggtcagcccgaggcacaaggaatgtagctctcataatttaatgtgattggggtggttctgtaaatgtctttaatctctatagtttgttatgtggcgcttgtcgagtctgttgtattatttctattccttacggtgcaccttgtccagttgccattgtcttggcacagccaagtgcagcttgtaggactttgtctttggagactggaacctgaccatgtagaattttttcgtccgttcatcgaacgaatttggctggtaacgtttcctgactattaatgtgcctttgaggaac

SEQ ID NO: 21583 - DNA, 258 bp, Triticum aestivum
  Clone ID: PAT_TA_21583
gcctcccctcccgagatctcctctcttcttccctccctccctcccttctctcttggcgacgtttacgctcaccagcgccaggtacgcgggtctttttcggccgaggtcgctgccgccccacgccaggtggtcaggtcttctccggtcccttcgccggcgacgtgcaccaccaggctgagctccacagtgggttcttgcagaggttccaggtttgtaacagactgctggggtgaatacacctactccaaaaaaaaaaaa

SEQ ID NO: 21584 - DNA, 642 bp, Triticum aestivum
  unsure (1)..(642): unsure at all n locations
  Clone ID: PAT_TA_21584
ttcaaacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttcccaggctaacctgcggattcctggtcactgggtggggcgggcttcatccgctccgcacctccgttggacaggctcaatggagaacgagaagcacgaggtcattgttgnctgataacttttccaccggttcaaaagataaccctgaagaagtggttcgggcacccaaagattggagctcatccgccatgattcaactggaccactccttgtggaggttgaccagttttatcaccttgcttgcccctgcttaacaactcttctacaaacacaatcctgtttagacatcaagacaaatgttattgggcccctgaaatgctgggactgtcaaagagatttggaccaagattgttgacatcaacaccgaattatggggatcacctgagcacctcaaacgaggctacggggaatttacccatggagcgggtgtgtttgaggggacactcaaaacctatttanatcagg

SEQ ID NO: 21585 - DNA, 608 bp, Triticum aestivum
  unsure (1)..(608): unsure at all n locations
  Clone ID: PAT_TA_21585
gaataatctccataacaagatgctattatggcatggttcaaggctgacaaattttattggaattcttagtcaagcacgagggatagcacctcctgaggctcctgtgacaggctatatgtttggcaaaggcctctacttcgcagatttagtaagcaagagtgcacagtattgttatgtggatagaaaaaatccgactggcttgatgcttctttctgaggttgctctaggagacatgcatgaactgaaaaaggccacgccaatggacaaacctccaagaggaaagcattcgaccaagggcttaggaaaaactgtgccgctagagtcggagtttgtgaaatggagggatgatatcgtcgtgccttgtggcaagccagtgccagcatctatcagggcatctgagcttctgtacaacgagtatatagtctacaacacagcccaggtgaagatgcagttcttgttgaaggtcagattccgtcacaagcgttgattgggaacctaggagagtagagttggactgttagttgaagaatntttctttggtgtcagtactcantagctagtctgcactgtngcatttgcaatggcatcggtgaactattccgcagctt

SEQ ID NO: 21586 - DNA, 175 bp, Triticum aestivum
  Clone ID: PAT_TA_21586
tgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataagaaactttatcgcccaaaaaaaaaaaa

SEQ ID NO: 21587 - DNA, 734 bp, Triticum aestivum
  unsure (1)..(734): unsure at all n locations
  Clone ID: PAT_TA_21587
ctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctgggtagcgattggagggtcaagagaacttctacagtgcctttgaggctgagcttgcagatgccatccctgtggtcaagacctctattgggtgggcactaagaataatacgccgactttgtgttggaaacaagaatggacttctattgccacatactacaaaccgaccaagagcttcagcatccgaggaattgcttgcctgatcaagtggggggtcaacgcattgatgagaggtttcctgcccttggnaatgcatanctgcaatgacatgttgcacttaccacctgacttgcaaggagactgaggagtcatgcaatggcttgggtccagggttaggaaacnatgccggaanacctttggggagtatggcctcncaaaaggnggttggtaaccaaacatcgttaaactgacacccaaccccaatccctctgaggaagggacagcttnngagntacaganctttgcgnaaaccncatccaagcnantaaagacctatnggaagaccaaattttgggnaatgaatctnaatttnn

SEQ ID NO: 21588 - DNA, 813 bp, Triticum aestivum
  unsure (1)..(813): unsure at all n locations
  Clone ID: PAT_TA_21588
cttcgactcccactcccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctgggacctgctcccggctaagggcgccaagcgcgggttttctgacgaggcgccgacgccatcgcccggtgcagcttccgggaagggaaagaaggtagcggaagaggaggacgacaagaaggttgcaggcgacgccgcagccggtcgcaaaagctcaagtggtgggatggcaccaatccgaagctaccgcaagaacacgatgtctacaccagctgaagggaacaaggaggatgctgaggcaagcagacaagggttctgtactcaagtcacatggatggcgcgccgtactcaggaagattgactcaagactacagaactccaggactgtcgtgcccgggaaatgttatgggctctttcggaggggggttcctgtaccaagggngtgttctactcaagnagatgaattgtctntgaattcatgaaatcctactccaagcagttagtatattgttcaggacgatcaacaaaagtttaacaanagggacntcgngnttgacgataattaaatccgggnnattnccaaaacn

SEQ ID NO: 21589 - DNA, 934 bp, Triticum aestivum
  unsure (1)..(934): unsure at all n locations
  Clone ID: PAT_TA_21589
gagagagagagagagactagtcccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaataaatcaatcgctggcattgtcactgagagagattatctccggaaaatcatagtgcagggaaggtcttccaagtcaactaaggttggcgacatcatgactgaacaggccgagctgctccctgtgaatcccgacaccgtggtccggcgggccgggcagccccggactgtcccccgcgcccgacacaccccggcgtccgtcggcgcgcggaggctgcggcccgcctccatcggcgacgtcntgcccccgtggtggccgaacacaaggaagactgaaccgntcaatgactacatccanggagntactaggacgcgtntncaacgacacccctcgattccgcaataatnaatccnccttgaatccatactccgacaatgtgatacaaatagcctgtttcctgganatatttaattcgnaagttccttccctttttatcacgctggcaagnttatgcaaagatctnacatccccgtttngggaaacacttngggaaacngaaaaactccccgtttcttagaaaaggtcntttaaaaaaaaaaaa

SEQ ID NO: 21590 - DNA, 537 bp, Triticum aestivum
  unsure (1)..(537): unsure at all n locations
  Clone ID: PAT_TA_21590
cttccgtctccaaatcctcctagcgaattcaccacagcttctcaccaccgctaccttcgatggcacccaaggcggacaagaagccggcggcgaagaagcctgcagaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatccgcatctcgtccaaggccatgtccatcatgaactccttcatcaacgacatcttccagaagctcgcggncgagtccgccaagctggcgcgctataacaagaagccccgcgtctccgcccgcgagatctcactccctccgccccccccgcccggcgagctgccttgcccgccgtctccgctggcaatttacctctaagtaaanncaagtngtngnttgaaactggcaatttccganggaa

SEQ ID NO: 21591 - DNA, 654 bp, Triticum aestivum
  unsure (1)..(654): unsure at all n locations
  Clone ID: PAT_TA_21591
gaaactccaatcattttaagatcttcatcacttttgcgaaagaaatcactagaaaatgatttttctaaaaattctcttttagctctaagcatagcggttcttttcttactttattccatagaaacataaagagatttaattgattcatctactttaggcacaaaaattttcatcttgagattttccacatcatgagcaatcctatcaacacttctagacaaatcatcaatcttattcaacttttcttctatggaagtgttaaaaacctttggtgtgttgataaattctttaatattgctctcaagagcagaggtatttcctattattattgtaagattgatttccataggaattaccataattattaagaggaattactangaaagggcctaggattaaaattacccctataagcatggtgttggaattantgcgagaaataaaatcacgtccatgacatcacaatttctcaatcaaagtagacaaagnataccattaaacaatagggnactttacaacaaacaattcataagagcacaactttcacccaggagaattctcaccggattactttacaagaggngcctcggagcatccganantgcagaatacaacattgggntcccaggatcanaagtcacaggggacaagttc

SEQ ID NO: 21592 - DNA, 1222 bp, Triticum aestivum
  Clone ID: PAT_TA_21592
gcgtccgcgcttttgttgctcgattcgagggctcctcccagcgcatggggatcgcacaggctgccgccccgctgcgcctgcatctcggatgctccggcgcggcgcccccgcggcccacctccctcagggtcgggttcgggttcggatcccatgcgaggaggaagggcgggaggaggcggagccctccccgcgccgccagctcgctgcatcccagcagcaacacgagagcgcacgaccatgaccccgccctcaagcctcccgctcccgccggcgatgtcgccgggagggacttgaacggcgccgccgaccacgcgccgcagcagaggcggcgcgcggcgagcgacctggaggaggaggcgtgggcgctgctccgggagtcggtggtgagctactgcggcagccccgtgggcaccatcgccgcctgcgaccccaacgactccagcccgctcaactacgaccaggtcttcatccgggacttcgtgccctcgggcatcgccttcctgctcaagggggagtacgacatcgtccgcaacttcatcctgcacacgctccagctccagagctgggagaaaaccatggactgccacagtccagggcaaggcttgatgccagctagtttcaaggtgcgtgtcgttccgcttgaaggtgatgaagaaggcgcaactgaggaagtcctcgatcctgattttggggaggctgctataggccgtgtggcaccggttgattcgggtctatggtggatcatattattgagggcatatggaaaatgttcaggagacctttcatttcacgagagaatcgatgtccagactggaataaaattgatcttgaagctctgcttagctgatgggtttgacatgttccccacattgctagtcactgatggatcctgcatgatggatcgtcgaatgggtatccatggacacccactggagattcagtcactgttctattcagccctcttgtgtgcacgtgagatgcttaccccagaagatggatctgctgacttgatccgtgccctaaataacaggcttatggcgctctcttttcatattagggaatattactggcttgacaagagaaagctaaatgagatatatcgatacaaaacagaagaatattcttatgatgctgtcaacaagtttaacatatatcctgatcagattcctccgtggctagttgaatggatcccttccggagggggttacttaattggaaacct

SEQ ID NO: 21593 - DNA, 337 bp, Triticum aestivum
  unsure (1)..(337): unsure at all n locations
  Clone ID: PAT_TA_21593
caacaagcggattaatgaaaagtaccatctcatagactcgaaaaatggtcagatccagatcgagttgcagtggagaacttcctagacaggaaggagccagaatgccttgatgttcctctattcagtttgcgtatatctgtgattggagattgaggtcatgtagatatttcttttttttatagacatctgttgttccggatcttctcttaatccgatcaaanttcccgacaaagaactatgccagacatgtttacaagccctggagaatggnactggaacaaatggacacgtccatacatttacactcccgcattcccgggcatactggagaattttn

SEQ ID NO: 21594 - DNA, 637 bp, Triticum aestivum
  unsure (1)..(637): unsure at all n locations
  Clone ID: PAT_TA_21594
gccgccgtttccatctccccggcgctccatcgctgggcacgcaggcgacggcgacggcgctcaggctcgtgctctcaggaacggcgtcagctgcttcctttctcgcctcttgccagtcgcctcgcgccctcgcctttggtcctccgcacggctgacatacgtagaccgatggcaacactgaaagatgcagcggcaaggaagtctatactggcaacactccgtcttgttgtcccagcccggtgcagcccgtcctgcacctccagttgggccagcacttggttctaccggctcaatttgatggcttttgcaatggacttcaatgccaagacccaaaagtacaagcaagaatctccaatgcaagcaccctaactgcctacaaggatacacttcgattcgcggcaatcgcctccgtaccaggtcctcaagaaggagcaagagccgaaaccgcaacatcgccaaccactgaactacctcctcacctccgcaagtttacagattcaaattaatcagtgaccctctgaacaaacttcttggaggctgtcaatcacatgggaagcactcaanggtatgcaatgtaagtnatacacaancanccttngcataaaatcgtcattgagtccaattgaatggcggaaga

SEQ ID NO: 21595 - DNA, 1398 bp, Triticum aestivum
  Clone ID: PAT_TA_21595
gccgcgcctccccgcccccgcctcccggccgcgtccgcggacgcgtgctcgcgggctcattgcagcacacctgcgctgcgcgagatggtccccgcaggcgaccacctcctccttttcgcgctcgcttccctcgggggcgcagcggcggccggcgccggcgaggggttctgctcggcggaaccgtcaaacgattgttctcagtcgccgccgctctactcgaaggtcaccagtcccactctcgcacccgtgcatttgcaagatttacctggcttcacacgtagtgtgtacaaaaaggatcatgctttaataacaccagaaagccatgtattcagtcctttgcctgattggaccaacacgttaggagcatatttgattagcccagctcttggtgcacacttcactatgtacttggcaaacatgcaagatggatcaaaatcagccttaccaccgaaagatgttgaaaggcttatctttgtagttcaaggcagcattgcattgtctgtggagagcggaacaacccactccctgttggtagactcttatgcttatcttcctgcaaacatgaagcactctgtgatatcagacaaaccaagcactcttgtaatctttgagaggaggtacacagccgttggggattaccatgctgatctagttgttggttcaacagataagcaacccctccttgaaaccccaggagaggtatttgagctgaggaagctgctacccacctctcttccttatgactttaatattcatataatggactttcagccaggcgagtatctcaatgtgaaggaggttcattacaatcaacatgggctgctgcttttagagggacaaggaatatatcgattgggaaatagctgatatatcgattgggaaatagctggtatccggtgcaagcaggcgataccatttggatggcgccatttgtgcctcaatggtatgctgcccttggtaaaaccaagtctaggtacctgctgtacaaagatgtcaataggaatccactgatatgagcaaaggcactcactcttgatggatggcaatcgttcaccatagagagctatgaagagttcttctagaagatggcctccaaaagacattgctccaactgcttgctggcgaactgcacagattccagagaatcggtgtaataaaaataataatagcaaatgagtacttggaaaattgtgatgttcatggctgcccattggtgcttggaggatgatatgaaatctgatacttttcccctttttcgagattgaaccttggaacttccatgtattcgtgtctggacagaaattgccgtaaccgtgacacttcagtaatctcgacttgctaatccgctgaaagaagttaaatgcatgcattgatgtaaagaagaggaacaaggaaaaa

SEQ ID NO: 21596 - DNA, 514 bp, Triticum aestivum
  Clone ID: PAT_TA_21596
gaaacgtgttctggaattgctagagaagaactacaagactatgcagtctctccaaactgtgcaagatgcagaaatgggtgaggagaagatgtccgcagacgatgtcgcgttgctggctaatatggttgaagatatgagcatggagactggctatgataaggaagatgatgaaatggaaatggatgatgcagacatggctgggagatgggtgctgcaagctttaaagaaaagattatgggtatattgccagcagggcgattttgccagaaaagagggtcccaagctgagccaagttgatttcttatacctgctgtccctccttcaaacaaagccgggtatacatttccccgtgattggtggtccaacttccccttccattatatccgttccttccgttttaattgccctgcctgttaatttcttattattactgaaaaccccctctgctctcccttagttttttaaagccctcccattgtgcgccaccgagaaatccctcgggttaaaaaaaaaa

SEQ ID NO: 21597 - DNA, 613 bp, Triticum aestivum
  unsure (1)..(613): unsure at all n locations
  Clone ID: PAT_TA_21597
cacacgcagttgcagcacatacagctagctagctcgttactgtttttgcagctgatctgatcgaccgacgcgacccaccgatcacgatcatgagctaccaagcgggctacccaccgccgggccaacaggcctacggcgcgcctccgccggcgtacgtcgcgccaccgccggcgtacccgccaacggcccaggacggcggcgcggcgtactacggccagcagcagacaaccaccaccagcaagcaagccgccggcggcgacgtttctgggaaaggtgctccgccgccatctggcggctgctgcgtcctccacatgtgcttcctgaaggatatactccattcattgtaacgacggcaaaggcatgctacctagctgatgaccggccgtactnccgtggttgtgatcacacantgctgcncaataactgcgtgtcattaatattacaatcgtgtataatatatacgntactactaccntaagtctcgaatcaatccggggtattgtntatcatatcancacacttgtccctaccggtcgtgtctgtatcaattgcaganatcnttacatcaagtngtnnataatacagcaaaaaaatcntccttaaaaaaaaaaaa

SEQ ID NO: 21598 - DNA, 229 bp, Triticum aestivum
  Clone ID: PAT_TA_21598
cggcggcggagatggacgaccgaggcggcggcggggaggccgagaggtggccgtggtgggctgcggcgagcgcggcacaggccgcggccgggatcgcgttgttccgacggggcaggagcggagctgcagtggcgatgccgttcaaggcattcggcatcgcctccctcttcgtcggctccggcgccaccgccgtcgccgctggggtgcttgccgctggcgtcgatcggtt

SEQ ID NO: 21599 - DNA, 663 bp, Triticum aestivum
  unsure (1)..(663): unsure at all n locations
  Clone ID: PAT_TA_21599
ctcgtgccgagctcctcctccgcacggccatgatcttgagttcttggcattgatgacgttctagtaccgagcgagccagcccctctttaacccaccttaacaataaacacagcctgcccccaccggccacctcttcttcccccgtgcagctcgagctgattcggcgggctctgccccaacatccacccaccttccgtccaatccccgatccaagaccgtgccgtgattccggcagcagctttccgcgcggccatgggcacnggcgcggtggcggtnggcggcgccggaccgggccaagcaagcgggcgggccggcggccacctgtgggaagaaggcactgctccacttctccctctgcttcgtcatgggcttcttcacgggcttcgcgccttctcctccntcctcctggaagtccgccgccgccacccccatcacnaccgccgnaccgtcccgggacggctcccgcctcccgcgggcgcgtcccgccgcgacccctgtcgccgcggagcgccgatcgttccgccgggcacgtgattggcacacaggaggagcgccaacgcctccgatgtggcacaaaagnctcggccgggaccncncgcnggcaatgtgnctncaaagcggncttggccgcgttcggtctnnaacccgcaanccgcacgtagg

SEQ ID NO: 21600 - DNA, 610 bp, Triticum aestivum
  unsure (1)..(610): unsure at all n locations
  Clone ID: PAT_TA_21600
cgtatcctcacgcccacaaaacacccgaagaaaagaagagactgaacgccgcgagttcacgccacgatggaaaacgccgcccccgccattgctaagccgtcgctgtccaagaagccctcgccgtccgttccgcctccggaacggcagctcaacgcactgcgccttgcgccgcgtgtttcgacctcttccgacccgcaacggcgacggcgagattnacctccgacgagaatggcttccgggcttcaggcgcctccggctccngcgcccaccgctcccggcttggaagccgccgttttgcgggtaatcccccggccggcgcccgccgggtccgccttcaacgatttcgatccctccaacgcgcgcttcgggacccttttggccatcccgtggtttnaccnagatgacacnacnaggggaattaangagcttccggtgttcataagacgnacgttatctnggcgcccactgnagctnctcaaaacccgctgcccaagtcngaacttgcantttcaggatnttgnaanttaccgaaggaaaggcggttaatcngantnaaaaatttnagggatactntgggcttantccgcacnggtntaancctaagntggtt

SEQ ID NO: 21601 - DNA, 677 bp, Triticum aestivum
  unsure (1)..(677): unsure at all n locations
  Clone ID: PAT_TA_21601
tanttggtacncaggtttcccgtnngaagttnaaacgacgccngtgagcggggtaatagactcntntaggngaattggtaccggcccccccttggatttttttttnnntttttttnttttaaaacaagtggntaattcatcaccgcagcaatgtagtgagtggactcagccaaaagttgagccagccaccggtgcacatacaacacacgcaatcaccatcatcatctcgtctacctaacccaccctctggtcttgttcccgccgcccggttgctgcttggcgccgccggctctggagctcggagccgccgccgccgccgccttggcagccgccctggacgacgccgtcgacctcaccagattcttcacctggggaggaggctccgtcgacttcctcttcagcctcgcctcgcgctcggctggcaggctcctcttcctcccaccgttgttagtgttctcttgctcgccgccgccgatggacgcgttcctcggcctcgcctttcctcttcctctcgttgcaagccggcttcaaggggcctcaaggagtgttctcaacgttnanccaagctgctttttcanggaatttgnaantncctaagganttggttcccatncgnggaaatacctncgagttaaaagnatcacanganaancggganccagaanggngtntttttg

SEQ ID NO: 21602 - DNA, 404 bp, Triticum aestivum
  Clone ID: PAT_TA_21602
cagctctgagctatagaaaaaacggcttgggggcgacggagagaggggtatttgcagtataagtacctttggatcgaagagcatcactcgaagatgcatcgaggactgttcttcttcttcctcaagctgtagcctgttgggaaggagaggccggagaggcctcccatggagttcccccactcatcacttcttgttgggtcccctgctagctgttccgttccctcagcaggtagctagagatgatcttgctttaattttgtgctgatctcttactcctcgtgtacgctcatatgcatggggcgacggatttgtctctgatcgttcccatgccgcctcttgtaccttgacttgggatctatatatcaaatgcaaataaacatcgatggggtgacaaaaaaaaaaaa

SEQ ID NO: 21603 - DNA, 399 bp, Triticum aestivum
  Clone ID: PAT_TA_21603
gtagacttggacatggccataaatctagcttcctgggattcgctatgacctcaaatgaatatactccaaggttgataaaaaaccttgatggtatcaagattaaaaggatagctgcgggaatgctgcactcagcttgcattgatgaaaaaggtacttggaagatcaaatgatgcacctagaccaagtgctgttgaagagatacaatttccagaagaagttgcttgtggaggttatcatacttgcccccgtaacagatcgtggagatttgtactcctgggggtcaaatgaaaatggctgccttggcctgggaggtccgggcgggcgccccctccctggtgttgtcagatgttctcccgttctgcgtcccggttctagggcaccctctcgttggaggcacac

SEQ ID NO: 21604 - DNA, 736 bp, Triticum aestivum
  unsure (1)..(736): unsure at all n locations
  Clone ID: PAT_TA_21604
tttatctccagacctataaacaataggtctcaattcgggaggaagaaccggtaataagcacaaaaccatccattctggttctacatttgtttgaataaaatgtttcgccaattgcatgcgtctaatcaaaaaaacttttcttattcgtctttttctatcttcccactcatctccactatacccctcgtcttctaattccttccattcgaccaaagaattctctataataattcgcaaatccaaatctgctaattgttctctaatagcacctgctcctgtcgcaatttcccgatttcgaaatgttgcaaagcctggggtagaaaaaaagggagaaatgctgtggttacaggatgcaatttcctcttcgaataaacctcgtaatcgtaaaaaagtgggttttttagtgctgggcctagcaaaagagaaatcgccgtatactaggccctccaacttcttaagaggtttatctaaaagattcgcgatataactaggaagacctttcaaataccacacatgagtcacgggacatgcgagtttgatgtatcccatttgatatcttccgtatccgagaatccacaaattctaccccgcatttttggcaaaatctttcgtcttcgttttcagctccgctcgctccaggggggccccgtaccgcttcgcccgctttgtaccggtcccccgctcantggctcgtttanaactctgacgggaaacctggcgttaccaacttaacgct

SEQ ID NO: 21605 - DNA, 622 bp, Triticum aestivum
  unsure (1)..(622): unsure at all n locations
  Clone ID: PAT_TA_21605
cagcatacgagtcaattcaggttccttgacaaggctgccattgtagcgccatcctccggcgagaaaggagcgacggcaagcccatggcggctctgcacggtctcccaggtcgaggagctgaagacggtgctgcggatgttccccgtgtgggtgtcgatggtgctcttcttccgcggccaccgcgcaagatgtcgtccaccttcatccgagcaaggcgagaccatgggacaaccgcgtgggggccgttcaccgtgcccgccggcgtccctctccaccttccgacgtcatcaagcgtcatgggtctgcatacccatctacgacaaagcgctggggcccgctggcccggcgcgccacggggcaangagcgggcctgtcgcaactgcagcggtggggcgtccgccccgtccccgtccctgggccggccgcnctccggggggggggcccgtaccattccccnaatatcctatacgccctcatggctctttaaactctnacgggaacctgcttaccaattacnctngaacaacccttccaactggctatacaanagcgacatgcctcaaattccacnaatgcaaggaccccttacggnataaccgggtttgtgtanccactacctaat

SEQ ID NO: 21606 - DNA, 629 bp, Triticum aestivum
  unsure (1)..(629): unsure at all n locations
  Clone ID: PAT_TA_21606
aaaatgttggcggctcgccggctgtccgccgccacctctccgctcctcctccgccgcctttccgcacagacccaccccacggcatcgtcggcgcagcccccgccggaggtgaccgattcgggtccgggagcgtgggccggccgcgcggtgacgctctcgctgctgggtctgacgggcgccgtcgcaagccagtgctgtcagcgacctctccgtcttcctctcatgctccagccaaggcaatagagaaggccccccagaaccangcagatagtcaatgctatcggtaaaccaatcatgcggggaccctggtacagtgcttccattgctgtgaaccacgcgaagcattctgtctccctgcacttccccgggtgtcaggaccccaagggaatggtctgctcaagctcaaagctgtgcgcttgggagatgaatcctgggatcctatgtgcagcccaccgagtgggagatacggataatggtgcccccccttgcctcttccggnagcgggctcacacacgaggtgcgggcaacaatccactgtcgccccgtccgctcacgctgatgcccnacgggaatgaacatgananagtcttcaatttctnaaatattatnaattcngaacggntncgaat

SEQ ID NO: 21607 - DNA, 607 bp, Triticum aestivum
  unsure (1)..(607): unsure at all n locations
  Clone ID: PAT_TA_21607
gcaagttggctgtccacgatatgggaggccgatgcaggcggtactgcatctcacgaattggagccccgtccactctcttggacagccgagtcatggtcctcgttgacgggcgtcgtcctagatctactgccgtcatcgacgatgtctggaccaccaccacctcaagcaccgtccgtcgccgtccgaggaacctcagccggagcatcagcgtcatcggagttaaggataaggtgaagtaccttgggagttagaaggagagatgactcatgttctcccgtggggatttgtttggtaattgctccgataatattacntgggacacttttccnaaaattttccccanaccgtagtttcccaananaaccatccacttttgtgantgtngtaaagaaccgacnaatnttgaaatgggattttgtnatngaaaanaagaagaaggattatttcaagttgggtactcntacnaaatcctaagaagtaactcggaacctaagnatcnnacatactataactcgnaataagttaagacangtgacactagagntgctaaacanagttggntatgnncatgangatantattaaagtgnccggcaaaagnantncca

SEQ ID NO: 21608 - DNA, 539 bp, Triticum aestivum
  Clone ID: PAT_TA_21608
ctccgcaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggtccaaaggtctgtttggcggacaggcaactatgccagtgcactgttcctcacagcaagctaaatctaatgcattggacaaattgaatctgagattaaagctattgtagaggcttccaagaagacccgttgttttctcaattcaataaaggactgtcagttccaaaaagcgacaaggtgaaggctatagccgaaatatttgctgacctggttttcaaatgttacaaagattcttggcttcctggcggaaatggaagctgaattatataccacccggccggtgtgattttccatt

SEQ ID NO: 21609 - DNA, 307 bp, Triticum aestivum
  Clone ID: PAT_TA_21609
taattctgctggctgcggcgatcccaaaataaaagaggccgggtgcgatgcatctcggacttctcgagtggtgtttgcgtcagacagccagccactgtggggctagtgttccaacatttgtcagcctgcttgcgcgaaggaaggggggtcactgactcaagagaagggcctggtcataggctgctgcattatgaatttctgatgatgtcttatgtctgtactctgaatcaactatgtatgagatctcatctcctttctcctactgaatgaatgaatcattattgggctttgctttaaaaaaaaaaaa

SEQ ID NO: 21610 - DNA, 415 bp, Triticum aestivum
  unsure (1)..(415): unsure at all n locations
  Clone ID: PAT_TA_21610
cggcggagggcactcctttctcttacctgacaaaccatcacgaaatatactaaaaccacgtttaatcttcagcgcagcgcagcaaggcgcaaggagacggtgcagggcagcatttctgggtttgtccgggttgtttcctctcttttttcctatgacgctatccataataactttgtgtaaccgctcaacgagacgaaagccatcattgggtgtgcctgatggcacccagtcctgcctgggtgtagatggagagatcatctacccggggggttgtttggtggttgctggcgtggtgatttgttgtgaaacgaagatagacactatagggantctcgttccttttggcattttataatgggaaaagaaaaaagcgtcgctatctttacacattctcaattccaaaaaaaaggggggg

SEQ ID NO: 21611 - DNA, 620 bp, Triticum aestivum
  unsure (1)..(620): unsure at all n locations
  Clone ID: PAT_TA_21611
gttaggatcgctctcgatgtcgctgacgcaatggccttcatgaacggctatggcatcgcgtaccgtgatctcaatgctcggaagatcctgctggacaggcaagggaatgcttgccttggggatatgggcattgttaccccttgtagtaatgttggtgaggtcaccgagtacgagacatctgggtaccgatggctggctccagagatcattgctggagatcctgaaaccgtctccgagacctgggatgagcaacgtctacagctacggaatggtgctctgggagatgatcaccgngagaaggaggcctactccacctactccccaatgcaagcagctgtccggatngctgcctgccggctgaaggccggagattcccaaaaactgtcctcccttccctgaggtcactaatgaacaagtgctgggacattcccctttgaacgcctcaattctccgagttacaccaacccacagaggcagaatgttaatantctttttcccccctcctcnctccttcccttcaaaccaaagcaaanacatttggctgggttcgccaacaacaggaaacgctccgaaaatttaaattatccaangctgttttaaatatgccaaatcctaccctn

SEQ ID NO: 21612 - DNA, 626 bp, Triticum aestivum
  unsure (1)..(626): unsure at all n locations
  Clone ID: PAT_TA_21612
ggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttgggtcaggaggaccaagagcaatttcaacgctgtcattctcaagaggcttttcatgagtaaaaccaaccgaccaccaatctccatgcgccgccttgtcatgtttatggaaaggaaaggagaagaacattgctgtcattgttgggcacagtcacagatgacaaagggtccaggaggttccagcaatgaagttactgccctgaggtccacggagaacagcaagggcaagattgtcaatgctggtggcgatgcctcacatttgaccagctgctcttcgggctccaacttggcgagaaacgtcctccttgaggggcccaagatccccgtggaattagnactttggaaaggtccngnatncccanagcanacaaacctnttncctcaanggaagaattcanaaggtctggaagagaanaccgtgatcaaggtaaacaaatttgncccctgttcatananatgcaacntt

SEQ ID NO: 21613 - DNA, 612 bp, Triticum aestivum
  unsure (1)..(612): unsure at all n locations
  Clone ID: PAT_TA_21613
ctcgtgccgaattcggcacgagatttgcctggatcagctggtgacgtcggaatttacgagctgcaggttttggccgagcagagctgctgtttgtttcactccatgcttgcgatggctgatgataccaacttcctccttttggttttactcttaagctgctcatcgttgtgttttggtactcaagctgatatcgagtgcctgaagtctgtacaacaatcagtgattgatcccggcggtgtactcaaatcttggaactttgaaaatgacaccgacggttacatatgccgctttaccggtgtggaatgctggcaccctgacgagaacaagattctctctctgcgactaagcaacctaagacttcaagggcaatttcctgttgctctacagaattgttcaagcctgaccggcttggacctgtcaaacaacaatttttcaggacaaatccctcaagaaatttcacgggggggtcccggctgctgtccccgcccggtcgnaaaaaaantttccggggcaaacccananaatatccaaatnggaaaatctgaacncccaactccagnataacaactcanggcaaatcaacccattcatttgctaccggtaacacttaaa

SEQ ID NO: 21614 - DNA, 538 bp, Triticum aestivum
  unsure (1)..(538): unsure at all n locations
  Clone ID: PAT_TA_21614
ctctcccactcgacgtctcgaccttccgcccgcctcctcgcttcaacagtgcgagagggcggcggcaccgcggccccccgcgccgcccccccccccccggccgccgcccccccggcggccgcgcccgcccgcggccccggcgcccggcacctgcggcccggccgcgacggccgcgacggccgagccggtgcagccccgccacggcgccccccccggggccgccggtccgcaccccgccgccgtccccccgccccgcgacccggcttccgcgctccctcgccgcgccccccccgtccgggtggtccggccgcctgcgcccgcccgtcgccgcccgagtgccgtccgcttccgctcttccgcggcccctctggctacccccccaccccctcccgggcgtcacccccggcccccgtgtccctgccctctctgtccctctnangntttgaattttnggaacaagtntaaagctgtcncttgtcgtgtcancggcgtaatcntcacgnttaanaattacttgttnaccgggaaaaaaaaaaaa

SEQ ID NO: 21615 - DNA, 403 bp, Triticum aestivum
  unsure (1)..(403): unsure at all n locations
  Clone ID: PAT_TA_21615
cgagctgcagcggatccggtccgccgccccggacggcgccgatcccgaggagcccgcggggtctaggctccggcctgtgagtatgatggacatccagatcgacgtgacgcttgggcgggcccggacaacggcggcaaaagaaggcggcttcgccccgtgtcggtgcaggaggtgtgggtcagccanccggggctccgccgtccaccaacggctccatcccgcgcntttgctgcgtanctttaagctaactactcctggtacactggatgagaaaaaccaatgttattttagcaaaaaaaaagaaattttttgtcctaagtaaattttcccccattaaaaaaccactggtccaagatgccatccattggttgtnaccgaaacggatttaccggtttacatttaa

SEQ ID NO: 21616 - DNA, 435 bp, Triticum aestivum
  Clone ID: PAT_TA_21616
catggctctcgcccttcgagcgccccgcttccagccgcttcccgcctccattcccgcgacctccaccgctttcgccagcaccgcgaggccttcctcctccgctgccgccaccaccgccatctgcgccgccgcgtcgcccttcaccgaggccacgtcctcctcgagataccgccgcgacgcctggtcctacactgcccaagactcctcctcttcctcgtccgccgccgccgcggcggcggcggcagcctcgggccgccgggacgacgagatcgccctgcagctcccggagctgcggaggcttctggaagctctcagggcgtcaagagggaaagggctggaaagggagggcggcggcggtgggccccgggagggtggcgcttgttgggacggggcccggggacccggagctcctcacgctgaaagccgttcgggcca

SEQ ID NO: 21617 - DNA, 200 bp, Triticum aestivum
  Clone ID: PAT_TA_21617
gccggttggagcagcaggaccaaattcccttgcgtggctcctgctctttgccttgtttgtttgtacgccaataaggacccaaatttccgtgcatgtgaagagaagaaagaatcgttccacagttttacactgaggggtttttttccgtacacagcatgatacaatataacccttgtttctggattcataaaaaaaaaaaa

SEQ ID NO: 21618 - DNA, 581 bp, Triticum aestivum
  Clone ID: PAT_TA_21618
cccacgcgtccgtcttcttccagctccggttccaaggccaactctcggggcagtgacagccgcacaaccgcccgttggtcaccacccaaactccactcgccaccggcgcccaccaccatggtggcgcacgcgctgctcaccgtgccgcacgcgaccgccggcccgcgactggccgcaccgcttttcaccccggcggcgacctcgccgagcctctgccgcgcgaactgccggtccggctccctcaccaaccagcagcaacggctgcgccaccttcaccctgccgctgcggccaccaagcccggagccatagggagcgccgcggaggctgctgcagcgccggcggaggggctcgtgaggtcgctgcagggggtggaggtgttcgacctgagcgggaaggcggtgcgcgtcgctgatctatggaaggacaggaaggctgtggttgcgttcgcccgccatttcgggtgtgtgctctgccggaagagggctgaccttctggcggctaagcaggaggcaatggaagctgcaggagtttctcttgttttaatcggaccaggtactgttgaacaggcaaaggcgttttc

SEQ ID NO: 21619 - DNA, 1159 bp, Triticum aestivum
  Clone ID: PAT_TA_21619
ttcgaccccccctcccctgcccgccccgcggcccaggcccacccgcgcggcagtgacagccgcacaaccgcccgttggtcaccacccaaactccactcgccaccggcgcccaccaccatggtggcgcacgcgctgctcaccgtgccccccgcggcccccgccccgcgtctccccgcccccctcctcgccgcgccgccgccccccccgcgccccgcccgccccccccgccggcccgccgcccccgccgccccgccgccaccccgccgccgccgccaccctgccccggcccccaccgagccccgcgccggcggctgcgccgccggcgctgcggctcggccggccgctgcgggcgcgggaggtctccgccctgagcgggaaggcgctgcccgtcgctgatctgtggaaggataggaaggccgtggttgcgttcgcccgccatttcgggtgtgtgctatgccgaaagagggccgaccttctggcggctaagcaggaggcaatggagccggcaggagtttcgcctgttttactcggaccaggtcctgttgaacaggcgaaggcggttcctgatcaaacgcaatgcaattgagaagtatatgccgatccagattactcatcatataaggctctggaatttgccaatggcttattctcaacattcactccatcggcgggtctgaagattatacatcggcgcggcggaggattctgccactgtacagggaaggatacaggcaggactgggaactgtcatttgaaaagaacaccaggacaaaaggcggatggtatcaaggggggctccttgttgcaggcccaggcatcgacaacatctcctacatccacaaggacaaagaagctggagatgaccctgaaatggaggatgttttgagagcttgttgttcctagatctttagtattgctttgatctcaaacttgaaataagaatagagctcctttagtatccccactgtcaaatgttctcgtgtatagtcgtactagtcgagtgcatagatgatgagtccagcaacacttgtccagcgccggtgaaaacaagatatgttcatatgaactagggagcatagcgcgtgcgatgctttggttgtatttgtataaaccctagtaaacctactgcattagttagtaaaaaaaggatgttcattgc

SEQ ID NO: 21620 - DNA, 596 bp, Triticum aestivum
  Clone ID: PAT_TA_21620
agagaggaagcttcttcctccacgctcatatatatcctactaccacagtgcagttcgtgccggacgagaaaggaggacggagggagaggcagttaggtcgctgaatctgaacggaacactctgaaacgcccacgccctgactgctcaaaatcctccatttaacccctacctcaaatttgagcaacttcggtgcaaattctccgagacatgggcgaaattcccgaaccagaggttcccaagcccacgccggagccgtcgtcgtggctcagcctgagagtcttctacctgcggctgagcaggtgcgaggtggacgaatccatgctggacaccctgaccatcacccacgccccgctcacctccgacaccgtcctggaggtgaacggcgacaggccaagaagcaccggcaacaacatggccacgtctcgtgccccctccgcagggaccgcgtggacgccgcgtcgcgcgaggcctccttcgtcagcacggcgaccgtgaggatggcgggagcgtggcttcaaggtcgcgtcggcagcggcgagaagctcctcgtggggatatggaatatgtgcgacgtggcggaggagaaaagaaggggt

SEQ ID NO: 21621 - DNA, 615 bp, Triticum aestivum
  unsure (1)..(615): unsure at all n locations
  Clone ID: PAT_TA_21621
caccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctgggagaacgtcatccgcgacgccgtcacctacactgagcacgctcgccgttaagaccgtcaccgccatggacgtcgtctacgcgcttaaacgccaaggccgtacctctacggcttccggcggtaagctgccgcccgcgcctcgccgtcgctgcgntctggtgttgctgcattcccaattgttggtgtggggaatttgctaatacngttnaacgcaatgccgtatctcacatgggttttctcagaaattttcatgctggntcncggatcaaacagcncaattggtcaanggcttcnttggaaacatcattccccttttgcnaatcatcantaaacagcngntagcctaccaaaaaaaaanggggccgtncaattccta

SEQ ID NO: 21622 - DNA, 289 bp, Triticum aestivum
  Clone ID: PAT_TA_21622
gcgccgtcttgtccttccgcgcattcaccgccgcatcgcctggcgccaccgcctcccacacggtgtgcacgtcgaggatggcctgcgccttgatcgcccagacggcgtagttgtccaccgtaagcatcggcatcgccatcgacgccgatccgcccgcgccaccgccatgtgggacgagcgccatggtcgccgatgatcgcccgaaccgaagctctatataccaattgttgttgccgccggtctcccccctgctcgtcgggagctctacctctctgtctcactcagtctc

SEQ ID NO: 21623 - DNA, 636 bp, Triticum aestivum
  unsure (1)..(636): unsure at all n locations
  Clone ID: PAT_TA_21623
ccctgccccctcgccccccgccaccgcctcagcgggagaagcagcagtgcccgccaccgcctctgctcccgccgaagaagcagcagtacccgccaccgcctctgctcccgccgaagaagcagctgtacccgccaccgcttcccctcccgccgaagaagcagcagcaccatcacccgccaccgcctctgcccacacttccgccgaagaagcggctggcgtcaccgcctctgctgcccgggaagcgagaagcagtgggtcatctcctccccgtcggagccgcggtccgtgccgctgccggtgtgggctctgatgtccggtcccggggaagcgcaaagaagcggtcaggctgccgcgggcgccgtccccgccctcacaacccaaccgccgcccgaggagacaaggcccccctgagaggccgagacgatagacacacaccctgctacggnacacccctgtccttgtnatccatctgatgacgntcgncattgatctatttaaaccttactctccgtcttctctctntctctctctcggatccatcaangatatgtgtnanatcgctggtgctggaccnnacaagtgatgaatgtcgtgaaactgataatatcagttataatannttttaaaaaaaaaaaa

SEQ ID NO: 21624 - DNA, 1334 bp, Triticum aestivum
  Clone ID: PAT_TA_21624
ccagggcgacgtttctggcgtcttcgcgcgcgtcctcttccccgctccgtctgccccggggccccgcctctccgctcctccgcgcgtccggcccccgccctgccgccgccgtcccagccccccgccccctgcgccctccccactcctgcggtcgtccctgccgtgccgacgccgagcggggctccccccccttccgccttgctggttaagcggtgcgccggaggaactggccccccgtcgccccgacatctgggggcttccgctgccgtctggcgggtttggccggcagtgcccctggagggagggcccgtactcgggagccggcttggtggctgaaatggatgatgccgatgctctcatgagccaatttgttgggatgtatagtgattttcatcgtgacccaagggttcgggatcatggaggcaatgtctaccgtgatgcgacatggaatggggggcatgaatcgagaggctgatgtaagaggaaggccaagcatattatctgagctggagacggaatttggttcagggccatggttgctcttccgtggccagctccccggtcatctctcagaggccaatagtggttttgacgttttcgtcaatggacgccgtggtgttggcatgcggagggcagatgttgcagattactttgttgggcctggattagaagatctgattgagcagttgactcataatgatcgtcgagggccaccacctgcctctcagtcatcgattgatgccatgcctagtgttaggatcactgccaggcatctcactggagactcgcattgccctgtctgcaaggacaagtttgaactgggatcggaagcaagagagatgccatgcaagcatttataccactctgattgcatacttccttggctagaacaacacaattcctgtcctgtttgccgatatgagctgcccacacagagctctagtggtgccagctgctcacgctcaagatcaaccaaccaaaatgacagttcaagcagctcaagtagcagtgggagaaccagcgggcgtcagaggagaaggaacccgttctcgttcctatggcctttccgctcatcaagttctagcactggttctcgttagattagtctggttacctggttggagttcacaatgctatttttagtgaagatgctgatcaaatgtgctttatgtgtgtcacgtcttacacccaatatgtaatgtatggcttgttatagtcgccccacaaaatggatttccttgcgagtatatagtcatctatcttgctaaatttcgtagcagctgattttgtttgcttttacacaagtcagtataaacttctttttttgagatttc

SEQ ID NO: 21625 - DNA, 653 bp, Triticum aestivum
  unsure (1)..(653): unsure at all n locations
  Clone ID: PAT_TA_21625
cacagcccgaaaccctcgccgccgatcggtttcggagaagagaagcaaatcaagatgtttctcggctcgctcccgcggcgcccgagcaaggaggctgcttacaagcagctgcggtcgcacatcatcatcatggcctcctgcgccgccgtcatccgcgccaccccttacatcctccatttcctcgcccgcgacggcgacatccaaggaactcaagctagatctgttaggccgtccgttgcttccccacctccaagaggtgctacaaaggcaaccgttattccgagccactgcaaggtactatggagttaagtggtaataagtgcctgcttaagttttttggtggttccaactttaaatggacaaactggacaatggtgttacaaactggcttgtgctgcgacaatattcctttttgcctaaccgtatggcccaaactctttgcccggggcggtttccccagccgtgatcttccaacttctcggtgccctcccaaggtccttcagcctggggggccgctgccactgccccatgtaggtctggtcgccctaacggcgtgcttanaantccnacgggaaaactgggtnccanntaacgcttganaancccnttcancnggtatacnaaggccaacgttnctccaaatnccacnaagg

SEQ ID NO: 21626 - DNA, 540 bp, Triticum aestivum
  unsure (1)..(540): unsure at all n locations
  Clone ID: PAT_TA_21626
gtcacattcaccgggaatggcaacgctcaaggtcccagccactgttcctcccgtcgccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgacgagctcctccgctccatcacggacgagatctcccggcgacttccacgagggccgtggatcctggtgggacgctgggacccaagcggagcgctgacgcggtgctggccaacgaggcggcgcggnaagtggtagccctggaaccgtgtgctcatccnagatngcctgcacgcgcacctccccccatnttcgggaccaagcaggtttatcaangagggtcaaacgtcnctttaggaaaatcnctgcgcacgcaacggggattccccaagtattggtgcactngnaatatnaccgtatgatggccaaaggcaacaanggtnganctcaagaacaaatatncatgagaagtc

SEQ ID NO: 21627 - DNA, 653 bp, Triticum aestivum
  unsure (1)..(653): unsure at all n locations
  Clone ID: PAT_TA_21627
ccataaagaacttggatttctctgctgactgcttcagcttgataacaataacaattcattgctcgtctcgagcgcagatggatcgcgagagcgcgatgcagggcagcagtggtggcaaccccggtgctgccacgcaggaggagtggctctaccctggcggctggcagccggagcaagctgtcgtggacggcgcgttcctcatggagctgctggaggacgcgccggtggcggaccagccgccagaggacgtcgaccggctaaagccgcgtcatccggtcccctggaggctgagatcgatngggagtgggcagccgccctcggcggtggcagacgcacgcacggcggagcaagtccctgggagaactccatataagcgcgctgggaggactaacgcctgctgccgtaccttggtaacatcccagcccctgcgtggccgaagcgccgtttggactctggacggagtcccgncgccgtngggcatggtangggcgttggacctngaacggcaccgctcatggtcggtacattcacagacatgctttacggtacaccagcccactcttagcaagnttnaccctgtggaataatttaattgaacaattacattgnataactatgatgcaatnntaacaacnancaattnattactaaat

SEQ ID NO: 21628 - DNA, 2691 bp, Triticum aestivum
  Clone ID: PAT_TA_21628
actcggaggtgtttggggaggagccacaatggcgatgaggtgcctctcttctctccctctcctctccgcatccggctccggaaaggcctgcgctgctgtcagagcgcatcacactccctctgctgccgcacaccgccggatccggactcacatgtcggtggccaccggcggtgagcaggccctgacggccaaggagcagtcccaggaacctgactatggagttgttagtatgcaccatgttggaatactatgtgaaaatcttgaaaggtcgatggcattctaccaggacctccttggtcttaaggtgaatcctgctaggccaaatgacaagcttccgtacagagggtgcttggctctgggttggttctgagatgatccacttgatggagctgccaaatccagattcactgacaggacgcccagagcatggtgggcgtgatcgtcatacctgtatagcaatcagagatgtcttgaagttgaaagaaatctttgacaaagctggaatcagctacacgctcagcaaatccgggcgaccagcgatctttgcacgagacccggatggaaacgcgttggaatttacacaagtgtaacaagtgagagtcaaatttccaactagaacacacctcacagaatggtgcttgtaagattactgtatccaagaccttgttgcaggtcttgctgtctagcaaacaagatctggctggggcaattctgcttgtgccttgtacataccagtcaagaaattgagatgtatctatcacatgatgataaactggcatttaaaatgttagccaatttggtctgtagtagtgattgagtattactgaatgacatgggtatggacaaatgaatattgtaaataccttcctacatctatgatacttacaatagatttaactgaaatcagatttgaatgcgctacgttttttagaaatcattgtcactgcattcttaatatctcttggaacaaaaataataataataatcctaatcccatccgaaagctctatgtcctgaattgggattcttcctatgctttcatggaagattagtagctcatcacattacagaagcccgcgttttgacatggtgaacagacccctagaggaatgtaacgctggggtggccgccatggaggaggtcgtgagcaatcctgtcccgctccttgtcggccgctgcggacagcactggattggcagcggcgaccacgtcggcgtcgtcctgctgggagagttcggactggatgtcggcgtcgagctcctcgccgctgcgttcgcagaagttgtgcagcacgcagcaggcgccgatcatgttgtggaggtccggcagcttgggctccgtgcggcgctgcaggcagcgccaccgccccttgagcctctcgacggcgccctgtgctgctgcgcgcgcggcggcgatgcgctcgttgaaggcgtgctgcgcccatgtcaggttctggtgcgcgtacggcacgagcatccagtccgtgagcgggtagctcgcgccgcccaccagccccaggccctctccgccgtccccggcctcgccggcgcggggccccccgcccacatccccggcggcccccccccccgccccggcgcgcggtccgacgccggcgggctcgcggggcggacccgccacgccccctgctcggccgccctgcccgccgccgggcacgcccggccggcgggcgccgccaggtcccccgccccccccgggccgctctcgccgcccgccgcgccgaacccggccccgccgcagccccgctgcaacccgcgcatcgtcgccgcccacccgtgcccccggggcgccgccgccagcctcccgcgcccggcccgcgggctgccgccccgcgcggtcccccgccgctccggcccccgcctcgcctcctgccagcgcatcgcccccccgcgcgccgccgccctcgccgccgtcctcctgcccaaggccgtccgctggccactggaatcccccgccgccaggttccaggccctgtccgggatccccggcgtcatcggcgcccgcggcacccaccccacccccagcgccccacccccggccgccgccgccgggtcccgcgacccccgccaccccgcgcccgacaagactgccccccacagcgccgccgtgcagtccgccctgcaccccgagcccgccctccccgacccgacccgccgcctgcccgcgacgcctcccccccccccccccctccccatcccccccctcccccgcccccgtgcgccgcccgcccccccccactccgccgccgccccccccccccccgccctcctaggccgcgcccccccgccccgccctcacccctccccccctcagccccccccccccggccccgcgccccccttccgcggccgctccccccccccgggcgcgccccccccccccgcagggcgccctccgcggacgcatcgaggcgcactgccgccccggcacccccccgccgtcccccgccgccgccggcccggacgccggcggcgccggctggccgggcccgcgccggccgcgcccagcgcgcggggccggggcgccgcccgccccccggccccgcgccgccagcggccgcgggcccggccccggcgggacacgaccccggcacgcgcctccctcggccccgacgaccccggccccgccgcccccgcggccgccccccactacgccgccgccatgtcgcgcgcc

SEQ ID NO: 21629 - DNA, 408 bp, Triticum aestivum
  unsure (1)..(408): unsure at all n locations
  Clone ID: PAT_TA_21629
tggatccgctttctcggcttcgccgtcgtcgatgaatggaggccatggtatgccaccggccaagttgctgggtttacaacgttgtacgctaacaacctcacttttgcgacaatcaaggcccaaggaatgcttggccatggtcgataggtggctctccggccgtcctctctaactccgacttctccgcgcgcatcacatgtgctttctctacgcacacaaggatttccgattccgggaatactattcctatccggctgtaacctccctactgttaagtttgtcaatgttatagcgtgacatggtacatataacatttgcatgttcatccatcgtccaaggnatacaagtgtgatgattccaacccgatgcatcaattgatgcatgcaacctttcaaaaaaaaaaaaaaa

SEQ ID NO: 21630 - DNA, 732 bp, Triticum aestivum
  unsure (1)..(732): unsure at all n locations
  Clone ID: PAT_TA_21630
ccacgtactacgcatcctctgttggagacaaccatgatgagatcgacttcgagttcctgggcaacgtgagcgggcaaccatacaccttccacaccaacatctacgccaatggcgtgggcaacaaggagattcagttcaagccctggttcgaccccaccaccggctaccacaattacaccatctcctggagcccctgcatgatcgtgtggtacgttgacagcgtccccatccgcgtgttccgcaactaccagcagagctacggcgtggcgtacccgacgagccgccccatgcacgcatactccagcatctgggcggcggaggactgggccacgcagggcggccgcgtcaagaccgactggtccaaggcgcccttccgtcgccaactaccgggaacatccacctcgacatctgcgactgccccggcggctacgcctgcagcaccaactgcgcggcggcggcggccccaacagtggggcgtgccactcagccccgagcagcgggggccatgcagacctgcagaaagctacccatctacgccatgcttcatccaanagtggttcaacgngtcaaccaaccnatggggctgccgcattacgacatccactatatacgatccctgtcttctggtctccgttacacaaagaaaangccgaatctcnccaagtttctcaatataaagttcctccttgttattattctaaaattatgaacnaantatncaaaaaaaaaaaa

SEQ ID NO: 21631 - DNA, 303 bp, Triticum aestivum
  Clone ID: PAT_TA_21631
ctcacaccgaactcgtgaagcacagtttccatcgtatgatgtcgaggaaagaggaaaaagaggggcaaagaagaagaaggtgctgtgagcgaagcactggtcgtcgcaccgccatcatcggcggtgtgagtgcatgcagcgaggaagcatgcttgccatgccgtccgcccgagagcttcggcgccgcgggctgggtggcgtgttgagcagggatgcttccggcggtgcacaagaaagaaggcaatcttatccggcaagggaaaggtaaccttcctcccagtctccctctctccatctaaacgg

SEQ ID NO: 21632 - DNA, 425 bp, Triticum aestivum
  unsure (1)..(425): unsure at all n locations
  Clone ID: PAT_TA_21632
ccgctgccgcggccgagccggcccctgcggcccccgagcccgccgcgccggccgcggaggtggccgagaaggccagcgagtgaggccgtgcgccgtgcgcgcactgcggcggcggacagcgggtcgggagatcgatggctcagcgcgcgcgcgcctacatggcacgggcttgctgttcagtacaacgcgaacgtgacggtttctctccatcntctgtgtgtgtgacagtgtgtccgtacctatagcagtggctgtcccctgtgacttgccccgtgccgacttgcgagtgacatgggctaaataaagtgcgcctccgcccggcgggtggtggtagtggggcgcggtgccccatgtgtgccgctgcagcttgtgtcctgttttgctcatgttctctgtcatctactctcatgtatggcaaaaaaaaa

SEQ ID NO: 21633 - DNA, 598 bp, Triticum aestivum
  unsure (1)..(598): unsure at all n locations
  Clone ID: PAT_TA_21633
gcgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaaggagcacgattcgccgcctgagggagcagactgaagcatgatatagctccttatattaatggggtttcctgtagttgctcctgtcaagcatgttgtgggggcctaaccaatggaaatgtggaacactgtactggtgttttcccatacaatgcccctaaattggttaatctcaaggtccaaagtgtgttaagattgccttggttacgttctaagccaatagtgatatccaccaaagctcctgnctcaattggtgngttttaaaanaananaatacantcgagggggccgt

SEQ ID NO: 21634 - DNA, 712 bp, Triticum aestivum
  unsure (1)..(712): unsure at all n locations
  Clone ID: PAT_TA_21634
gcacgcaacaagtacgcaggcagcgcagcctcgagccgtcgccatggcgagcaagcacctcgtcctcgccgcatgcctcctcctcctcctgcccaccgcctcggtcgccaccgacgtcgactactgcagtaagaaggactacccggtgaaggtgagcggggtgcagatcctgcccgatccggtcgaacccggcaagcccgccactttcaagatctccgcttctactgataaaaccatcgagaaggggaagctggtcatcgacgtaaagtatttcttcttctatgtgcactcggagacccgcgacatctgcggagagacttcctgcccagcgaccggcgacttcgtgctgtcccaccagcagacgctgccaggcttcactccgccgggctcctacacgatctacatgaagattgtcggggacgacaacgaggagctgagctgcatctcgttcgggttcaacatcggttcccgcgcctcctagctcttcgcgcccggccccgggcaccaactcgagcctgctcctggacgtttcgtccctggaccttcccgtgccctttgccttttgtggccggctgtcttcatctcagtcctttcatccggggttgaccttcacgctatgcaaaccactgatacaanttaagggancctaacgcttgatggggccgttttttataccacaataaccgttgtgtttgtgcctaaaaaaaaaaaa

SEQ ID NO: 21635 - DNA, 494 bp, Triticum aestivum
  unsure (1)..(494): unsure at all n locations
  Clone ID: PAT_TA_21635
cacacacacactcacggcttccacagcttgctctcgctgcactcgcaagcaatacatctcgtcgttccactaagaccgaggagcaaatggcggccaccctgaagctcaggatcctcatcgtggcggccgccgtcgccgcgtccctggtcggcacggcctcagcggccgagggaccggcgcccgctccgacgtccgccgccgcgtccatggccgcgccggccgttgccgctgcgtccttcaccgcgcttgtcttcggctacctcttctgaacgccgtgaacattcaggcgtagacaccgtgtttgaccgtcggaaattctgtgtgttgtgcccagccgaattgtttgcctgctcagatcctcctccttctctctctctcgctctcatgttttggggtgtataggtttgtaattactggtcaattttttaatgggtgacatggtcccgtaattagtcatgacattggtttaccttagagaacggannttggttctc

SEQ ID NO: 21636 - DNA, 737 bp, Triticum aestivum
  Clone ID: PAT_TA_21636
gagttttttttttttttttttggtaaatgactataagtcaacacgtagatggataaaaaatcacaggtttgtatcacaggctcacagcaccagcagggtaaccttccacccacaacgacaccacaatgaaaccataggtggagggccgactatcgtgttttttcaggaagattcacgagccatgatacttggtcctccataacatgtgtgcagagcaacaaacaacggttccgcatcgaagacaggcatgtcatcacagcatgcaccatgcgcaagatctgaatgtgccgcctcatcaccaagcgcgaaatgttcttatgtctgatgtgagcgagcttcatcttgttctcctctgattcacaccacgtcactaatgtagggcagccaataatttttagatatcaagctttgtcagttgttggatgctgtccggcaaagacccgatccccttgcagtggtagatcacaaacttcttgacagaggcaagttctcctaaccactgcgggtaagacggcttcttcaccagacacactgtcagctcttgtcggcacctccgctctgccacccggcccggcactcctgccgcgtggggcgccaccctccacgattggagggagaggtgtgggatactctcaggccaggcggtccgataacttcgaccggtgatagttatgcttcgaaatgcaagcaacctgcactgatgtaaattcaagggtgccttgctgtcttcaacagtc

SEQ ID NO: 21637 - DNA, 417 bp, Triticum aestivum
  Clone ID: PAT_TA_21637
gtcgtttgatgcggatgaggccgacgttaaggagagtggagcgtgacctgaggcatagtcatgagcgtctttggactatgagcctcaggtagacgtggtgttacgacgaggtgccttctgcgacacatcgggtgaccgactgtgaccccgtattccagttaactattgccggttacgtccctcaccattcctcgcttgtcaactggcaacgcaatctgttacggatagcagagttgactgggcaaaacttttgtacatacctacataccaccggatcacgtgggacaaatgtgctgggagggcgggttctcgtccaagtgttcgctgctaggtggctgtatctatcttccaaatgctactgatacctacccgtttgaagcaatcaaacaataatcatctactccgaaaaaaaaaaaa

SEQ ID NO: 21638 - DNA, 651 bp, Triticum aestivum
  unsure (1)..(651): unsure at all n locations
  Clone ID: PAT_TA_21638
ctgaaattacagatggttcagaccctaatatcagttgaggggattgaaatcaatgcggttaatagagctggagagactgcttttgctattgcagataaacaaggtaatgaagagctcgtcaacatcctgagagaggtcggtggaggaactgcaaaagagcaagtaaatcctcctaatccagcaaagcagcttaagcagacagtcagcgatatcaggcatgatgttcaatcacagatgaagcaaacacgccagaccaagatgcaattccaaaaaatcaagaagaggattcagaagctccacattgggtggggctaaacaatgccatcaactccaacactgttgttgcggtgcttattgccaccgttgcctttgctgccatattccaactccccggtaatttctggaggacatgactcaagcacctgacccagacatgaccttgggggcaagcattgatagccagtgatcaacctttataatctctgggttcgatgctttggtccccttacccgcttgcggcgtatagccagcactcaatggtgttgacaaaggcaggaaaaatgccttgngataactattggccggtcgcggctccggaccccagctctacactacctcgtccgggtcggcgcatgttgccggtcntgattg

SEQ ID NO: 21639 - DNA, 607 bp, Triticum aestivum
  unsure (1)..(607): unsure at all n locations
  Clone ID: PAT_TA_21639
ggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggcaatgggaccgccctggtgctcttcctctccccggtgcctacgttcatccgcatctggaagaaggggtcggtggagcagtactcgccgatcccgtacgtggcgacgctgctgaactgcatgatgtgggtgttgtacgggctgccgctggtgcacccgcacagcatgctggtgatcaccatcaacggcaccggcatgctcatccagctgactacgtggcgctcttcctcgtctatccgcgggggcggcgcgcccaaggttcctcctgctggccgccgagtcgccttcgtcggcgccctcgccgcgctggggctcgcctggcgcaatccacaacggaagccctgggctcggggcccgatctctnggacggattan

SEQ ID NO: 21640 - DNA, 667 bp, Triticum aestivum
  Clone ID: PAT_TA_21640
tcgagttttttttttttttttttggcaataaattaggtatataaaataaagcatctcaatgggggtcgcaatatagtacagcaaaacagaaaaaaaggaagagagaagagaaagaaagaatccgaggcgacggtggtacgtccgcaccgcacgtaccacccgccaccgaacgtgagtggcactgcactacaactacaccggccaagaatacagcgcggcgccgcgcaccggctgcatccgcgtcaccaattcctgtcgtcgtccgtcccggcgttgcggtgcggccgtgcaggcgccacccgctcgcgcgcgcgcccgtgcctaggcgagcagggccacgaggcccagcgcggccgccatgattacgcctgccacggtccttccagcacccgcggtgtcggcggccacgccatcgccgaccgggccgggtgcgtcggcttcgctggccgaaggtgccttagccttggagcgcttggtgctggtgggtgccccggcgacgggggctggagccggggccttggactccttcttctggcgcttggacggcgcgctcggtggcgccggcctgtcgcgcgccgcgggcgcggggacctcggcgggcttggtgggaggggaggcgggggcgggggcgggaggcgaggcggcgggcggcagctcggccaccggc

SEQ ID NO: 21641 - DNA, 1345 bp, Triticum aestivum
  Clone ID: PAT_TA_21641
gttctttcactcttgacaagtttcattaagcgtccccatcagagtcttgctggtataggcattgctgcatttgttcgcctgatgagcagtgctggctctgtcttcgtggatgaaaaatggctggaagtcgtgttgtctttgaaagaagctacgacagagacgcttcctgacttctcttatatcgcatctggagcttaccttgaaaatgtaccaatagaaaatggagactcttcagataagagagaagacgaatctcaaccatcagaggatggtactgaagaaacctctagatcaaggaacctgtattttgcaattgctgatgccaagtgccgagctgctgtccaactccttttgattcaggctgtgatggagatatataacatgtacagagctcagttgtcggcacagaacacagtaatcctctttgaggccttgcatactgttgccactcatgctcacaagataaacagtgacaacgacctgcggaccaagctgcaggagctgggctctatgacccaaatgcaggatccgccattactacgccttgagaatgagtcatatcagttgtgcctcactatcctccagaatatattcttggacagagctccagatgaagggagcttagaggtcgaaacccaccttgttggactttgcaaggaggttcttgaggtatacttgagcacagcaaggcctgctcacctttctggtggtatacagccgcttggtcattggcttattccggtcggttcgtcaaagcggagggagcttgcagccagggcaccgcttgttgtgtcaacattgcaagctatcagcggtctcggcgactcatcgttcgagaagaaccttggccagttcttccccctactagctggtctcatcagctgtgagcatggttcaggtgaagtgcaggtggccttgagtgatatgtttagcacttgggttggcccaatcgtgcttcagtcctgttgatgctgaagcaccctgtgatatagtatacctccacatgtaagttattctttgttccagacttccagtgtcatatctttctgttgctccgtttccccccattttgttgtgttcattattttagtcgttgtgggaagtggtgtcttgagccgaactgatcatgtagatcctttccccttttatgctattggttttctgcactgggagcgtgtatgtttacaagatgattaaattatatgccttagtatagttcaccaagttattgagcagttcgttctgctttggatgtttgtaactgccgctgtccgaagcacaggaagcttcagcattgtgttatacatttcgttaacttttgattggcatcagatggttctggttc

SEQ ID NO: 21642 - DNA, 534 bp, Triticum aestivum
  unsure (1)..(534): unsure at all n locations
  Clone ID: PAT_TA_21642
ccacgcccccgctcctctcgtctctttcttcgcctcttccatcgcaggattcggcggccatgggcggcggcaacggccagaagtccaagatggcgcgcgagaggaacgccgagaagaacaagggcggcaaaggcagccagctggaggccaacaagaaggccatgaacatccagtgcaagatctgcatgcagaccttcatctgcaccacctcccgaggccaagtgcaaagaacatgcggaggcgaggcatcccaagaacgacctctaccagtgcttcccccacctcaagaattagtaagcagcagaagcatatgatctgctcagctaaaagacaagtactacatatatatatatacgctgtgtgtcaattaatgggtttgtaagctgctgttgatgcggctgcttccttcgtgttgccccctctgattatgtactgtaacccttgggctgtcaacgtactgtgctaaaaaccactggtcctgtgtgggatcaaaaaaaactgccaaaanaaanaaaaaaaaacccnaaggggggg

SEQ ID NO: 21643 - DNA, 952 bp, Triticum aestivum
  Clone ID: PAT_TA_21643
tctcacatctctctctctctctctctctctctctcccccacctcctcctctcctctccttctcgccctgtctcaccctcgcgccccccattcaccacgctatgcttcagctagcttgctcttctctgctgcaagctgctgatcggttctttgatctttccgggagggaagcgccgggagttggctgttctgtcaggctggctcttgacatgttcagatcgaaggtccaggagatgatcctcaggaggaggtccacggtccatgaacggcgccgcgcagcacgccggcagctcgcccacggcttcgtgcgacggtggaggcggcaacgggtgctgctgctcgtgcgccgtcgttcgcggcgccgaggctgctgcaccccgccgtcgctcgcgccgccggccggcccgcgcccgccgctccggtcacacaggcatggcccgcctccgggatccccgcgagctatgttctggccgcgtccccggcagtcccgtcgtccgtcgcgggcgcgggcgcgggagggcgctcgcgcggcccctggtgcgacgggggcgcgggcccgcacgggctccccgacgtgctggactgcgcccacaaggcccagcggaggactaacgtcctccggggggccctgaggcggcgccggcgcccggctctggtgcggtcgtcctccctggaccggcgcgtggagttccgcgtcaagaacaagagctcctggctgccgctgcgcgccgcccgcgccggggcggcggcggacgaggacgacgggccggcgtccgaggactacacctgcgtcatctcccgccggcccaacccgaggacggtccacatcttcggcgaccgcgtggtagactcatcggcttgcaggtgattaccacggagaagaagatgcggccggaacgataagaagatcacgaagtagactcttgcttgcctgcaaatagtgccacgccaca

SEQ ID NO: 21644 - DNA, 393 bp, Triticum aestivum
  unsure (1)..(393): unsure at all n locations
  Clone ID: PAT_TA_21644
ccggggttcatgccgtccggcgcgccggcccgcgccgcgccgctcgcgctcgcggtcgcgctcgccgcgttggccttcttcttgtgatctctgcatgtgacaactggacggcgagcttcctcggtgtagtaagtagcgcgcgcgacggcccgagggaggagtcgacacatcgtgccgccggcgttccacgggttcattcatttcccagtgtacttatgcatatgctccttctgtgacaataattttcacgtactggccatctatgggctacacggtagttcttccttgtaatgtatgaaagttttcttttgttgctttggtctttaatttcttaaatctgatggtttanaacaatccttgtaanaaatgggaacgcagattcaagaagaaaaa

SEQ ID NO: 21645 - DNA, 716 bp, Triticum aestivum
  unsure (1)..(716): unsure at all n locations
  Clone ID: PAT_TA_21645
ttttttttttttnttttcaccactgtggggtgggccgccttcttcctccttatgtggcgcccccccggttttggggnccaaaccccggcgcgaacttatcccccaggtgtgctgggccaagtctcacactttttttttttcttggcacaggatcgaatgtcacatctttatatataacaggagttctatacaaaataaataagtaattacattataaggagacaacggtccagcaacccaaagttgactgggagacgacgacctagacctctcacgaactcgtcacagcatcctccaagcgcctcatcctgcggtacctgttcttgacctgggcacttgagattccaggtaccaacttgcttttcagatgactcgtgtcctcgctctttctttcgtgaccgctggccggtggcctctcgccgctctgcggtgcgcgcgccgcgggtgccacaccgttttgtttccctctgagccttggccctctctctctcccggcgtacttcgtgacgaccccaccaacccaagccgacctgccccgagtgcatgggtcgcccagatcctccgtttgcccccgtgcccttcgccgcagaccgtcgtccgttcgtcccctccctcccctcgcgctccgcgctccccccccccggcgcggccacaagcncctaactccgggcttaatctcattctcagatcagctggctgtaacnccttttgattac

SEQ ID NO: 21646 - DNA, 651 bp, Triticum aestivum
  unsure (1)..(651): unsure at all n locations
  Clone ID: PAT_TA_21646
tctgaccgtaccacctctgttacctgcaccgccgctccgttaaatcgcggcccgatcgccgatgcctccccgccccgtcccactattctctcgcctgcgcttccgcctcccgagttgcgccgccgtctccatctccacccctccatcctccgcggcgcccctgcactacggccatcgcactcccctcgctagcccttttcctctgtccccaccttgcccgcgcatcctccgtgcggccgtcgcggtttcttcgctggatctgcgcccgatcaccggcgggttcgcgctattcagcatggctgctgcctcctccgccacctccgtccacgacttcaccgtcaaggatgctagcgggaaaatgtggaccttagcacctataaggggaaggttctgctcatatcaatgttgcatctcagtgtggcttaaccaattccaactacacagagctgagccagttgtatgagaagtacaaggacaaggtttgagatccgtgcattccaaccaacatgttcgtgggcaggagcctggcactattgaggaactgtcagtttccgagtcctcctgctgggggagtaccaaattcgaccaggcgcatgncctgnaaaaaangatcaattgtaaaaggatttgcgntaaaatcanaanaagata

SEQ ID NO: 21647 - DNA, 579 bp, Triticum aestivum
  unsure (1)..(579): unsure at all n locations
  Clone ID: PAT_TA_21647
ccgccacncgccgcctctagccccgcggccccgccccgtgccctggccccaccgccgctcaggcccagcccgcatggaccccaccgaccagtcgccggaggaggtgtactccgtgtgggccctcccgccggagcccgtccgtgaccgcctccgccgcctcatggccggcctccgcgccgcgcacggcggcccccccttcgagccgcacgccaccgtcgtcggcgccgtccgcgggcgccgccccgccgctgtccaggccctccgcgccgccccgccggccgccgaccccgcccccctcgccgcccgcggctcccccgtcgcccgcggcgactgcgcctcccagcccgtgtccctccgcctcgtgcccgcccccggcgtgaccctccccagcgtcctctcctgcgctcaccctggcttccgcagtccgcccccttggaggccacatgtcagccgcctggatggggatcgaacagacctgcagggggcagctgcaaggttgaaggcggcggggccggacagtgtcctatctggactgctgttggagtgcgcggagctcgcacnnnatcgaacggatactgn

SEQ ID NO: 21648 - DNA, 585 bp, Triticum aestivum
  unsure (1)..(585): unsure at all n locations
  Clone ID: PAT_TA_21648
cacacattcatttagtcatctaccaagatcataagcatgccagcccaaccatttgcccttctggaacctcgctgggcaaatcctggagaaggttggttccgtgccgcttacaaatgggatagagacaagatctataaatggatgagggagaccgcagacgcagttcgagtccaacccggaaatcaagaactgggtactctcccttgcggatattcacaatcgcgtgacccttccttcgctcgagaatggcagtctgtacaaggacgtaacaaagcaaccatcatcgcatattgcacgactggatgggatagtagctgggaaccaaggatgttgcaacatcatgtaggtcattgtcagtggttggtacttcaagcatactccacagcctgcattgggccctatgccgcaatggtggtgcccttacgatctacttgggctttccttaacctcctggggacaacgccgggcactgctgacaaaaacaactctactcctctcanagctgtctatggacgtggggccccctaccccgggaacagtacaggtggaaatggcgcaagtatcaaggcaaggtgattgctgttc

SEQ ID NO: 21649 - DNA, 673 bp, Triticum aestivum
  unsure (1)..(673): unsure at all n locations
  Clone ID: PAT_TA_21649
gccacctagaaaaaaattctcgccatcacgagcagtcgagcaccaccctctgaccggtgaccgctgtgaagtcagtcagcttcagcaccacgagcacgatggccctcgcgctcgccacgaccccactcgcgcatctcgcccttgccccgccctcgatcttcggctcccagtcctcgctgctgctgctcccgcgccgcgcgtcgcccgcccccgtctccctctcccaccgccgcatcatcgcggccgtcgcgaccaaggaacccgagctcggcggcggcggattcgggggccggcgacggtgccggagggagcggcggcggcagcaccgaagggggaaggaagggcangaaggagcacggggggaanaaaaaaatngggcnagggcctgtcatttcccaaaaactnacctcgcctaagccgngctcttcgaactggtggtgtatgggatatatgaagagtggaancaaaaaccttggctgcagagnatataaccctgtcttantctcaaatcaatccaatganactgtctccataacatngttangtaatcgcgccncgtaatanggtcccntcanaatcggaagatcctcggncttcctttnccggtangcgnggantccngattgtnccacctatnacgggctttttctaaatggnccctaagtccgttatn

SEQ ID NO: 21650 - DNA, 683 bp, Triticum aestivum
  unsure (1)..(683): unsure at all n locations
  Clone ID: PAT_TA_21650
tcatttactacttcccatccaatcaccccacaaacccacaaagcccttctttagaatcttctgtcttcgacaaccccaatacttcaagatgcagtacatgaccatcgtcgctttcctcgccgccaccgtggccgccggtccccagatcagggcttacccttccattgatcagatcaccgtcgcccaggccaacaatgcttgcggaaacaacatgcaggtcacctgctgcaacaaggtcaccaacactcctgccggcaacgctgttggcaacggtgctggtatcctcaacaacctgagcctgtttgatcagtgctccaagcttgatgttaatgttctggctattgctaatggcctccttaacaaggaatgccaggcaaacgccgcctgctgtcagaacagcggcggaagcgccaccggtggtcttgtcaacgtcgcccttccttgcattgctctcaacagccttatctgagcgcttctgacatcacgcatgggccaggtttggagacttcggancttanattgggtaatcaagcanttggcggtcaatcttactcggtttggnaactcattcattccgattggtttgtatgttgnggnattggggtaaaattcgtgaggatnaccagaagctaagtcgcagttataacacgaagganatttatngccacaanatccgataaaaa

SEQ ID NO: 21651 - DNA, 573 bp, Triticum aestivum
  unsure (1)..(573): unsure at all n locations
  Clone ID: PAT_TA_21651
gtcttgctactaaggttgagaagtcccgcaagcaaatgaaagancggaagaacagggccaagaagatccgtggtgtcaagaagaccaaggctggtgacgccaagaagaagtaaacagtcatttatatttctgtattactgtcctgaactctgggtggtcgtctagttgcaatgtcataattatggtcgtgttaggttttgttccgcactcagcagtaagtgaagttttgtaattccctggatgtgaacctacccggattggctgtagcatgttgtgagatgagaaggctattttgtcatgcaattgtgtcatttgcaagccaatccattttgtcatgcactcgtgccgaattcngcacaagcaacatcccattaagtgtcanancggaggtnttcnanttccntttgaaaggtttggccctgttcgggatgttacattccaaaggacaatacnccggggagccccaaggttgccttgtanaattgttgatctacaagnctcnaaaccatttcacanaancccaatttcttggncggaanactttgtctgcgctatcacaaaaagcnaaaaaat

SEQ ID NO: 21652 - DNA, 678 bp, Triticum aestivum
  unsure (1)..(678): unsure at all n locations
  Clone ID: PAT_TA_21652
gccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatgggtctctcctttgggaagctgttcaagccgcctcttcgccaagaaggagatgaggattctcatggtcgggctcgatgccgccggtaagaccaccatcctctacaagctcaagctcggcgagatcgtcaccaccatccccactatcggattcaatgttgaaactgttgagtataagaacattagcttcactgtttgggatgttggtggccaagacaagattaggcccctgtgggaggcactactttcagaacacacagggacttatttttgttgttgacagcaacgacagggaacttttgtttaaggctaaagatgactccacaggatgctgaatgaggataactgctgaccttgctgcttgtattgcaaacaaacaatttccaagcatnaagcnccgaatncganaanctggcnggatcctgaaaaggangtaacaaaaactnncaaacngggaagttttagggtnangggtnacaaatcccaatttagttngaggncnacaagntttaaaattgggnttttaattnaaaa

SEQ ID NO: 21653 - DNA, 263 bp, Triticum aestivum
  Clone ID: PAT_TA_21653
gactttcattctctttctatcttctgccgtggtcgggctttgagtcttactcaacttcacaccttgtaacaaagtcaagaaactttttctttgactgttccattttgaactacttcaaaatcttgtcaaggtatgtactcattgaaaaaacttatcaagcgtcttgatctatctctatagatcttgatactcaatatgtaagcagcttcaccaaggtctttctttgaaaaactcctttcaaaaactcgagggggggcccggta

SEQ ID NO: 21654 - DNA, 1594 bp, Triticum aestivum
  Clone ID: PAT_TA_21654
ctcgtccccgatcgcatcgcatcgaaccgaatcgccttgaggctcccaccagaatagctccgcgacaacgagcttcctcccgcgagcgaaaagatcgcacagaaggaggtgcggaagtgagggtgtgtgcgcgcgcgagggagatgggatcggagggacggagctggaacggggtcaccggcgggtccagaggtgacggtctggaggtgacgtagacggtgccgtcgcaggcgtcggcgctcgcggaggtgccctcgtcgaccaggacggtagacatctcgcccttctaattcgagatgactccccgcatcatagatctctgcaaggagttggtgcactcgtggtggtccttggacagctcgtgcttctcaatctcgacggtgtcgggcggcatcaccaacatgttgctgaaggtatctgtcaaggaaggctctgacagtgagtcctcgctcccggtgcggctgcacgccccgacttccgaccgggtgatcggtcgcgggagggaattgcaggccataccatatctctcagctgcaaggttcggggctcggttacttggagtatttgagaatggagtggtttcgtcattcatccatgctagggcactatctccttcagacatgaaggagcctagaattgccgctgaaattgccaagcagctacagaaatttcatcaagtagatataccgggatcaaaagaaccacagttgtggaatgacgtattcaagtttttgaaaaaagcttctgtattgaagtttgaagataatgagaagcagaagaggtatgagatgatctcttttagagaaatacaagatgaagttaaagaacttaaggatctctccgatcttttgcatgctcctgttgtgtttgcacacaatgacttgctatcgggtaatctgatgctgaatgatttggaagagaagctatatttcattgattttgagtatgggtcatatagctaccgtggctttgacatcgcgaatcatttcaatgagtacgcaggctttgagtgtgactacaacttgtacccagataaagatgtacaataccatttcttcaggaattatctatctgatagaccaagtgaggtccaagagcaggatctggatgccctttatactgaaacgaacactttcaggttagcatcacacctctactgggcattgtgggcactcattcaggcaagggtatccccaatcgatttcgattaccttggatacttcttcctacggtacggcgaatacaagaaacagcgagagttctgtttctccttggcgcaaggcttcctttcttcactgaggagtggctagtgctcagaagttgtgtccccgagccacttcttagccgcccgcttatactttggggcaggcacggatgatcggctttgtactgtgttaagtagggagtctcgtcgtatgattatgtcagttgtgagattcttcctttttcgttttattttcctgcaggaggcatgtagtttccaatagaaagttgtacaatctgtgaataatgtacacgtgttggttgctacaaacacaagcctaatgaattctgttttgtgtaaaaaaaaaaaaaaaaaaaaaaaaaaaactcg

SEQ ID NO: 21655 - DNA, 672 bp, Triticum aestivum
  unsure (1)..(672): unsure at all n locations
  Clone ID: PAT_TA_21655
cccagaggaagagaagaatcttggcccacatgatcgattgattcatgtttaccatttcatgaaagaccctaaccagaatcaacaaattcaaaattttggagatccttttttgatggttattcgggaaggtgagactgctgcagaggtaatggagcgcatccagagaaaacttagagttcctgatgatgagttctccaagtggaagcttgcattcatatccatgaaccggccagagtacctccaggacactgacgttgtatcagcacgttttcagcggagagatgtatatggtgcttggggaacaataccttggcttgggagcacactgatacaacatccgaaacggtcttacacatccaatcaagaatccggcacacctattagaaccccgtaaaaattttataatttgagaaaccttcatcaaagttcatcccattgtcaaaggcgtccggcagcagcatgcccaaggtgatacgacgcttccaaacagaaaaatccgggtatgtaattgcccgtgctaagcctgcaaggggcaagcccacaagcccccatgctcccccacttcattgttccaancaaccaacangtttnggtttcctccgcctgtcnagtatacggccctganaggtagtgtttgcttanttgttaancaagctncacatanaaaaattt

SEQ ID NO: 21656 - DNA, 619 bp, Triticum aestivum
  unsure (1)..(619): unsure at all n locations
  Clone ID: PAT_TA_21656
agaaaacataagttttttatatacattgaactcctccgttttaaaaaattgaacttcttggttttaatttttagtattgaggaaaatctgagtttctataaacatcaaacttcttcattttttgtaattaggacttattggtggtattcattaagtaatgggaaaagagctagttatgtaataaatatcgaattgcttaattatttaaattttaacttccaagtatttttttaagagagaaaactattttttacaaacattaaacttctccattatttaaatttggaacctcctagttttaagtaggaacaaggaatccattctccataatttttggagatcctatagtttttaaaaaattgggctccctgggtatccctttagtaacaaggaaaccctaatttaataatagatatcnaaccgctcatggttaaatttggaaattttaagtattttttggactccnagggnatgcaanaaatgggaancaatttaaattatactgnacacccataaagtattgaactctgggttanattaaaggaagaatcatttaaacccaacattgtatttactgacccctggccttattgactcatttaaaagggaaaccattact

SEQ ID NO: 21657 - DNA, 641 bp, Triticum aestivum
  unsure (1)..(641): unsure at all n locations
  Clone ID: PAT_TA_21657
cgcacatccaatattccgcatgctaccaccatctggcaaggaaaagaacttcatgtactgccacctacatcctcagataagagcttatgaagcgaatccaaagcccgttggcttagcatttgggtggaacaattggaaatgagaggatctttcttgatgaaagacttctcgggagttttaagtacgacaccatgctgttgataaaacttatcaacatggctctctcatccccaatcagggttatttgcctgtttgaggcttcaagtgcttgatgttgaagtatggggtggctgggtggagagcaacgaaacgacagcagatattccaangaagagggaagacatcttctcaagagcaacgaagaaggttgatccccaaacttttggctagctgggaagaccccccagagaagatgatgatggcatgatgtcggaccaaacacgttcgacgggaanaccgtgatttggtttcaaccccggggattcnagacacacgtttgtgcacatangatatttgcttcgcattggcgggtcaaccttattagggtgatncnaaaganatntcagactatcccataanaatgaatcgggaggcaagggcaactgcnantnttaggacctttnnggaggcantaattggtt

SEQ ID NO: 21658 - DNA, 766 bp, Triticum aestivum
  unsure (1)..(766): unsure at all n locations
  Clone ID: PAT_TA_21658
atcaggtcctacatggagccatgaatggcaaaggtggtagagttgagtcaacaactaatggtgccttcaatactttgagtgggtttgaagcagcagacagacgaaatagttggcaatattttaaactgctcctctcccgataaggagtcacttttggatgatcttgagggcgaaaatcctaatcaaagtgattcaaatcatgtcacactagcaataagtattgaggacacaggtgtcgggataccactgcaagcacaagatcgtgtttttacaccgtttaagcaagctgacattcaacttccaaggaattatggcggtactggcatccggtttaagcatcaccaagttctaccgaacttaggggggggggcaattatttccactaccacccttcctgtttggagcacgttcacttctcaagcacactggaacacccatacaaagaatttccggccattccaagtnggactttccagagcactaccaacgcctttttaagggaagaaagcaccggtggtggtngcgtcctgtgcggtacgccgtctcccagaccccgccactgctcggttggtcctccaatctgggacagatttcccctattgacttccccttggcaaacgcgccccgttctangctcggcgcgtccttttatgaaancttccgggggctaaanaantcattntgacactancacnaaaacncctttcgnngccaggatcttggccccgancgcaggaattggtcaatngatgganttaccaggacc

SEQ ID NO: 21659 - DNA, 744 bp, Triticum aestivum
  unsure (1)..(744): unsure at all n locations
  Clone ID: PAT_TA_21659
gcaggccgattttggcatctgacggagccccctctctctccccccccctccctcttacggtacttttatcttcttcctcctccgccccgccgtggctctggatctggtgacctagctagatagctacccatggcgagcggccatgcctcgctccactgaagcctccttgcttcgagctactccacgcctcagtaattcaacttctctgccgtgttccccttgcgtggatcgatctacttccggccgggcgcgcagcgcaggacgcgagggcttggtcttggtcttgccgctgctgcttcctctgggctccagatctcccgctcgttgatggccggccggatctcctcgtagccggctggccgtatacaccgtatctgatccttcctctttgtccatgtgttgaaaccaaacacggttcgatctgagcggatgatcaacttctccctatgccaggttctaggccagctaccaagcatcatctgctcgggatattttgcttactctgacatcccgtaactctgttgaattactctcctatatatcgtcatgtatagatggttctgggtcagccaccaagtttcctctgttctgcatattttgtttcgtctgacatccaacaagtctggaagcgatctctttatagcgtcacatataactggcacgcttcttttgaagtctcgtgcatttacttggagctcattgacaccggnntttaaactgaaaaacatgatactatgcaatttg

SEQ ID NO: 21660 - DNA, 1314 bp, Triticum aestivum
  Clone ID: PAT_TA_21660
ctaacgatcagatcacttggcgctcccgctgttctcctgtctctggcaatgcagggtgttttccgaggcttcaaagacacaaagacaccgttgtatgctaccgtggttggagatgcaacaaatatcatcctagacccaattttgatgtttgtttgccacatgggtgtcactggtgccgcagttgctcatgtcatttcccaagtacctgataaccatgatcttgatatgtcggctcgtccagcaagttgatgttatcccaccgagccttaaatccctgaaatttgggcggttccttgggtgtggattcctgctgctcgcgagggtggtagcggtgacattctgcgtcactctggcgtcgtcgctggcagcccgcgacgggccaaccatcatggcggccttccagatctgctgccagctctggctcgcgacgtcgcttctcgccgatggattggccgttgctggacaggcagtgctcgcaagcgcgttcgccaagaacgataccaagaaggtgattgccgcgacctctcgtgttctgcagctgagcattgttctggggatgggtctcacagtggtgctcggtctcttcatgaagttcggcgccggcgttttcacaaaggacgccgctgtgatcgacgtcatccacaaaggcatcccgtttgtcgccggcacgcagacgataaacgccctggcgttcgtgttcgacggcatcaacttcggagcacaagactacacctactctgcatactccatggttggggtggcgtccatatccataccatgcctggtgtacctttctgcgcacaagggattcatcggcatatgggtcgcattgaccatctacatgagcctcaggaccgtagccagcacctggaggatgggggcagcgagcgggccatgggctttcctccggaagtgatggatcggctcgcaagattgatggcggtttgtctacagtgcatagctggtagatagccatatgcatacgctcgttccatgtaattagaataagtgtagtattgtgttgctgttctaagcttggggtattggagttagatgatgggccttattgctttgcttcgcggccgtctgccttttgttgggggagagagaggctactctgatcttgtgattcatgtccttgttctgtgccggagatggcgatttatatttaattggaccagtgctctgtaaaaatcatactacattgatacgttggtctatccctagttatgtcattttccctctcttaatccttgtatatcgaatgtacccgagaccattcttcttgcaaaaaaaaaaaaaaaaaaaaaaaaa

SEQ ID NO: 21661 - DNA, 569 bp, Triticum aestivum
  unsure (1)..(569): unsure at all n locations
  Clone ID: PAT_TA_21661
caaaaacccgccactctcagatccgcacagcgacgccgccagccagacccgatcccctccctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgtcgctctacaccgtcgacggcggcgagcgcgccgtcatcttcgaccgtttccgcggggtgctcccggagaccgtcggcgagggcacccatttcctcgtgccctgggctgcagaagccttcatcttcgacatccgcacgcgccccgcacaactnctcctccaaactcgggggaccaaggacctgcagatgggtcaactcacgctccgtctcctctcccgccccgactncaanactccccacatcttaactccctcggatccagtacgacacaaatgtcccccctcggcaacaagtgccaaggcgtctcgccattaatgccgacaactctcacgacgcccangttcgcctctcgcaagttatcgc

SEQ ID NO: 21662 - DNA, 510 bp, Triticum aestivum
  unsure (1)..(510): unsure at all n locations
  Clone ID: PAT_TA_21662
tggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgattccgttacggtcgacctccgccccagtccgccgtacggttggggccggggacgcctacggccacagcggccaaggctacgcgccccccgcccgcctacggccccggggccgggtacggcaacgtcgtccacgtcgcccaacgaggtccgcgacgagaggccttactacgggcggcggcggcggcggtcttggtggcgcctaccgaggcggtggccccgagtacggccacgaagggccgaccgcaccacggcggcggcggtccctttgccgccacgcccccccccgcgcgcgcggcccccccggcgccccgcctgtgaggaacaaactncangattactcaangctggggaagacaatncaaccc

SEQ ID NO: 21663 - DNA, 526 bp, Triticum aestivum
  Clone ID: PAT_TA_21663
ggcacgtctagcggtatatcagtttggagtcttctctcaaatgagtgcatctttaatttggactgtcatgctcctgttcaagatttattgtttgacaagaatcatattttagcagttgggcgctgaacctctgctctcccgtctcacaataaacgggacagtcctttccacaagtaaaatgttgcccctcagtccggcgtttcctgtctccatccactccaactggggatagcagctgttgcctgggtacggaggcctgggtggatgttgattctccagaagttgggagccacctgtgcacattccggtacccggggccctagacaagtaaatgacccatgagcatccctttgcgaacagcgccccggagaatgccagggctgtacctctttgcactgcagttgcacaagtttcatgggacgttgcccctgacaatgctcctactgaacaaagataccttgacggtaaaaaaaaacatttgatactagttcgagccaaacaaagtctgctccggaaaaaaaaaaaa

SEQ ID NO: 21664 - DNA, 1024 bp, Triticum aestivum
  Clone ID: PAT_TA_21664
gggaaaagatccaattttccgagcgacgacagagagggtcaaagataaacacgagcagccggaggatagcctgcctgcgcggctgcgacgacttatttcccggcgatgtcggcggcgcaggctgcgagcgccatcttgcggccgtccgcgagtgcgccgctcagggaagtggcgttcttcttcaccgataaccacaacccctccccggctcgcctctgcatccgacgacgcagtgcggagagaacctttgcagggcttcaaattgcagcctccaactttaacagatccagaatttgccatgttaaaagtggggaggctgatggctatccaaaaactgaagaagataagttagctgacgaagaaacccttcagcgtaatttggacagagctatccgggaagaagattatgcccgtgctgccaaaatcagggacgatctgcgcgtcctccatgaggatactgaagcttccgtccttgcagcaaatacacgattctacaacgctttcaagaatggagattttactgcaatgtactctatctgggctaaaggagaccacgtgtatgttgtccatcccggtgcaggtcggatatccggttacgatgtggtcttgcaaagctgggagatggtgtgcaacgcggactatgagttccctctaaacattgatcttaagaacatagaggttcatgtgcgtggtgaccttggttatgttacatgcttggagttggtcaagaccaaaggaaaatcttgggggaagcaaattgccaccaacgtcttcgagaagatagatggcacatggtatatctgcattcaccatgcttcacacattgaagaatgaaatgacactttctggtggtttatgttgtatattccatagccgttggcgatgttatgccatgtgtccatttggggttatatatgactggaatttactattgctcatggacttgacacctcaaggaggtgaagtcatattccatatccaagctacttaaacataaacctgatgggcattgatcccggctgtg

SEQ ID NO: 21665 - DNA, 615 bp, Triticum aestivum
  unsure (1)..(615): unsure at all n locations
  Clone ID: PAT_TA_21665
tcaatctctcctcatggctcgctccaagctctccgtagaattgttgctggcattgctcgtggtcctcgccgccggcccggcgatgcgactggtcgaggcggcttcggcgcacctgcacttttacatgcacgacgtgacgggcggcccgtccccaacggcggtgcaagtggttagcgggccgcggggcaacttccggcaacaccatggtgatcgacgacaagctaaccgaggggacgtcaagatcctccacgacggtgggacgcgcgcagggttactacatggtggcgtccgtggcgaacctccgactcctccgtcaacatgaatgtccttcttacttccgggccatacgccgggcagctccctcaacggtggtgggccctgacgacgtcagcgtcccggtgagggactctcaatggtccggcggcacgggcattcaaggatggcccccggtatttctgtggaaaacctcccccccccgtctccactgaatttctggcaacctccttgacctacaagcatatggatgacccgcatcatgtaaaaatgattggtgactgcaatggtgtacctttcttcatcggccggggaatactgacttagaattgtagannagta

SEQ ID NO: 21666 - DNA, 452 bp, Triticum aestivum
  Clone ID: PAT_TA_21666
ccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctccgccttcaaagaagccccgcctcctcatgaccgcgttgaaaccgctgcgcgcgcgggcggcggttctcatctcatcacccgtccaagtttttggtccgcagctgccgagtccaccggtggaagtggaacacactattccttcattcattccgtatggtgccagtagcgctattgtttgatttttgtggctgccccccttgtacagtaccgagtgccgagaaaagatgcatagtcatcgtatacataccaatacaataccgttcctatggctccccctattcaaaaaaaaaaaaa

SEQ ID NO: 21667 - DNA, 651 bp, Triticum aestivum
  unsure (1)..(651): unsure at all n locations
  Clone ID: PAT_TA_21667
cagcaacggcggcggccatgcaggtgccgggccgcctccggcgcgtcctccgggcgccgccacccagaatcctactctaccgcgcgatctcctccccgccgcccggtggcggcagcggggtggcggtgaagcaggtgacgcgggggaacatggaggaagccctggagaagctgcggggacgcgtgcgggaggccgcatccgtggggttggacctgggagatgagcggcgtcacgagcgcgcccgggagagacacctttcgagcccgaccngcgccgaacgtgcgctacctcaaactcccgcgactccgncggagccggttcgccgccctaacagcccggcgtctgccctttccgatgggacctgccaagtccgccttcgttgcccatccgcataacttcttttcttccctcgcaaggacccctagtgattgtccactcatgattccttgtcagaaactcaatcgagttcctacaaatacagttgattaaacaatctccgtnaaggatacttaccatccagacacaagaggagaccgctcagaatttaatttcatcatggcgacantaatctcacaatctaaaggtggaaatccttaaatgctcgaatctttccgggggaaaatactcaggaggtttnaacncaccatgtna

SEQ ID NO: 21668 - DNA, 777 bp, Triticum aestivum
  unsure (1)..(777): unsure at all n locations
  Clone ID: PAT_TA_21668
aagccattatggctcacaagaagcgtgcaatcacagcaggagtctaaccagaatgacaggtgcttgattgctatccctgctggtatcaatcagaagaaaagcgtagatgctcttatgaagaagtttcttgcagagaactttacagctatattgttccactacgatgggaaggtcaacgagtggaatgatctaccatggagcaaaagtgtgatacacatcgctgcttctaatcagacaaaatggtgggtttgctaaaaggttcctccatcctgccgtcgtctcgatgtacaagtatatatttcctttgggatgaagatcttgaagtagataattttaacccaagaaggtacttgaatatagtgaaatcaagaaaggctgggagatatctcaacctggtccttgaccctaagttacctgaaattcatcatcccgataactgttcgtaaaaaaacaggcaatttccacagaagagtcagtcgggctaataaagattgttcaagagaaggccctccttcggctggtcggggcggggccttgccccctccgctcgcgttctcggcctcccaaggtgcctggtgccatcctgaatgggccgccccgtgcagcgggtatggtttacactttggtcccgcgccaggtggctgcacaaagacattggagtagtgatacgaattgtagtcatcaagataagacatagagtcgaatacaactacccngaagaccaatgacncgtaagaatgccagtcanacaacagaggagnacagcctgcatagcaa

SEQ ID NO: 21669 - DNA, 655 bp, Triticum aestivum
  unsure (1)..(655): unsure at all n locations
  Clone ID: PAT_TA_21669
gccagatgcccttgtggttactgccacatatcagatgtggaaacccacaagcaggatgatcacatggagagttttttccttgcagaaacggtcaagtatctctggcttctttttgatttagctgctggccctgacaatattgttgaaaatggaccatataagtacatatttacgtacagagggccatttgttacctgttactcctgagatagccttggaagatgaacattgttcatattttggagcattctgtaatggcggtgccgaccatggatatggtgctagtgctagttctactaaagcatcgaaatgggaaactatacccaattagatgatattcaaaccccttccagtcactattcaatgtccaatgtgttgtttacccaagttacatcaagggattttgtccaacgatgacccatgcccaaaaatttggatancatacccggattaacagggaaacttnataaacaccctcggagatctggtaaccaggggaaccgccatacaaccacgtcaaaacaatcagttcataaatgatccccaccattccaagcaaaagaggaggtttgaaccaatccgatccagttccaatatgtggaacccgatccgtccgtccagccgtaaaaagtggccccgatancgaaatnggcaa

SEQ ID NO: 21670 - DNA, 502 bp, Triticum aestivum
  Clone ID: PAT_TA_21670
acgcttactacagcaacctcaagtcccagaaggggctcctgcactccgaccaggtgctattcaccggcaccggcggtggcaccaacaacatcgtcaacaacttcgcaagcaacccagcggcgttcagcagcgccttcgcctcggccatggtgaagatggggaacctcagcccgttgactggctcttagggccaggtcaggctcagctgctccaaggtgaattaatcgatgaaaaaatggtcatatatctgccatcaataaggctagcaacggccatattatatataacatcatgtattgtgtagtatatacaatccatgatgtacttaggcacgctttcttggaccataagcttgtgaaaacaggcttatttttgttatatatgtatgtcaatggtacccgtgcaaaggcatgaaggccatgtgttgcaactatcaacgagcagcttttcgtgatgtataacatacttctatgatataaactagcaaatatgcccgtgcgtt

SEQ ID NO: 21671 - DNA, 791 bp, Triticum aestivum
  unsure (1)..(791): unsure at all n locations
  Clone ID: PAT_TA_21671
acatgtcaccaagtcaccaccactccaatagtccggtaaagaagtgcaggcagctagctagctcaccatggccgcctctgcttcttgcatttctctggtggtgctcgtggctctggccacggtggcgtcggcgcagctgtcgccgacgttctacgacacgtcgtgccccagggccctggccaccatcaagagcggcgtcatggccgccgtgagcaccgaccctcggatgggcgcgtcgctgctccggctgcacttccacgactgcttcgtccaaggctgcgacgcgtctgttctgctttctggcatggaacaaaacgctatcccgaacgcggggtcgctgaggggcttcggcgtcatcgacagcatcaagacgcagatcgaggccatctgcaatcagaccgtctcttgcgctgacatcctcaccgtcgccgcccgcgactccgtcgtcgctctcggggggccatcatggaccgtccctttggggagaagagattccatagatgcaaacgaggcggaggcaaacagcgaccttccaggctttaattctagccgctcagagctcgaggcggcattcctcaggaagggcggcctcaatacggtcgacatggtggccctatcgggcgcgcacaccatcgggcaggcgcagtgctcaaccttccgggctcggatctacggcggacactaacatcaacgcgacctatgcggcgtcgcttagggccaactgccccctatacagtcgctccggtgacggcagcctggcngacctgtacacgacgactcccaacgcgttc

SEQ ID NO: 21672 - DNA, 1573 bp, Triticum aestivum
  Clone ID: PAT_TA_21672
aacaggtgtcggagactaacgttggactaatgggacctaaattttggatgagctgaccgggatcgatctgcaggtgcacgtgagctaaatctttgtctataaatatgcatgcgatgcaccactctcttgcacaatccactaagcaccaccactccaccaccaccaggtagctagtaagccggcgtagctttgctcttgtagctagctagctaaccatggccgcctctgcctcttacctttctctggtggtgctcgtggctctggccgccgtggtgtcggggcagctgtcgccgacgttctacgacacatcctgcacaagggccctggccaccatcaagagcggcgtcatggccgccgtgagcagcgatcctcggatgggcgcgtcgctgctccggctgcacttccacgactgcttcgtccaagtaagttggccacatgcatgcatgcatatcccgatagccgtcacgtaccctgttttgtataggttttgcttgctaaacactataagcatgtgatgtgcagggctgtgacgcgtctgttctgctttctggcatggaacaaaacgctctcccgaacaacgggtcactgcggggcttcggcgtcatcgacagcatcaagacacagatcgaggccatctgcgcccagaccgtctcctgcgccgacatcctcaccgtcgctgcccgtgactccgttgtcgccgtaagaatatcatcttacgatcgtgtacatcatcgattggatgccatcgttaaccgttttcttcgtatccttcgcgtgcagctcggagggccatcatggacagtccctctgggaagaagggattccatagatgcaaacgaggcggcggcaaacagcgacctcccaggccctacgtctagccggtcagatcttgagctggcattcagcaacaagggcctccttacggtcgacatggtggccctctccggcgcgcacaccatcggccaggcgcagtgcgggaccttcaaggacaggatctacaacgagactaacatcgacacgaccttcgccacatctctccgggccaactgcccccggtccggcggcgacggcagcctggcgaacctcgacacgacgacggccaacacgttcgacaacgcctactacaccaacctcgtgtcacagaaggggctcctgcactcggaccaggtgctgttcaacaacgacaccaccgacaacaccgtccggaacttcgcgtccaacccggcagcgttcagcagcgcgttcacgacggccatgatcaagatgggcaacatcgccccgaagacggggacgcaagggcagatcaggctcagttgctccagggtgaactcgtgattgaatgacgagctactacctaatacctggtgggcagcgcttgccagcacagacccttgatgaatgaataaggccccagaaccaatggccaatataaataccagcccttgaaatgtgtattttatgtacgagcagcagcaaatcatgcatgcatccccatattatgtaccaatcgaattccccctttttcatgcaaaggcatggagaattactatcaatcctacttatagttgcatcc

SEQ ID NO: 21673 - DNA, 1123 bp, Triticum aestivum
  Clone ID: PAT_TA_21673
gccgccggccgggtcgggattgcatccagtacaagcgtctcttcctatcacaattaagctagtgtctctcactagacgttggctagcaagaagccatggcccattcgtctctatcaaccgtgttgctcttgtgcctggccatggcggcgtcggcgcagttgtcgccgacgttctaccaaacgtcgtgcccgaacgctctgtccactatcaaggccgccgtgacggctgccgtcaacaaggagaaccgcatgggcgcgtcgctgctccggctgcacttccacgactgcttcgtccaaggttgtgacgcgtctgttctgctgtctggcatggaacaaaacgctttcccgaacgtgatgtcgctgcgaggcttcgaagtcatcgacaacatcaaggcaaagctcgagaccatgtgcaagcagaccgtctcctgcgccgacatcctcaccgtcgctgcccgcgactctgtcgtcgccttaggagggccttcgtggacggttcctcttggaaggagggactccaccaatgcaaacgaagccgcggcaaactccgacctacctcccccattcttcgacctcgttaacctcacccaatccttcggcgacaaaggcttcaccgtgaccgacatggtcgccctctcgggcgcccacaccatcgggcaggctcagtgccagaacttcagggacagactctacaacgagaccaacatcaactccggcttcgcgacgtcgctcaggccaactgcccccagccgactggctccggcgaccgcaacctgggcaatctggacgtgtcgaccccgtactccttcgacggctactacagaacatggacctcccaagctttacatctagccgggcagatcttgagaaggcattccttaacaaaggggtcaacacgggcgacatggggggcctctccggggggcacaccatcgggcaaggggaaggggggaacctttaaggcagggtcttccaacagaataaaattgaaaccaaccttggcccattttttccaagcaaatggccccaggcaaaacgggaagggaagccgggggaaccgggaaacaacaacggccaaaacgttcaataaggccaactaaaccaatttctggtaccaaaagggg

SEQ ID NO: 21674 - DNA, 1620 bp, Triticum aestivum
  Clone ID: PAT_TA_21674
ctcgccaccacaccactaccaccagtcagaagtgccgctagtaactagtaagaccaagcagctgtccccctggagtacgttagctctctagcggcgcttgtgcctctggccctatccgcggcgtgcctgttgttcctggcactggcggctccggccaggttgccgccgccgtccaccacaccgccgtgcccggacgcccggtccaccatcaaccccgcgggcccgggccgcggtgccagggccgcccctacgggtgggcccctgcctgggctgcgcctccactactctgcactcctacgtcggaacctgccacgtctccgatctggcgtctgatcaagggctcacacggccatgccggcactccgggcccccgagggcgttcagcggcataaagagcatctatacgacgatctagaccacctgccaacggcctgtgccgtccgcctccatcctcgctggcccgcctcgtcaccccgtcctggcccgtggaatggccgtcggggccagtgcgaaggcgggaaaacgagagtccaaaaatgggaacgagaacggcggcaaagcccgcgacgtgccacaggctttcacactctatcccgggccacgatcttaagcccggtcacttcaggaaacaacgggcctccttgacgatccgacatcggtgggccctctcgggcgcgcacaccatcggccaggcgcagtgtgggacctttaaggacaggatctacaatgagactaacatcgacacggccttcgccacatctctccgggccaactgccccaggtcaaacggcgacgggagcctggagaacctgcacacaacgacggaccaacaccttccataacgcctaccacaccaaccgcttctcacagaaacgcctcatgagttggatcttgcaccgtggacacacggcaggcggcacaccacacaacgacggtcaacctaactcccagcaaggcaacgccagccgcgttcagcaggcgccttcagcctcgaccccatggtgaaggatggggaacctcaagcccaattgaacttggctctccaggggcaaggtctaaggctcaagctagctccagaggtgaattcaattgcataaaaaagtggtcgatatatgtgcagattcaataaggcttagcaatggcccatttatacaacatccaaaatgtacctaggcgccgtttctcttggaaccataagcttctgaaaacaggagatgtctcatacatgtatgtcaaggccctcgtgcaaaggcatgaaggtttcccttgcgtcacgtacataaaaaaataaatactacataaatttctcttttgccaggacgcagaaaaaaaatttttaaggaagtctcagtcgttgtacctgggccgccgcccccttccccttcgacaccccatgaatgaataaggccacagaaccaatggccaatataaataccagcacttgaaatgtgtattttatgtacgagcagcagcaaatcatgcatgcatccacatattatgtaacaatcgaattcccactttctcatgcaaaggcatggagaattactatcaatcctacttatagttgtatacataataatgagatataaattctgctttaaaaaaaaaaaaaaaaaaaaa

SEQ ID NO: 21675 - DNA, 709 bp, Triticum aestivum
  unsure (1)..(709): unsure at all n locations
  Clone ID: PAT_TA_21675
ctcccctctcgctatatccccggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgcaggccggcgaggtccgcgtcaagatcctattcaccgcgctctgccacaccgaccactacacctggagcggcaaggatcctgagggtcttttcccttgcattcttggccacgaagctgccggaattgtggaaagtgtcggtgaaggagtaactgatgtgcagcctggggatcatgtcattccttgctaccaagcagaatgcaaagaatgcaagtttgcaaagagcggaaagacaacctctgtggtaaggcccggagtgcacaggcgtaggtgtcatgatgaatgatatgaaggcaggtcccgtaatggaaagccatttccattcaggggggcaacaacattaaccactagcggggggcagtctgcatgtaaccacagaacccctgtaatcgcccgccgttggggtctccgccggcacgggtgggacgctagctggctgtgtcgttttgctgaattgcttntttagaaaatcngggttnagttggttaacaaaaattttgttaaatttgt

SEQ ID NO: 21676 - DNA, 617 bp, Triticum aestivum
  unsure (1)..(617): unsure at all n locations
  Clone ID: PAT_TA_21676
cgcctccattctcccgtcccctcccccacagccggtcctcctcccgtcccctcccctcccccacggccggccgccctcccgatctggaggcctccggccagatcaactcctccataccacggcgtgcctcgcggtgtccccggcttgctcgccgtcacccagcttgctgcggatctggcaggtccgtactcaccaaggctcccgtgcgtcgacgtctcctgccaccagatccggcgatgaacaggctgtcttgtgcctcctcctcaagctcacgagctgggattgcctcttcctgcttgccaatggatttgtagttcaaggtgattaggattttattgcagcaatgtaaaattgtttgttgcgtgatggatctaagtagcacatgaaccactttaatcttggtcttgtgttctctgtgatgaacttgcgtgggctagcttgatggatttatgtccacaaaaaggctagcacaatttagccctctgattgtttgttggggatttgactacaagctgggattaattttgtctgcgttaaggctcctcccaattctccgatgcccgttngtatagataaaataagctgcatttatttgtttgcaccggaaaaaaaaaaaa

SEQ ID NO: 21677 - DNA, 829 bp, Triticum aestivum
  Clone ID: PAT_TA_21677
gcaccagcaacaggggcatctccttcgccgcccgcgccgccgcgcgcttcggcggccgcttctcctactgcctcgtcgaccacctcgccccgcgcaacacctccagctacctcaccttcggccccgacgccaacggcgccgcttcatcgtcgaggacgccgctgctgctcgacgcccaggtggccccgttctacgccgtcacggtcgacgccgtctccgtcgccggggaggccctcgacatccccgccgaggtgtgggacgtcaaaaagagcggcggcgccatcctcgactccggcaccagcctgaccatcctcgccaccccggcgtacaaggctgtcgtggccgcgctgagcaggcagctcgccgggctgccccgggtggccatggacccgttcgactactgctacaactggacgtcgccgtcgacgggcgacgacctcgccgtggccgtcccggagctggccctgcgcttcgccgggtcggcgcggctccagccgccgcccaagagctacgtcatcgacgcggcgcccggcgtcaagtgcatcgggctgcaggagggcggctggcccggggtgtccgtcatcggcaacatcctgcagcaggagcacctctgggagttcgacctcgccaaccgctggcttaggtttaaggaccggcgctggccacagtcaccaacggggcttcaggcggccctctcctcttctcttctcactccttcccccctcgggcgggctttcccgcttccgtctccctgttcttgtcgggctcgttcttctctcgcgggtggtaatgaaatcgggcatgttcccagtatctgaaaaaaaaaaaa

SEQ ID NO: 21678 - DNA, 439 bp, Triticum aestivum
  unsure (1)..(439): unsure at all n locations
  Clone ID: PAT_TA_21678
cgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggttggcgtgaagcgcatctcccgggctgatctacgaaggagacccgcggcgtgctcaagatctttcccccagaatgtcatcccgcgaccctgtgacctaacacggagcacccccgtcgcaaaaccgtcaccgctatggacgtcctgttcgccctcaaaacgccagggccgcaccccctatggcttccggcggctagttaggtgtgggtaattgcctgtccaagtgcccccgatctgtggtacnanttggctgccttcc

SEQ ID NO: 21679 - DNA, 671 bp, Triticum aestivum
  unsure (1)..(671): unsure at all n locations
  Clone ID: PAT_TA_21679
cggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgaccccgcgcggcgccggcaacctttgggcgcagcgtcttccaacccgggggaagcaacctgggccaccaagggcatgggcgccaacctcttcgaccgggccgcangcccaatccccccaccgtctacgactgggctctacaagcgacgagaccaaggagcaaccaccgctagattgggcganatggatggacagtgaagggcatgttgctggccccggggggcatcaccaccatctcnattatagcaatcacacatataanactngtgttgtgtatgttgtctgtcgcngttccgcctttaattaccaagttangagtagtanaattgcctcacccataaaatatagtacaatggagttagacgtcaactttccaanaantttcacctatanttagtcctcggaaaaaaaa

SEQ ID NO: 21680 - DNA, 405 bp, Triticum aestivum
  Clone ID: PAT_TA_21680
ccacgtcgagtgtatcgcagagtacggagaggacaacgaattacgcctaaccggccgtcatgagacgggatcgatcgacagcttctcctggggtgtcgccaaccgtggcacaagcatccgtgtaccacgcgaaactgcggccaagggttacggttacttcgaggatcgccgccctgcttccaacgccgatccttaccgcgttaccaaggtccttctccaattttccatggcttaaagcgagttttagagtttgttcctttctgatgacatggtctacggcgtgcaagtttggggaaactattgattacatagatagcatgatagcttgtccagaaggacagtaatgacaacaatcagtaaaatatttgtttgcctcatatcaatatgattgatgcgaatcaacaa

SEQ ID NO: 21681 - DNA, 592 bp, Triticum aestivum
  unsure (1)..(592): unsure at all n locations
  Clone ID: PAT_TA_21681
gcgaaaaggtgtgaagcttccttcggagatcccagtaccagaagcaacgcaggcatcggcttgcgacaggagaggacggagatgacgcagaagcagaccctgttcaaggggcagagcaagaagaagactatccctcccaaccgccacggcaaggcgcctcatgttcgtaaaggaaagagagccgtcaagcccaccaagttcacaaaggacatggacgccgagaaggaactccaccaagttcatcaaccagtgcaacgaaataaaagctgcgatcctgctagcaaagagggcgggtgacctccaacatagtgaaggcggtggtgaggaatctaaatccaaagaaataggaacccagaaactgaaaacgatgtngttgaacgtnatgccttggtaactgttnatccatgtatccngctgaagaattcatttccctttggctggtaaatgacatgttaacccaaattacggtgtactcaaccgggtaatggctgcaagtttgntctgtgcaaaaaaaatatccngaaagtctcancgggactngcggngntcactaaccaaaaattnattngggccgnnccattcccttacggtg

SEQ ID NO: 21682 - DNA, 744 bp, Triticum aestivum
  unsure (1)..(744): unsure at all n locations
  Clone ID: PAT_TA_21682
cttgcctccgatccccaattcctccttcggatctcgcattcagcgcagcgcaggtgtgaaaggaagggggacgcggaggaagatggggctcgcgttcgggaagctcttcagccggctcttcgccaagaaggagatgcggatcctcatggtcggcctccgacgccgccggtaaaaccaccatcctctacaagctcnaagcccggcgagatncgtcaccaccatccccaccatccggttccaatgtttgaaactggtttgaagtacaaagaacattacttccactgtcctggggatgtccgggggccaggacaagatncgacctccttttgggagcattactttccaagaacacccaaggtcttatcttttggtggtgggacaacaatgaccgttaccgtgtttgtttgaagccaagagatgactcccaacaggatgctggaacgaggatgacttacgtgatgctgtgctgcttggttttgccaaacaagcaagtctcccaatgccatgaatgctgctgagatacggacaactgggttacatcctgcgccaacgacacggtacatcagagcactgtgcanactgggaaggtctgttaaggctgactgntgtcagaanattcaacagggttgggccaccttatgtaccggaatgacaggncccntttctgaancaggnaaaccnntgaacgttanttnccggcaaaaattttnntggaanttcggcncgtaanccaaagngggtttg

SEQ ID NO: 21683 - DNA, 235 bp, Triticum aestivum
  Clone ID: PAT_TA_21683
tttcgcggctcccttctcccgtcttcctacctggctacctccggtctccagacccgaaacgctgacgccaaatcaaatcaaaccttgctgccttctgcatccggtagcagcaagtcgccgcttgtgcccttcctcctcactttccctcgctgacgcccgatccccatgattcgattacgcgacccgccttgcaaaccctagcttctcccgctctctccctttccaatgcgcccca

SEQ ID NO: 21684 - DNA, 664 bp, Triticum aestivum
  unsure (1)..(664): unsure at all n locations
  Clone ID: PAT_TA_21684
gataatcgttgcctccagtgtggccagtgggaccgtcccggggctcctggaagggctcaacttctggcgcctcgtccccccagcttgggctgaggagcgagccttgttcgccctggtgagggtgtccttggtccatcatgaggggcacatattcttccggcgccgtcatcccgaaggccatgctgtagtgctccgcgtgccacacagctctgcttgacgcgcacaccgtggggtggtagcgcggctgtccactgggccacaggtcgcgtcgagtccttctccttcgccggactggggagcgggggtagcgccgccgccggtccgggtgccgacagcttggctggcgttggagtagccttnggaccccgcngggtgcgcgcggagcccccacgccggccgccctggccttgagacggagctgggtgcagaaggggtgaccccccgaggcggcaaagccaagagctctgcaaccactccaacaacacgtctggccgcctcaacacccggcttacccctcccgcgcgctacttgcctcagggggccgtaccaattcccanataatctatanccnccatggctcnttaaagtctatngaaactggtacactatcctgaaaanccttcatggtatncaaggcaacattcctcaattcactaggaaggng

SEQ ID NO: 21685 - DNA, 672 bp, Triticum aestivum
  unsure (1)..(672): unsure at all n locations
  Clone ID: PAT_TA_21685
gcagctcgaactagctttagctactacgtgtgcaagtgcaagcagctcactcgttcgaccatggctgcgagagcggcgctcctccagctggctgtcagcctggttatccttgccgccgtggcgagcgcgagcgcgaccgactgcccaccgccaccgctgccgccggccccaaagccgccgacgcccggcggccaccacggccacgggtcgtgccccaggaacgcgctgaagctgggcgtgtgcgccaacgtgctgggcctgggtgaaggccaaggtaggctcgccgccgtacgagccgtgctgctcgctgctggacgggctcgtcgacctggaggccgccgtctgcctctgcaccgccgtcaaggcaacatcctcggcatcaaccttaactccccatcgactcagcctcatcctcaacaactgcggcaagaactgccccaacgacttcactgcgcgtagatcatcatcaatcagttattgatcgtcgtccatcgccggccggcgggggctcctcacatcccttttgctaattgtggtcattgcccccccntcccccaactactttttattttgccctcacctaaattttgggtgggtggtaactctnntaccaagagngtacaacctctgtaantcggctggtntantatncgatgtttccatatctattat

SEQ ID NO: 21686 - DNA, 581 bp, Triticum aestivum
  unsure (1)..(581): unsure at all n locations
  Clone ID: PAT_TA_21686
gccgccgccccgccgtgttgctcgccgacaccgccccgccggcagccaaaatgccgttcaagaggttcgtggagatcgggcgagtggcccttgtaaactacggcaaggagtatggccgcctcgtcgtcatcgtcgacgtcgtcgaccagaacagggctcttgttgatgcccccgacatggttccgttgccaaatgaacttcaaagcggctttccctgactgacatcaaagattgacattaaacgtgtcccaaaagaagactacactggatcaaaggcaatgggaggaagctgatgttgaaaagcaagtggggagaatactcaatgggggcaagaactgattgttcaagaagaggagacatcactccaatgactttngacaagttcaaaggccatgttgggcgaagatcaaagagggcgggccattaggcaagacttgctaancttaaaaagnggctgctgctgcttaaatgctttgggtggtcctccatccgttccttgaaatgtatgcacgattacttgacanttacttgtcaagattcaatttaaccggctattaaaatttgccaatcgcnatcgaatc

SEQ ID NO: 21687 - DNA, 560 bp, Triticum aestivum
  unsure (1)..(560): unsure at all n locations
  Clone ID: PAT_TA_21687
ccgcgtgcggctccacacgcgcccgccgatgccgaagcgcgccgtggcgtcgttggggcagtgggcggcctccccgcccgtctacgatctgagggagttcggggcggccggggacgggcggacggttaacacggccgcgttcgagtctgccatcgcggcgatcgccgaagaggggcgggggcaggctcaccgtgccagccgggcggtggctcaccgcgccgttcaacctcaccagccacatgactctcttcctcgctgctggcgctgagatcctagggattcaggatgaaagatattggccttgatgtctccattaccatcatacggctatggaagagagcacaagggacctcgatatgggagccttatacacggccaagacctgaacattgactataacagncataatggtactataaatggacaagtcaaattggtgggtaaaattcngagaaantccttatcacacaaggggtctctggtgcactcatgcgtcaagtacatatcattcnaatacaccctcgtgatctccttctggaccctaaactacnacgcaagat

SEQ ID NO: 21688 - DNA, 601 bp, Triticum aestivum
  Clone ID: PAT_TA_21688
cgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaggtgaggggtccggggttcgtgtggcgaacggcgtgttgagccacgcgcgcgtgcgcccgcgctctgtgacgcccggaacgttcttgggagagcgcgagcgaggccttgtctcttctcggtgcgggtcgctgtgccatgtgatgtgatgtgacgctggatcgttttgggtccgaccaacgggagaagagcggctgtggtcgccgtcgccgccgtgtgtgggctggatggcctgctttcttgtgctcctcctatatatcagatgtactccctccaaggacaaggtttcgctaccttttcgtatccctaaactacactaatactacatacaataaaactgcatttctcaaaaaaaaaaaa

SEQ ID NO: 21689 - DNA, 713 bp, Triticum aestivum
  Clone ID: PAT_TA_21689
cgccgccgccgccgctccctgacccctagtgtccggatttaacttcaaacatggcggacgtcgatgtcgagccggaggtcgccgccggtgctcccaagaagaggacgttccgcaagtacagctaccgcggcgtcgacctcgatgcgctgcttgacatgtccaccgacgacctcgttcagctcttcccagcgcgcgccaggagaaggtgccagaggggtttgaagaggaagcccatggcgctcatcaagaagctgcgcaaggcgaaaaaggatgctcctgtcggcgagaacccagagccagtgaagaccatctccggcaacatgatcattgtccccgagatgattgggagcattgttggtgtcctacaatggcaagaccttcaaccaggttgagatcaagcctgagatgattggcactatcttgcagagttctccatttcctacaagccggtcaagcacgggaggcccggtattggtgccactcactcctcgcggttcacccctctgaaatgagtcgttacccagatctgtagcttcccttgcgtgccctgtgcctgcgcccgttcagctttgctgcttgtttcgttcgtgctccttgcccaagccatcttgttccgtgccctgctctagatttcaaagctaagcattgcataactatgctgttttgttggaagtatgtgagtataatcttatctaatatgtgatgttaaaaaa

SEQ ID NO: 21690 - DNA, 920 bp, Triticum aestivum
  unsure (1)..(920): unsure at all n locations
  Clone ID: PAT_TA_21690
ggaacacttaacctgaagaaaaccactattgcagcagcagtatagtcaacggtgtagcagtagctgcattgcgttattggggtagtagtgtggcagtgttggactgctggtcatcaggtcatggcttcttcttcttttacttccttgtcagtgatgggtgctcttgtgcctagccggcgccggcggtggcctccgcgcaactgttcgccgacattctaccccaggtcgtgtcccagagcttctggccaccatcaaggcccccgtgccgcccgcggtcgcgcagggtgcccgctgggggccccccctgctcgagctcctctccgatgactgctttgtccaaggttgcgatgggtccggtgctgctgaatgacacggccaccttcaccggcgagcagaccgctaatccgaacgtcggctccatcagaggcttcggcgtcgtcgacaacatcaaggcgcaggtggaggcggtgtgcccggccctccctctcccgcgccgcccgcctccgccgccgccgcccccgccgcctgcctcccgccggggtccccggcggtgggggcgccacccggcccagctggcactccacccacgcctcccgacctctctcccgtgggtccctgcagtcctgtccccggcccccccaactanaccgtgttttncccaaaaacggtcaanaagncnaacttnctccccnnaaaggccaaaatttggctgganattcanacttccngggcacatttaacacacaacttaaccnggtttcaacctccangcaatcccccgggggccggaaggganggaactncccctgaacgcaaccacntngaaaccctataacactctgcnaaagntgtaaanccacaaantttaaggggcccgaggcttcccantttctcncccnggttacggattcnggaaanta

SEQ ID NO: 21691 - DNA, 465 bp, Triticum aestivum
  unsure (1)..(465): unsure at all n locations
  Clone ID: PAT_TA_21691
ctcgtgccgaattcggcacgagatcgcggagcggaggtcctctaatcaagctcacggtgacatgttggaggctctattgagaagtggtgatgatgggaccagggaaaagctcagtgatgagcagatcattgacttgatcatcaccattatttacgacggggtatgagaccatgtccgacgacctccaatgatggctgtccaagtacctgtcccgaccatcccacaggtctccccaagaactaagggtatgntgcacatacccctgaagacaaattaatattgttttttgcccagccaaagacaattttgatttcccagaaaagttcatgtgcttccagagtttagtgatggtcttttcacttcccgaatgtttagagagcaccttgatatttngaagggaatccccccggaggaggctatcaactacagggtctctcctccctggnctcactcnaagggggggcc

SEQ ID NO: 21692 - DNA, 676 bp, Triticum aestivum
  unsure (1)..(676): unsure at all n locations
  Clone ID: PAT_TA_21692
cgtctccgcccatggcgccacctcccgccacgccccctccacccgccaccccgccgccaccggccgcgcccacgccggccccgagcgtggccccgactcccccgcccgtggcgacaccggctgcgtcccccaagagccccaagacgccgagccccgccgccgcgacgtccccggcgccctcgctctcgcccgcgggcacgccgacgaacgaagactcgggtgcaagcgcgcgcgcggtcggcttcgccacggtggtggcgttggcgggcgcgggcctcgccgtcttgctttgagtagtagactccgactcttcttcctgtcctcactagtcacgccgatgttgtcaccccctccgcgtgcctcgacgttgctgctcgctccatttcagtttcatcttttttttttcctttggtgttgttatttaattttaccggccctacgatcgattcttgatgtacgacgacgacgatgatgatgcattgggttgctttggatcgccgggcggcggggcggtggtgggtaagtttctgcccgcgggtgtccgaccccgccacgccatgtacttttaccgcactacatttgggtctatagagagaggcttgtgtacatccccgtgcattattccaatggccgtttgaataaaactcctgtgcagatcactcnnaaaaaaaaaaaa

SEQ ID NO: 21693 - DNA, 786 bp, Triticum aestivum
  unsure (1)..(786): unsure at all n locations
  Clone ID: PAT_TA_21693
acagtgcggccgcccgcgctggtacgaaatgaatttctaggtctcgcgatttcttaccatcaagttggtaaaaagcctcgatttattggcaattgctagaattatctatgatctattttggaaatcctttttttgtttagactgttttttgtttatgagatgtctggaattccttatttatatcccatgcaaaagaagagaatccaaggcaaaggcgagaacaataaaattaaaatttcttccttttcggagggattgcaggtcttcttaatcgtctattcggcacaagaaaaagcctttttcttgtgccgattcttcttgtatcaaaataagaatcctttttcttcctaattcgtcaaagattactatttcttctttattcgggtctgtctcttggacctctttttcttttgcttaggtttagccgaggtagtggacaaacagaggggaaagaaaatatggcgggggacaaatttcttgtgattggtgaacaaatagaattgcttggcttgtttaattaagttcaacttcaaatttacagaaattttgaaaaaaaaaagtaaccctcgaaggttttttttttttttaggctagttgaatagttttgattaaggtttaattagtttattaccccaaacaaaatctcgggttttcagcattcctccttcgtgacctcggccgcgaccacgctaatcactagtgaattctataccccgcnaaggccgcgttaaacgcgganggaaacctgggtccaantaacnctgnaaaatcccntnccagnggggn

SEQ ID NO: 21694 - DNA, 281 bp, Triticum aestivum
  Clone ID: PAT_TA_21694
tacaattcggaagaaatcctgctgctaacaaagcttcctaaagcaggatacaattttctttccagattttgatagatttcagaagttggtaggaactggaaagtgacaaaccagaggttgtgggtatctgttggctgttgttactgcaacctgtttgggcatacacactaggctgatgggttcctcccatggtgtaatgtttgtccgaaaaataacattgtacatcccatttgggggattattaaaaagattactcccataaaagccggaaaaaaaaaaaa

SEQ ID NO: 21695 - DNA, 584 bp, Triticum aestivum
  unsure (1)..(584): unsure at all n locations
  Clone ID: PAT_TA_21695
atttttcatctcattcggcgccgcggcaccccctgctcgtcactcgcgatggcccggatcaaggtgcacgagctgcgcggaaagagcaagacggatctgcaagcgcagctcaaggagcttaaatcggagctctccctcctacgcgtcgccaaggtcaccggcggggctcccaacaagctctccaaaatcaagatcngtgcgcacctccatcgctccgcgtgctcaccgtcatctcgccagaagcagaagtcggcgctgcgtgaggcgttcaaagaagaagaagcttctcccgctccatcttccgnccccaagaagacccgcgccattcgcaggcgcctcaacaagttccaactccccccttgnaagactggagagggaaaagaagcgtgagaagtattttcccaatgcggaagtacctatcaaggcctaatttagtggaagaacagcttttacctatcaattctgccanaagttcttgatttgntgtacccaatctacgtcattacaagggatgatgaaaccgatttcgggccgttcaancaaanatcttggtggnatcncatcctataatgaaaaaaaaaaaa

SEQ ID NO: 21696 - DNA, 653 bp, Triticum aestivum
  unsure (1)..(653): unsure at all n locations
  Clone ID: PAT_TA_21696
gattagcgtgttcgcgcccgaggtacttgntaacactacaggaaaaggaangagagacatgttaccaggacgacaccagntgaaatcccagtacatccttgaagttgattttgaggggacgaatcagttagcatatcccgagacgtggttctttatgcttgtcgtggctatttgtgtgctgacacagatgaattacctgaacaaggcacttgatacatttaacacggcagttgtatcaccaatttattatgtgatgtttacatcattgacaatactcgcaagcatcataatgtttaaggattggtcntggtcagagccttggaagcattacttctgaaatatgtggcctgattgtccgtgttgtccgggtaccattttgttgcatgtcaccaaaggattacgaaaggttcctccaatccnagaataggcttttacgcaccgttgtctccctactncnggaaacaagatttgaatgggaaactactggagnacgttttnaggaggattttaaggagaacccgattacgaaaagaaanccttntagaccgcagggattttccaagcattggaggggtggcaaccatggatgacnggcaactgttgatttaaacattncccgcaccccatttgttttttgcccctggtanaaattt

SEQ ID NO: 21697 - DNA, 703 bp, Triticum aestivum
  unsure (1)..(703): unsure at all n locations
  Clone ID: PAT_TA_21697
ttcgaacggacctaggatgtaacagtcgtgccctaccttttggccgctccagttgggcatcatctgtccgtcatctataaatagccttaccttctctctcctctaatccctagacgcgcaccgcaattaccatacccaaacaagccgagaggatcttcacctgcgagctcgcgtgtgggggatttgctgggagtctggcagcgtgtggcggctgcgacggcccccgtatcgtggctggcgttcttcgcgacgtcagacctgggcgcggcaggagcttctggtgcgcgcgggcaggaccaagaggcgggactcggtgattttctgtaccgcgcagaggcgatttcggtccgggccggcgcatcgccattgaaccgcgagactaccgtcgctccatccgggggcaacctgttcgtgtctgggcactgacgagcaagctacagaggattctggggttcagctggtagagatagctgagcaggagctcattgaaggtcaagaacaggtaccacaggatgaggcgcatggaggatgctgcgatgagttcgtgagagagatctacgccgtcgtctcccaggtcaactttgggttgctggatctttcctcctataatgtaattaattaattggtatcatacactgctcccggttttctagtaaagaggcccgtccgccgccgctaagtagaaaaaanccnaggggggggc

SEQ ID NO: 21698 - DNA, 198 bp, Triticum aestivum
  Clone ID: PAT_TA_21698
gggatattgaagagattggagagaactcttatgatgccatttccatgtccgtgaagaaccaataattttcctgtgccctgaattgggtggtttccatagcatgtgcacggggtttgggtggaatgcctacagaatcgactgtgtcaagctttcttgattccgtagaaacatgttttgtttgacctcaaaaaaaaaaaa

SEQ ID NO: 21699 - DNA, 546 bp, Triticum aestivum
  unsure (1)..(546): unsure at all n locations
  Clone ID: PAT_TA_21699
ctcgtgccgcgccatagcagccagcggagtaccaaaccccacacgagcaaaagcagagcacacagcacaaacctctttcccctcccctgccccgcctcctcctcctccattccccatcccccatcccccatccaccgccgtcgatggcgaggccgacgcgcgcgctgctgctcccgctcctcctcctggtcctcgcgctggcggcgctggcccgcgcgtcggggtcgggcgacgttccggcgtcgtctctgagctgggacctcggcgtggttgggcgccggggggaggacgaggagttcggcttccccggcggcgactccgtagcgcgccgggtgctgcagggcggcggctacctcagctacggcgcgctgcgcatggacaacgtgccctgctccgtccggggcgcctcctactacaactgccgcccccggcgggcaagccaacccctactcgcgccggctgtaccgcnatcanacgctgccccggcgtatcccccgaagcgtcaacgacggaaacaggagtcanactgtaatcaacncgttgttn

SEQ ID NO: 21700 - DNA, 565 bp, Triticum aestivum
  unsure (1)..(565): unsure at all n locations
  Clone ID: PAT_TA_21700
tttttttaacaatgaacagctagaagtttaattgttcgagtgataaaaaagtgagatacagatatccagtgagatcttgtgtgcactgtaagactgagaacaaaactatgaataattctctattaatataactttgcagcaattttttctctggttgactaaaccaggccttgatgaaggactttggacgattcaaacggaggtccaagctacttactcgctggtggaccgtccgtctaccggtgaggtgggtggttgccagcaagaactgttcgtctcctagcccaggtccatcccggctgggagcccgttaccagtgaccgctatcccaagtgctcccaaccaactgcttcctttcaaagggtccctgactgccttccttcgaagccccccngacggccttccttcccatgcctggaacgttagatcttgcccggcacggtcaatagctgacggacagcgtcaaatgtgccttgacgctccgagttaatgttccccgtttgggtacaccggcaaaacgcgccgactaggtgtcaccccacctcgccnaatgcctggnaaatga

SEQ ID NO: 21701 - DNA, 561 bp, Triticum aestivum
  unsure (1)..(561): unsure at all n locations
  Clone ID: PAT_TA_21701
cctgagccgactccgccgaggtcggtggcggcggcggcggtgagcatggccgcgcagagggagaagtccgcggccgtcgcggtcggcccagcacacggcgctgcggtatcggggtctccttctccttcgtcctcatccggaggcccggcggcggcgtcctcgtccgggagagcggtggagcgccgcattcgggacctgggggagctcggcgccaacgtggacgcgctgcagaagatgctcgtggcggaaggctgtcttcgtcgacgatgacatcttctccaaggcctccctcgccgccgaccaggcccgcaccattaaggttcttgaccagagggtgcagtctctggaacgcgaactcgatgccgccatttctgcagcagctcgagctcctacagattaacgacaggccgaagctgcgcaacgagctgcagagttacgcacacangaggtcaccaaaggaactggagaacatgcgaggtgttcaactgcacatggaggagttccgctggcacaggatggctgcgaagtaccttcgatgtgtagttgcgtgcagaatacaac

SEQ ID NO: 21702 - DNA, 611 bp, Triticum aestivum
  unsure (1)..(611): unsure at all n locations
  Clone ID: PAT_TA_21702
cggacccctacatcgacgggcccatcatccaggcgtcggtggcgcgggctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactccctgtggagtgaagccaaagaacaacaacctggagctgggtgctgctgacaacaccaaccataccaagaagacaaggatgaaggagatttaccaangcttcaagaagnttccgtctacctgggtgagcgtgtaacggatgacangccctcgcccaaacgttaacccccaatggancatcatccaagaggttaagaaggtgactaacaaccccttnccgtttggttccngcataccaacccagaaaacgttaacaaatgcgcaatggggccttacgggtgattatccggaacgcatggtgaggaactggccaacggtctcccaacaaggctaaggggtggaggatatccanggcataaaaannctgcatatcatgaa

SEQ ID NO: 21703 - DNA, 637 bp, Triticum aestivum
  unsure (1)..(637): unsure at all n locations
  Clone ID: PAT_TA_21703
agaaggagagtgtaaactacgtcgcgttgacgggtccccttccagacctggaggagtggtcaacctcggttcctagcgagctaagcccaagagtgaaacaatgggtgccttgcgagctcgcgtgagaatgtgcgttttcttctggttgcacctttgcttgcttctacaactttgtctgtctcccccctccacggtccttttaaggtgtacataaggccatctgtctgcatctgaagaagtaccatatcatatcagcactcacatgtccaaggaaggaattgcaatgtggaaggtagtctatctggctcccaaagcttgaagaacagcagagcgaagacctgtccgtttaatggagttgatgcgtgtaaccctgaaaccgagccgagggaagaacgcatcgcgctacatttttgggcatgtcctgctgcctgctgttgattacatcacattcatccctcaaggtgtcacatgtcaattcaaacgggattataacgccgttattacaccctttgtttttaagtacactctaatttcggtgtaaacaacgatctgcccgctgactaacaaancaccacgttcatctagtcatgaagttgtgtcaaaaaggggccccctcccctccctcttgccccgggcg

SEQ ID NO: 21704 - DNA, 482 bp, Triticum aestivum
  Clone ID: PAT_TA_21704
gcaatcagagccaagcacccaccgtcctcctttctttccttcgactcatcaaagcatgtcttgctgcggcggcaactgcgcgtgcacctccggctgcaactgcggcagcggatgcggcggctgcaagatgttccctgacgtggagaccgccggcgtcgccagcgtgaagcccacggtcctcgccgcccccgccaccaaggcgagcgccggcgggttcgaggcggccgccgaagggcggcggctgcgactgcaacacctgcaactgcggcaccagctgcggctgctcctgctgcagctgcaactgagccacccgcgatgacgagaaaccacccggcctcccccccaccatcgtactacaactatgtaccgggtctaaataagttcctccaacggcaccgccattgttcctcccgtcgctgcatgttgcctgcctcgtgcccgggctaatataaatacactttttcaccaacaaaaaaaaaaaa

SEQ ID NO: 21705 - DNA, 629 bp, Triticum aestivum
  unsure (1)..(629): unsure at all n locations
  Clone ID: PAT_TA_21705
ccaaagtacaacgtcggcaaccgcaactcttgggtttgatggaacggtcccgtcacatttggaagatggaaaccagtttgtttgtcttcagcagaacgagaaccctgcaatgtggatgcatggagctggttcacgagggatgcccccacttgcagccagtaccatgtatggctatcaagggcagatccatcaagaccggcttccgggcagggccagctaccttccacaatatggtcctgctcctaaggcatcacacccggcctggggccccgaacacccgaatccctagccattataacctaannggggctgctccaggctaaccagatgtngncaaacactactgattcaacccacaccccctttatcacatctgttggaaacgccttgttgtgttgttgccccaaccccaaaggcatccaatcccggtgctgattcaagcacccggtccaactgcnttttcatgattacgtcctgaatttttanagnccaagaatatatgttnggcattccaccgtnggttgtnggnatggcaaaagtacnggtcgtcatcaaatcngatnggaagggcgtctttctcaatccccttttgcttnaacttanataaccgatttacataccattttncg

SEQ ID NO: 21706 - DNA, 635 bp, Triticum aestivum
  unsure (1)..(635): unsure at all n locations
  Clone ID: PAT_TA_21706
tggatttggaaaggatggcaaggaagtctacttcagggatatatggccctcgacagaagaaattgcgcaggttgtccaatccagtgtgctgcctgacatgttcaagggcacctatgaggctatcacaaaaggcaacccaatgtggaaccagctaactgtcccagaagcatcactctactcatgggattccaaatccacttacattcatgagcccccttactttaaggacatgaccatgtccccacctggcccctctacagtgaaagatgcctactgcttgctgaacttcnggggacagcattactacagatcacattccacctgcaggaagcatacacaaagacagccctgctgccaagtatttgnatggagcgtggtgtggacccgaangacttcaacccatatggtaaccgtccgtggtaatgatgaagtaatggcaangggaacgtttgcaaacattaggtngngnacaagtttttgaacggnaattggncccaagacatcatgtcctactggggagaacttcgttttgatgcggcaatnaatacaatctganggcatgcacatancctcnctgggctgcgntggaacggaattccctattggntgcnaggnccgatgnccnggattanctg

SEQ ID NO: 21707 - DNA, 332 bp, Triticum aestivum
  Clone ID: PAT_TA_21707
atccaaaggcgatacaattcatacagaaatccggatatagaaaccgtagccctcatgctggattccggcatgagagatggccaaccccagggtgttcttatacatgaccgtctgcagagcgccggcggggcgcatactgatggaactgtacaaggactctgtgccggggacagtggagaacttacgagcgctctgcacctgcaatacaggggtaggcaatagcagcaagccattgcactataaaggcagcaccttggacagtgtgatacgggacttgatgtgccagggcggtgactttaccaggggcaactgcaccggcaggaagtccatct

SEQ ID NO: 21708 - DNA, 671 bp, Triticum aestivum
  unsure (1)..(671): unsure at all n locations
  Clone ID: PAT_TA_21708
aattactcgaatatgaaaaggtacatcgattttaaaaagttaaatgaacttgaaaaaactacacgaactttaaaaaaatacgcatatttgaaaaagtacatgaacttggaaaaagtacttagatttataaaagtacacaaattttaaaaaggttcatgtatttgaaaaaagaaaccaaatttgaaaacagtacgcggacttgggaagaagtaggcaaagccgagccggaacggtcaaaaccgggatggggacatccaccataactggggcaaaacccgttgaccaagggatgaaccttgtccggtttaaagaagctaagggtgcaanttgtccatttttgaagttgaggaaccaattttagaccccgtccaagaatttgagggaccaaaatataactttcctccaatataaaagggcatttttaacatttggccaatatttcccataacggttnagttataccatttcacctaattagaaccaaatcttttccggaaatactatcaaccaatttggatgcacttttcaggaaccaccgttgcaaaacgacgatattgtgtgccaaatacagcccctgaatcccacaaactgtggcaccagcacagggtcacattcccaaccaggggccggacattcccaggtnntaccccaggcncttnantcggggaacc

SEQ ID NO: 21709 - DNA, 653 bp, Triticum aestivum
  unsure (1)..(653): unsure at all n locations
  Clone ID: PAT_TA_21709
gtttttttttttcctttgtagaaattaaaaatgtttattgggaatcctgtagtcaatgatagacgaaacgcataggagaagcaaaagaacaagcaacaacctttcctcatcgagtggaaaatgcgactttttttcctcgcgaaagtgcgtaataaagaaactcttgcacatcttattgggcctgacgactcctgagcaggcagcagcgcttcagactgatgaattgccggcgcccaccaaggagagcagcgcgtccctgtagtgtccgtgcgccttggccgcgatgacgtcctccagcttggccccgaactgctgggtggtaggcggctctgatgtcgtccatgtcgtggtccgaccgcgtcaccgccacctcgtcagggnctccttcccgtggtgggtcggcgctgtccctcaacgcgcctcaatcactggctgaattacttggccggcccgacaagcagaacacggtctccaacaaggtctcctccccccttggcgcagncctcccgactgcctgcctgcacccctggtaganatgaactctgccaagtgggcttcccctggggcaagatcggcgactcgtctctcacaanttccgtcccgggngttaaggggaacaancctcgctcgctttgactcttgcaccgggccct

SEQ ID NO: 21710 - DNA, 1200 bp, Triticum aestivum
  unsure (1)..(1200): unsure at all n locations
  Clone ID: PAT_TA_21710
gaattcggcacgagccgccgccggcccccccggccggccctcctcccccgcggccccttctgtcgccggccgcgagggcggtcccgccggcgggccgccgcgcgctcggcgcccgcggccccgccctcccccccctccccgccggccccccccggctcccccttcgccggctccccctccccgccggccttcttcgttcgcacccaactttcctgcacgttgctttggcttataggcttgatcgtcctctcgggaatatggagggggtgttcttcctcttaatgctcgagagtgctgtccatatgtgagactgatccttacttctgttgttgtgcaagaaggcgtacgtctagtctactggaggcgtctcaagaaaaagaaaaagttgctagcttctctggttgacagacaagatgctaatctctttggctggtgggttaggtcatggactggctcatgcggtctttttctgcctcagcctcctaactccaggcatttggtcaagcaacgttttatgtcgagaggtgctcaaggatgccatttttccttgtgtcggcaattattgcacttgggttcttggtcatccatacttcctcgatgattattgcttttaatggatatggagagagaaagaagagggaccaaatctttgtcccagtggttcacctgattgctgctgtgatgacattgatcaaccttgtgccagggggttgccttgtcggcacacctttactgtgcgtgacggctgcgatgaccttgtactactcctggcaagtggtggggcagagaataacagagcaccaacatcgacagtcttaacagctagcgctttgccttgtgctcgtcgcatcgcatggagtttccttgtgggctaatctttgtactaggacaactgtatgtagatttagcggtttcgccaatagttggctcatcatcttatgaaagcccatgcggccgtgagatattgactcccttatgaaattatgatgggttgtatatggtacttgtactgacacggtatacttgtaatgagatgttttcagtgctgtctggtcaggcaagagattgccgtcagattgcgtgattggttcaattaaatactacaaactccgctgctagttagtaatcgtggttttagttcaaatttgaaacggagggaatantagttagtaaaaaaaaaaaaaaaaaaaaggcccctag

SEQ ID NO: 21711 - DNA, 523 bp, Triticum aestivum
  unsure (1)..(523): unsure at all n locations
  Clone ID: PAT_TA_21711
gcttgctcctcagctccctgtcgcacacaccttacgccgggtaggcaggagcaggactcccactgtcccaccgagccagaggccctccgatccgagcgagcaggggcgccaccgtctccaatggctcggccacagcaacggtaccgcggcgtgcgggcaacgccactgggggctcctgggtctccgagatccgccaccctctccctgaagacgaggttctgggctggggcaccttccgagacggccgaggacgccgcgcgcgcctacgacgaggcggcgcgcatcaatgtgcggncctcgccgtgcgcaccaacttccccgaagacgcccgccgcccgacggacaggggcaacccggccgcgacgggctttctctccccgcgctcctcgccaactcccacgcttcaaccttgcgtccgtgcaggcggcccccggcagggccgatgatccgcggnacccctcgcngccccgccggcgcctcgaacgctcccgtccttgcctccagcctgcatgnaacccccctt

SEQ ID NO: 21712 - DNA, 642 bp, Triticum aestivum
  unsure (1)..(642): unsure at all n locations
  Clone ID: PAT_TA_21712
cggctccgccagccacccgtaaaaccctagacggctagccggcgcacggaagcgggcagcggagcggaggtgagcctctcctgcgtcggattgtccccgcccccgcccccgctaggcgccatgaagctgacggtgaagaccctcaagggaacgcacttcgagattcgggtgcagcccaacgacacgattatggctgttaaagaaagaatattgaagagatacaagggaaagacagctatccatgggggccaaacaactgctgattttcaaatgggaaagtcccttgaaaagatgaaatacatttggnaagagaataaatccnatgaagatggtttcccaattgccatgcttaagtaagggtaaacatccngttcaaactggactcaacttcccagcactaaanacccctgcaacaaggaaggacccctctaaaagccccaaaacactcctcaacccccgggtggaccatttaattttcaacccgaagctcctgcaaaggcctaaccacatgaaatcgggacaatctctgtctggaggattttccaatattacccctaatggaatggtggggaatggganaatnaatcaaaggcccctccnctaaaaacccaagtgtntaaacccaccggatctaaacnaatt

SEQ ID NO: 21713 - DNA, 399 bp, Triticum aestivum
  Clone ID: PAT_TA_21713
cagaacgacagttggcggttacagacctgtacaaacatttcctccaacttcaggactacaatgatagggtcaaaacagctgaacagaggctgcagtctctcgttgatgctgccttggtcgagctcgacatggccgaagatgctactaccagagatggctcgatgtacgagaacggcgtgctttgaacacccaactgccatgggtttgtgtggttgctgatttgttagatttgtagtttgcgtctgccatgtaatagaactgcattgtaactagaaacaggaaaaatgttgtgtaagggtcggagaatctgctgtcgtggtccctgagcccggatttctctttcgaagttgggttcattaaccggcctgattatccctgataccgttaaaaaaaaaaaaa

SEQ ID NO: 21714 - DNA, 524 bp, Triticum aestivum
  unsure (1)..(524): unsure at all n locations
  Clone ID: PAT_TA_21714
cggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacaagatgcctgacaaggagacggagccgctgttgngcgaccaaggacaacagcgacaccaaaaaggcgaacggggttgctcacgactgctaaagatgttcccgtttgccgttgcttaatagcctaattatccactcctagtgttactacgacgcactgttctgaatctcagaaancagggaagaatcatcctttttgtttcctataatattgtaaatgtaatatcctctattgcgaattataagccgtttcaattttttgaaaaaaaaagaaaaaagaaaaa

SEQ ID NO: 21715 - DNA, 517 bp, Triticum aestivum
  unsure (1)..(517): unsure at all n locations
  Clone ID: PAT_TA_21715
cgcgcaccactaccacggcaagagcaccaacgccgggaagaggcagcagcaggaggacctggactacggcttctactcgcagctgccgccggccaccgacgccgacggcaacgagaacgagcgctggagctggtagagcatgctgcatcgggacaagaacaagacagcagcgagaagaaagaaaaaacaataaattagtagcaataattgggtgggtgggtttggcatttgggcaatgatgcctgacgtggcgcctgcaggctttcttggtcctaatccctaatcctaatcctaatcccaatccatccagctaagacgtccacccccgggggtttgtcctgttgatttcccaccggagacgacgatgcagcgcttgccctttgatttccatggctttttctcgacccccctccgcctcttctcctgcactactactacttgtacaattcatcnattgattgaatgaatggcacgatatgacataattaagttttgtttgtttcaaaaaaaaacatgg

SEQ ID NO: 21716 - DNA, 649 bp, Triticum aestivum
  unsure (1)..(649): unsure at all n locations
  Clone ID: PAT_TA_21716
ggcgactggctcgtcgcgctcacgcaggtcatccagaaggcgctcgccggcgcctactacccggctctcgtggtcggcgccgtcgtcgagttcctcctcaacttcgtcgcgctcaacaatggcatactcggcatctttctcaacctcttcagatgtaagctggtgatcccactgaaccgggaggcgcccaacttccggtccatgatcgggatgatcgaaccgggaaggacggagctgaagccgctgccagccagcggcggcccagaggaccggcggctgcaggtggtgggcgtctccgccgccgccggttccgggcggcgatgactactactgggacgtggagagcgggcagcgccgcggtgccgctggtgcagcagcattacgtgaacgggcggctcctccgcctccgcacttctccgtgttccaagtgacatgatggcgccaagatcgcctacgagaacccgcctactccagaacgtcgtcaacaactctggatgtcacttcctggggttctaaaccgctggacaagtncgtggggacanacacccgctggtcgctcgacgggagcgaccggcgctgcgtgtggcgggctgcgcctacgtccctcatctggctctcgctgggcgtgctctggcntcatngttccagc

SEQ ID NO: 21717 - DNA, 704 bp, Triticum aestivum
  unsure (1)..(704): unsure at all n locations
  Clone ID: PAT_TA_21717
tcaagagggagctgcacctcctccagaccgccggggagaccccgtgcgtgctcgacgcggccggggggcgaaggagttcatgaagcagaatgcgacgggggtgatcaaagtggagatgcgcctctctggacggatcactctcgcctttggcaacaaggcgcctgctggagctcagctgcccgcgtcacgctgcaacgcccgccgccgggccccgatgtcgtccgtgttccctgaggtcggactgcatacctgacaagcccaagaaaatccgtcttctggacggaacatcaagtgtctatagtttggaatatttcttgagcatttcagcatgcatatattcatattccctctggtctttttactccgcgtataagatctctctgaaatcaaacttcaaaaagtttgatcaattttatagaaaaaaatatctacatctataatactaatgttacacaatatgagagttaaattcataatgtatctattgatatagatttcgtattgtaaatgtttttactttttttataaaaaatgggtcaaaccgtatgaattttgacttcaaacaaatcttatatgcgaagtaataaggaccgaaagtancaatgaccccccactangcaagttattgaccacccggtttatgagggtattttgtaaaaaaaaaaaaaaaaaaaacccgagactaaacccgnccccnccggggg

SEQ ID NO: 21718 - DNA, 655 bp, Triticum aestivum
  unsure (1)..(655): unsure at all n locations
  Clone ID: PAT_TA_21718
tgttgtccagtctgcgtttcgagcgttcttggctaggcgtgctttacgagctttgaaaggaatagttctacttcaagcccttattaggggccattctgttagaaggcagacagcagagacgcttcagtgtatgcaagcgctgggtaaaagcaaaagctcgtgtccgagcaaagacaagtccgtgttgccttaagaaaatcaagtggcacggaaaaagattccctngaacaagatgattcattgagaaccatgttccgagaagtccgagggaggctggtgtggcagtattggttccatgggaggaaatgcaagctaaagcactggaaaagacgagaagctgctgctaagcgtgagagggcaatggcatatgcntttgactcatcagcggcaagctggttccagcaacaaattcctttgaccctgcaaggtcctgaactntggtgagaaccactggggtccattgggggtcggcgggtggtggcccccatcgggggaggttactttccggtctccctgcaaaccgccaccgcaaaacaggtggggacgagccgatccacccgggtacgccatgggtaaccgccctcaataaccgggctcgaagccatcgggttctcctaagcactcacatgtcgccactcaggtacccacggtgttt

SEQ ID NO: 21719 - DNA, 555 bp, Triticum aestivum
  unsure (1)..(555): unsure at all n locations
  Clone ID: PAT_TA_21719
cccaaacagcctccaggtctagctagggtttcgtctccgccgcttgctctaatcctctcccggcacgcgacacgcgagggcgcagcgtttatggcggcgacaccggcggacgcgaagaccgaggccgccaagatggacctcctcgaggacgacgacgagttcgaagagttcgagatcgaccaagaatgggatgagaaggaagaaggcaatgaagctgtccagcagtgggaggatgattggggatgacgatgatgtgaatgatgatttctccgctgcagctgaggaaagaactggagggaagcaacgcccaagaagagctgaagtattattcccccagtttaacaattgatccttccaatgccagctacttcttggaatccggaccttttagtgatttggtgccgccgggagcatccaccccggggagtaaaaaataaccataccagtgatttccaagtttgaacgggaggaattgacggcacaatccggtatttaanaatacccattgggggtagatatccanagtctacctattaaacggtttccttcntcaaa

SEQ ID NO: 21720 - DNA, 430 bp, Triticum aestivum
  unsure (1)..(430): unsure at all n locations
  Clone ID: PAT_TA_21720
aggaaatcgacatgaacattgaaaattctgcagcagtgaccaaagaggcaaagacagaggtcgccaaagcagtcaagactcagaaatcgaattcgtccctggtaaattcagactaatgcaaactacagaagcattgttgccgtgcctattctgcactcctgacaaatcctttccgttgggcagatttgcttgcttatggtcatatttggggtcctgctgctccttgtgattatagttttgggcagcttggggacatgcaaccttttccccttaacagagctattcccgcgcgagttcaagaattgaagattgttccgnggtccttatcctaaccatcatatccgtgtggccaagaagaatgtccccaacgggttttagaaagccccccccncccctttaaattccgggcttggtantgagcggtctcttt

SEQ ID NO: 21721 - DNA, 669 bp, Triticum aestivum
  unsure (1)..(669): unsure at all n locations
  Clone ID: PAT_TA_21721
tttgctttcttggaagagtctaccaactcatatttctgaatcccgctgttacagcaatattataaattttataggaatacaaatcaattcatcatgaagtccacaacactacactggaaccagaatctatactgcaaagttgagagaaaagcacttagagcgacttgaaggcgttccttgggtccctcacaactgggagcacaaagctggggcgcaccagtctcattttctccctatccttcgccctcctcagtgttttccttgcccttggtcctcccacttttgggtgcctccctgggtgtacggatctccctgaattccccgtaccttgcgcaccctgtactcccttaagagattgattctggatagcagctcctccaccaatgttgccttggcgttccctatttttcagcctacttggagtagacctcagatgcaggctccacaaccgtaccaacttggganacttnggaagccttgggcttcccngccgcttgaatgctttttggncattacagcctcaacngnaacncgaatcttctcaacccggattaggccgggcnggagtcaacaacctgccngggtgtcctgaagtctccaaccactataacgcnaggcctggggananacctcanaccctcgtgntcaacaaccggcgngccgttggcg

SEQ ID NO: 21722 - DNA, 578 bp, Triticum aestivum
  unsure (1)..(578): unsure at all n locations
  Clone ID: PAT_TA_21722
gccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcaccctttgcggactataacatcccaaaggatcctacgcttcacctccctgctttaggcccgccgtggcatccattgaccctccgctgccagcgctccgtccgcaagtacaacccaagacaagatgattttggccgcaaatgctatgcacgactgcaccctaaggctgtncaactgccgccaagagaatgttggccacaacaaccactttagggccaagaagaaatttaagacgggggcggccccctcatctcctatggcgcttggcgggtgcgtggcctggtggcgtttttcctccctcgtttccctccgtgggcctccggttgctttacctggcgtctgcatccatccgttgtgtattggccgtccccga

SEQ ID NO: 21723 - DNA, 642 bp, Triticum aestivum
  unsure (1)..(642): unsure at all n locations
  Clone ID: PAT_TA_21723
tgcagatcaatataagttggcaggtagtcttccagaaaaaatgtccaacttaagcagccttgaactgatagatcttggttacaaccaactcactggggcaattccagaatcaatcgctacgatgggaaatctcgggttgcttgatgtctctaacaatcacattttaggccctttgccaacacagattggcacgcttttgagtatacaacgactatttcttgaaaggaacaaaatctctggctccataccaagatagcattggcaatcttagcaggttagattacattgacttgtccaacaaccagttaagtggaaagataccagcaagcttattccaacttcataaccttatccaaataaatctttcccgtaattccatggtcggtgctccgccaaccgacattgctggcctaagacaaatccgaccaattgggtgtttccaagtaacttctgggtggggagcatcccagatgcggggggacaccccaatatgccaaactanctgattctctcaaanaacccctgggaggtcaattccancanctccaaantgtcaaanncttnaaaggntaccntncccaaaaaaccccggggaanatccgaggcctgaactttcngtttgaagagnncnccccctaaagg

SEQ ID NO: 21724 - DNA, 478 bp, Triticum aestivum
  unsure (1)..(478): unsure at all n locations
  Clone ID: PAT_TA_21724
agaatttgcgcccagacattcctcgctgctgcccaagcgcatttgcgaatgttatgcggaaatgctgggatgcaaaccctgataaacgccctgatatggatgaagtggtgcagcttttagaggctctggacacgagcaaaggcggtggcatgatacctgatggccaatcatcaggatgcttatgcttcacaaaggctccgtggtccatagatacttttcatgggtaccccttcccttgggcaacactttcccccgtggttaaatggactggggccacagcatgctcccctttggcacgacctgtgcancctcccttaacagtcctccaatactgcctggcgattatggcgtgtcaaacctgttactcctcaatacatttttgccgtcctcccgccnacacctttcaatatactagtgtgctccggtatggggtcccaaaaagaatttggnatacgcgttaccccctaaaaaaaaaaaa

SEQ ID NO: 21725 - DNA, 424 bp, Triticum aestivum
  Clone ID: PAT_TA_21725
ccactacccctagatgttcgacggcgcaccaccgagccttctcctccccgccgacgagctgcggcggaagtttcagcacgcaggaatctccctggaccgacccatcgtcgtgacctgcggatccggcgtgactgcctgcatactcgctctggggctgtacaggatcggaaagcgtgatgtgccagtctacgatgggtcctggacggagtgggagggtcagtcggactccgattaccccaaagtcaccgctcctggtacagcttgagcgtctgggactgggagttggcagttttagactgccagcatgatggcattgtgtttgcgacaggctgaaccgattttatcgagcactggaagcattgtattcgctacggggtaggcctgctaatggcaaaaatccaacccaaacgccaaaaaaaaaaaa

SEQ ID NO: 21726 - DNA, 549 bp, Triticum aestivum
  unsure (1)..(549): unsure at all n locations
  Clone ID: PAT_TA_21726
gctcggtggtgtacgcgtcgttcgggagcgtcacgaagctcgccaagcggcagatgcaggagatcgccggagggttgcgccagtgcgggcggccgtacttgctggtcgtgcgcagggacggggtcgacgacgacgaaggcggcatccatggcctggagaacgacaccgagatgcaggggatggtcgtggactggtgcgaccagctggaggtgctgtcgcacccggcggtcggctgcttcgtctcgcattgcgggtggaactcggcgacggaggccatggcgtccggcgtgcccatcgtcggtgtgcccaacatgttcgaccagccgacgaacatgtacttggtcgaggaagagtggggggtccggcgtcagaggagagcgagacgccgatggcgtgctgacaggggcggagctggcaaggtgcattgagctggtcatgggtgatggcgcangaacagtggcataagggaaaggcaaaggccttccaagagacacccagcggcgccattcacaggcggcccgccgaacaacctttnactcgnaagacatt

SEQ ID NO: 21727 - DNA, 617 bp, Triticum aestivum
  unsure (1)..(617): unsure at all n locations
  Clone ID: PAT_TA_21727
tccccacagcgttgtcttgacctaccccaccggaaccgcagcaccctcaccaattcctccgatgaagccgaggccaactcggcgccaccaaggaggttctgcactcaccgctgcattttatcttttattcgatctcacgaggctgccggtgctcgacaccgagcagacatggcgggtctccatcgacggccccgtcgccggccacatcatccacggcgtctcgcccccgtctccctccttcccccttgacgccgccgctccggctctcgctcccgctgctgcgctctccctcccgccgcgctcgctgctgcccggcgctccctctgctgcgcggccctgctctactccggcccgcgctcgcgctgctcccgctgcccctcctccgactgctgccggcgccgctgcttcagcgctcgcccttggcgccgctcctcgtcctgcgctctccgtgcgcgctcccgcttccggnccaaggggggccggtaccaattcncccaaanganctataagccctnatggcgtntttanaagtctgacgggaaaacctgggtaccaaantaacccttnagaaaccccttcgcaactgngtaaaacgagagccgaacattccttcaaat

SEQ ID NO: 21728 - DNA, 523 bp, Triticum aestivum
  unsure (1)..(523): unsure at all n locations
  Clone ID: PAT_TA_21728
gtcccatctctctctctctcccccttctacatgacgttgtcgatgctgtagcggcagccggcagtgtatagagctagccatgctggaccacctcgtgtcgtcctacacgcaccgcagtggcggcgaccagcccgcggcgccctcgccctgcgacctcgcgtccgtggacgacgtcccgggcaacggcggccacaagcctggcaaggccgtgaccgcgtccgtgtaccgcgccaagatcgcggggcactcgcgggtggtgacggtgtcgtggtcccgcgacttcctgtcgcacgcgttctccgtgggcatctccggcgcggacggcgcgtccgccgagtgcaaggtggagctgcggtcgtgggagttctggcgccgcgccggggctcgccgcgcntngagctggtgggcngcggtccgcgttcggcggcnttccccttctgttgggactcccggcgggcgccgttcnccggcgggtgcccgaccccggngcggnacttcttgcgctggangcnccggcaagtgt

SEQ ID NO: 21729 - DNA, 402 bp, Triticum aestivum
  Clone ID: PAT_TA_21729
gacctcatgtacgccaagcgcgccttcgtgccctggtacgtcggtgagggtatggaggagggcgagttctccgaggctcgtgaggatctggcggcgcttgagaaggactacgaggaggtcggtgctgagtttgacgagggtgaggacggcgacgagggtgacgagtactagacgctctactggcgcggcgtcgtcgggcttgtgtgccactgctatcctgtgatctgccctgagtggctcctatcgtgttatgtttctgtcggttcttatctatctgtcgttgtgtggtttacaacttacgttgtaagactttattcccccgctttgctactgggttattaagtttggcgttattgttttcttgatctctgagatgctttgctttcacacctgttttttttt

SEQ ID NO: 21730 - DNA, 550 bp, Triticum aestivum
  unsure (1)..(550): unsure at all n locations
  Clone ID: PAT_TA_21730
gacggcggcggcggcgacgacgagcagccacctggggaagagcaggtagcaggaaatggcggcgttcctgaggtcaaaatgttcaccagttggacgtactttgatgggaagccttggaaatagtttgtttggggctgccaactcttctgttggggcaataacaaggccttctcattgcgatgctatcagtcagcaaatcaagaacattcatccagatgaggactaacctgaaggtggtccgataactcccggggccaagccggtgaggtgcatccattccctnanggggaaaaaggggannagggcncgggaaanntnttaaccggttcntaaaggaggcccatcctcgtggcaaggtcaagaaaggagacgtagtctacggcgtggtcgtccgtgccgccatgaagaaaggacgcagcgacggcagcgagtcagttcgacgacaacgcgtggtcctcgtgaacaagaanggcaactgantggnaccgcgtctttggcccgtccccacaactgaggaagaagaacactcaagatctggcctgctgaaana

SEQ ID NO: 21731 - DNA, 562 bp, Triticum aestivum
  unsure (1)..(562): unsure at all n locations
  Clone ID: PAT_TA_21731
gcaggttgatacttatcttcatgtgttccaagtggcttattcgggtaagcagagatgttgtcctgcagaacatcttctgaggaacacacctatatgaatttgactgttaacgttgcagtatgtgagaattaggtgttctctaataaattcatgaaaaggccctgggagtatgacgtatacgctccacccgcagggaaagccttgcggcagcccagtatcgatcaaggatttgtgtgaaactagcctcgcaagaaaacttgtagttcaaggcatagtccactattcaagttgtgatctagtgtagcataaatctctaagtgggaattcaactacacagtctccactaagcaccgggtatataaacaatgttttgggaccaaatggtgagatgtgccaatgagaatttgtgggggattgttggaatttgcntgtgggcttttgggccaaagccaactaaaatctgaaatctcctggncaatcagcacacatgtagtggagtgagtgagctaaagttaatccactcataantnaganaagtgcaccccttatacatgacnctcac

SEQ ID NO: 21732 - DNA, 565 bp, Triticum aestivum
  unsure (1)..(565): unsure at all n locations
  Clone ID: PAT_TA_21732
tgagattcaaagaactatgttggagctgctgaatcagctagatggttttgactcgcgtggagatgttaaagtcattctagcaacaaaccgcattgaaagtcttgatcctgccttgcttcggccaggccgtatagaccggaagattgaattccctctcccagatattaaaactagacgacgcatcttccagattcacacatcgaaaatgacattagctgacgatgtgaacttggaagagtttgttatgaccaaagacgagttctcgggcgctgatattaaggccatctgcacggaggctgggattgctcgccttaagagaacgcagaatgaaggtgacccatgcagatttcaagaaggcaaaggagaaggtgatgtacaagaagaaggaagtgttccggatggtctctacatgtagccgacctctcctgcctgcccaacaactacccgcctccgtctctcccggcacggctctcttcatggccacgtacgtgtcgcactccttgttctgacgtgcaagtggtcaggagaacctgtataataaataccttcaatgnccaaagtaaat

SEQ ID NO: 21733 - DNA, 663 bp, Triticum aestivum
  unsure (1)..(663): unsure at all n locations
  Clone ID: PAT_TA_21733
aaagaaggctttgcaataaaagctggctggccagtcgcagacaccccggatcctacactgagaattgcaaataaatacctgcaggattccatagttttgatgaggaaactgcttcagaagcaagagtctggttctaagaagcctaagaagggagctgcaccggcacctccgtccgaggaaaagaagatgagcattggtctcatatatgtgaacgagcactactctggatggaaagagcagtgcttgagggtgctgcagtccaagttcgacagccaaagccgctccttctcacccgatcaaggaaatagcagaacctctgaaggagtgccccatccgggcaaggaaatgaacctggaagcaggtcaagaactgtgcatgcccttcatcaaagctggaagaaggacgaggcaaggagttggcctccaagcgctgggcttgaacttcatccggtgagatggtgttctcccgggagaattggactgatcaagagnaactggccttgacaatcnagtgtctccgcttcngacgaactgccncgctaagtggtgaaatctcctctagagaagaccacacaccgggacccacgcatctctanaacaagtgaaataactnaangcctttgtattantccgaattccctttgtttgttgacanttcgcgcaa

SEQ ID NO: 21734 - DNA, 417 bp, Triticum aestivum
  Clone ID: PAT_TA_21734
tttttttccacatcaatcttgaactaacgtcacaacatttcttcccttcagggactacacgcttattatacgtatgtttcacccatacgattcacattacacgaccacatcctattctttctttcattcttgcgcgctagtaataacagtagtagtacggtttacttcacataaacacagcatacaggacactgtttcttcacaaatacgtagtataaggccattgagcctgctagacactcaggtgacaggtggtagagaagcagcggcagatagctggtttaacgatgagatcaggtgtaggaagcacgagcctgttaatctcaagggagggtcttcgtagagatgagctcgaacgacagcccattctcctcgaggcgcttctggagatctgtggggccgaagacggcgcccggc

SEQ ID NO: 21735 - DNA, 817 bp, Triticum aestivum
  unsure (1)..(817): unsure at all n locations
  Clone ID: PAT_TA_21735
ggcacgaggcctagcccactgccaaggcccaacggaaaggaggttctcttctaagcatataaggtgctgcatgcaatgggtaatgccactgatatctgggatcttgttcaggtgcgcagctcctttgcacaataccaatcaagaactgattaaagcataacagagaaggaaggaaatataagagggaaatgaaatctcgcgcagcttgaaactttataaggataagctgctcgtggtaatagtggaaggaacaccgtatccatgcagatgccttcctgcaccaacactcatgtgatggaaaacatcaatattctgcagacgccgtctgaacttctagtaattgagcagcagttgcacttgcatgtatgatatcccacagtttatcgggttgttgtatatataatagcaaagattagatgtttttgtcaggctgtcaagactcaaagtatgatgacaactgaatgctcctgaatggggggagatccatgangagcatgggtcccctttctttcggggaaatattgccggcatttattgtgtaacaatagaactaggattaactgtcgataaagctgaaagttcgtctctctccctctctagtaggaatcangtgtagctatatgttgccatgtaacaatatttttggtctaccatcgattatttattgagagaatgtccanaacaaggttttaaaaaaaaaaaaaaaaaaaactcgagaggtacttttaaagcggncggggccccatcgattttcncccggggggggggaccaggnaagngnccccaattnncccctaaanggaggnnnattacaaat

SEQ ID NO: 21736 - DNA, 619 bp, Triticum aestivum
  Clone ID: PAT_TA_21736
cgccggccgacaaggtgctggcctcctcgctcgtggaggtggtcgacatcatccgggaggccaaggacaggatggccgtcgagttctcccgcttcgctggggaggagacggaccaggacccgttccagatgaccttcaactacgagtccatctacgtctccgactggagcaagctcggcttctccgaggtcgactacggcttcggcccgcccatcttcgccggcccgctcgtcaacaacgacttcatcgcctccgtcgtcttcctcaaggcgccgctcccgctcgacggcaccaggatgctcgccagctgcgtcaccaaggaacactccgaggagttcgcccgtggcatgaaggaagacctgccctgaacttgttcttcctagcttattatatactgctgatgatcatcctgagccctggctgcagggagatgatgaatggtgacgtaaacatgcttctgtttcgttgatgctgttggtacttttggttgtattttttttggggttcactttatcttggtcaatacgtaccacattagatcacagcaagcaaattcgatcttaatttgtactacaccatttgatatgagaccgagacaataaaaaaggttatactgtcc

SEQ ID NO: 21737 - DNA, 389 bp, Triticum aestivum
  Clone ID: PAT_TA_21737
cgagtttttttttttttttttttttttggtatggtagggtactatactgacatcaagccatccttgttacaagcacaccatccatggctcagccaatcgaagagaagaggaacgttacataccatatactatcacgatcaagctccaggtaaccgaccgaccactcatattgtacttacttacttagcccaataatcacaccctgcatttgcacatccttccaaccctaacaacccacggagaccaaaccaaacgtcaaggcatctttttttttctactccctttccgcgccaagaggattcgccaagaaccaacctctctagctagaccggtatcacgtccaggccagacgtgtctcgcatctcaaggacaaggcctccaaggggggg

SEQ ID NO: 21738 - DNA, 631 bp, Triticum aestivum
  unsure (1)..(631): unsure at all n locations
  Clone ID: PAT_TA_21738
ccgacctccagacgaaaccacccaagacgcgtgcttccattcctagcccaacagaagcgaagcacgccaccgaccaccggcctcgaagggatcatcttctctacaactcgtcctcgtggccttgttcctcctcttgtataggggactgcggcggagtggagatccgtgccgacatagtccgacttcttcgctcgctgcctacgattgatggcctcaccttcaccaaccgaagagttcagcagggaagcagctcgtcagtctctgatcgcgatctccgagtccactccgggagacaccttcaccgccagacggtgaggacaccgccgatctccaagcgcagagaacgggaagcgggcgatggggcggacaagttcagatcaaagctgatgtccatcacagacctgtcttctgatgcccaacctgcgcagtgccctccccgaggatgtcgctgcttgtcatcggtgtgatcttcctgctcgacttgcggacacgatgtatcagtgcttgcggtcgctctgcgcgctttgctggcctgctttaaccggagccccctggtgtgtctttcggtcgtccttggtaaaatattcaaggaaacggtggaaatatatgggcaaagttccctaccgttgan

SEQ ID NO: 21739 - DNA, 709 bp, Triticum aestivum
  unsure (1)..(709): unsure at all n locations
  Clone ID: PAT_TA_21739
ttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatctggggctcgacagcctgggacaccgtcgaggtgggtcatggccatcgaggaggattcaggtcgagggccgggacatggaggctgacaagattgatcatcccttctgggcatcgattagttcccaaccaaccaatggctgcttanctntgtcnccccaanaagagcaatttaagttagnttcnctggttttgtttcccaaggcaataactgctggagtngacagaaacttttccnggngctctgcatgcttaacgtacggtatatttcaaatggaattaatttaacgtaatgtttttgntgcttaaacnaaancggtgaaaacaattggtatgatcgatntgttggtattaatggtctaaattcagaaattacgttcagtcttgaactaataaaangttaagntat

SEQ ID NO: 21740 - DNA, 503 bp, Triticum aestivum
  unsure (1)..(503): unsure at all n locations
  Clone ID: PAT_TA_21740
accctctctatcgaagaccctgctgttcctattagactggaagtttttgacaaggacactttcgtcgatgatacaatgggtaatgcagaggtggacatccgcccattagtcgagattgtgaagatgaaactccaggacgttgccgacagaaccgtggtaaagaaactggtgcccaacagacagaactgcctagccgaggagagctcgatatatatatccggaggggaaggtgaagcaagacatgggttgtacggctgaaggaacgtagagagcggggaaatagagctccagcttcaagtgggatcgacctccctggctctaagggtgtatgagtggggggcggctataactctgccttgccctgctgttttcgcggtctccaactctttttcnacttgaaaagaagactagtggttgcggcgctccctcgcgtaaactgtcaattgtatgtaagaattatgatgccttggcgtttagaaaatacgtcagggaaaaaaaaaaaa

SEQ ID NO: 21741 - DNA, 740 bp, Triticum aestivum
  Clone ID: PAT_TA_21741
ccaaagctttggatccttattcagagagtcgtggacgagacattctgaggtgtcaactttaattactagcagaatccagtggaacctgcggacacgatacatgcacagtacgtcatgcataactcatcgattagccggccacataccatgcatggagtaaacaaaagagaatgtgctcaagacagaaacactcacccaaaatggtaaggaaatagaatatcacttttgagttcctgctttgtaagaaactgccacaggtctgcctccatgtcggcggggtgatgctccaacacatatccattaacgatgtgtgggtcaatgaacccaacatcatggatgttccttactctgcattccttaatcttcattctgcatgtataatagcggacacaacaatatagttaggacatatatatagtgcaggcaatatgaacgagatggggtagaaattataaatcacttacagaacgtagcaactgatgatagatttatcgagctcgcgcagattgaaaagctggaacaattcactcagatgaatttgtacatagtaatgtttgaagtgatgctcatatctaacttccgcataaatatattctttggcgtttttattttttatgtaacccttgtaccatttcagcagacctttcatttgtggaggtagatccttttcctgcgcaggctcgacgagaggcccattcttcacatatgttaattactacctccttcactggcgcctcatc

SEQ ID NO: 21742 - DNA, 546 bp, Triticum aestivum
  unsure (1)..(546): unsure at all n locations
  Clone ID: PAT_TA_21742
gcaaaaccttccgtcggaggatggcttccgccggcgctggagaagggaaggagacggctgccgggagcagcctccacagcaagactctcctcaagagccaaccactgtaccagtacatactggaatccaccgtcttcccacgcgagccggactgcctgcgggagctccgcgtcgccaccgccacccaccccatggcgggcatggctgcgtcgccgtgacgaggtgcagctgctgcagctcctgatcgagattcttgggcgccaagaacgccatcngaggttggcgtcttcaccggggtactccgctgctccgccaccgcccccgccctccccgacgacggcaagattngtggccatcgacgttaccccgcgnagagctacgaccagatagggtccccggtgnatccaagaaggccggcgtggcgcacaagatcgacttccgcgtccggctcccgctgcccgtgctggaccaaatgtggccgangaggggaacaaggcaagtccgacccccgttcgtggacgcgacaagtaactcctcaatacacag

SEQ ID NO: 21743 - DNA, 1136 bp, Triticum aestivum
  unsure (1)..(1136): unsure at all n locations
  Clone ID: PAT_TA_21743
tggaaacctgctaagtggtaacctcccaattccggggaaccctgaatttaaaaagggcatcctggccaaatccgtgttttgagaaaacaaggggttctcgaactaggatacaaaggaaaaggataggtgcagagactcaatggaagctgttctaacgaatcgagttaattacgttgtgttgttagtggaattccttctaattctaaattagagaaagaggggttttataccttatacatttaataaacacgtatagatactgacatagcaaacgattaatcacagaactcatattatattataattataatataggttctttatcttttttaaaaatgaaattagaaatgataatgattatgaaataaaaaactcataaaaactcatatcataattttttttcattattgtgaatccactccaatcgaatattgaataatcaaattcttcaattcaaattcaaagttttcgagatctttaaaaaagtggattaatcggacgaggacaaagagagagtcccattctacatgtcaatactgacaacaatgaaatttctagtaaaaggaaaatccgtcgactttataagttgtgagggttcaagtcccacctcggccgcgaccacgctaatcactagtgaattccttattcccctttttcttcctcggttttttcttcttccctctgcgtctaagatgcattanctttctcattctactctttcacaaaggaatgcgagngagaactcaatggatcttatcctattcattgaatagatttcttttttattaagagtatccggcaagaaacctgggtatcactctattttaantttattaatnaaccatgcacaatgcataggactacccccatttcaaattttaaatttgaaatactttaataattttagtcctttaattgcatagatcaaataccnactaggaggatgcacaagaaaagncagatagccaattggtnagcacagacgaaaacctcgtgtcacagtnaaaccngtccggcagagaaanaacaaagtcacgataggatgtcaatacncagggggccgtaccaatccccaagnatcgntagccccaaggcgtctttaagcnanggaacctggtccantatccttnaanccn

SEQ ID NO: 21744 - DNA, 551 bp, Triticum aestivum
  unsure (1)..(551): unsure at all n locations
  Clone ID: PAT_TA_21744
aacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggtccggggtcaggatcggggtctgtatccaaaggatgtcgctggaggggctggcgaagagggcgcagaagcgagaagcggcagacaaggcagcggcagagaacaccttgaacacctgcaagaggtttggggctgcagaaatcccccagacctgtatatgccgtaggaagtttggncacaggtgaatgagtgacttaaccgcccctatggctatatggtgctgctaaaaacactgcacccttttgggccacaaatacttccactgggaaaactttaacctggcttttacaaggaacttttcccnccgtggtcanacccattcccaacacgttttttcccccaaatgcactgctgctgcacacgtttcantanaactgattnccanggtggggccatttagtttgcaa

SEQ ID NO: 21745 - DNA, 425 bp, Triticum aestivum
  unsure (1)..(425): unsure at all n locations
  Clone ID: PAT_TA_21745
ccaacagctcgctttgcgggcggccgccccggctggtacttctctatgttgtctgcactcctatccaggtataggcgtctgaagcaatctttcttctctttaagcgccttctggacatcatcattccaccaccaggtatccttatcttcgcttctccttcccctggacactccaaactcctccgaggccaccttacgaatgcaagtcgccatcttcatccacacattgtccgcatcccctccttcctcccaaagggccctccttaatgaccctctccttgaacacctggagctacctcccccttggagcttccaccacttcngttccaagcgaccttggcacgcttatcccgctggacacgaatccgaaagtggaagtcagcaaccaccaacttatgctggggtacctcggccgcgaccacgcta

SEQ ID NO: 21746 - DNA, 651 bp, Triticum aestivum
  unsure (1)..(651): unsure at all n locations
  Clone ID: PAT_TA_21746
caagcgccttcaaactttcagaacacgcacttctgctagctagctagtagccatggcttccgcagtctcgtctctcttcttcgccacggcgctcgtgatgatggccctcatgatcatgctcgagggcagcaccacatgccacgccgcgcggcatcttgccgacacgacgaccgccccgaccgctgctcctaccgccatcccggccattcctgccatgccgaagccgccggtcgtgcccaccgtgcccgcggccacccttccaccgatacccgccgtgccgacgtcgacggtgcctgcgctgggcgtgccaccgatccccgcgttgcccaagatccccgcggtgccccctatgccggctgtacccgcattgccaaaggtgacggtaacgctgccgccgccgatgcccgccgtcgtcgtccctaaggttggcgccttgccgccgatgcccgccgtgcctaagctgacactgccgccgatgccctcgattccgggcgtgcccatgccgtttgtggcgccgcctcctccgataatcaattaacaatgtctgatagactgccatatatctggtatccacggagtcatcctcgcctggccatgcgccattgttctcgctggggcccctgcctcaaaactgnntcgctttagtaangn

SEQ ID NO: 21747 - DNA, 516 bp, Triticum aestivum
  unsure (1)..(516): unsure at all n locations
  Clone ID: PAT_TA_21747
gtgggaacaaggtgaacctccaatcaccacttgggctcaaatgaaggatgtcatgcccacctactacaattgcgatctcttcaagaagctacaactcctcaagcaaggaaaaaagagtgttgaagaatactagaaggaaatggagatagccatgattcaagccaatgtcacggaagatgatgagcaaactatggcacgcttcttggaatggcctcaaattatcctatcatgagagatcgccgtctttcaagccctactccaacctcattggagcttggtgcaccaaagctatccaaggcgcgaatgccaagtgcatggttgacttcaaagtacgccaagtatcatcccaagaactacggttctccaccatcnaagttcancgatcctccaattctacctccaaccaancaccttcaaccaaggacaacaagtaaagttccaagaaactccgcagctccagggggggcccggaccattcgcctatagtgagnngattacgnggtcatgcgtcggttt

SEQ ID NO: 21748 - DNA, 359 bp, Triticum aestivum
  unsure (1)..(359): unsure at all n locations
  Clone ID: PAT_TA_21748
cggcgcttggagaggccatcgggttggtggtcgggcagtggacagcgctgcaggtggcggtggggcagcagcgactcccatgccaacgttgatcaattcagcgaatcaatcctctactggttctatccctcaagggtacgtacagctccttcagtaatcagcatccttagataaataaaataatatgttccttcttgtctccttggaggcgggatcctgtagtaaagttggatattgtttactttagcatctgaattctcctaagatctagcggcatgatcgtcaactacttggctttcnagaccgggtgcagcaagaatggctccactttgtggctgcatggctccgaaggggggggg

SEQ ID NO: 21749 - DNA, 214 bp, Triticum aestivum
  Clone ID: PAT_TA_21749
ctcgtgccgcgattttgtctgctaggaatctagaaagagtttttcttttcttttttgccatgtgctgttgctgaaacattgaaccatcagcatcaggcttcgacagagctgtctgatgtttgttcatcaattcatcaccagtgtaacactacagattgtaacatttggaatctcaaggataggaattaaaaatgttctgataaaaagggggggg

SEQ ID NO: 21750 - DNA, 439 bp, Triticum aestivum
  Clone ID: PAT_TA_21750
ccgagctatcgtctgttgagggaaatttgtcgccgtgggtagcaaatagccgcaacaccgcagtaggtcctcgccttcatcacggctccggtcttggggagaagcctgagcatgtcgccggtacgcgttgatggtgctcctgggcgcctcgtatgaaaacgacggccgaggaccgccatcgccactaggaagggaagaacagcacaactgtcgttgacccgcgtatgtgctactgctctcggctagctcgggtaacgtaggagcttcgctgacgcttgaggatgtcgtgcatcgcttcttccgtgggagaattccgggcaacagagcgtggaattgctccgtccggtgtaaccgttgtcgccggggcaacctctatcggttggaccgggtgaaggactgcgcgttcaacaatacaaaacattcccttaaaaaaaaaaaa

SEQ ID NO: 21751 - DNA, 623 bp, Triticum aestivum
  unsure (1)..(623): unsure at all n locations
  Clone ID: PAT_TA_21751
cttatattggattattttacgactgtgggagtacatgcttgcatcttacatgtatatcatttttttcaaacacaatagcatccttctttgaaataatgctaaacataacatcttgcaatacacggtgcctcctaataaacatcctcaagctatctactacgctgaagaatacatcttccctgggattttggttgtcatgggttcattggacaaaattttctccctgggactttttcccgaagtcccataattcataaagctcacctcctttaaccaaccaaagaataacaataacccccaaatgtacatggcacaaggtacaacaacgcaggttgaccatgcccgtcccctcaaagaacagcgcaagatacgtaatgaaaaggcaactgcatatcccacaattaagccagagaaataccantccaagaactttccggtttgcnccggcaaaccatnctgatccaacaagnatccaagggaagatatgcaccaaagctaccattcataaccacccaagggtcaangaacgggtacctagngcataggattgatccaggtacacacggcaatnaacatgccttcagatataggggatgncncaagtgcaanatgagactanaggc

SEQ ID NO: 21752 - DNA, 228 bp, Triticum aestivum
  Clone ID: PAT_TA_21752
agtcgttgaagctgctgctgtatctgggttatctagtgtctctgccattgcccatggatggtgctgtctttcaaagtatttgtatggtttgtgtcgtgagtcgtgactgagctggtttcatggaccagttgtgttctccgttacccaaaactatccgtgcgaccgcatatggcttaatcatgaataaatgttgtttggatttaaactattcgctggaaaaaaaaaaaa

SEQ ID NO: 21753 - DNA, 615 bp, Triticum aestivum
  unsure (1)..(615): unsure at all n locations
  Clone ID: PAT_TA_21753
cgcatctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggttacattggcgagttcgagtacgtggatgaccacagagctgggaagatcgtggtggagctgaatggaagactgaataaatgtgggtgttattaagcccacgttttgatgtaggtgttaaggagatcgagggatggacggcgaggcttcttccatctcgccagtttgggctacatcgtcctaacaacttctgctggaattatggaccatgaggaggnccgccgtaagaatgttggtggcaaggntctaggttccttttattgaaaatgtgtttttttgagccacagatgcgtcaagaaccgcctgatgttttgagggtgttaagccggggtcgaaccttgnggttgtaaanacatggcannattnaaattggattttgaatgtccncananctgcgttccattaa

SEQ ID NO: 21754 - DNA, 499 bp, Triticum aestivum
  unsure (1)..(499): unsure at all n locations
  Clone ID: PAT_TA_21754
cgccgtcaaggccaacatcctcggcatcaaccttaacctccccatcgacctcagcctcatcctcaacaactgcggcaagaactgccccaacgacttccactgcgcgtagatcatcagtcagtcagttattgatcgtcgtccatcgccggccggccgtggttcatcgtcatcattccgttttgcttaattgttgatcgatcgtcttcttcctgtcagtcccagcagcttatttattttaaatttgtctctttatacatatatatgagtggtgtggttacacttctacatagcccaggcagcggctacgacgcgtgcgtgtatatgtctggcctggggtgatcagttaattactgatcggtgttgcgcagtagtgcagtacgtatattcttcatttgtagtcatgacgatctgtttgcatggttcgttcaataaatgaagttgacaagttgtactttctttctaaaaaaaagcaaaacgagatcgagcgcgggnggggggg

SEQ ID NO: 21755 - DNA, 623 bp, Triticum aestivum
  unsure (1)..(623): unsure at all n locations
  Clone ID: PAT_TA_21755
gttgtatcggcaggtgtgaagtccattttggacataccgcggacacttgaatacctggaaactgaaggggtgactgttgctgcttacagaaccaatgaatttcccgcgttcttcacagaaattagtggatgccaggtgccatgtcgtgttgattctccagaagagtgtgccaaaataatatatgcaaacaagaacctacgtcttgggttctgggattcttattgcagtaccgatccccaagcagcatgcaacttcagggaaaattatagagtctgcaatacagacagctctaaaagaggcaggggataaaaggataataggaaatgcgatcactcccttcatgcttgaaagagtaaaagaactaactgggaggatctccctgggaagctaatattgcacttggtaaagaacaatgccctatgggtgcgaacattgctgttgccctttctaaccttcagcaagagagaaatagcagaatgggaagatccccttgtagggtacgcccccggtggagtacacaggagcaancattcaggatggaactactgaagntggaacggtgtatnanagtgcngagncgcaagaaagttgcgcacttgacgtatganagtggcacatgncna

SEQ ID NO: 21756 - DNA, 261 bp, Triticum aestivum
  Clone ID: PAT_TA_21756
cctcgccggagtagccgcgcccaccgtcgacctcgcgccgtcccatcgtgtccaacagctccgccgtcgcctactcctttgagcaggttgagccccgagcgctcgcttgccccgaagcctctgctccgacctcgccttcgccgctcaccgtcggagatcccctccgccgtcaccactgcaacagctcgcccccgacctcgccgtccgctccgtcgcaaccaccgtgagcctggccaccttcccatcatctcctctctccct

SEQ ID NO: 21757 - DNA, 642 bp, Triticum aestivum
  unsure (1)..(642): unsure at all n locations
  Clone ID: PAT_TA_21757
cgattgcggcgccggcgcgggcaacggcaccgccgccaatgtctgcgacccttcgctcgtccacacggcgattacgctcgacgaggagtacctgaggggctccgtcgccgcggtccactcggtggtgcagcacgccaggtgccccgagagcgtcttcttccacttcctcgtgtccgacccgagcctcggggacctcgtccgcgcggtcttcccgcagctccggttcaaggtctactacttcgaccccgggcgcgtccgcgggctcatctccacgtcggtgcggcaggcgctgggagcagccgctcaactatgcgcgcaactacctggcccgacctcctccgagccctggcgtgcgccggcgtcatctacctcggctccgacctcgtcctccgtcgaacgaacgtcgccaagctctggcggcaccgactcggcggtccgaacctccggcgctcccgagtactggcaacccaactttacaaagtactnaacgggcggtctggccggccacgcgcccgccgctcttcctgggcggggcgtgtacttaacacagngtcagggcttactcaacgtgnggnaacggtaaccaggatcacgctgtgnntnaaatcccncgggngattanaannggcctgcgctcngnag

SEQ ID NO: 21758 - DNA, 603 bp, Triticum aestivum
  unsure (1)..(603): unsure at all n locations
  Clone ID: PAT_TA_21758
gggagttccaagtcggcccgactgttggcatttctgctggcgaccaagtgtgggtcgctcgctaccttcttgagaggatcactgagatcgccggagttgtcgtcacatttgaccccaagcccatcccangcgactggaacggtgctggtgctcacacaaactacagtaccggagtccatgaggaaggacggcgggttcaaggtcatcgtggatgccgtggagaagctcaagctcaagcacaaggagcacatcgccgcctacggcgagggcaacgagcgccgcctcaccggcaagcacgagaccgccgacatcaacaccttcagctgggtacgccgcgcccctcgccttctagttctggatcatctgaatctttccacatctcgttactccgacagtggttctgaatcatctgaatgactgcagggcgtcgcaaaccgtggcgcgtcggttcgcgtgggccgggagacggagcagaacggcaagggctacttcgaggaccgccggccggcgtccaacatggacccatacgtggtcacctcgatgatcgccgagaccaacatcctgtggaagccctgaagccgatnggcgccgatngccgtgcga

SEQ ID NO: 21759 - DNA, 709 bp, Triticum aestivum
  Clone ID: PAT_TA_21759
atcttctacaagccggctacatagccaaagcactcgaacgcgtatagaaaacatgtcgagtcctctgcttgttgcaatggccgcggcggcaatcgtcgtcgcctgctgtttagcggcgtgtccggtcggcgcgggcgcgagcgctggtgacttctacgacaacttcgtggtgaagtggggcacggacccagaccccgaccggcgggtcgagatcgtcgacggcgggcggctggtgacgctcaccctcaacaacgtctccggcgccgggttccagtcccgggacgccttcctcttcggcgagttcaccatggagatgaagctcgtgccgggcgactcggccggcacggtcaccaccttctacctgacatccaaggacccgacggcggcgggggacgggcacgacgagatcgacttcgagttcctgggcaacgtcagcggggagccgtacctgatgcagaccaacgtgttcgcccagggggtcgggggcagggagcagcggtcctacctgtggttcgacccgacagaggacttccacaactacaccatcctctggaaccctctgaacatcatcttctctgtggacggcgtgccggtgcgcgtgttccggaaccacgacgcgaacggcgtgccgtacctgagcaggcaggcgatgaaggtgcacgccaccatctgggacggcgacacctgggccacccgcggcggccgggtc

SEQ ID NO: 21760 - DNA, 764 bp, Triticum aestivum
  Clone ID: PAT_TA_21760
tagatccggcagctatatcgacgccattggtgtttacatgtatcccaacgataggacgacagtcgggcttatttctgtgccgctgattctcgatggccagggcttgcccacccccactaagagtggatcctggggtggaagcggaggtagtgctcgagacattaatcaaaagtcctggcgtctgacaagtctcacggttagctacaaagggttaatcgatgcattctccttttcttacatcgaccaagctgggaagaagcaaagtgttggtccttggggcgaaggatactacaatgacacgactaagacgatcagctttggcccagcggagtttgtcaaggaagtatgtggagcatacgggaatcacaatggaatcgttatcgtgaagttccttacgtttgtcaccaacgaaggaacgtacggacctttcggaactcctgatcatccaggtccagacgtgtcggcaactcatttcaggttcgtggctgacgagggcagcaccatcgtggggttctatggtagatctggcagatatattgatgccatcggtgtttacacagtgcgagttagataattttgatgcatgaaacgccggtgtgacgacaatctattggtttcatctagctgtgttttcccctcaggcttgaaactcatctacactagaatggcagtatttgtaattcacttgtgctgtcataggccagaaaaatataacgattaacatgatatatttattatacttttatctatagccatggattcgc

SEQ ID NO: 21761 - DNA, 510 bp, Triticum aestivum
  unsure (1)..(510): unsure at all n locations
  Clone ID: PAT_TA_21761
cagaagcagcttgcgccgccgcctccgtcgtctcagaagcagccggagaaagcatggatacccaggtgaagcttgcggtcgtggtcaaggtgatgggccgcacggggkcgaggggtcaggtgacccaggtgagactyaagttcctggatgaccagaaccgtctcatcatgaggaacgtcaagggccctgtccgtgagggcgacatcctcaccctgctcgagtctgagcgggaggccaaggaggctgcgctaagaaatttcttccttcatacctgcctgtcttcaggacgaagaatgatgtactgttgccttctttgtctantgctttcgttctttgcctagctatgtggaggtgtactgggttttgttctgttgcctaaattaaagtgcacttgatgttgtgagacttgatcattgtcgcaactccttggtaaagtgaatcgtgaatcgtctatattggattctaaaatgantttgaaatcaaccatgtgcctgtggtggggntcaaaaa

SEQ ID NO: 21762 - DNA, 690 bp, Triticum aestivum
  Clone ID: PAT_TA_21762
ttcgagcggccgcccgggcaggttgaagttcgatgccaaggagccaagattcgaggccgtcaaggcgccaaaggcagcttaagcttaatcaaggagactaaaagaaaattatttacttattagctggcttttgttttacaatgaagaaaaaaaaaaaactgtcctgtaaatcatcaggcaaaaggggagctacaagccttcatacacactgggaaaaccagcgaaaaggagcatgcatcgcgatgtgcggctgttctgggtggagacgagagtttctaaggagcggaaggtttcatttattcaaaacatccagaggagcagctgcccttccaatgtggatttacgcgaggcatgagtaggccagcgccttctcctccgacagctcctgggcggtcgcatccatcttcttcctcgagaactcatcgatcgggagacctgcaagatgacatacaataaatatttggcaggtggctacagattaatgtggtcacacatgtgcgtgacagacaagtagaagcatgggaagaatatatgaaccaaagaaactgtcatgcggttaagagtgttgcgtcgacacccaccttgaacaattgtccattcaccaccactgcacgttactgggaaggagtagataagaccagcaggcacaccatatgaaccatcagagtacctgcccgggcggccgctcga

SEQ ID NO: 21763 - DNA, 488 bp, Triticum aestivum
  Clone ID: PAT_TA_21763
cgtggtcgcggccgaggtgtgggagttccaagttggcccgactgttggcatttctgctggtgaccaagtgtgggttgctcgctaccttcttgagaggatcaccgagatcgccggagttgtcgtcacatttgaccccaagcccatcccaggcgactggaacggtgctggtgctcacacaaactacagtacacaaagcacacacatacacccatcactcgctagcatgcagcgagtagaccgaggcaagaaaagaaagttacaagcactagtagataagtagtgccaaccagaatgggaggattttactcccctaggtgagatgacatcttcgtgttggcccgctgggtgggttagcgccggtaggaaattcacaggagaaatcgccgtgcgcactgatgatctcagtagcaccgaagcgccaactttgcttggtgttgttcataatatacggtcttccgagagagtacctgcccgggcggccgctcgaa

SEQ ID NO: 21764 - DNA, 670 bp, Triticum aestivum
  Clone ID: PAT_TA_21764
cgagggaaaaagataggcattgattagtttctttacatagagataagagagataaaggatttgggaatggagatccctcctcattcaactttatattaatgtttgaataacggatgctcctcacattcagataaacagatataaaaccttataccttccattctccttcctgagaagtggacggtttccgaattaattttcaatcctggaaggatacaggtacttccactagacttgggtccagaccagttcgcaaccaaatgaatatagtgataattttagttcctacttctggctggacctcaaatatccatgggaggataacataatccttgcatctcaaacagggcctaacatagcatcatcatgtgcactattttatgaatatcgatctgggagttctagtcgcgattttgtgttaccttcagtatataatctcgtattaccataatagaaggaaaattctactcaggaaaacaaaacagccgttagaaaataaatcttgtattgcttgcttacaactggatgcaggatcgaggttaaacggccacataccagtatggtccaaggccaagattctactgcccaaaaggacaacgccagtgatgaacaaagcaaaaagtcttgagcccattttgtctgttaataaagagaggacaagcaattaatc

SEQ ID NO: 21765 - DNA, 656 bp, Triticum aestivum
  unsure (1)..(656): unsure at all n locations
  Clone ID: PAT_TA_21765
catgatcaggccctcctcaaaggtgatcatcaagttcctcatcgtcatgcagaagcacggttacattggtgagtttgagtatgttgatgaccacagatctggcaagattgttgtggagttgaacgggagactgaacaagtgtggagtcatcagtccccgttttgatgttggtgtcaaggagattggaggggtggaccgccaggctgcttccatctccgtcagtttgggctacatccgtcctgacaacctctgctgggcatcatggatcacgaggaagccaggaggaagaatgttggtggcaaagtgctaggtttttcctactggagcggaatttgtgaaagtgtatttcaagaccggtgtgataggatgttactcaagacacaaggtgtctactttttgccctgcatactgcatcctttgttatgttatgttggttccgggaatatgnaagacttcgaatttaaaaaaaggggggccggtaccatncccctatatgancntataaccgcctcacggcctcgttanactcngacggaaactgngtacaactaaccctgagaancccttccactgggtatacaaaggcgacgtgnctccaatncnactaagcaaggacccccgtcggatacccgngttgngaccactnccnantcagg

SEQ ID NO: 21766 - DNA, 423 bp, Triticum aestivum
  unsure (1)..(423): unsure at all n locations
  Clone ID: PAT_TA_21766
cttcctgcttgccgctctcgctccgcagacgccgccgccgccgccgccacggccagagctcgactcgctccctaggaggtaaggatggtgagagtcagtgtgctgaacgatgctctcaagagcatgtacaacgctgagaagcgtgggaaagaggcaggtcatgatcaggccttcttccaaggtcattatcaattccttatccgtccatgcaagaagcacggatacattggcganttttgatacgtttgatgatcacagtcctggaaattcgttgtttgaattttaatggcaagcttaacaagtttggtgtcatcatcctccctttgatgtttngtgttcaaggaattttanggatgggactgcaggtccttccttcnccgtnattttggttacattggtgcnganaatttcggctggattaat

SEQ ID NO: 21767 - DNA, 484 bp, Triticum aestivum
  Clone ID: PAT_TA_21767
tcgggcacgaggcagtttccttcttgtgcccgtgcgctcgtcggcctccgtcctcgactccgctcgagaagcgagagcatggacacccaggtgaagcttgctgttgtggtgaaggtgatgggcaggaccggctccagaggtcaggtgacccaggtcagagtgaagttcttggatgaccagaaccggctcatcatgaggaacgtcaagggcccagttcgcgagggtgacatcctcaccctgctcgagtctgagagggaggccaggaggctgcgctgaggtggttgtgtgtcctggtggttcttgtatgaagttggatctcggcgaatttgagctatgtttattgaacttggtgtgagaacacctgccttatgattagtgagcctggtgataatgttgcaatttggttttatgatccaggttgaaagtgcacttgtgctgagacatggatattctttgctgtattagctcaatcgatgcatggatt

SEQ ID NO: 21768 - DNA, 947 bp, Triticum aestivum
  Clone ID: PAT_TA_21768
gccgccgtgagcagcgacccccgcatgggcgcgtcgctgctccggctgcacttccacgactgctttgtccaggcaagttccgcataactggaacttcgctaactaatttgcttgatcgaggaacagctgggattgaccaattatttgctgtgcgtgttttgctggctgcagggctgcgacgcctctgttctgctgtccggcaacgagcagaacgcgggtccaaacgcggggtcgctgaggggcttcggtgtcatcgacggcatcaaggcccaggtcgaggccgtgtgcaagcaaaccgtctcctgcgctgacatcctcgccgtcgccgcccgcgactcggtcgtcgccctcggaggttcgtcatggacagttcctctggggagaagggaccacaggtgcaaacgcggggctggcaaacagcgacatcccaaggcccgggctccagccgggcgcagctcgaggccgcgttcctcaagaagggcctggacacggtcgacatggtggccctctccggcgcacacaccatcgggcgggcgcagtgcagctccttccgctctcggatctacggcggcgacaccaacatcaacgccgcctacgcggcgtcgctccgggccaactgcccccagtccggcggcaacggcaacctggcgccgctggacgcgacgacgcccaacaccttcgacaacgcatactacacggacctcctgtcccagaaggggctcatgcactcggaccaggtgctgttcaacggcgacactaccgactacacggtccggaacttcgcgtccaacccggcggcgttcagcagcgccttcacgacggccatgatcaagataggcaacatcgcgccgctcaccggggcgcaaggccagatcaggctcagctgctccaaggtgaactcctgattgacgtacacgtcgatcggcagctcgccagcacgacacacg

SEQ ID NO: 21769 - DNA, 568 bp, Triticum aestivum
  Clone ID: PAT_TA_21769
tcgttgacacgctacggaatccttcatcagttcttcgtgcttgtgcagcttttgctctgcttcagttcactatgccggcgggtcgacatgctgtgcaacacgcggccctgctacagaaagccggggcgtcccgggtcttacggtgggcagcagccgcagcaacagctcccattgaagcgaagatctttgcacggatcgtccttcgcaacttggagctccaccaagcagggccttccacatagaagcaaaggatgatgagcaaacagcactcctacttttcactggtggagaagagcagctgacctatttattcccccatatccatggcttcggcatgaaccagacgacatgacggctatcgtcgtcgaattttggcatttcctcctagagaacttggttggcatctgccccccccccccgagtgtgctttgcgattttgtgtgtaagagcaagtaaagtaaaactgcctagtgtgtaagataatcttatggatcagtgccctaactaatttatgaggcgtttgcggtaaaaaaaaaaaaaaaaaaaaaaaaaaccaacaaaccccccc

SEQ ID NO: 21770 - DNA, 603 bp, Triticum aestivum
  Clone ID: PAT_TA_21770
cccacgcgtccggtaaacagatctgctctccctctctctctcatccgcggcgatacgatccaagatggcgatgagggcgtggaggaggagcgcggcggcgagggccccggcgcacctgtgcctgtggctggcgctcgtcgccgccaccctggtgctcgcccaggtgctcatccacctcggcaagaaatccaacctgtctgaggtgacgcacaaggtctacttcgacatcgagatcgacggcaagcccgcaggtcgggttgtcatgggacttttcggcaaggctgttcctaaaaccgcagagaacttcagagcactctgcacaggtgagaaaggcatgggcaacagcggcaaacctctccactacaaggggagttcgttccacagaattatccccagcttcatgatccaaggaggggacttcactcttggcgatggaaggggcggtgaatcaatctatggcacaaagttcgccgatgagaacttcaagctcaagcacactggaccaggctacctttccatggccaatgctgggagaataccaatggatcccagttcttcatcaccactgtaaccacgagctggttggacggcaagcacgtcgtg

SEQ ID NO: 21771 - DNA, 443 bp, Triticum aestivum
  Clone ID: PAT_TA_21771
ggcaaaatggttcactcttccaacaaatgtactggcctggaaatcatcaggcaaaaggggggctacaagccttattcatacccactgggaaaaccaacgaaaaggggcatgcctcccgatgtgcgggtgttctggggggaaaccaaagtttttaaggggcggaagggttcatttattcaaaacattcaaaggagcagctgcccttccaatggggatttaccccaggcatgaataggccaacgcctttttcttcgacagcttctggggggggggatccattttttttctcgaaaactcatcgatcgggagcccttgaacaattggccattcaccaccactggacgttactgggaaggagtaaataaaaccagcaggcccaccgtttgaaccatcagagtacacacccctggaaacaaatgttcccttggggggtcccaaaaccc

SEQ ID NO: 21772 - DNA, 829 bp, Triticum aestivum
  unsure (1)..(829): unsure at all n locations
  Clone ID: PAT_TA_21772
ggcacgaggactaagggtgcaggcagctagctagctaaccatggccgcctctgcctcttgcatttctctggtcgtgctcgtggccctggccacggcggcgtcggcgcagctgtccccgacgttctacagcgtgtcgtgccccggggcgctggccgccatcaagagcgccgtcacggccgccgtgagcagcgacccccgcatgggcgcgtcgctgctccggctgcacttccacgactgcttcgtccagggctgcgacgcctctgttctgctgtccggcaacgaagcaaaacgcgggtccaaacgcggggtcgctgaggggcttcggtgtcatcgacggcatcaaggcccaggtcgaggccgtgtgcaagcagaccgtctcctgcgccgacatcctcgccgtcgccgcccgcgactccgtcgtcgccctcggagggccgtcatggacagttcctctggggagaagggactccacaggtgcaaacgcggggctggcaaacagcgacctcccggggccgggctccagccgggcacagctcgaggccgcgttcctcaagaagggcctggacacggtcgacatggtggccctctccggcgcgcacaccatcggccaggcgcagtgcagctccttccgctctcggatctacggcggcgacaccaacatcaacgccgcctacgccgcgtcgctccgggccaactgcccccagtccggcggcaacggcaacctggcgccgctggacacgacgacgcccaacgtgttcgacaacgcatactacacggacctcctgtcccagaaggggctcatgcactcggaccaggtgctgntcaacgg

SEQ ID NO: 21773 - DNA, 613 bp, Triticum aestivum
  Clone ID: PAT_TA_21773
gctccctgtccctgcgccgccgcccccggtccgttgtagccgaagcagcttgcgccgcctcctccgtcgccgccgcctccccctacccccatcgccaacagcccaagaaagcatggacacccaggtgaagctcgcagtggtggtcaaggtgatgggccgcaccgggtcgaggggtcaggtgacccaggtgagagtcaagttcctggatgaccagaaccgtctcatcatgaggaacgtcaaggggcctgtccgggagggcgacatcctcaccctgctcgagtctgagcgggaggccaggaggctgcgctaagcactttctttcttcacctgtctgtcttcggaagtactcctgaaatgatgtgctgttaccttcttactctactgctttcgtcttttgccttggctatggagatgtaatgagtttccttctgttgccgaaattaaaatgcacttgatgttattgttgccttcttactctactgctttcgtcttttgccttggctatggagatgtaatgagtttccttctgttgccgaaattaaaatgcacttgatgttattgttgcacacctctgggtaatgtgaatcgactatattggatcccaaaaaaaaaa

SEQ ID NO: 21774 - DNA, 438 bp, Triticum aestivum
  unsure (1)..(438): unsure at all n locations
  Clone ID: PAT_TA_21774
ctcgaccgccgccgtcccagttcgcttcgcgtcaccgagagctcgtcggcctccgtccccgcgagaagcgagagcatggacacccaagtgaagcttgctgttgtggtaaaggtgatgggcaggaccggctccaggggtcaggtgacccaggtcagagtgaagttcttggatgaccaagaaccgtctcatcatgaggaacgtcaagggccctgttcgtgagggtgacatcctgaccctgctcgagtctgagagggaggccaggaggctgcgctgaagcccttgttgtcttgggatgtaatctgttaattttgttcaatgtttgtcgaacttgccgtgtgacccatactatatctgctttgggatttaagtaagcctggattgcattttttttagttcctgggtgggaaattgcaattgtttgtcngcaaaaaaaaaaaa

SEQ ID NO: 21775 - DNA, 438 bp, Triticum aestivum
  Clone ID: PAT_TA_21775
gactaaacagatctgccctctctctctctctcgtccgcggcgatacgatccgagatggcgatgagggcgtggaggaggagcgcggcggcgagggccccggcgcacctgtgcctgtggctggcgctcgtcgccgccaccctggtgctcgcccagggtaagaagtcgaacctgtcggaggtgacgcacaaggtctacttcgacattgagatcgacgggaaagccccgcaagtcgggttgtcatgggacttttcggcaaggcgtaagaatgttggtggcaaggtgctaggctttttctactgaaaatggaaaatggaaaattcgatgaaagtatctgagatgtgttagtaggatatttcccaaggaacacctaagttgtctttttttgtctgactagctgccgctgcttgttgagttattctggaatccgttatgcacttt

SEQ ID NO: 21776 - DNA, 633 bp, Triticum aestivum
  unsure (1)..(633): unsure at all n locations
  Clone ID: PAT_TA_21776
gccacggggcagctctcgtcgacgttctacgacacgtcgtgtcccagggctctggccaccatcaagagcggcgtggcagccgccgtgagcagcgacccccgcatgggcgcgtccctgctcaggcttcacttccacgactgctttgtccaaggctgtgatgcatctgttctgctgtctggcatggaacaaaacgcgggtccgaacgtggggtcgctgagaggcttcggcgtcatcgacagcatcaagacccagctggagagtatatgcaagcagaccgtctcgtgcgccgacatcctcaccgtcgccgcccgcgactccgtcgtcgcccttggagggccgtcatggactgttccacttgggagacgggactccaccaccgcaagtgcggcgctggcgaacagcgactccctggcctgggtccagccggtcacagctcgaggcgcgttcctcaagaagaacttaacacgtcgaatggtcccgtctcaaggccgcacacatcggnaagccaatgtccaacttcccgactccaatctacggcggtgacacaacatcaaactgctncgcnactctcccaaggcaacgccccnatcccggnngaacggaactnggcaactggacacgacgacccaacac

SEQ ID NO: 21777 - DNA, 448 bp, Triticum aestivum
  Clone ID: PAT_TA_21777
agcgccgccgccgccccaactcgccttgcgtgactgaaagctcgtcggcttccgtccacgcgagaagcgagagcatggacacccaggtgaagcttgctgttgtggtgaaggtgatgggcaggaccggctccaggggtcaggtgacccaggtcagagttaagttcttggatgaccaagaaccggctcatcatgaggaatgtcaaggggcccgtccgcgagggtgacatcctcaccctgctcgagtccgagagggaggccaaggaaggctgcgctgaaccctagcgttcttgggtggctcttgtttgggccttgggtgtcctcgaattgtgctatgttttgaacttctgtgacctgtcttgagataataacctggtgataaattgcattttgttaaccctggttgaaaatggatgggtgttaaacatggtatccttgcaaaaaaaaaaaa

SEQ ID NO: 21778 - DNA, 420 bp, Triticum aestivum
  Clone ID: PAT_TA_21778
aaacgcacagcaagcgcttgcagagaagccatagagctgcccgagatcggttccagcaccaggcgccgcaggccgcagaacaagttcgagagctagaaatggcgccggcttcgtcgttcccgatcatcgacatggggctgctggccggggaggagcgacccgcggccatggacctgctgcatgacgcatgcgagaactggggattcttccaggtcctggaccacggcatctcgacggagctgatggacgaggtggagaagatgaccaaggggcactacaagagggtgcgcgagcagaggttcctcgagttcgcgagcaagacgctgcaggacggcggcagggcggcggagaacctggactgggagagcaccttcttcgtgcgccacctcccggagcccaacatcgccgagatacctgacc

SEQ ID NO: 21779 - DNA, 358 bp, Triticum aestivum
  Clone ID: PAT_TA_21779
ttcggagcggccgcccgggcaggtacagggagcttttctttaaaacaaaacacaatcgctcaaaagttctttcatctttcatctcatcatcgttccatcgtgagttaaacgccagtagtagcaggtagtcctccatccatttttgggcggtaataaaaagtgtaaaagtatggacaatccgaattgaaagtggccggtgaattcaaaaaaggccgggtaacaatgaatgcttccagtcaaagctgctggccttcagtaggtcgccgcccaggcgtgctgtgggaattggaaagaagaaagtaaatgtccacagcgcctgaagtcgggcaagttggcgacctcggccgcgaccacgcta

SEQ ID NO: 21780 - DNA, 629 bp, Triticum aestivum
  Clone ID: PAT_TA_21780
gtcctgtaaatataggcaaaggggagctcaagcctcattcatacacacttggaaaaccagcgaaaaggagcatgcatcgcgatgtgcggctgttctgggtggagacgagagtttctaaagagcggaaggtttcatttattcaaaacatccagaggagcagctgcccttcgaatgtggatttacgccaggcatgagtaggccaacgccttctcctctgacagctcctgggcggtcgcatccatcttcttcctcgagaactcatcgatcggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaagcatatc

SEQ ID NO: 21781 - DNA, 921 bp, Triticum aestivum
  Clone ID: PAT_TA_21781
gtggtacggtattgagcaggagtacaccctccttcagaaggacgtgagctggcccctcggctggcctgttggtggataccctggtccccagggaccatactactgcgccgccggtgccgacaaggcctttgggcgcgacgtggttgacgcccactacaaggcctgcctctacgccggcatcaacatcagcggcatcaacggcgaagtcatgcctggacagtgggagttccaagtggggccgtccgttgggatctctgccggcgacgagatatgggttgcccgctacattctcgagaggatcactgagattgccggaattgttctctccttggacccgaagccaatccagggtgactggaacggcgccggtgcccacaccaactacagcaccaagtcgatgagggaggccggtggctacgaggtgatcaagaaggcgatcgagaagctggggaagaggcacacggagcacatcgccgcgtacggcgagggcaacgagcgccgcctcacgggccgacacgagaccgccgacatcaacaccttcaaatggggcgtggcgaaccgcggcgcgtccatccgcgtgggccgcgacacggagagggagggcaagggatacttcgaggaccgcaggccggcatccaacatggacccctacgtcgtcaccggcatgatcgccgagaccaccatcctgtggaacggaaactgataaagccacggttgttcctcttctgcacaacgctactacgcctgcaatgcacgcatccgctctgatgtcatgtcagtttggttttgcgatttcggttccccgtcgtggggtgtcctaaaattttttacttcggtctccggtgtactgcttggaaagtctgaataacggctgcaaatggattttgctttcgtcatagggggacctagctacctttagct

SEQ ID NO: 21782 - DNA, 852 bp, Triticum aestivum
  unsure (1)..(852): unsure at all n locations
  Clone ID: PAT_TA_21782
atttattgtaaatttattttgaagaatacatcaatgacgtatcatattttctatagtagaaggcatagagttataattacaaaaaactgtcaacaatgcgaacatacacggcgacacgccgacaccaacacactacacatggcctactctcccgcggaaggatctaaacctcctgctccaaaccccgcgcgcagcatgtccaccgtgtgaaaaatttcatcccatgtggtccctgcaggagcggcgagtgggagaacaatggagttgatccactcctccttctgctcctcggagtcggcggcgaagtacatggtctcgcccggggtggagagctcgaaggcgaacttgcggtcgggcacgccctcggcgcccttgacggcgaggcaggaggcgaggaagatgacgccgcggggcaccggacgcgtggtcgacgtccgagtccttgaaccagaagagcatcccctgcttgagcacgaaccagcggccggcgccacgccttgctgtgctccccctgctggtccagccaccccgcgcactcgggctggtgccagaactcgatgtagtccaggaactccgcgtccgcggccggggcgccggcgcccatcgcctctcgccacaggctcgccgccatgagacgtggagggatttggggatccggtcgggcgagtcgggagattttctggggacagttcgttcgttcggttgggtttcccccctgggccctgcttttaacggaacgggccgggctggagtcggactgtgtgctgtactaccgagctggtttgtatcggtatcggtatagatgcgttgctcacatggatagcaacaatccctcaaaataaaacngagttg

SEQ ID NO: 21783 - DNA, 682 bp, Triticum aestivum
  Clone ID: PAT_TA_21783
acactctctgcttcagctaagcagcacaaacacgcaggcagagttacacacagcgcgagtgggagaggcagagaggcatcagatcgagagcgatggcaattcctgctaatgctgctgtctcgttgaacttcccggtgatcaacatggagaagcttgagaccggggagaggggcgcggccatggaggtcatccacgacgcctgccagaactggggattcttcgagctgctgaaccatggcatctccgccgagctgatggacgaggtggagcgggtgagcaaggcccactacgcggcgtgccgggaggacaagttcaaggagttcgcggcgaagacgctggaggccggcgagaagggcgccgacgtgaaggacgtggactgggagagcaccttcttcgtccgtcacctccccgcctccaacctcgccgacctgcccgacctcgaccaccactacagacaagtgatgaaggaattcgcgtccgagatcgagaagctggcggagaaggtgctggacctgctgtgcgagaacctgggtctggagccgggctacctgaagcgggcgttcgccggttccaggggcccgacgttcggcaccaaggtcagcagctacccgccgtgcccgcggccggacctggtggacggcctccgcgcgcacacggacgccggcggcgtgatcctgctgtt

SEQ ID NO: 21784 - DNA, 607 bp, Triticum aestivum
  Clone ID: PAT_TA_21784
gtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacttcgaggaccgcaggccggcctccaacatggacccctacgtcgtcacctccatgatcgccgagaccaccctcctcctctgagctctgagcgaccagcagccaatgcctaccacaccgccggacgacacttaggctctcgaccttctcgatcgagggtggccattgattgatttctgcaaaatgtttcgtgttttccgtttcttttgcaaggtctagcctgttttgggggcgtgtctttcactttactcgttcagataagagtaagagtcctcagtgtgctctgaaaataatgttgtttcctcattccgataaatgaaatcatggaaccttgtgatgtgattccgttc

SEQ ID NO: 21785 - DNA, 612 bp, Triticum aestivum
  Clone ID: PAT_TA_21785
aagaaaacggatctacaagctagccttcttcatgtgtacacatacgagcaagaatatcctacgagtagcaacttctaagtgttctacacatcagatttacacacggacaagtgccaggatacatcaaattaagatccacttaaaacccatcaagaaagcaacacacacgttgctagcctgggcagcctagatccaccgggaagtagcagcactgcaaccgaaccaaatatatacagggctctggtcgcagccagcaagcatactggaggacagcaccagtgcgacgaggacgggcatgacagctcgccggtggcggggtcagaaagtggaggccggcttgggaaggagcaatgaagcggcagggccgagagtcattgccgaacctgttgctacggtggcacacaccggcggatggatctagcgcatgtgcggctcaacgcggacacgcgcacggatcccttggggcggcgatgcggttgacgtcgggtggcgcgaagctccgcagccgtccatggcgttggctggtgctcgtcagcggcttggggaacggcggtaggtggaggtggatcttggctgggaacaaggagaggcgtgggggacgggagagagagc

SEQ ID NO: 21786 - DNA, 844 bp, Triticum aestivum
  Clone ID: PAT_TA_21786
tttttttttttttttttttttttttttaataaaaatgaatgtatatttctttaacaaaaagaaaacggatctacaagctagccattcttcatgtgtacacatacgagcaagaatatcctacgagtagcaacttctaagtgttctacacatcagatttacacacggacaagtgccaggatacatcaaattaagatccacttaaaacccatcaagaaagcaacacacacgttgctagcctgggcagcctagatccaccgggaagtagcagcactgcaaccgaaccaaatatatacagggctctggtcgcagccagcaagcatactggaggacagcaccagtgcgacgaggacgggcatgacagctcgccggtggcggggtcagaaagtggaggccggcttgggaaggagcaatgaagcggcagggccgagagtcattgccgaacctgttgctacggtggcacacaccggcggatggatctagcgcatgtgcggctcaacgcggccacgcgcacggatcccttggggcggcgatgcggtttgacgtcgggtggcgcgaagctccgcagccgtccatggcgttggctgcctcagagggatttagattgtactcattccaattaccagacactaatgcgcccggtattgttatttattgtcactaccttccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcc

SEQ ID NO: 21787 - DNA, 830 bp, Triticum aestivum
  Clone ID: PAT_TA_21787
ccacgcgtccgagtaaacagatctgctctctccctctctttctctctcgtccgcggcgatacgatccgagatggcgatgagggcgtggaggcggagcgcggcggcgagggccccggcgcacctgtgcctgtggctggcgctcgtcgccgccaccctggtgctcgcccaggtgctcatccacctcggcaagaaatccaacctttctgaggtgacgcacaaggtctacttcgacatcgagatcgacggcaagcccgcaggtcgggttgtcatgggacttttcggcaaggctgttcctaaaaccgcagagaacttcagagcactctgcacaggagagaaaggtatgggcaacagcggcaaacctctccactacaaggggagttcgttccacagaattatccccagcttcatgatccaaggaggcgacttcactcttggtgatggaaggggtggtgaatcaatctacggcacaaagttcggcgatgagaacttcaagctcaagcacactggaccaggctacctttccatggccaatgctgggagagataccaacggatcccagttcttcatcaccactgtaactacgagctggttggatggcaagcacgtcgtgttcggcaaggtgttgtctggaatggacgtggtctacaaggtcgaggccgagggcaagcagaacgggacaccaaagagcaaggttgtcattgctgacagcggagaagtgccgctgtgatgacctgaaacggtctctggtggaaagctacggtgactagttttcattgtaggaccgttattgtcgggactgttttcgtgtacctgcccgggcggccgctcga

SEQ ID NO: 21788 - DNA, 568 bp, Triticum aestivum
  Clone ID: PAT_TA_21788
tagattgcaccaaagtaaaattctttaggatacttgcaaagttgcagatcacccatagatgtacattctcataaatgactctgctccatattaacagtacaacgagagctcccaaacaatggtgctccagctacaacgacttggtaaatgttggcgccaggtttctggcggattcacacagcggcatcctctttggtatcctccacaggctcctccgaagatgtggagctcacgttttggtcaccaggaccattagagaccttcaccgcggcaggccttagcaccctctccctcagaaggaaccctcggtggacttcgtgtgagacgatgcctgccttgaactctgtagattcttcacgcgcgatagcctcatgaaccactggatcaaatggcttgccaacagtttccacaacccctacgcctaagtttttcagtgtttctactaattgcttgtatatgccttgatagcttgcgctaatcttctgctctttctcagtctctagggtgatctctacatttgttttctcaaagctgtcaaccagaggcaacagactctgtacaagttcca

SEQ ID NO: 21789 - DNA, 763 bp, Triticum aestivum
  Clone ID: PAT_TA_21789
taacattacactgctaataatacatatattaggtagcatggttgaatgaatatttacaatggatagaaatggtcattgaggaggcaagggaaagcaggaaaggccaacggcaatatttacaagacatgaaagtagcttagttcgcatcttaaatagggaagtgtatcaactgaactttgacatggctgtatgagcgtcaaagactgggtttgcaaacacgcatgcaacgtagtagcatgtccagaagggtgcaaagagaggtgcctgaagacaacgacggtgattcatggttcacttgtccttgcgggcggaggcgttagtagccagcgccaaagtagcgagcccaaggcggcgagggccaaggcagagaccttctatatacaaaacagccagacatgcacgctcatcccaaagcgtcgatcagccgctactttagcttttttgctaaaacgttcttggcagcaacagcagccgccctctaaagcttagttgtctcagcaaccgtagtgtccacggtctcagcaggtgcagtggcagaagcatcagcatcaacatcagtcagtttagatcccttgccagtgaatcacccgggcgtcgggaaacctccccgagcagcaggccgagcgttaaacagcaggctgtatgaccctcaattgtacacgagaggcgaaggaagcacaaccatgacgaagaactccaaacacaaccgttcgcggtggacggagacggctcgaagagctgcaggccgagcgagcgaggcggc

SEQ ID NO: 21790 - DNA, 680 bp, Triticum aestivum
  Clone ID: PAT_TA_21790
cgtccggcgtaccagcacaagcacgcatacagatagggagagggagtagaaagacggagagagacatcagatcgagagcgatggcaattcctgctaatgctgccgcctccttgagcttcccggtgatcaacatggagaagctggagaccgaggagaggggcgccgccatgggggtcatcggcgacgcctgcgagaactggggcttcttcgagctgctgaaccatggcatctcgcacgagctgatggacgaggtggagcgggtgagcaaggcgcactacgcggcgtgccgggagcagcagttcaaggtgttccgcggcgcggacgctggaggccgggcgaagaagggcgccgacgtgaaggacgtggactggggaagagcacatctttcgtccgccacctccccgccctctaacctccgccgacctgccccgacttcgaccaccactacaggcaagtgatgaaggaattcgcgtcggagatcgagaagctggcggagaaggtgctggaccttctgtgcgagaacctgggcctggagctgggctacctaaagcgggcctttgccgggtccaggggccccacgttcggcaccaaggtcagcagctacccgccgtgcccgcggcctgacctggtcgacggccttcgcgcgcacaccgacgccggcggcgtgatcctgctgttcc

SEQ ID NO: 21791 - DNA, 455 bp, Triticum aestivum
  Clone ID: PAT_TA_21791
gccggccggtttggggtcgccaaggagggtgtcatgtctctcttcaagggtgctggtgccaacattctccgtggtgttgccggtgctggtgtcctctccatctacgatcagctccaggtccttctcttcggcaaggccttcaagtaagcgattcgtacaacataccctgtatagatgagtgtgggggataaggattcgaggagaatcttaattagcgggctggacatggtgtccgctggttgaaacaaaaaggcgagatcgaagtgcagatcgagggaagttgtcacagatacccgacgtggtcctctgaaacagcagctctttacgggttagagtggcataggcacggcgtctttttctaatcttgctttgccttccgttctaggccgctgtaatttatacaccaatgcaaattccctttactgtctaaaaaaaaaaaaaaaaaaaggccccta

SEQ ID NO: 21792 - DNA, 1421 bp, Triticum aestivum
  unsure (1)..(1421): unsure at all n locations
  Clone ID: PAT_TA_21792
ccgcattcccaacaacacctctccctccgcttgctctgccctctccatcaccgcctccatctccggcgaccgggggaagaagaagaagaagtagcagccatgtctccgctcgctgagcttctcagcctcgacctgtccggctgcaccggcaagatcatcgccgagtacatatgggtcggcggcaccgggatggacgtcaggagcaaagccaggacgctgcccggacccgtcgatgaccccagcaagcttccaaaatggaattttgacggctccagcaccggccaagccacgggtgacgacagcgaggtcatcctctgccctcaggccatcttcagggacccgttcaggaaggggaacaacatcctggtcatctgtgactgctatgcgcctaacggagagccgattccgagcaacaagcggtacaacgcagcgaggatattcggccaccctgatgtcaaggatgaagaaccatggtatgggattgagcaggagtacacccttcttcagaaggacaccaactggcccattggctggccactagggggttaccctggccctcagggaccttactactgcgccgtgggtgcagagaaatcttacgggcgcgacatcgtcgacgcgcactacaaggcctgcctctacgccggcatcaacatcggcggcatcaatgcagaagtcatgccaggacagtgggagttccaagttggcccttccgtcggcatctctgccggcgacgagctctgggcggctcgctacatcctggagaggatcactgagattgctggcgtcgtcgtctccttcgaccccaaaccgatccgnggagagtggaatggtgctggtgcccacacaaactacagcaccaagtcgatgaggagcgagggtgggtacgaggtgatcaagaaggcgatccagaagctggaggcgcggcacatggagcacatcgccgcctacggggagggcaacgagcgccggctcaccggccgccacgagaccgccgacatcaacaccttcgtatggggcgtggcgaaccgcggcgcgtcggtgcgggtgggccgcgacaccgagaaggaaggcaagggctacttcgaggaccggaggccggcatccaacatggatccctacgtcgtcacctccatgatcgccgagaccaccatcctcagcaaggccggtctctccaatggcaagtagagtggctttgatgggttctgttatctgtgtgagtgcccgtggttgcgcatgtgtgtgtgtgtgtgtgtctgtgtgatctgcattgcagtgacaagactggcagggtttgaataatgatgataaagcaataacatgtaatgtgcttgtcctagctggatgtatgttcctcgtcctgaacttgtttgtggtctgcaaacatctcgtgttatataagcgtgggttatgttcatggc

SEQ ID NO: 21793 - DNA, 702 bp, Triticum aestivum
  Clone ID: PAT_TA_21793
ttcttttaaaaaaaacggatttacaagctagccttcttcacatgtatacatacgagcaagaatatcctacgagtagcaacttctaagtgttctccacatcagattcgcacggacaagtgccagaatacatcaaattcagatccacttaaaatgcatcaagaaagcaacacacacgttgctagcatgggcagcctagatccaccgggaagttgcagcgctgcaaccaaaccacatgtgtacagggcccctgtcacagccagcaagtatactagaggcagcaacagtgcgacgaggacgggcatgccaacgcgccggtgacggggtccgaaagcggaggccggcttgggcaggagcagtgacgcggctgggccgagagtcattgcggaaccagctgctggggcggcacacaccggcggatggatctagcatgcgggcggctcaagcggccacgcgcacgaatcccttggggcggcgatgcggttgacgtctggtggcgcgaagctccgcggccgtccatggcgtcgggtgcctgagagggagagggcaagggataaggcataggggatagatagagaacgaggaatataggcaggaggaaggagacggtggtaggggcagtggagcttgagatggtgctcgtcggcggcttggggaacggcgggaggtagaagtggatctcggctgggagggagcagaggcgtg

SEQ ID NO: 21794 - DNA, 853 bp, Triticum aestivum
  unsure (1)..(853): unsure at all n locations
  Clone ID: PAT_TA_21794
ttccttattggccggcaccatgagtcctgatnttctacggggagatacagagcacgttagcctaaacggtacagataagagtctgccactcagcctgctgaatgcatcgccgcatggtggaaataaactcccctgaagcatgaggtgggtaggctgaaccatatatggagtcgaacagcgaggccattgcgcatatcaagaacgtacagggggcgtgtccctaccggacggtgctgatgaaacgcgacatcgtaatggcctgatgctgatgccttggaaaggagagaggccttctttcttacgtgacttggatatgccaaccagaatgggaggattttactcccctaggtgagatgacatcttcgcgtttggtgggctaacgccggtaggaaattcacaggggatatcgccgagagcagtgatgatctccgtagcgccgaagcgccaacttcgcttggtgttgttcataatatacggtcttcagagagagtactggtctgcaaaatgggtactttgtgtgcaaaacctgcctcagtgttgcacaaattatctcaggatccttcctttctttttctctgaccaggttggcccataaatcagcaggtttgtcctaccaaacttcctgtcagctatctttattagctttccgcaggattcaggcatatctgttttcagtgggtactcaactagaatgaagcaatcttctccaaccaacggggaccttgcaagctgatcgagtagtgtactgtagttgacctcaacatatggcggtgttacactaatataatctaaaggtagatatccttcttttgattatattagtgtaacacctcaacatatggcggtgcggacg

SEQ ID NO: 21795 - DNA, 785 bp, Triticum aestivum
  Clone ID: PAT_TA_21795
cacaaacacacatacagaattacagatagggagagtgagcgcgtcatcacggagcgatggcacttcctgctaatgccgctgcctcgttgagcttcccggtgatcaacatggagaagctggagacggaggagaggggcgcggccatggaggttatccacgacgcctgcgagaactggggattcttcgagctgctgaaccatggcatctcgcatgagctgctggacgaggtggagcgggtgagcaaggcgcactacgcgtgccgggaggagaagttcaaggagttcgcggcgaggacgctggaggccggcgagaagggcgccgacgtgaaggacgtggactgggagagcaccttcttcgtccgccaccttcccgcctccaacctcgccgacctgcccgacctcgaccaccactacaggcaagtgatgaaggaattcgcggcggagatcgagaagctggcggagaaggtgctggacctgctgtgcgagaacctgggcctggagcagggctacctgaagcgagcattcgccggttcaaggggcccgacgttcggcaccaaggtgagcagctacccaccgtgcccacgccccgacctggtcgccggcctccgcgcggacgccgtcatcttccctgccccggcgcttgtcgaggagctgtcggaggaggaggcggagcgtgccgggagcgccgtgtacccgaggttcgtgttcgaggactacatgaacctgtacttgctccacaagttcgaggccaaagagccgtgctttcaggccatgaaggcggacgcc

SEQ ID NO: 21796 - DNA, 799 bp, Triticum aestivum
  unsure (1)..(799): unsure at all n locations
  Clone ID: PAT_TA_21796
tcgggcgtgacatagttgatgcccactacaaggcttgcatttatgcaggcatcaacatcagtggcatcaacggagaggtcatgccagggcagtgggaattccaagttggaccgtccgtcggcatttcttcaggtgatcaggtctgggttgctcgctacattcttgagaggatcaccgagatcgccggtgtggtgttgacattcgacccaaagcccatccctggtgactggaacggtgccggcgcacacaccaactacagcaccaagtccatgaggaacgagggcgggtacgaggtgatcaaggccgccattgagaagctgaagttgcggcacaaggagcacatcgcggcctacggcgagggcaacgagcgccgcctcaccggcaggcacgagaccgccgacatcaacaccttcagctggggagtggcaaaccgtggcgcgtcagtgcgcgtgggccgggagacggagcagaacggcaagggctacttcgaggaccgccggccggcgtccaacatggacccatacgtggtgacctccatgatcgccgacaccaccatcctctggaagccctgaagcggaagctttcctccatccagctcgccgtctcgtgtcggtttgttccgcggcagtgtcccggccgttgcattgcagggtcccgtccagcgatttgcgcaacaattgttccttcccgatccgtttgcttatactactctactactgcaatttagctagaatttgggtcaagtcgtggtgtgccaaaacaaaacacataaaaactntgacgcttcccacttccattc

SEQ ID NO: 21797 - DNA, 550 bp, Triticum aestivum
  Clone ID: PAT_TA_21797
ccgcgccgccgccgccgtccgtcatagcagaagcagcctgcgccgccgcctccgttgtctcagcagaagcagcgatccccatcgccagcagcccaagaaagcatggacacgcaggtgaagcttgcggtggtggtcaaggtgatgggccgcaccgggtcgaggggtcaggtgacccaggtgagagtcaagttcctggatgaccaagaaccgtctcatcatgaggaacgtcaaggggcccgtccgtgagggcgacatcctcaccctgctcgagtccgagcgggaggccaaggaggctgcgctaaaaaacttcttcctttatacctgtctgtcttgggaagaagaatgatgtactgttgccttcttagtctaccgctttcgttcttttgcctaaactatctgggagggtgtaaatgaattttgttctgttgcctaaactaaagtgcacttgatggtgtgagacctgatcattgttgcacacctcttggtaatgcgaatcgtgaatcgtctatattggatcctaaaaaaaaaaaaaaaaaactcgagggggggg

SEQ ID NO: 21798 - DNA, 797 bp, Triticum aestivum
  Clone ID: PAT_TA_21798
tgagatagcattggttgggacatcctcacagggtagttccaaaattgtaaaatttgagggagcaagaaggttggcatttaagcatatagaagcctttgtgttgaccttttcagatccacaaatgttttctacggctgcttcatcctcaggtgcagcagccttatctcaggttgctgaagcactttttatacaagaagctggacatcttagatgcagccgagctgagattgctagatttgttgacacgctacggaatccttcatcagttcttcgtgcttgtgcagcttttgctctgcttcagttcactatgccggcaggtcgacatgctgtgcaccacgcagccctacttcagaaagccggggcatcccgggtcttacgggtggcagcagccgcggcaacagctcccatcgaagcgaagatcttcgcacggatcgtccttcgcaatttggagctccaccaagcagggccttccacatagaagcgaaggatgagcaaacagcactcctactctactggtggagaagagcagctgacctatttattcccccatatctgtggcttcagcatgaaccagacgacatgacggctatcgtcgtcgaattttggcatccccctctcctttcagagaacttggttggcatcttgttgcttccgctgagtgtgcttgcgattttgtgtgtaaaagcaagtaaagtaacattgcctagtgtgtaagataatcttatggatccgtgcactagctaatttatgaggtgtttgcggtaaatttggacttcagctgcagccaactttaaatt

SEQ ID NO: 21799 - DNA, 637 bp, Triticum aestivum
  unsure (1)..(637): unsure at all n locations
  Clone ID: PAT_TA_21799
gataacaagtgcaggtagcacggatagctctggacttgtagcttaccatggccatgggttctgcttcttgcatttctctggtggtgctcgtggctctggccacggcggcgtcggggcagctgtcatcgacgttctacgacacgtcgtgccccagggctctggccaccatcaagagcggcgtggcggccgccgtgagcagcgacccccgcatgggtgcctccctgctcaggctgcacttccacgactgctttgtccaaggctgtgatgcatctgttctgctgtctgggcatggaacaaaacgcgggtccgaacgtggggtccctgaagggcttcaagcgtcatcgacaacatcaaagacccaactgggagagtatatgcaagcaaacgtctcctgcgccgacatctcaacgtcgccgcccgcgatccgttgttgcccttggagggcctcatggactgttcactcgggaaacgggatcaacaacgcaagcgcctcgctggcgaacatgaactcctgggccaagctcanccggtcaaagctcaggctcgttctaagaagaacctacacgtcacatggnccctctaagcgcgnaacatcggaaggncattgtcactttcgatcgttacgngtaacanataa

SEQ ID NO: 21800 - DNA, 826 bp, Triticum aestivum
  Clone ID: PAT_TA_21800
tgatttccagcggccgcccgggcaggtctaatctcgagttttttttttttttttttaatcaggtgtcaaattgtttcactcttgcagcaaatgtactgtcctgtaaatcatcaggcaaaaggggagctacaagcctcattcatacacacttggggaaaccaaacgaaaaggagcatgcatccccgatgtgcgggtgttctgggtggagacgagagtttctaaaaagcggaaggtttcatttattcaaaacatccagaggagcagctgcccttccaatgtggatttacgcgaggcatgagtaggccagcgccttctcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagac

SEQ ID NO: 21801 - DNA, 608 bp, Triticum aestivum
  Clone ID: PAT_TA_21801
gaattcactagtgattagcgtggtcgcggccgaggtcgaagcagaaaaagcatcgtctcgcctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcatgcccgaggcaaagcatccgaagagcgagctcgtccaagtgcttccctcacctcaagcagtgatatctgcccaatcagacagagagagagataaaagagagagagagagagaagctgtcataatccacctactattatcatgttccgcaatgactgattgttgacctaagcttggggtctgaactcggtgtgctgctgtcccggctgctttggttgtgtgcccatctactatgtaatcgtcctctatcagcctgttgtgctacattatcttaatcctctgtggatttgctcctcgtgcttagtcagtatgctgtcgcaaaaaaaaaaaaaaaactcgagactagttct

SEQ ID NO: 21802 - DNA, 1278 bp, Triticum aestivum
  Clone ID: PAT_TA_21802
tactacaaacttgaccgatcgtccttaaaaccattatacaggctgaggttttacagaatcagcaagagctgctctaagattcaaagctttgcaaaacaccaacagcaatagaaatgatcatatgccacagtcccaccgcacggtggctcctcttgctcttgtgatacaaaaatctatatagatgaaacaataaacgtctcaaatatgttcttccaagttgagtcccaatatgaatgtgcctatggccgtttcctgccccgtttattctttgatgacgcgagaaaatcggacgacagagcaggcactgcactgcacatttgtgagcgctcagtccagcctccttagcaagtatgctacctggacgtccttggttagcggcatgatcctgttgccgtacagtccagcgaccaggctgggcctgatcttgtacacaggcgccatgcccttggcttcagctcctatgttcacctcctgtccaaatatcttggccttggtttccacccgatgttcgatggcacgctcaaccgtctcgtaggtgaggagctgcattagttgagcgccgtcctgagcttttattgcaggagtgtaatcttcaggggactcttgaaacttggcctctgccacaaactttccatagtggattctcttagagagtgcctgcaagcagggtcgtgtcgcaaagagcactggatccagaatttccatcacttccttccttcactagccttggaagaacttcatcaaagtacattttccaaatctctttgttgatattaatggaatcagcaataggatgcagaaccgttggatactggataggcggcaacagtgtctcaggcagatcttctggaaagaatgggtgctcatctgggctcttgtatctcccaacctttgcatgtagcttttcagtttctctaaccatgaattcaaccaaagagccaccaaatccatccacatggaaagaatcgctatcatatgtatcagcattgtaacaatactgtgctctctccaagagaccgaatatgatgctgtcttctagtctaatcaacgaggttctgatactgtccaaagtcagtatttgactttgatctatcctctgtttctccaccctggccaccggcgcggagttgttagttgcagcgaacagcgcccgcgccggccgcgacgacgccttcctccacgccgatccaaaggcgacgctgctccggccctgcgctccctggctcgtaccgtgccaggctgcgggcaacgcggccgtcttcgacaccaccttaaact

SEQ ID NO: 21803 - DNA, 1341 bp, Triticum aestivum
  Clone ID: PAT_TA_21803
aatctcatcccatcacctgcacttcgctagtacatccacacaacaccactcgagtctgaaactctgaaaaggctcatcgtcaccatggttgttccggtgatcgacttctccaagcttgacggcgccgagagggccgagacgatggcgcagatcgccgacggctgcgagaactggggcttcttccagctggtgaaccacggcatccctctggagcttcttgaccgcgtcaagaaggtgtgctccgagagctaccgcctccgggaggcggcgttccggtcgtccgagccggtgcagacgctggagagactggtggacgcggagcggcgcggcgagccggtggcgccagtcgacgacatggactgggaggacatcttctacctccacgacgacaaccagtggccgtccgacccgccggccttcaaggagaccatgcgtgagtaccgcgccgagctcaagaagctcgcggagcgggtcatggaggccatggacgagaacctcggcctcgacaagggccgcatgaaggccgccttcaccggcgacggcctccacgcgccgttcttcggcaccaaggtcagccactacccgccgtgcccgcggccggacctcatcaccgggctccgggcgcacaccgacgctggcggcgtcatcctgctgttccaggacgacaaggtcggcggtcttgaggtgctcaaggacggcgagtggctcgacgtgcagccgctcgccgacgccatcgtcgtcaacaccggcgacccaggtggaggtgctcagcaacggccgctaccgcagcgcgtggcaccgcgtcctgcccatgcgcaacggcaaccgccgctccatcgcctccttctacaacccggcgtttgaggcggccatctcgccggcggtgggcgaaggccgcgctggccgcgtacccagactacgtgtttggggattacatggatgtgtacaacaagcagaagttcaatgccaaggagccaagatccgaggccgtcaaaggcgccaaaggcagcttaagcttaatatcatggcgattacacgacaactatttacctattagctggcttttgttttacaatgaagaaaaaaaaatgtttcctgggcgatgggtgctacagtgcctagtgggcgatttggggcgatttgccggcgactgggcgtctatgccgtgcttcccttcccggttccccctgatcccttctcccctcagctatcttctcttctgatctggttttcctctagattccccctctatctctttccctttctcatgtattggtctcccttcctctgttatctgtctcgtcttcgaatcctacttctaagtcatccaaaaaaaaaaaa

SEQ ID NO: 21804 - DNA, 485 bp, Triticum aestivum
  Clone ID: PAT_TA_21804
ttttttttttgaccgaacgaggctctcgtttgttataccttccagcaagaatacaagaagagagaaaaaaataatattgtatcgtcctacagtgttctcctaacagaggctaggctagacctagactacttggctgaactcgccgtccctgcacacgcccacgtcgatggtcatcgtcttcttcccctccttccccaccttcggcgacgacagcactctacagcagttcctcctcggcgaccggtcccatatcccggggtcgggcctcttgagcacgacgatgtggtcgagatgcgcgtccgggtcggtgatgttccaacggcacgcgggccgcgtctcgttcgcggggcgccaccgctcgtaccgcgtcaccgttgtctccccgccgcgggcggcctccgcgctgcgcgccgacgacaggtagtacacggcgggcttgtggcacggcgtgcgcgccagaggccgcgtgttgaacgcgtacgccg

SEQ ID NO: 21805 - DNA, 981 bp, Triticum aestivum
  unsure (1)..(981): unsure at all n locations
  Clone ID: PAT_TA_21805
gcacgaggccacagccagataacaagtgcagctggtagcacgcaacgcatagctctggacttgtagctaggtagccaaccatggccatgggttctgcctcttgcatttctctggtggtgctcgtggctctggccacggcggcgtccgggcagctgtcgtcgacgttctacgacacgtcgtgccccagggctctggccgccatcaagagcggcgtggcggccgccgtgagcagcgatccccgcatgggcgcgtccctgctcaggctgcacttccacgactgctttgtccaaggctgtgacgcatctgttcttctgactggcatggaacaaaacgcgggtccgaacgtggggtcgctgaggggcttcggcgtcatcgacaacatcaagacccagctggagagtatatgcaagcagaccgtctcctgcgccgacatcctcaccgtcgccgcccgcgactccgttgtcgcccttggagggccatcgtggactgtcccgctggggagacgggattccaccaccgcaagtgcctcgctggcgaacagtgacctccctggcccgagctctagccggtcacagctcgaggccgcgttcctcaagaagaaccttaacacggtcgacatggtccgcgctctcaggcgcgcacaccatcgggaaggcccagtgctccaacttccggactcggatctatggcggtgacaccaacatcaacactgccttcgcgacgtctctcaaaggccaactgcccccagtccggcggcaacaccaacctgggcgaactggacacgatgaccccaatgcgttcgacaatgcctactacaacaactcctgtcaaaaaaaagggctcctgactcggaccaagtgtctnaacaacgacaccancgacaacacggtccgcaacttgcgtcaaagcggcggcttcaacaacgcctcaacaagggcatgatnnanatggggaaactcncgccgctnacgggaagcaagg

SEQ ID NO: 21806 - DNA, 532 bp, Triticum aestivum
  Clone ID: PAT_TA_21806
cccacccccacccgccttccttcctccgcgacttgcctgcccgccctcagtcagccggccatggcgctcctcaccgatctcctcaacctcgacctcaccgactccacggagaagatcatcgccgagtacatatggatcggcggatctggcatggatctcaggagcaaggccaggaccctccccggcccggtcaccgatcccagcaagctgcccaagtgggaactacgacggctccagcaccggccaggcccccggcgaggacagcgaggtcatcctgtacccacaggcatcttcaaaggacccgttcaaggaagggcaacaacatccttgtcatgtgcgattgctacaccccagctgggagtgccaatccccactaacaagagatacaacgctgctaaatctttaacaaccctgatgttgccaaggaggaccatggtacggtattgacaagagtacacctcctacagaaggacatcaacgggcctctcggctggctgttgtggcttcctggtctcaaggtccttactactgt

SEQ ID NO: 21807 - DNA, 1167 bp, Triticum aestivum
  Clone ID: PAT_TA_21807
atcaccgaggtaaacgagttatttaggatagatactccctccgtccgggaaaacttgtcatcatcaaaatggataaaaagagatgtatctagactttgcaatcaccacaaatgtaccttctcatatgtgttgtttcaaaaaggacccatttggaatcaaacgactccgctccatattaacagtacaacgagagctcccaaacaaatggtgctccagctacaacgacttggtaaatgctggcgccaggtttcgcctggcggattcacacagcagcatcctctttggtatcctccacgggctcctccgaagatgtggcgcccgcaatttggtcaccaggaccggtagagaccttcaccgcagcaggccttagcaccctctccctcagaaggaaccctcggtgaacttcgtgtgagacgatcccagccttaaactctgtggattcttcacgcgcgatagcctcgtgaaccactggatcaaatggcttgccaacagtttccacaacccctacacctaagcttttcagtgtttctactaattgcttgtatatgccttgatagcttgtgctgattttctgctctttctcagtctctagggtgacctctacatttgttttctcaaagctatcaaccagaggcaacagattctgtacaagttccacttgtatattagatgtaaactttgcacggtcctttcagcctgtttccggaaattctctagatcagcatttaagcgaagaaacttattcttccctgaagctatttcagctgtaatactttcaagcttgagaagttgctttacttctctcttcctccatgctagtgattgccttctcgatgtcactaacaacatcatcgtttccatctagaaaggctttcttgtacagtcgaattaggtcattcataggagggaaatcttccccatttacaatcttgcgggtcagcgccagcgacgcggagcggccgcagcgcttgcattggggcgccggaaagagaggaaggtgggggcttggcggctgggtttccgagcagcaggtagggcgcccggcgcggttagggtttgcaggtggcgtctggtagggtttgcggcggcggcggaggcggcggggtaggcgcagtaggttgccgccatagtggatacgcctctatcgttttgcttccgtgctgtctg

SEQ ID NO: 21808 - DNA, 249 bp, Triticum aestivum
  unsure (1)..(249): unsure at all n locations
  Clone ID: PAT_TA_21808
gaattcactagtgattagcgtggtcgcggccgaggtttccaaatcaagaactcatcatttgtgtagcccctctgtatatttaaaactcatggatggtaccgaggttgaaatgtcagatatgtgtttattatttagcttgccttgtagaaacctcatcccgagttaaatatcatcatacacccttgtccaaaaaaaaaaaaaaaaactcgaccctgcccgggcggccgctcgaaatcacntagtgaattc

SEQ ID NO: 21809 - DNA, 992 bp, Triticum aestivum
  Clone ID: PAT_TA_21809
ggcgcgatccgaaggcgagctgaagcaatggagcggctgcagagaatcttcagcggcgccaccgggatggggcagccggggagcgactcgccgctgctcgactcctccgagcaggtctacatctcctccctcgctctcctcaagatgctcaagcacgggagggtcggcgtgcccatggaggtgatgggcctgatgctgggcgagttcgtcgacgactacacggtcagggtggtggatgtcttcgccatgccgcagagcgggaccggggtcagcgtcgaggccgtcgaccacgtcttccagaccaacatgctcgacatgctcaagcagaccgggagacctgaaatggtggtagggtggtaccactcgcatcctggatttggttgctggctttcaggagttgacatcaatactcagcagagttttgaagctttaaaccccagggcagttgctgttgtgatagatcccatccagagtgtcaaggggaaggtagtcatcgatgcattctgtctcattaaccctcagaccatgatgcttggccaggagccaaggcagacaacatccaatgttgggcacctaaacaaaccatctattcaggcacttattcacgggctgaacaggcactactactccattgcaatcaattaccggaaaaatgagcttgaggagaagatgctgctgaacttacacaaaaagaaatggactgatgggttgattttaaagaaattcgacacccactcaaagaccaacgaggagactgttcaggaaatgctgagtctggccatcaaatacaacaaggcagtgcaagaggaggatgagctgccgcctgagaaactagcgatagcaaatgtcgggcggcaggatgcaaagaagcacttggaggagcatgtctcgaatttgatgtcatcgaacatagtacagaccctagggaccatgcttgacacagtggtcttttagtctgctactactggttgttccaactctatacacagaac

SEQ ID NO: 21810 - DNA, 939 bp, Triticum aestivum
  Clone ID: PAT_TA_21810
ctcctggctccttcgtacatcatcaggcaagctctgaagctcggtaggcaagaagaaacatccggagacgcagcctgtctcgaatcaagagggtaagatggcatcgacattgtcattccccatcatcgacatgggtctgctccgccggggacgagcggccggcggcgatgaaccttctgcacgatgcatgcgagaactggggcttcttccaggtcctgggaccacggcatctcgacggagctgatggacgaggtggagaagatgaccaaggagcactacaagagggtgcgggagcagaggttcctcgagttcgcgagcaagacgctggaggacggcggcaaggcggcggagaacctggactgggagagcaccttcttcgtgcgccacctcccggagcccaacatcgccgagatacccgacctcgacgacgactacaggcgggtgatgaagcagttcgcgtcggagctggagaggctggcggagcggctgctggacctgctctgcgagaacctcggcctggaaaaggggtacctcacgcgcgcgttccgtggctccaagggcgcccccaccttcggcaccaaggtcagcagctaccctccctgcccgcgcccggacctcgtcaacggcctccgcgcccacaccgacgccggcggcatcatcctgctcttccaggacgaccgcgtcggcgggctccagctgctcagggacggcgagtgggtggacgtgccgcccacgcgccactccatcgtcgtcaacctgggcgaccagctggaggtgatcaccaacggcaggtacaagagcgtgctccaccgcgtggtcgcgcagaccgacggcaaccgtatgtccatcgcattcttctacaaccctggcagcgacgccgtcatcttcccggcggcggcgctggtggaggcggaggcggccggcgtcgacgcggccgcg

SEQ ID NO: 21811 - DNA, 1355 bp, Triticum aestivum
  Clone ID: PAT_TA_21811
gctcaaacgcacagcaagcgcttgcattgcagagaagccatagagcaacctgagatcagttccagcaccaggcgccgcagcacaagcagctcgagagctagaaatggcgccggcttcgtcgttcccgatcatcgacatggggctgctggccggggaggagcggccggcggcgattgacctgctgcatgacgcaagcgagaactgggggttcttccaggtcctggaccacggcatctccacggagctgatggacgaggtggagaaaattaccaagggagcactacaagagggtgcgcgagcagaggttcctcgagttcgccagcaagacgctggaggacggcggcagggcggcggagaacctggactgggagagcaccttcttcgtgcgccacctcccggagcccaacatcgccgagatacccgacctcgacgaggagtacaggcgggtgatgaagcagttcgcggcggagctggagaggctggcggagcggctgctggacctgctctgcgagaacctcggcctcgagaaggggtacctcacgcgggcgttccggggctccaagggcgtccccaccttcggcaccaaggtcagcagctaccctccctgcccgcgccccgacctcgtgaagggcctccgcgcccacaccgacgccggcggcatcatcctgctcttccaggacgaccgcgtcggcgggctccagctgctcagggacggcgaagtgggtggacgtgccgcccacgcgccactccatcgtcgtcaacctgggcgaccagctggaggtgatcaccaacggccggtacaagagcgtgctccaccgcgtggtcgcgcaggccgacggcaaccggatgtccatcgcctccttctacaacccggccagcgacgcggtgatcttcccggcgccggcgctggcggaggcggaggcggccggcggggcgtaccccaggttcgtgttcgaggactacatgaagctgtacgtgcgccacaagttcgaggacaaggagcccaggttcgaggccttcaagtccatggagagccagagcaccaagctcatcgccaccgcttagaagcaacccttgctctgctctccgtacgtggcctcggttaatggttgaggacgatggcacataggatgctccagagttcgtacgtacgtacgtgctagaccactggctactgtttggtgccgaataaacgagcctgtgctggcttgtgtgctacgcctagctaggatctgtagtaagtaggagtgtttgtcattttcgctgtgttgtgctgcttccgaccagcatgagagctgtattgttctgtgtctgttcttattcccaggggcatcgtatcggttgtctcttttaat

SEQ ID NO: 21812 - DNA, 618 bp, Triticum aestivum
  Clone ID: PAT_TA_21812
ctgcgccgccgcccccggtccgttgtagccgaagcagcttgcgccgcctcctccgtcgccgccgcctccccctacccccatcgccaacagcccaagaaagcatggacacccaggtgaagctcgcagtggtggtcaaggtgatgggccgcaccgggtcgaggggtcaggtgacccaggtgagagtcaagttcctggatgaccagaaccgtctcatcatgaggaacgtcaaggggcctgtccgggagggcgacatcctcaccctgctcgagtctgagcgggaggccaggaggctgcgctaagcactttctttcttcacctgtctgtcttcggaagtactcctgaaatgatgtgctgttaccttcttactctactgctttcgtcttttgccttggctatggagatgtaatgagtttccttctgttgccgaaattaaaatgcacttgatgttattgttgcacacctctgggtaatgtgaatcgactatattggatcccatgatttgagtgctggtggtataaatctgatcgtttctacttgttaaatcatcatgtgcttgtaaaaactcatatgagattcgaactatgattagtgatttggtgtgctgatggaaaaaaaaaa

SEQ ID NO: 21813 - DNA, 1184 bp, Triticum aestivum
  Clone ID: PAT_TA_21813
aaaggggaaaaaccgttttttaaggggatgggccccttcgtgaaccctccccctaaacaaatttttttggggtgaggggccgttaaacccttaattggaaccctaaaaggagccccccatttaaaactttacggggaaaaccggcgaaagtggcgaaaaaagaaaggaaaaaaaccaaaagaacgggggctaagggcctggcaaatgtaacggtccccctgggggtaacccccaccccccccggggttaaagggccggtacagggggggttccctttcccctttagggtgggcaaatttttggaaaggggattggggggggccttttttttttttccccaactggggaaaaggggatttttttcaaagggatttaatttgggaaccccagggtttttcccattcccccgtttttaaaacccggcccaggaaattaattttgggggcccaaaaaaaaaaattttacctcccccccccggggtagtaaaattgggttctttaaaacgggccccccctttttttttttttttttttttttttttttttttttttttttttttttttttttttttttttttttttttttttttttttttttttttttttttttttttttttttttttttgcactaacaatgttatgttcatatttaagtcggtgccaagcaacagaaagagtacatgagccacagaaagagagcacatgatgctctgcgaaatatttgcagagtactgctctccagaggagagaaacagggaacacaataaacaagagtcagtacaccaggcagttcgatcacgtggatctttattaagaccagcaaccacaagtattgcgaagctaggcgaccaatgactgactgagatgacgacgatgaagacctgcggcgcttactagggcataaccttttgaatcatcgtctcacggaattacgaggcagccctccccaacagctgaagggccaaccagcacaggtgcataaatggcgtcatcagtttcctcctccacctgggacttgaaccaaacaagcagcatcaaagatgtaggccttcacttcctcaaagcgtgcttccgacagggagacctcggcgaggagtctccatgccgaagcttctgatgcctcctcgtagtcatccctacgtttcagtacaatgtggccactgatctcccaaacagcagggttc

SEQ ID NO: 21814 - DNA, 1622 bp, Triticum aestivum
  unsure (1)..(1622): unsure at all n locations
  Clone ID: PAT_TA_21814
gtgggggcgggacgcgacgcgactccacactcttccgcacgaatcaccgctctcctctagctggaataagggtcacctggatgaccggggcagacctggcaccagtaatggagttgaaggctgtggcaaaatggaggaacatccactgaagttgttgcttctgataagaaggataataccaagatggaagaggctggcgagagcaaggatgttgcagcagcgaataccaatgccaaccaacataataaagcctcagaaaacggcgctaagggctcatccgatgatgatgccaagatggaggaggctgaagatgcaaaggaagatgatgtgggtgctgtgaagcaggcaggtacagagggtgtcaaatcgggtgacaatgcggatgccaaggaaggtaatggtgccaatgcagcagaacatgaggattccaaaacggctgctattgaggatgtagttgcaaaggaagatgacancaccaagtcagcaaaacacaaggactccaaaatggttattgtanaggatgcagatgcaaaggaaagatgacaaagccgccaaggcagcagaacacgaggattccaaaacggctggtatcgaggatgtagttgtaatggaagatgacaacaccaagtcagctgaatacaaggactccaaaatggttattgtagaggatgcaaatgcaaacgaagatgacaaagccaaggcagtagaacacgaggattccaaagcggctggtattgaatatacagttgcaaaggaagatgccaacaccaagtcagcagaacacaaggactctaaaatggttattgtagaggatgcagatgcaaaggaagacgacaaagccaaggcagcagaacacgatgatcacagagcaggtggtgtggcagcagaacgcaaggatcacagaacaggtggtgtggaggatgcagatgcaaatgaagacattagcgccaaggctgaagagtgcaaggttggcaacatgaatactgtagataatgcagatgtaaaggaagatgaagatgccaatgaagacattggcgccaaggctgaagagtgcaaggttggcaacatgaatactgtagataatgcagatgtaaaggaagatgaagatgccaatgcagcagaacatgaagatgccaaaatggttgatgtggatgatgcagatgcaaaggaagattatggcaccaaggtagcagaacatgaggatgtcaaaatgggtgccgtggaggatattgatgcaaaggaagataacaacaccaaggcagcagaacatcatgatatcataatgggtgtggtagagcatgcagatgtaaaagaagataacagttctaatgtagcagaatggcgtggatgtcaagatggcggaggctgagaccaagccaggagatgcagagctcgaagacaaagggcacaaggaagaaatggatgtgaacacagaggtcaagaagggaccgaaagatgcagatcaatgtggttctgagatgcatgatgaattgaatgggcaaggaaagaatggagcggctcggcagcaagaaaataaagctgaagaaatgagtgatgatgatagtcaaggggaagtggaagtggaagaaaagggctcttcagataagaaagaggaaggaggg

SEQ ID NO: 21815 - DNA, 1229 bp, Triticum aestivum
  Clone ID: PAT_TA_21815
cggccgctcgaggcggcgggcggggttcaacaactctctgcttcagctaacattaccagtccagcgcacacacatacagatatcgagagtgtgtgtgtaagagagacattagatcgagagcgatggcaattcctgctgatgctgctgtctcgttgaacttcccggtgatcaacatggagaagcttgagaccggggagaggggcgcggccatggaggtcatccgcgacgcctgcgagaactggggattcttcgagctgctgaaccatggcatctcgcacgagctgatggacgaggtggagcgggtgagcaaggcgaactacacggcgtgccgagaggggcagttcaaggagtttgcggcgcggacgctggaggccggcgataagggcgccgacgtgaaggacgtggactgggagagcaccttcttcgtccgccacctccccgcctccaaccttgccgacctgcccgacctcgaccaccactacaggcaactgatcaaggaattcgcgtcggagatcgagaagctggcagagaaggtgctggacctgctgtgcgagaacctgggtctggagcagggctacctgaagcgggcgttcgccgggtccaggggcccgacgttcggcaccaaggtgagcagctacccgccgtgcccacgccccgacctggttgacggcctccgcgcgcacaccgacgccggcggcgtcatcctgctgttccaggacgaccaggtgagcgggctgcagctccttaaggacggggcctgggttgaggtgccgcccatgcgccacgccatcgtcgtcaatatcggcgaccagctggaggtgatcaccaacgggcggtacaagagcgtgatgcaccgcgtgctcacccgcgccgacggcaaccgcatgtccatcgcgtcattctacaaccccggggccgacgccgtcatcttcccggccccggcgcttgtggccgctgccggcgccacggagaagaacgagggcgaggagggcggcgccgtgtacccgaagttcgtgttcgaggactacatgaacctgtacgtgcgccacaagttcgaggccaaggagccacggttcaaggccatgaaggcagacgccgcgcccatcgccaccgcgtgataacgccgcgcccatcgagtacaagagtattttgagacgtgtttactttcttttgggcgtgccatgtatccggttagctttatgggtaatgtattttcgagtccgactcac

SEQ ID NO: 21816 - DNA, 780 bp, Triticum aestivum
  Clone ID: PAT_TA_21816
ctatagggcgattggtacggggcccccccgttttttccaatgaaatgaatgtatatttctttaacaaaaaaacggatttacaagctagtcattcttcacatgtatacatacgagcaagaatatcctacgagtagcaacttctaagtgttctccacatcagattcacacacggacaagtgcgagaatacatcaaattcagatccacttaaaatgcatcaagaaagcaacacacacattgctagcatgggcagcctagatccaccgggaagttgcagcgctgcaaccaaaccaaatgtgtacagggcccctgtcacagccagcaagcatactagatgcagcaacagtgcgatgaggacgggcatgccaacgcgccggtggcggggtccgaaagcggaggccggcttgggcaggagtagtgacacggctgggccgagagtcattgccgaacctgctgctggggcggtacacacgggcggatggatctagcacgcgggcggctcaagcggccatgcgcacgaatcccttggggcggcgatgcggctgacgacgggtggcgcgaagctccgcagccgtccatggcgtcgggtcctgagagggagagggcaagggatgaggcataggggatagatagagaacgaggaatataggcaggaggaaggagacggaggtagggcggcggagcttgagatggtgctcgtcggcggcttggggaacggcgggaggtagaagtggatctcggctgggagggagcagaggcgtgggggacgggagagagacaag

SEQ ID NO: 21817 - DNA, 1438 bp, Triticum aestivum
  Clone ID: PAT_TA_21817
tgattagcgtggtcgcggccgaggtaataaattgagtgatttcaggggcatagaaatctgtactatctccgaaataagagatgtggtacaaaatggttcccgcatacaatcactgggagctctcataacatgtaaattccattcaaaccatgaacataagcatcactagatgtactattggaatgaaactaatcattaaccattctcataacgcaagctcttctaatcatattgtactattggaatgaaactaaaatcattaactgaggcacaaagaacctctaaaatgatgaagctatgacctgcgacgctgcatcaccaaactctttcttctggtcatcgccttcattctgttctgcaacaccaacagcgtcactgtgagattcaacaacctgtgcctcctcaacactcatttcttgagacgattcaccattttctgctccgctcttgcgacccagcaccgcgtcaatagctgctctacttgctctggcagcagattcctccttagccttagcctcagccttcttcttctcctcttcttctttagcaagagcctctgccctagccttctcttcagctgcacgtgctgcagcctctgctttctccgtctcaacatcctcatacaactttgtcatatccccgtttctcccctctttctgcaatgccccgtatagaagtgccttcaattcatcagtaaatacaatactctcatccaaaagaatacccttggccatcttaattgcatcatccaaccttgcaacattgatgtatgctctcaacagtgattcatagctagcaatgtttggcttgacctccctttcgggcatcagatcaaagaacctctgtgcctcgtcaatcctatcaaccttcaccaagccacttatgactttgttaaaggcattggcattgggcctgagaccaacatcaaacatcttattgaagtaaccaacggcgtcatccacattaccaaccctgaagcaggactcaatgagcaagacataagtgtattcgtcaggattaataccacgctcccccatctccttgtacagtccttccgcctcaccaacaagttcattcttccccagccagtcaatcagactattgtatgagagtgcatctggtgtgcagcttttctcacccattttgccaaacacctcaattgcgtcctggaatctttccacacggcagtacgcatcaaccatcacattaaaactaccaagattcacagcaatcctcctgggcgggtcatgctctttgcacatcctatcaaacaactcgactgcatcatctaacctcccattcctaccaagcgcatcaagcaccatgttgtagctaacagcctcaaatctcaccttggatccctctccaagcacctcggtgtagcaatccatggcctccttgtccggacgcgtgggtcgacccgaaattccggaccggt

SEQ ID NO: 21818 - DNA, 733 bp, Triticum aestivum
  unsure (1)..(733): unsure at all n locations
  Clone ID: PAT_TA_21818
ttcgagcggccgcccgggcaggtacagggagcttttctttaaaacaaaacacaatcgctcaaaagttctttcatctttcatctcatcatcgttccatcgtgagttaaacgccagtagtagcaggtagtcctccatccatttttgggcggtaataaaaagtgtaaaagtatggacaatccgaattgaaagtggccggtgaattcaaaaaaggccgggtaacaatgaatgcttccagtcaaagctgctggccttcagtaggtcgccgcccaggcgtgctgtgggaattggaaagaagaaagtaaatgaaaaagatcgtgctcgcggtatctttttcactcaggactgggtatccatgccaggtgttataccggtagcttcaggtggtattcatgtttggcatatgccagctctgaccgaaatctttggggacgattctgtattacaatttggtggaggaactttaggacatccttggggaaatgcacctggtgcagcagctaatcgagtgggctttagaagcctgtgtacaaagctcgtaacgaaggggcgcgatcttgctcgcggaaggtaatgaaattatcccgaagcaagcttgcaaatgggagtcctgaactaagccgcagcttgtgaaagtaatggaangggcggatcaaaattccgaagttccgaagcccggtangatacctattggataaagtangataaaacacctatagcnatannatgacacgga

SEQ ID NO: 21819 - DNA, 1658 bp, Triticum aestivum
  Clone ID: PAT_TA_21819
cttgctagactaatcagacataaaatttggatgctttctcccaactgggagacggggactgatgtgcagctgcacgtgagctcaaattttccctataaatatgcatgaaatactgcgttatcttgcaagccacagccacagccacagccacaaccagataacaagtgcaggtagcacgcatagctctgggcttgtagctaggtagctaaccatggccatgggttctgcctctcgcatttctctggtggtgctcgtggctctggccacggcggcgtccgggcagctgtcgtcgacgttctacgacacgtcgtgccccagggctctggccaccatcaagagcggcgtggcggccgccgtgagcagcgacccccgcatgggcgcctccctgctcaggctgcacttccacgactgctttgtccaagcaagtttcacataatatatcagctctttttcccttaaccaactttcttgaactcccggatttaacaaaatttatattccgacctaatacgtttatgttggctacagggctgtgacgcatctgttcttctgtctggcatggaacaaaacgcgggtccgaacgtggggtcgctgaggggcttcggcgtcatcgacaacatcaagacccagctggagagtatatgcaagcagaccgtctcctgcgccgacatcctcaccgtcgccgcccgcgactccgttgtcgctgtaagaacatcttagtactacactcatttacatgatcgatgctacctgaaggatagaacatatatcccctccgattcatataaattgtcgctgatttagtacatacttaatttcctacttggtctgctatctttcacatacagcttggagggccatcgtggactgtcccgctggggagacgggactccaccaccgcaagtgcctcgctggcgaacagtgacctccctggcccgagctctagccggtcacagctcgaggccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggagaacctggacacgacgacgcccaacgcgttcgacaacgcctactacaccaacctcctgtcacagaaagggctcctgcactcggaccaggtgctcttcaacaacgacaccaccgacaacactgtccgcaactttgcgtccaacgcggcggccttcagcagcgccttcacgacggccatgatcaagatgggaaacatcgcgccgctcaccgggacgcagggccagatcaggctcagctgctccaaggtgaactcgtgatggacgtatgcgtcggcagcacgacacgtgaatgaataaggcccccaaaacagtggccagtaccacttatcataccagcacttgaatcgtgtattttcaaagcatgtgcagcagcaaatcatgcatgcatcaacgtatgtaacgacggttgaatcctcaatttctcatgcaaaaggcaaggagaattactatcaatcctaccttattacactcgtacacagaatgaagatgtaaactcctcttgtgaaattg

SEQ ID NO: 21820 - DNA, 1208 bp, Triticum aestivum
  Clone ID: PAT_TA_21820
ttttttttttaaataaacgtccactgcacataattaataatttgtttacatacagacatactgtacactttaagcatacattctgctcgtgtttcataacaatcatgtaggaccaactatcacggagggcgtgcatgctttccagtggaaatttcatttcacttctttccaggtacacagccaatgctgtactacaatatatacactgctcggaaataatcaggaagaccttttgtttcgtacacgtacaccaccaatctctcttgtaaacatcactgcaagaggttggagagcccagccctcacgcgtgttcttcatgaaatgacacgcaattgtcatgcgtgttcaggagagaaaagctcaggcagtatacatgcctcttaggcctcctcctcgagggcgaacaatcttgcctccacagacacggatagagtcgcagaaatctctcttcttgagaaacttcttgatatcttctagtatgaccggtgtgttttggattatcatcttcttgcacttctgtacgaaactctctgtgttgttgcatcctttcagaagtatctcgattatcttgagctccatctcagggtcttcaagaccagcacgaatctcatcaacaacctcatggcaaagggtgcaagcatgttcatgtcctgggaggcgaatgtatgtaacttcctcacaaagacttgctgatacgcaaaattcttcagggcttagagaatcaatttgttcgaagaacagtgctgcataataatcaaccaactttgtacactctaacttaagtgaatgaaatttcaaacaagcttggtgaagagtatctataatttcgatccgtgtctcattctccttcaaatagaagagggtttctgtggcaaactgctcacaaagttggcatagttgtggacttccctttgttgtaagagataccgtgttctcatttaatctcttttcgacaacagtatggtcccaaggcccaagattctactgcccaaaagggcaacaccagtgatgaacaaagcaaaaactcttgagcccattttgtcttaagttcggatgaggatcttgggagcggagggccgggcggggcgtcgtgtgcggacggccgagcgccgtccgcggcggagacaagcgggagcgagaagagctaggcagaggcagggagaagctgtttttttttccttacgcgagggagaagatgttttgagaac

SEQ ID NO: 21821 - DNA, 1387 bp, Triticum aestivum
  Clone ID: PAT_TA_21821
cgtccgcccacgcgtccgatcaaacacgcagctagcgcttgcagagaagccataaagcagcctgggatcagttccaggcttccagcaccaggctccgcagcacaagttcgagagctagaaatggcgccggcttcttccttcccgatcatcgacatggggctgctggccggggaggagaggcccgtggcgatggacctgctgcatgacgcatgcgtgaactggggattcttccaggttctggaccacggcatctcaacggagctgatggacgaggtggagaagatgaccaaggagcactacaagagggtgcgcgagcagaggttcctcgagttcgccagcaagacgctggagggcggcggcagggcggcggagaacctggactgggagagcaccttcttcgtgcgccacctcccggaggccaacatcgccgagatacccgacctcgacgacgactacaggcgggtgatgaagcagttcgcggcggagctggagaggctggcggagcggctgctggacctgctctgcgagaacctcggcctggagaaggggtacctcacgcgggcgttccggggctccaagggcgtccccaccttcggcaccaaggtcagcagctacccgccgtgcccgcgcccggacctcgtcaagggcctccgcgcgcacaccgacgccggcggcatcatcctgctcttccaggacgactgcgtcggcgggctccagctcctcaaggacggcgagtgggtggacgtgccgcccacgcgccactccaatcgtcgtcaacctgggcgaccagctggaggtgatcaccaacggcaaggtacaagaggcgtgctccaccgcgtggtcgcgcaggccgacggcaaccggatgtccatcgcctccttctacaacccggccagcgacgcggtcatcttcccggcgccggcgctggcggaggcggccggcggtgcgtaccccaggttcgtgttcgaggactacatgaagctgtacgtgcgccacaagttcgatgacaaggagcccaggttcgaggccttcaagtccatggagagccagagcaccaagctcatcgccaccgcttgacaacaacaaccacggtactccgttgctctgctctccgtacgtggcctcggttatggtcgaggacgatagcacataggatgcttgagagttcgtacgtctagtactgtttggtgccgaataaacgagcctgctggctgtgtgctacgcctagctaggatatgtagtaggagtgtttgtcattttcgctgtgttgtgctgcttccgaccagcatgagagctgtactgttctgtgcctgttcttattcccaggggcatcgtatcgattgtctcttttaatatttacgtgctgcctccttgtgtgagaaaaaaa

SEQ ID NO: 21822 - DNA, 1205 bp, Triticum aestivum
  Clone ID: PAT_TA_21822
atactctctgcttcagctaagcagcacaaacacgcatacagcgcgagagtgagagagggagcgaggcatcagatcgagagctatggcaattcctgctaatgctgctgtctcgttgaacttcccggtgataaacatggagaagcttgagaccggggagaggggcgcggccatggaggtcatccacgacgcctgcaagaactggggattcttcgagctgctgaaccatggcatctcgcacaaattgatggacgaggtggagcgggtgagtaaggcgcactacgcggcgtgccgggaggacaagttcaaggagttcgccgcgcggacgctggaggccggcgagaagggcgccgacgtgaaggacgtggactgggagagcaccttcttcgtccgccacctccccgcctccaacctcgccgacctgcccgacctcgaccaccactacaggcaagtgatgaaggaattcgcgtcggagatcgagaagctggcggagaaggtgctggacctgctgtgcgagaacctgggtctggagcagggctacctgaagcgggccttcgccgggtccaggggcccgacgttcggcaccaaggtcagcagctacccgccgtgcccgcggccggacatggtggacggactccgcgcgcacaccgacgccggcggcgtcatcctgctgttccaggacgaccaggtgagcgggttgcagctgctcaaggacggggcatgggtggacgtgccgcccatgcgccacgccatcgtcgtcaacatcggcgaccagctggaggtgatcaccaacgggcggtacaagagcgtgatgcaccgcgtgctcacccgccccgacggcaaccgcatgtccatcgcctccttctacaaccccggcgccgacgccatcatattcccggccccggcgctcgtgggcgccgccgacgctgctgagaggaacgagggcgaggagggcaccgccgtgtacccgaggttcgtgttcgaggactacatgaacctgtacgtgcgctacaagttcgaggccaaggagccacggttcaaggccatgaaggcagacgccgcgcccatcgccaccgcgtgataacgccgcgccgatcgaggacaagaatattttgagacgtgctttattttcttttgggcgtgccatgtatccggttagctttattgcttatcaaaaatcatgggtaatgtattttctagtccgactc

SEQ ID NO: 21823 - DNA, 1053 bp, Triticum aestivum
  Clone ID: PAT_TA_21823
ttttttttttatttataaaagtggggcgaaagcctgtttgagagcgctgtgtacttataatctttcgatagagtttcactcaggacatgcacaaaactgtaaatcggaagttgcacttcattacagaaacatctttgagaatgacatggtgtaactaatacactcctgtatactataatgatatgtatggtcgtgtttggagattaaggaaaacactggagtgaacctggggtttcatgagtaaatcacaggaatagtaacaatccgataggctaaccgagaagtcagcttgcaatcgctgtgaaaactcccacgggggtccagagtggcgactgagtagctgacccgcacgatgcggaaggcgactttgcagaaacgcctgaacccgccggaccgcctgggcgcattccgcagcgttgccagctcccctgtcgtggtggaggtcccctgcacgacgtgaccgtcgctggagtagctcgcctccatcaagcacaccacgtgaacgtacgcaagctgaccgtcgtcgtcctggaatcggtatgccatgtacttgccgaggtacccatccttcccgcacaacccgcagttatggccggcggcctggtggagttcgagttcatgctcctcgacgcgcacgcgcttcggcaggaatgcgcacatagggtggaggtcgaggtcgtgctcgcggttgtggtacaggaagccgcacaccgggtcgccgcagacaccgcagatcggaataacaccgcctgggttgttcgcgctcgccgggcggctctggaaaagggtgagcgcacggccctcgaacatagagggctcgacgcgcgtgggcgattgagcgcagcatatgtggaggtcgaagtcgcattgctcgcaccggaatctgagctcgtcgccgatctgcctgcagccgtcgcactggaacagcttgtccatggctaccagcttaagcccgtgctcatgcgtggagtgggaaagcgttgcccgaacgtcatgtccagtgaatgtaaccatgctactgtaagcttctcagctccggagactttcgtagct

SEQ ID NO: 21824 - DNA, 811 bp, Triticum aestivum
  Clone ID: PAT_TA_21824
accaagtcatcggtgctacattctcaaccaaagtcaactgttggaactccggcatatattgcccctgaagttctgctcaagaaagaatacgatggcaagattgccgatgtgtggtcctgtggcgtaaccctttacgtgatgttggtcggcgcctaccctttcgaggatccagaaaatcccaagaatttcaaagtgacaattcagaaaatattaggtgttcagtactcgattccggactatattcacatacctatggactgccgaaaccttctctcaaggatctttgttgccaacccagctacgaggatcaccatacctgagataaagaaccacccatggttcctcaagaacctcccagctgacctcatggacggtcccacagtgagcaaccagtatgaggagcctgaccagccgatgcagaacatgaacgagatcatgcagataatggcagaggcgaccataccggcggccggcgccctcggaatcaataagttcctgcctgacggccttgacctcgacgacgacatggacgacctggactcggacctcgacatcgacatggacagcagcggggagatagtatacgccatgtagtaaacctgtgaatatctgtatgtgcagaagcggtatttgtggtcttcccccttgtttgcttcttgaacatacaccagattgagtgccattttgtgttaagaagaagagtgtagaaatgtacattgagaggattgtattcaggctactacttgagtctgaaattggtgttgctgctcattgatgtgttgtctaacaaaatacagtatgttggagtttt

SEQ ID NO: 21825 - DNA, 1490 bp, Triticum aestivum
  Clone ID: PAT_TA_21825
ttcggcacgaggcccaccccaccccacccgccttccttcctccgcgactctgcgcgccctcagtcagccggccatggcgctcctcaccgatctcctcaacctcgacctcaccgactccacggagaagatcatcgccgagtacatatggatcggcggatctggcatggatctcaggagcaaagccaggaccctccccggcccggtcaccgaccccagcaagctgcccaagtggaactacgacggctccagcaccggccaggcccccggcgaggacagcgaggtcatcctgtacccacaggccatcttcaaggacccgttcaggaagggcaacaacatccttgtcatgtgcgattgctacaccccagctggagtgccaatccccaccaacaagagatacaacgctgctaagatctttagcaaccctgatgttgccaaggaggagccatggtacggtatcgagcaggagtacaccctcctacagaaggacatcaactggcctctcggctggcctgttggtggattccctggtcctcagggtccttactactgtagtattggtgctgacaagtcgtttgggcgtgacatagttgactcccactacaaggcctgcctctttgccggcgtcaacatcagtggcatcaacggcgaggtcatgcccggacagtgggagttccaagttggcccgactgtcggcatctctgctggtgaccaagtgtgggttgctcgctaccttcttgagaggatcactgagatcgccggagttgtcgtcacatttgaccccaagcccatcccaggcgactggaacggtgctggtgctcacacaaactacagtaccgagtcgatgaggaaggacggcgggttcaaaggtcatcgtggacgctgtcgagaagctcaagctgaagcacaaggagcacatcgccgcctacggcgagggcaacgagcgccgtctcaccggcaagcacgaaaccgccgacatcaacaccttcagctggggtgtcgcgaaccgtggcgcgtcggtgcgcgtgggacgggagacggagcaaaaacgggaaagggctacttcgaggaccgccggccggcgtccaacatggacccctacgtggtcacctccatgatcgccgagaccaccatcctgtggaagccctgaagccgagcagcgccgaccgccgtgcgatgatcagtgatgggttgggtttggtggtggccactggaggatttggacgaaattcttccaagatatttccgtttccgtttggttgcatactacgcgtagtccgcttaggtaggtcacatcgtcgtcgtcgtctgtcatcagggtgtctggtctctcttctcgtctttgggtgggtgggtgggtggtggctagaggcgtgtcaaacacacaagactactattgattgttttcccttgccgtctgggtgccctggtctcgtgtaatcatcaattgatatggtaataaaatggtccgtaccgctgccgtggtaccacgc

SEQ ID NO: 21826 - DNA, 592 bp, Triticum aestivum
  Clone ID: PAT_TA_21826
gccggccgggttccggctgaattatttcctccctccccgcgccgccgcctccgtccgctgtaggagaagtagcttgcgccgccgccttcgtcgtcgtagcagaagcagcgatccccatcgccagcagcccaagaaagcatggatactcaggtgaagctcgcggtggttgtcaaggtgatgggtcgcacggggtcgaggggtcaggtgacccaggtgagagtcaagttccttgatgaccagaaccgtctcatcatgaggaacgtcaaggggcccgtccgtgagggcgacatcctcaccctgctcgagtccgagcgggaggccaggaggctgcgctaagaaatttcttcctttatacctgtctgtctttggaagaagaatgatgtactgttgccttcttactctaccgctttcgttctttgcctagctatgtggaggtgtaatgagttttgttctgttgcctaaattaaagtgcacttgatgttgtgagacttgatcattgtcgcgcacctcttggtaatgtgaatcgtgaatcgtctatcttggatcatatatgatttgaaatcagtaaaaaaaaaaaaaaaaaaggccccta

SEQ ID NO: 21827 - DNA, 756 bp, Triticum aestivum
  Clone ID: PAT_TA_21827
ggaccaaaaacagttagcggctagcaatagcagcaatataacgattcacggaagtagtaaatggctctatctgcggacacaaatgtataaacctcgcagaataacgagacggggggaccagatacccaaaaactcttagcatagcacaaaattaactagttcaccaggtcaaatagccattaagtaacaagcaaactcttccaaaaaaagaccaactgtttcgacactgaatttcaagtcctagatagtttctttgccaccgccatcacgatcccaggcactgttcgcttacttgaagcacttggcgtccagcaaggcctgcccctcaaacggctcaaggtcctcgatcatggcctcgacacgcttcttctgggcctcgtcggagaggtcaaccttagtccactcgtagagctccatgtcatagacctcattcatgacgaactcagggatgtcctgcccacggaagagccacagccccttgactttgaagggcgcctcagaaccaatcacgagcatcttgccaaaagcgtacttgcggcacagatccatccgctgcaggaacccgccgaccttgttcagggtcacgtaggatacggtgttctcttcctggtacttgtagtcacagaaccagagagagtagccctctgggtcatacatctcccagaaacctttaacagcaacatcatggtttttttttttttttttttttttttttttttttttttttttttttttttttttttttttttttttttt

SEQ ID NO: 21828 - DNA, 1301 bp, Triticum aestivum
  Clone ID: PAT_TA_21828
ctgcaggccacagccagataacaagtgcagatagcagtgatagcacacatagctcttgccttgtagccaaccatggccatgggttctgcctcttgcatttctctggtggtgctcgtggctctggccacggcggccacggggcagctctcgtcgacgttctacgacacgtcgtgtcccagggctctggccaccatcaagagcggcgtggcggccgccgtgagcagcgacccccgcatgggcgcgtccctgctcaggcttcacttccacgactgctttgtccaaggctgtgatgcatctgttctgctgtctggcatggaacaaaacgcgggtccgaacgtggggtcgctgagaggcttcggcgtcatcgacagcatcaagacccagctggagagtatatgcaagcagaccgtctcctgcgccgacatcctcaccgtcgccgcccgcgactccgtcgtcgcccttggagggccgtcatggactgttccacttgggagacgggactccaccaccgcaagtgcggcgctggcgaacagcgacctccctggccctggctccagccggtcacagctcgaggccgcgttcctcaagaagaaccttaacacggtcgacatggtcgcgctctcaggcgcgcacaccatcgggaaggcccagtgctccaacttccggactcgaatctacggcggtgacaccaacatcaacactgccttcgcgacgtctctcaaggccaactgcccccagtccggcggcaacggcaacctggcgaacctggacacgacgacgcccaacacgttcgacaacgcctactacaccaacctcctgtcacaagaaagggctcctggcattcggaccaggtgctcttcaacaacgacaccaacgacaacaccgtccggcaacttcgcatccaacgcggcggccttcagcagcgccttcacgacggcgatgatcaagatgggaaacatcgcgccgctcaccgggacgcaggggcagatcaggctcagctgctccaaggtgaactcgtgattgacctacacgtcggcagctcgccagaacgacacgtcaacgaataaggccccagaagcagtggccagtaccgattatcataccagcacttgaaacatgtatatttctctaagtatgtgcagcagcaaatcatgcatgtacctacatatgtaacgacggttgaatcctcaatttctcttgcgaaggcaaggagaattaccatcaaccctaccttattacactcgcacacggaatgaagatgcacacttgcctgatgacattttggcatgaaaaaaaaaaaa

SEQ ID NO: 21829 - DNA, 1545 bp, Triticum aestivum
  Clone ID: PAT_TA_21829
tgatgctgatgaagaagagaatgaggaggatgaggatgatggggagatgggggttgatgacgaagatcaggatgaagtaaatagtcttaatatacagaagctagtgcaggcaagaggttttcagctccatgatgaggatgatgatgatgatgattctgatgatgattttagtgatgacgaggagctgcagaccccgatagatgaggttgatccatttatcttctttgttggaaccatccaagctgtacaagcatccgacccagccaggttccagagccttatgcagacactggattttcactaccaggcactggctaatggcgttgctcagcatgccgaggaaagaaaagttgaaattgagaaagagaagttggagaaagcaaatgcacagtgatgaatgaattatagcaatggttgtttgtcttgagttttgttgcaggccagtgcctgtgatttggtgatcgcaggcaatgggtttttgcagccttggtctacttgtttttggaggcctgaggcacacaattcttggaatagaagaagtcgacaacattaccatcgtgggataatctcttgcagcctcggtctatttgtttatgggcggtgcgagccctacagatgatactacacacttgttatgatgctgttttggtcctgagctccggctccgtttggttgatggaatttgttaaatgagccctgtgggtggggcgcgtccccaagttcgcttatagcctaggaatgtccggtgtagagtgtatatgattgggccgttattggtggattaccaatacgatggtttcattttttctttctgtcgttgcaggattcagtgaatccagttttgtccgtacaatttgttgaacatcgctcaagcatgtctctatggtttgacagaggctggtgaaataaactttgcctgcatctggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaaaaaaaaaatttacgaccccgggcaggcaaggtattaccttttttttagggcccccaaatttaattccctgggccggggtttaaaaacggggggatgggaaaaccccgggggttccccaatttattcgctttgaaaaaaatccccttttccccagtgggggtattaccaaaaaggccccccccgttggcctttccaaacattggccccccctgattggcaatgggacccccccctgtacgggccctttaagcgcggggggggggggggttccccccagggggcccgttacttttgcaaggcccttatcccccgttcttttggtttttttcctttcttttttccccaagttcgcgggttttccccgtaaagttttaaatggggggccccttttagggttccaatttagggttttacggcccctcggacccaaaaa

SEQ ID NO: 21830 - DNA, 1312 bp, Triticum aestivum
  unsure (1)..(1312): unsure at all n locations
  Clone ID: PAT_TA_21830
cgttcgtccacgcgttcgcccacgcgtccgcccacgcgttcggcttagcagtacaagcacacatacagatagggagagtgagagagaaagaaggagagagacatcagatcgagagcgatggcaattcctgctaatgctgccgcctcgatgagcttcccgatgatcaacatggagaaactggagaccgaggagaggggcgcggccatggaggtcatccaggacgcctgcgagaactggggcttcttcgagctgttgaaccatggaatctcgcacgagctgatggacgaggtggagcgggtgagcaaggcccactacgcggcgtgccgggaggaacagttcaaggagttcgcggcgaagacgctggaggccggcgagaagggcgccgacgtgaaggacgtggactgggagagcaccttcttcgtccgccacctccccgcctccaacctcgccgacctgcccgacctcgaccaccactacaggcaagtgatgaaggaattcgcgtcggagatcgagaggctggcggagaaggtgctggacctgctgtgcgaaaacctgggtctggagcagggctacctgaagcgggccttcgccgggtccagggggcccgacgttcggcaccaaggtcagcagctacccgccgtgcccgcggccggacatggtggacggactccgcgcgcacaccgacgccggcggcgtgatcctgctgttccaagacgaccaggtcagcgggctgcagctcctcaaggacggggcctgggtggacgtgccgcccatgcgccacgccatcgtcgtcaacatcggcgaccagctggaggtgatcaccaacgggcggtacaagagcgtgatgcaccgcgtgctcacccgccacgacggcaaccgcatgtccatcgcctccttctacaaccccggcgccgacgccgtcatattcccggccccggcgctcgtgggcgctgccgacgctgctgagaggaacgagggcgaggagggcaccgccgtatacccaaggttcgtgttcgaggactacatgaacctgtacgtgcgccacaagttcgaggccaaggagccacggttcaaggccatgaaggcagacgccgcgcccatcgccaccgcgtgataactgatacgcgcccggacccggacgagagtattgtgagacgtgttttattttcttttgggcgtgccatgtatccggttagctttattgcttatcaaaaatcatgggtaatgtattttcgagtccgactcacagattcttgtcagggcactaaattccggggatttatatattttgcggattatggcnnnnnaaaaa

SEQ ID NO: 21831 - DNA, 1082 bp, Triticum aestivum
  Clone ID: PAT_TA_21831
gcaccaaagtaaaattctttaggatacttgcaaagttgcagatcaccatagatgtacattctcataaatgactctgctccatattaacagtacaacgagagctcccaaacaatggtgctccagcaacaacgacttggtaaatgctggcgccaggtttctggcgggttcacacggcggcatcctctttggtgtcctccacgggctcctccgaagatgtggagctcacgttttggtcaccaggaccattagagaccttcaccgcggcaggccttagcaccctctccctcagaaggaaccctcggtggacttcgtgtgagacaatccctgccttgaactctgtggattcttcacgcgcgatagcctcatgaaccactggatcaaatggcttgccaacagtttccacaacccctacgcctaagtttttcagtgtttctactaattgcttgtatatgccttgatagcttgcgctaatcttctgctctttctcagtctctagggtgacctctacatttgttttctcaaagctgtcaaccagaggcaacagactctgtacaagttccacttgtatattcgatgtaaactttgcacggtccttttcagtctgcttccggaaattctctagatcagcatttaagcgaagaaacttattcttccctgaagctatttcagctgtgatactttcaaactgagaagctgctttacttctctcttcctccatgctagtgattgccttctcgatgtcactaacaacatcttcgtttccatctagaaaggctttcttgtatagtcgaattaggtcattcataggagggaaatcttcgccatttacaacctgcgggtcagcgccagcgacgcggagcggcggcagcgctgcattggggcgccggaaagagaggaaggaggggggttggcggctgggtttccgagcagcaggtagggcgcccggcgcggttagggtttgcaggcggcgtctggtagggtttgcggcggcggcggcggaggcggcggggtaggcgcagtaggttgccgccatagtggatacgcctctatcgttttgcttccgcgctcgcagcccggccggc

SEQ ID NO: 21832 - DNA, 557 bp, Triticum aestivum
  Clone ID: PAT_TA_21832
gccggccgggtccggatctttccgccctccttgcgccgtctgcccccgtcgttgcagcagaagccgcttgcgccgccccctccgtcgtcgtagcagaagcagcgacccacatcgccagcagcccaagaaagcatggacacgcaggtgaagctcgcagtggtggtcaaggtgatgggccgcaccgggtcgaggggtcaggtgacccaggtgagagtcaagttcctggatgaccagaaccgtctcatcatgaggaacgtcaaggggcctgtccgggagggcgacatcctcaccctgctcgagtctgagcgggaggccaggaggctgcgctaagcgctttctttcttcacctgtctgtcttcggaagtactcctgaaatgatgtgctgtccttcttactctactgctttcgtcttttgccttggctatggagatgtaatgagtttccttctgttgcctacattaaagtgcacttgatcattgttgcagacctcttggtaatgtgaatcgactatattgaatcctatgttttgagtataaatctggatcacttctactcgt

SEQ ID NO: 21833 - DNA, 1561 bp, Triticum aestivum
  Clone ID: PAT_TA_21833
gccgccaacctctctacaaacttgaccgatcgtccttaaaaccattatacaggctgaggttttacagaatcagctagagctgctctaagattcaaagctttgcaaaacaccaacagcaatagaaatgatcatgtgccacagtcccaccacacggtggctcctcttgctcttgtgatacaaaaatctatataggtgaaacaataaacgtctcaaatatgttcctccaagttgagtctcaatatgaatatgcctatggccgttccctgccccgtttattctttgatgacgcaagaaaatcggatgatggagcaggcactgcgctgcacatttgtcagcgctcagtccagcctccttagcaagtatgctatctggacgtccttggtcagcggcatgatcctgttgctgtacagtccagcgaccaggctgggcctgatcttgtacacaggcgccatgcccttggcttcagctcctatgttcacctcctgtccaaatatcttggccttggtttccacccgatgttcgatcgcacgctcgaccgtctcgtaggtgaggagctgcattagttgagcgccgtcctgagcttttattgcaggagtgtaatcttcaggggactcttgaaacttggcctctgccacaaactttccatagtggattctcttagagagtgcctgcaagcaggtcgtgtcgcaaagagcactggatccagaatttccatcacttccttctttcactagccttggaagaacttcatcaaagtacattttccaaatctctttgttgatattaatggaatcagcaataggatgcagaaccgttggatactggataggcggcaacagtgtctcaggcagatcttctggaaagaatgggtgttcatctgggctcttgtatctcccaacctttgcatgtagcttttcagtttctctaaccatgaattcaaccaaagagccgccaaatccatccacatggaaagaattgctatcatatgtatcagcattattaacaatattgtgtctctcccaaggagacggatatgatgctgtcttcttagtctaatcaacgaagttctgacactgtccaaggtcagtatttgactttgatctatcctcttgtttctccaccttggccaccggcgcggagttgttagttgcagcgaacagcgcccgcgccggccgcgacgacgccttcctccacgccgatccaaaggcgacgctgctccggccctgcgctccctggctcgtgccgtggcaggccgcgggcaacgcggccgccttcgatgccaccttaaactccatggccgaccgcgccccggccctccgctgcagcctggaaagtggaattgggatctctggatttggatttcagaatcaggcgtgccgggctggaaggaaaggagcaggggaggtgggtgcgtgtgaaagagagagggagaggagcgagatggttgggggagcgaagtaggtaggagtaggaccgaccgtacgagggagaggcgggagggtgaggaggggggcggaggcccggcgcggtaggtcggcctgtcgtgagggttccttctctg

SEQ ID NO: 21834 - DNA, 1973 bp, Triticum aestivum
  unsure (1)..(1973): unsure at all n locations
  Clone ID: PAT_TA_21834
gcctcggaatgagatgaagcgagacatgccggtgggaactgatgccgccagctatcgcgctccagcgccagctccagatgctgccacatcggcagccgctgcacagccgccgcctggttatgtctatgcgcagatgcagccacaacagcagttacagcagccaccacagcagcaattacagcagcagcagcaattacagcagcagcagcagttacaacagcaagctcagcagcaattgccacaacaaatacagcagcagccacagcagcaattgccgccgcaattacagcagcaagcacagcagcagcaagcacagcagcagcctccgcagccgcagcaagcacatcagccagctccacagcagtatgtcaccgcgggaaatcagcatttcattcacaacccagccacgggcacattcattccaatccaatcttattaccagcagactgtccctcagcaagcgccgcagcaacagcagtcgcctgcatttgacccaaatactggcatgtattacatccctatgcagcgtccaaatgcacctcagcagtatagcattcctgctggtgctgtagcccctatggctgccccgacacttgttgacagcgtaccgaagccaaccgtgccgattcctcagcaatatatgaagcctgaattgcagcagcctggcatgtaccgaaccgcggcgcccgctgcccctgctccaggggctaacacggcccctaattatgctggaatggggtaccaccatgtaatgcaatcccaccaccatcctgcatcgcagcctccgccgaccatggcgggaaactatgggtaccccgagtatgctgctgatccccgcgcacaggtattctactcccaggcaggagcaccaccagcatcattgccgcctcagtatcagctgcccatgggagcacctgatgccagcggtcaggctgacatgaatcagaaccgtggtggttcatagcgaaggacgggtgaattctcttattctgcgtatcctagaggtaaacctgctgttacttatcattattgttattacaagttgcgcgagtcgatcaaacattggatggtgtgattgggcagttgcgcattcgggatcaaatcaagcatgcatctggacttgtgattaggggtgggggtccaaaataagatcaaaacggtactatgttcgtccctgtgttgccgagcctgagggggagtttctgatttggtcctggagagtccatttgccgatgttgcagtaagctggggtggaaggaaggcctgtgaatgaagtgttggattacagttccaattgcttgtcttaatttttgaataaatatatagttgtctaaaaagctcagtaaaaacttccaaatcaagaactcatcatttgtgtagcccctctgtatatttaaaactcatggatggtagcgctacgcaggattagataaccaaaagagcagcaaacatggcgtgcgtcgcacaagttgttgagcaccctgccttcagttctctggccgacggctcttatttagcggtggttgctccttgtcctcgtctcatcgctgtaaagccagtcgtagacggtgggggagttgggctgcgggcaggttcagaagaggttggcagcncagaggcntcttggtggccaggttgcatcnccaggggtggaaaacagctcacagccaacacagcatgcacagccagcagcaggcaggcagtggacgacgacggcagtcaccaggcgtggtcaggggtcngtcaggcatcgacaggcagacntgcttaatcagcactcaccactgcagcatgtgttgatggcgaggggttgggtggcaggcaggcccggcggagcttgtcgaggcccgtctccgggcgaggcccaggccaccacgtcgtcccacagcttgtccagcatcctgtgcagaagttggatctgatcggtgcaagaactagtgtcactcgcttgtagcactaccaccgataagatc

SEQ ID NO: 21835 - DNA, 1289 bp, Triticum aestivum
  Clone ID: PAT_TA_21835
ggtcgaccccacgcccgtccgaaacacacacatacacacacacacacacacacagatggcacttcctgctaatgccgctgcctcgttgagcttcccggtgatccacatggagaagcttgagaccggggaaaggggcgcgaccatgggggtcatccgcgatgcctgcgagaactggggattcttcgagctgctgaaccatggcatctcgcacgagctgatgaacgaggtggagcgggtgagcaaggcgcactacgcggcgtgccgagaggacaagttcaaggagttcgcggcgaagacgctggaggccggcgagaagggcgccgacgtgaaggacgtggactgggagagcaccttcttcgtccgccacctccccgcctccaacctcgccgacctgcccgacctcgaccaccactacaggcaagtgatgaaggaattcgcggcggagatcgagaagctggcggagaaggtgctggacctgctgtgcgagaacctgggcctggagcagggctacctgaagcgagcattcgccggttcaaggggcccgacgttcggcaccaaggtgagcagctacccaccgtgcccacgccccgacctggtcgccggcctccgcgcgcacaccgacgccggcggcgtcatcctgctgttccaggacgaccaggtgagcgggctccagctcctcaaggatggagcatgggtggacgtgccgcccatgcgccacgccatcgtcgtcaacatcggcgaccagctggaggtgatcaccaacgggcggtacaagagcgtgatgcaccgcgtgctcacccgccccgacggcaaccgcatgtccctcgcctccttctacaaccccggcgcggacgccgtcatcttccctgccccggcgcttgtcgaggagctgtcggaggaggaggcggagcgcgccgggagcgccgtgtacccgaggttcgtgttcgaggactacatgaacctgtacatgcgccacaagttcgaggccaaggagccgcgcttcgaggccatgaaggcggacgccgcgcccatcgccactgcgtgactagtggactgcgcgcgcataagttcatgtgctcgtacgtgccagtactcagacaaaagtattttcagacttgtgttgtggtgtgtactgtaagatattatgcgtgtaatgttgtcactggtatttttcttatttgcttttctaaagggtactatgtttcagttcactttccttttaattcaaacgtatgaatcaagttttgattgtttaccacatgttccatgtggtgattaaaaaaaaaaaa

SEQ ID NO: 21836 - DNA, 1294 bp, Triticum aestivum
  Clone ID: PAT_TA_21836
gccggccggttcgggatctcgtgcaacatacatagccaaacacacgaaggctcgaacgtatagaaaacatgtcgaggcctctgcttgcaatggccgcggcggcgatcgtcgtcgcctgctgtttcgcggcgtgtccggtgggcgcgggcgcgagcgctggtggcttctacgacaacttcgtggtgaagtggggcacggacccagaccctgaccggcgggtcgagatcgtcgacggcggccggctcgtgacgatcaccctcaacaacgtctccggcgccgggttccagtcccgggacgccttcctcttcggcgagttcaccatggagatgaagctcgtgcccggcgactccgccggcacggtcaccaccttctacctgacatcgaaggacccgacggcggtgggggacgggcacgacgagatcgacttcgagttcctgggcaacgtcagcggggagccgtacctgatgcagaccaacgtgttcgcgcagggcgtcgggggcagggagcagcggtcctacctctggttcgacccgacagaggacttccacaactacacaatcctgtggaaccctctgaacatcatcttctctgtggacggtgtgccagtgcgcgtgttccggaaccacgacgcgaatggcgtgccgtacctgaccaggcaggcgatgaaggtgcacgcgaccatctgggacggcgatacctgggccacgcgcggcggccgggtcaagatcgactgggcgcacgcgcccttcgtcgcctcctacgggacctacgccgccagcgcctgcgtctccgccggccggcaacggcgatcaggacggagcgccgtcggccttctgctgcccgggcgacgccccgtcgtggatggcccggcggctggggccggacggcgagcgcgcggtggcgtgggcgcgcgacaagtacatggtgatggactactgcgacgacccctggaacctcggccgccccgccgagtgcgacatggaccgcctcgcctcagccgtgtaatagttttggttccgtcggccatactcaccacatacgtgtcgtcgtgtgccagacaaacaggcgtacggtgtttgtgttggtgcttctagcgtagcctgctacgtcgtctcactcagatgtgacgtgtagggctgtaggcgtagcgtatataatacaggagataactactatgagttttctctagcggatcatagcaaggatgattcctgcagaaacctgcccctgctgtaacctgtagccgtgtaattcatgcatatccagacgctgagataagattaacgcatttctg

SEQ ID NO: 21837 - DNA, 575 bp, Triticum aestivum
  Clone ID: PAT_TA_21837
gaactagtctcgagttttttttttttttttttttttttttacccaaaaactctttagcatagcacaaaattaactagttcaccaggtcaaatagccattaagtaacaagcaaactcttccaaaaaaagaccaactgtttcgacactgaatttcaagtcctagataggttctttgccaccgtcacgatcccaagcactgctccgcttacttgaagcacttggcgtccagcaaggcctgcccctcgaacggctcaaggtcctcaatcatggcttccacgcgcttcttctgggcctcgtcagagaggtcaaccttggtccactcgtagagctccatgtcgtagacctcgttcatgacgaactcagggatgtcctgcccacggaagagccacagccccttgaccttgaagggcgcctcagaaccaatcacgagcatcttgccaaaagcatacttgcggcacagatccatccgctgcaggaacccgccgaccttgttcagggtcacgtacgacacggtgttctcttcctggtacttgtagtcacagaaccacagagagtagccctctgcggacgcgtggg

SEQ ID NO: 21838 - DNA, 823 bp, Triticum aestivum
  Clone ID: PAT_TA_21838
gaggctcccctgtcccgcatttcccagagagctaccatttgccactacaacacctctccctctccctctccctctccatctccggtaggctccgggggaagaagaagaacagcacgccggcatccgccatgtctccgctcgccgaccttctcagcctcgacctgtccggctgcaccggcaagatcatcgccgagtacatatgggtcggcggcacgggcatggacgtcaggagcaaagccaggacgctgcccgggcccgttgatgaccccagcaagctcccaaaatggaatttcgacggctccagcaccggccaggccacgggcgacgacagcgaggtcatcctctgccctcaagccatcttcagggacccattcaggaaggggaacaacatcctggtcatctgtgactgctatgcgcctaacggagagccgattccgagcaacaagcggtacaacgcggcgaggatattcggccatcccgaggtcaaggctgaagaaccatggtatgggattgagcaagagtacacccttcttcagaaggacaccaactggcccattggctggccactagggggttaccctggccctcagggaccttactactgcgccgcgggtgcggagaaatcttacgggcgcgacatcgtcgatgcacactacaaggcctgcctctacgccggcatcaacatcggcggcatcaatgcagaagtcatgccaggacagtgggagttccaagtcggcccttccgtcggcatctcggccggcgacgagctctgggcggctcgctacatcctggagaggatcactgagattgctggcgtcgtcgt

SEQ ID NO: 21839 - DNA, 704 bp, Triticum aestivum
  Clone ID: PAT_TA_21839
tagcgtggtcgcggccgaggtacggcctgcacccagtcgagtttggtggtaacaccggctccggctccttcaacggcggcttgaatttcgagtccatccagaacggccagttcaagccagctgaccccaaggctgcgtcctgcttcttgtacgattcgctcaagcctgtccttctcaccggtaacctcgagggcaacttcctcgcttctttcttgctcggatggaccgtcaccactggtgccggtattgcctcttaccctctcgacaccgtccgccgccgcatgatgatgacttccggagaggccgtcaagtacaagtcctcgttcgatgccgccagccagatcgtcgccaaggagggtgtcaagtctctcttcaagggtgccggtgccaacatcctccgtggtgttgctggagctggtgtgctgtccatctacgaccagatgcagctcctcatgttcggaaagaagttcaagtaaactactcgccccacgagttcaggccgccaaaagcaaagacaatacagggtggtctgtgaaaattgagaggagaggaaggtctgcatgcctttaggagattgcagatggaagaaagtggtttgcattgctgctctgggttctacgggtgccctgggcaggatggtatgtcatgactgctgcgttgccagcagagcgtgatgcacgtgtacctcggccgcgaccacgcta

SEQ ID NO: 21840 - DNA, 3240 bp, Triticum aestivum
  Clone ID: PAT_TA_21840
aagctttgtgagattctcaaaaaaaaaaaaaaactacagtaagagcatgaaagaaactgtcgcactgctgaaccgcaccttgtcactttcatcgaacacgacctgtgcccaagatgacggtgctgcggtctaagtgaggctgaattgccttggacagaagcggactccctacaattagttaggccaaacggtgcatccatgtgtagctccgggctcgggctgtatcgccatctgcaatagcatccatggagctcgttccatgtagttggagatgaaccaatgatcgggcgtgtggacgtatgttcctgtgtactccgatagtagagtacgtgttagctctttcatggtgcaagtgaaatttgtgttggtttaattacccctacgttagttgcgggacaggagacacatcatgaatttaaaggcgatgatgtcctctcctgtaatgttattcttttgatgtgatgaatcaaaatgtcatataaaacatttgttgctctttagttaggcctgatcgtagaacgaaatgctcgtgtagcggggctacgagcctatgacgcaataacactggtttgccggcccggagtcgcttgacaaaaaaaagcatgttaagtttatttacaattcaaaacctaacatattatattccctcaaagcaggttcacgatcacacctgtacctaaaaaaaacatgaagaatatattactccattattatgagatgaaccacttggcaagagtggtaagctatataaaaaaatgaacattattacgagatgttatatgccattatattgattcgaagatatatgtttctttctcccacgggcacctaacggatacatgataaggccaaggcagatcacgggaaattattcgaatacatgttacgccctattgccggaaaaaaaatgcagggcaggtgttggccgtagcgatttaagcacttaagctggaggttgccacacttggatgcaagcgtctgacccttctaaaaaatcggcggctttgtccgtatccgtatcccctatccaacatctagctggccacacgacggggctgggcagatcgtggatgccgggtccacgtcgatcgtcagccatcatagaccaatcgaccatctgttatggatgcttgctagctagactagtcagacataaaatttggatactttctcccaactgggagacggggactgatgtgcagctgcacgtgagctaaatttttccctataaatatgcatgaaatactgcattatcttgccacagccactgccacagccagataacaagtgcagctggtagcacgcaacgcatagctctggacttgtagctaggtagccaaccatggccatgggttctgcctcttgcatttctctggtggtgctcgtggctctggccacggcggcgtccgggcagctgtcgtcgacgttctacgacacgtcgtgccccagggctctggtcgccatcaagagcggcgtggcggccgccgtgagcagcgatccccgcatgggcgcgtccctgctcaggctgcacttccacgactgctttgtccaagcaagtttcacataatatatcagctctttttcccttgaccaactttcttgaactgcctggatttaacaaaatttatattccggactaatacgtttatgttggctacagggctgtgacgcatctgttcttctgactggcatggaacaaaacgcgggtccgaacgtggggtcgctgaggggcttcggcgtcatcgacaacatcaagacccagctggagagtgtatgcaagcagaccgtctcctgcgccgacatcctcaccgtcgccgcccgcgactccgttgtcgccgtaagaacatcttagtactacactcatttacatgatcgatgctacctgaaggatagaacatatatcccctccgattcatataaattgtcgctgatttagtacatacttaatttcctacttggtctgctatctttcacatacagcttggagggccatcgtggactgtcccgctggggagacgggattccaccaccgcaagtgcctcgctggcgaacagtgacctccctggcccgagctctagccggtcacagctcgaggccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggcgaacctggacacgatgacgcccaatgcgttcgacaacgcctactacaccaacctcctgtcacagaaagggctcctgcactcggaccaggtgctcttcaacaacgagaccaccgacaacactgtccgcaactttgcgtccaacgcggcggccttcagcagcgccttcacgacggccatgatcaagatgggaaacatcgcgccgctcaccgggacgcagggccagatcaggctcagctgctccaaggtgaactcgtgattgacctacggctacacgtcggcagctcgccagaacgatacgtcgacgaataagccccagaagcagtggccagtaccgattatcataccagcacttgaaacatgtatttcaaattcaaagtatgtgcagcagcgaatcatgcatgcatctacaattctacatatgtgacgacggttgaatcctcaatttctaatgcaaaggcaaggtgaattactatcaaccctctacacttgtacacggaatgaagatgtacacttgtcttgtgacattttggcatgaagtgacccgtgctctataattttacgagaaaactctttttcaatgttaggagaaaaatggagcacacggaatgcaaaggcaaggatctttctcaaaaaaaaaaaaaactgtcgatcctacttaattacacttgtacacggagtgaagatgtacactcttgggaaatttggcatgaagtaggtacttcacgcaaaatttcacaagaagagtgtacatgctcgattattttatgtgaaaactttttttactcgatgttaagaaaaaattgaagcacacgaacaactatgtattacacgttccccgattcctatacgataatcctagacgtgcagggttgttacggtagagtggtgccccttcgttaataaccccacccggcatgaatttaagagtggtgctcatcccctaagtaatcttaagctt

SEQ ID NO: 21841 - DNA, 1465 bp, Triticum aestivum
  Clone ID: PAT_TA_21841
ggtagaaatgattgataaggagccaaacaggagcttcgtagttgagaagggtcgtggcactcctttaaaggatataccaagtgtggcacagaggttaacgaggaagaaacctgctgatcttaaatttcttcacaatgttctttttgggaggaaaggcaagactgtcgattttaaaggccatatacttcagttctctggatttgtgtggcatgagagcgatgaaaagcagagagccaaggcaaaggagaagcttgacaagtgtatgaaagacatgctggtggatctctgttggcttcttgctattccggttcccaaaacaaacatcagaaaggaagatatcgtggcaaagctgttggacttcattgctgaacctcatgctatgcctgattctggcctctctgatgaccaggggtcaaattctaggaaacgcaagagaggaggtggtagttcaagcaagacttcggatatcactcccaagaggtccaagaagaaatttgctgacgacatatctccaaggcgaaagcaagctctggagtatgatacggatgaagatgtgaagtctgatagcgaggaagatgcagatgaatctcatgatgagcaggaagatggctatgactctgccgaagaaaaggcaagtaggaagtcctcggaagtaaaatattctgcaggtagaaagaaggctgctgctgggagcacccataggacaagtccgccaaggacagcaagcaagactgcaggcaaaacatcaccatccaaaggttccaaggaaaaggagagccctgatgagagtgcaaaggtcttctctaggaagaagaaacccatcatatcaaagcatactccaagctctgaaaaggtgatagaagaaaataagtcatcaggtaaagaggcaatgaagagcaaaggcgaatcagcagaagggggtctgcccagtaaggctgagttgaagaagaccattatcggaatccttaaaaaagttgacttcaacacgtctacttttagcgacattcttaagaagctcgatgaccattacaagattgatctgaccgcaagaaaaggagctatcaaaattatgattcaagaagagctgacaaagttatcggagcaggaagacgatgatcaagacaaaaatgcagatgccaagaagaaacagtcacggcatcgagcaaaggtcaccggctgaagcattgtgaaacaccatagcattagcgcccgagtgttgattattttgtacttaatgcctacttcacttttgccttggtgggttcttgggcagtcgtatgttaattatggttcctatgttttcaaacaccaaaatcctagccctgtttgtgtatgtgaaaacataacctgtaggcagctccgtaccgggaggcacttctagctaacatttgtaggcagctccgtaccggtcataggtttgaatagaatatggacatattcggaaaaaaaaaaaaaaaaaaaaaaa

SEQ ID NO: 21842 - DNA, 1122 bp, Triticum aestivum
  Clone ID: PAT_TA_21842
caaattaatctcaccaaaccagtgcatataaattaacacacgcaggaaactacttaacaaccgaccgatatattattgcatgatgaaatcaaatttggatgaacactaaataacggatgcacttgacgatgcatgcatgcgcttgagtgatggacggatttgctgatgaattaagcgcacttggaagcccttgggggcggtcttgccgcagccttaaatgttcttattatcccaagtgtatatctcaagccgtagcaaattgaacaaggggatattaagaacatttaaggaccaaatacaaatcgaacagtatacttaaagaaagttataagaacaaaaccgatccatagtataaataaagacacctaaaatcaccaataaaaatctctaataatatacatgtgcacacaccatatctgtggaaaatatgaactaaaagaatctatgacaaagacatgtagaatagtagagttacaggtgccaccgcctcaccggtccttttgctcaccgaatcaatcgacgaatctatgatttgccgccggccgcggggcggcggctgtcgtagtcgacgacctcagcgtcggtgacggagcgggagtgctggacgatggaccggccgatggagttgatccactcctccttctccttctcggcgtcggcgatgaagtacatggtctcggccggggtggagagctcgaaggcgaactggcggttgagcacgtcctcggcgcccttgacggtgaggcaggaggagacggggatgatcccgcggggcacggagccgcgcgtgacggcggcgtccttgaaccagaagagccggccctgcttgagcacgaaccagcgccgccgccacgtcttgatgtactcgccctgcttggtcagccacccggcgcgctccgcgccgtgccagaactccacgccgcccgccgccgggtcgtcgccgccgcccgacgagggggaggaggaggagcccatgaccgcgcgccacaggctggccgccatcgcgcagggggggatcggggatccgggatcgggcgggcgcgtgcgagcgccgggggggactgcgactggggagggaggagagggacaaagtgggtggggagtattcccgacccggccggc

SEQ ID NO: 21843 - DNA, 530 bp, Triticum aestivum
  Clone ID: PAT_TA_21843
cgagggccggctccgtccgttgtaggagaagcagcttgcgccgccgcctccgtcgtctcagcagaagcagcgatccccatcgccagcagcccaagaaagcatggatacgcaggtgaagctcgcggtggtggtcaaggtgatgggccgcacggggtcgaggggtcaggtaacccaggtcagggtcaagttcctggatgaccagaaccgtctcatcatgaggaacgtcaaggggcccgtccgtgagggcgacatcctcaccctgctcgagtccgagcgggaggccaggaggctgcgctaagaaatttcttcctctatacctgtctgtctttggaagaagaatgatgtactgttgccttcttagtctaccgcttttgttctttgcctagccatgtggaggtgtgatgagttttgttctgttgcctaaactaaagtgcacttgatgttgtgagacttgatcattgttgcgcacctcttggtaatgtgaattgtgaatcgtctatattggatcctatatgatttgaaaaaaaaaa

SEQ ID NO: 21844 - DNA, 637 bp, Triticum aestivum
  Clone ID: PAT_TA_21844
ggcgctagggttctaccctctcatctttccgccctcctcgcgccgccgcccccgtcgttggagcagaagccgcttgcgccgccgcctccgtcgtcgtagcagaagcagggatccccatcaccaacagcccaagaaattaagcatggatacgcaggtgaagctcgcagtggtggtcaaggtgatgggccgcaccgggtccaggggtcaggtgacccaggtgagagtcaagttcctggatgaccagaaccgtctcatcatgaggaacgtcaaggggcctgtccgggagggcgacatcctcaccctgctcgagtctgagcgggaggccaggaggctgcgctaagcactttctttcttcacctgtctgtcttcggaagtactcctgaaatgatgtgctgttgccttcttactctactgctttcgtcttttgtcttggctatggagatgtaatgagtttccttctgttgcctacattaaagtgcacttgaagttattgttgcgcacctctgggtaatgtgaatcgactatattggatcccatgatttgagtgctggtggtctaaatctgatcacttctacttgttaaatcatctgtgcttataagcaaaaaaaaaaaaaaaaaaactcgaggggggccccgg

SEQ ID NO: 21845 - DNA, 1231 bp, Triticum aestivum
  Clone ID: PAT_TA_21845
atctcccacctgcacttgcatccacaagactgcacacaacaccacacccgagtctgaaactctgaaaaagctcaccgtcaccaattcaccatggttgttccggtgatcgacttctccaagctcgaccgcgtcgagagggcggagaccatggcgcagatcgccgacggctgcgagaactggggcttcttccagctggtgaaccacggcatcccgctggagctccttgaccgcgtcaagaaggtgtgctccgagagctaccgcctccgggaggcggcgttccggtcgtcggagccggtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcaccggcgacggcctccacgccccgttcttcggcaccaaggtcagccactacccgccgtgcccgcgcccggacctcatcaccgggctccgcgcgcacaccgacgccggcggcgtcatcctgctgttccaggacgacaaggtcggcggcctcgaggtgctcaaggacggcgagtggctggacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggcgaaggtggcgccaccgcgtacccggactacgtgttcggggattacatggacgtgtacaacaagcagaagttcgatgccaaggagccaagattcgaggccgtcaaggcgccaaaggcagcttaagcttaatcaaggagactaaaagaaaattatttacttattagctggcttttgttttacaatgaagaaaaaaaatgtatttttggagtttattcagacgcgtagcaaatatgatgtgtgggggtaattgtgattggttcggtgtcaaataattaggaaatgaagtatggatttttcaaaaaaaaaaaaaaaactcgacctcggccgcgaccacgct

SEQ ID NO: 21846 - DNA, 1280 bp, Triticum aestivum
  Clone ID: PAT_TA_21846
aacatacatagccaagaactcgaacacgtatagaaaacatgtcgagtcctctgcttgttgcaatggccgcggcggcgatcgtcgtcgtgtgctgtttcgcggcgtgtccggtgagcgcgggcgcgagcgctggtggcttctacgacaacttcgtggtgaagtggggcaccgacccggaccctgaccggcgggtcgagatcgtcgacggcggccggctggtgacgctcaccctcaacaacgtctccggcgccgggttccagtcccgggacgccttcctcttcggcgagttcaccatggagatgaagctcgtgcccggcgactcggccggcacggtcaccaccttctacctgacatccaaggacccgacggcggcgggggacgggcacgacgagatcgacttcgagttcctgggcaacgtcagcggggagccgtacctgatgcagaccaacgtgttcacgcagggggtcgggggcagggagcagcggtcctacctctggttcgacccgacagaggacttccacaactacaccatcctctggaaccctctaaacatcatcttctctgtggacggcgtgccggtgcgcgtgttccggaaccacgacgcgaacggcgtgccgtacctgagcaggcaggcgatgaaggtgcatgccaccatctgggacggcgacacctgggccacgcgcggcggccgggtcaagatcgactggggcgcacgcgcccttcgtcgcctcctacgggacctacgccgccagcgcctgcgtctccgcggccggcaacgatgatcaggaaggagcgccgtcggcattctgctgcccgggcgacgcctcgtcgtggatggcccggcggctggggcccgacggcgagcgcgcggtggcgtgggcgcgcgacaattacatggtgatggactactgcgacgacccctggaacctgggccgccccgccgagtgcgacatggaccagctccagctcgcctcggtcgtctgattgtttggttccgtcggccatactactaccgcacacgtgtcgtcgtgttatcagacagacagacgtgcggtgttttgtgttcgtgcttctagcgtagcctgctaggtcgtctcactcagatgtgacgtgtaggcgtagcgtatataatacagtagataactactgtaggagtttctctagcggatcatagcaagaatgattcctgcggaaacctgcccctgctgtaacctgtagccgagtaattcatgcatatacagacgctgagataagattaactcaaaaaaaaaaaaaaaaaa

SEQ ID NO: 21847 - DNA, 751 bp, Triticum aestivum
  unsure (1)..(751): unsure at all n locations
  Clone ID: PAT_TA_21847
ttaaccctactaaaggggaacaaaagctggagctccaccgcggtggcggcccgctctagaactatgtggatcccccgggctgcaggaattcggcaccaggcagaagcagcttgcgccgccgcctccgtcgtctcagaagcagccggagaaagcatggatacgcaggtgaagctcgcggtggtggtcaaggtgatgggccgcaccgggtcgaggggtcaggtgacccaggtgagagtcaagttcctggatgaccagaaccgtctcatcatgaggaacgtcaagggccctgttcgtgagggcgacatcctcaccctgctcgagtctgagcgggaggctaggaggctgcgctaagaaatttcttcctttatacctgtctgtcttgggaagaagaatgctgtactgttgccttcttagtctactgctttccttctttgcctagctatgtggaggtgtaatgagttttgttctgttgcctaaattaaagtgcacttgatgttgtgagacttgatcatttttgcgcacctcttggtaatgtgaatcgtgaatcgtctatattagatcctatatgatttaaaatcatcatgtgcctgtggtggtttctaaaaaaaaaaaaaaaaaaaactcgagggggggcccggtacccaattcgccctatagtgagtcggattacaattcactggnccgtcgntttacaacgtcgtgactgggaaaaccctgcgttacccaacttaatcncttgcacacatnccct

SEQ ID NO: 21848 - DNA, 2027 bp, Triticum aestivum
  Clone ID: PAT_TA_21848
cgcagcactcccgcagcggggtgcccaactccggcccggcggaggaccagcgggccaaccagcagaagctcgccgcggcggccaggcaccagcacgacgtgcagtccgtgcccgactcgccgatgctggacaagaactcctccttcggctccacgtcctcggcgccgtccctgtcgaatctgccgccgattcgggtgcggcccgaggatcggcagcctgtggcgccgccggtctctgtggaggatcactttgcccagatggggatctcggagcagcagggcctgcctccgccggtgatgggatatatgcaaccgccgccccaggcgccgatccccgccatggcgatgcaagcggccagcagcatctcgccatcggagccgcccagcagggccttctcagatgatgacaggtccgatcacgggggtcggatgcagcagccaccaaagcaggaggttccacctaccgccgaccccaacaacagggccatgttctacaatgatatgtcgcctcggaatgagatgaagcgagacatgccggtgggaactgatgccgccagctatcgcgctccagcgccagctccggatgctgccgcatcggcagccgctgcacagccaccgcctggttatgtctatgcgcagatgcagccacaacagcagttacagcagccacctcagcagcaattacagcagcagcagcaattacagcagcagcagcagttacaacagcaagctcagcagcaattgccacaacaaatacagcagcagccacagcagcaattgccgccgcaattacagcagcaagcacagcagcagcctccgcagccgcagcaagcacaccagccagctccacagcaatatgtcaccgctggaaatcagcatttcattcacaacccagccacgggcacattcattccaatccaatcttattaccaacagactgtccctcagcaagcgccgcagcaacagcagtcgcctgcatttgacccaaatactggcatgtattacatccctatgcagctgtccaaatgcacctcagcagtataccattcctgctggtgcggtagcccctatggctgctccgacacttgttgacagcgtaccgaagccaaccgtgccgattcctcagcaatatatgaagcctgaattgcagcaacctggcatgtaccgaaccgcggcacctgctgcccctgctccagggcctaacacgacccctaattatgctggaatggggtaccaccatgtaatgcaatcccaccaccatcctgcatcgcagcctccgccgaccatggcggggaaactatgggtaccccgagtatgccgctgatccccgcgcacaggtcttctactcccaggcaggagcaccaccagcatcattgccacctcagtatcagcagcccatgggagcacctgatgccggcggtcaggctgacatgaatcagaaccgtggtggttcatagcgaaggattggtgaattctgttatgctgcgtatcctagaggtaatcctgctgttacttatcattattgttattacaagttgcgcaagtcgatggcaaacattggatattgtgattggtcagctgtgcattcgggatcaaatcaagcatgcatctggacttgtgattaggggtgggggtccaaaataagatcaaaccggtactatgttcgtccctgtgttgccgagcctgagggggagtttctgatttggtcctggagagtccatttgccgatgttgcagcaagctgggggtggaaggaaggcctgtgaatgaagtgttggattacagttccaattgcttgtcttaatttttgaataaatatatagttgtctaaaaagctcagtaaaaacttccgaatcgagaactcatcatttgtgtagcccctctgtatatttaaaactcatggatggtaccgaggttgaaatgtcagatatgtgtttattatttagcttgccttgtagaaacttgatcccgagttaaatatcatcatacaccctttgtcccaaaaaaaaacctcggccgcgaccacgct

SEQ ID NO: 21849 - DNA, 716 bp, Triticum aestivum
  Clone ID: PAT_TA_21849
gaattcactagtgattagcgtggtcgcggccgaggtccgaagcagaaaagcatcgtctctcgtctcgtcgaggaatcaacaaccatgggcggtggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcacgccgaggcgaagcatccgaagagcgacctcgtccagtgcttcccccacctcaagccgtgatatctgccaaatcggacggagagagagataaaagagagagagagaagctgccgtaatccacctagtattatcatgttccgcaatgactggttgttgacctaagcatgggtctgaactctggtgtgctgctgtcccagctgctttggttgtgtgcccatctactatgtaatcgtcctctatcagcctgttgtgctacaatatcttaatcctgtgtggatttgctcctcgtgcttagtcagtatgctgtcacaaaatttatctttttgataatgtttctcgcttccaatggcaccgatgctagcttggtcagagcacggtttacagccaagcagcatcaaacatgagcagtctttttttttttcgaaagcaaacacagatttctattatgattaaaaaaa

SEQ ID NO: 21850 - DNA, 1271 bp, Triticum aestivum
  Clone ID: PAT_TA_21850
tcggcacgaggcaaccatctcattgcacagagatcagatcagagcctacctagctactcactcaccttcgtcgagaacttcaccatggttgtcccggtgatcgacttctccaagctcgacggcgccgagagggcggagaccatggcgcagatcgccgacggctgcgagaactggggcttcttccagctggtgaaccacggtatcccactggagcttcttgaccgcgtcaagaaggtgtgctccgagagctaccgcctcccgagaggcggcgttccggtcgtccgagccggtgcagacgctggagaggctggtggagacggagcggcgcggcgagggcggtggcgcccggtggacgacatggactgggaggacatcttctacctccacgacgacaaccagtggccgtccgacccgccggccttcaaggagaccatgcgggagtaccgcgccgagctcaagaagctcgcggagcgggtcatggaggccatggacgagaacctcggcctcgacaagggccgcatgaaggcggccttcaccggcgacggcctccacgcgccgttcttcggcaccaaggtcagccactacccgccgtgcccgcgcccggacctcatcaccggactccgggcgcacaccgacgctggcggcgtcatcctgctgttccagggacgacaaggtcggcggccttgaggtgctcaaggacggcgagtggctggacgtgcagccgctccccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcggaggcggccatctcgccggcggtgggcgaaggcgccgccgccgcgtacccggactacgtgtttggggattacatggatgtgtacaacaagcagaagttcgatgccaaggagccaagattcgaggccgtcaaggcgcccaaaggcagcttgattttaatcaaggagattaaaaggaaattatttactctacctattagctggctttgttttacaatgaagaaaaaaattgtatttttggagtttattcaagacgcgtagcaaatatgatgtgtggggataattgtaattggttcggtgtcaaatgattaggaaacgaagtatggatttttcattgaaaaagtatctgcttttttgaggggtaaaaaaaaaaaaaaaaaaaaaaaaaaaaaaaaaaaaaaaaaactc

SEQ ID NO: 21851 - DNA, 687 bp, Triticum aestivum
  Clone ID: PAT_TA_21851
cgaattcggcacgagggcctccctcgccctcgcctccccgccgccaccccaccaaagcagagagctcccggcttctcccccctacgaggttaggtaaggatggtgagggttagcgtcctgaacgatgctctcaagagcatgtacaacgctgagaagcgtggcaagaggcaggtcatgatcaggccctcctcaaaggtgatcatcaagttcctcatcgtcatgcagaagcacggttacattggtgagtttgagtatgttgatgaccacagatctggcaagattgttgtggagttgaacgggagactgaacaagtgtggagtcatcaagtccccgctttgatgttggtgtcaaggagattgaggggtggacccgcccaggctgcttccatctcgtcaagtttggctacatcgtcctgacaacctctgctggcatcatggatcacgaggaagccaggaggaagaatgttggtggcaaagtgctaggctttttctactgagcggaaattttgtgaaagttgtatttcagaccggtgtgataggatgttatctcaggacatcaaggttgtctactttttgcctgcatagctgctatgcctttgttatgttatgttggattcggttaattatgagatgcactttcgaatttcgggtcttgcctgcgatgaattatgcctttgaagatgccatt

SEQ ID NO: 21852 - DNA, 710 bp, Triticum aestivum
  Clone ID: PAT_TA_21852
tgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgtgcgcctgcgcagccgcctccatcgttgtagcagaagcagcgatcccccgtcgccaacaccccaagaaagcatggatacccaggtcaagctcgcagtcgtggtgaaggtgatgggccggaccggctccaggggtcaggtgacccaggtcagggtgaagttcctggatgaccagaaccgtctcatcatgaggaacgtcaagggccctgttcgtgagggcgacatcctcaccctgctcgagtccgagcgggaggccaggaggctgcgctgagcggctgcttttcctgtcttcggaagtaaactctactgcatttgaatcaacttcttgaacgctggctttgtcttttgcctaggctatggaaatgtaagcagtacttaataggttgaagttttcttctcttgcctgaattaaagtgcacttgatgttgtgagacttgatcatccgtgcgcacctctgggttatttgaattgattagatgaatgatatgttgtatcctatgatttgagtgctggtgtaaacctgaattgcttctagtaaaattatgattacctgtggcg

SEQ ID NO: 21853 - DNA, 822 bp, Triticum aestivum
  Clone ID: PAT_TA_21853
cctgcatcgcagcctccgccgaccatggcgggaaactatgggtaccccgagtatgctgctgatccccgcgcacaggtattctactcccaggcaggagcaccaccagcatcattgccgcctcagtatcagctgcccatgggagcacctgatgccagcggtcaggctgacatgaatcagaaccgtggtggttcatagcgaaggacgggtgaattctcttattctgcgtatcctagagttgcgcattcgggatcaaatcaagcatgcatctggacttgtgattaggggtgggggtccaaaataagatcaaaacggtactatgttcgtccctgtgttgccgagcctgagggggagttgtttctgatttggtcctggagagtccatttgccgatgttgcagtaagctggggtggaaggaaggcctgtgaatgaagtgttggattacagttccaattgctcgtcttaatttttgaataaatatatagttgtctaaaaagctcagtaaaaacttccgaatcgagaactcatcatttgtgtagcccctctgtatatttaaaactcatggatggtaccgaggttgaaatgtcagatatgtgtttattatttagcttgccttgtagaaacctcatcccgagttaaatatcatcatacacccttgtcccatatttttgtaccattattgatattgattccatacattctctggtttaaaaaaaaggggggccggtaccaatcgcctatatgatcgtataccgcgccacggcgtcgtttcaactcgtgacgggaaacctgcgtaccaactaacgctgcagaaatcccttcgcag

SEQ ID NO: 21854 - DNA, 1118 bp, Triticum aestivum
  unsure (1)..(1118): unsure at all n locations
  Clone ID: PAT_TA_21854
gaattcggcacgagccacagccacagccacaaccagataacaagtgcaggtagcacgcatagctctgggcttgtagctaggtagctaaccatggccatgggttctgcctctcgcatttctctggtggtgctcgtggctctggccacggcggcgtccgggcagctgtcgtcgacgttctacgacacgtcgtgccccagggctctggccaccatcaagagcggcgtggcggccgccgtgagcagcgacccccgcatgggcgcctccctgctcaggctgcacttccacgactgctttgtccaaggctgtgacgcatctgttcttctgtctggcatggaacaaaacgcgggtccgaacgtggggtcgctgaggggcttcggcgtcatcgacaacatcaagacccagctgggagagtatatgcaagcagaccgtctcctgcgccgacatcctcaccgtcgccgcccgcgactccgttgtcgcccttggagggccatcgtggactgtcccgctggggagacgggactccaccaccgcaagtgcctcgctggcgaacagtgacctccctggcccgagctctagccggtcacagctcgaggccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctgggcgaacctgggacacgacgacgcccaacgcgttcgacaacgcctactacaccaacctcctgtcacagaaagggtcctgcactccgggaccaaggtgctcttcaacaacgacaccaccggacaacactgtccgcaactttgcgttcaaacgccggcggcttcaacaacgccttcacgacggcatgatcaaagaggggaaacatcgcgccgctcacggggagcaagggcaagtnaagctcaactgctccaagtgaactcctgatggacgtagcgtcgnaacacgacacgtgaatgaataagggcccaaaacaggggcagtacactatcatacaacacttga

SEQ ID NO: 21855 - DNA, 720 bp, Triticum aestivum
  Clone ID: PAT_TA_21855
gccggccgggttcaaacacatctttatttcctccctccctgtgccgccgcctccgtccgttgtagcacaagcagaagcaccttgcgccgccgcctccgtccgttgtagcacaagcagaagcaccttgcgccgccgcctccgtccgttgtagcacaagcagaagcaccttgcgccgccgcctccgtcgtctcagcagaagcagcgatccccatcgccaacaaccaaagaaagcatggatacgcaggtgaagctcgcagtggtggtcaaggtgatgggccgcaccgggtccaggggtcaggtgacccaggtgagagtcaagttcctggacgaccagaaccgtctcatcatgaggaacgtcaaggggcctgtccgggagggcgacatcctcaccctgctcgagtctgagcgggaggccaggaggctgcgctaagcactttctttcttcacctgtctgtcttcggaagtactcctgaaattgtgtgctgttgccttcttactctactgcttccgtcttttgccttggctatggagatgtaatgagtttccttctgttgctgaaattaaaatgcacttgatgttattgttgcacacctctcggtaatgagaatcgactatattgaatcctatgttttgagtataaatctggatcgcttctacttgtaaaatcatcaagtgcatgtggtggattctgctccgtgatggcgacatcctcaccctgct

SEQ ID NO: 21856 - DNA, 1261 bp, Triticum aestivum
  Clone ID: PAT_TA_21856
gaaaaaaacgccgtcttccgcaagcgccctccgaaccaaatcgaacaaccgagagaagccatggagcgacttcagcggatcttcggcgccggcgggatgggccagccgccgtcggactcgccgttgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccatgccgcagagcgggacgggggtcagtgtcgaggccgtcgaccacgtcttccagaccaatatgctcgacatgctcaagcagaccggcaggccagaaatggtggtagggtggtatcactctcatcctggttttggttgctggctatcgggtgttgatatcaatactcaacagagtttcgaagctttgaaccccagggcagttgccgtcgtgattgaccccatccagagtgtcaaggggaaggtggtcatcgatgcatttcgtctcattaaccctcagaccatgatgcttgggcaggagccacgtcagacaacatccaatgttgggcacctgaataagccgtctattcaggctcttattcatgggctcaatagacactactactctattgcaataaattaccgcaaaaatgagctggaggagaagatgctgctcaaccttcacaaaaagaaatggactgatggattaattctgaagaaatttgacgcacattcagaaaccaatgagcagactgttcaggaaatgctgagcctagccatcaagtacaacaaggcagtgcaagaggaggatgagttgtctcctgagaaattagcaatagctaatgtgggacggcaagatgctaagaagcatctagaagagcatgtctcaaatctgatgtcgtccaacatagttcagaccctaggtaccatgcttgacacggttgtcttttagtctaccactagtgttgttccaaagtctatcattcatgttatgtatccaaagcctgccacaacgcagcaaggcacattcgggttctaacagtttgctcgacagactcaattttctgtagtactatattctgcatgtttaatttcgcagcaattttcatgggtgtcctttaaaattgcaagttctggttctgccgaagtgacatgattgctgaagtcagctaaatcttatgctgatggatatgtggctgcccatgtgttaatatgacttgtggtggagt

SEQ ID NO: 21857 - DNA, 1384 bp, Triticum aestivum
  Clone ID: PAT_TA_21857
gccggccggttcgggagcacctgcacttacatccacaagactgcacacaacaccacacccgagtctgaaactctgagaagctcatcgtcaccaattcaccatggttgttccggtgatcgacttctcgaagctccacggcgccgagagggcggagaccatggcccagatcgccgacggctgcgagaactggggcttcttccagctggtgaaccacggcatcccgctggagctccttgaccgcgtcaagaaggtgtgctccgagagctaccgcctccgggaggcggcgttccggtcgtccgaacccgtgcagacgttggagaggctggcggaggcggagcggcgcggcgaggcggtggcgcccgtggacgacatggactgggaggacatcttctacctccacgacgacaaccagtggccctccgacccgccggccttcaaggagaccatgcgggagtaccgcgccgagctcaagaagctcgcggagcgcgtcatggaggccatggacgagaacctcggcctggacaagggacgcatgaaggccgccttcaccggcgacggcctccacgcgccgttcttcggcaccaaggtcagccactacccgccgtgcccgcgcccggacctcatcaccgggctccgcgcgcacaccgacgccggcggcgtcatcctgctgttccaagacgacaaggtcggcggccttgaggtgctcaaggacggcgagtggctcgacgtgcagccgctcgccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggtggccatctcgccggcggtgggcgaaggcgccgccgccgcgtacccggactacgtgttcggggattatatggacgtgtacaacaagcagaagttcgaggccaaggagccaagattcgaggccgtcaaggcgccaaaggcagcttaagcttaatatcatggcgattaaacgaaaattatttacctattagctggcttttgttttacaatgaagaaaaaaaattgtgtttttggagtttactcagacgcgtagcaaatatgatgtgggaaaaatgtgattggttcggtgtcaaatagagtaattaggaaatgaagtatggatttttcattagactagaacaatgcccgtgcgttacaacggagtataaatattcgaatacattaacttgtgatttatctgtcaataataatataattgtcattagactaaaaaaaaaaaaaaaaaaaaaaaaaaaaaaaaaaaaactcgacctcggccgcgaccacgctaatcactagtgaattc

SEQ ID NO: 21858 - DNA, 2805 bp, Triticum aestivum
  unsure (1)..(2805): unsure at all n locations
  Clone ID: PAT_TA_21858
gaggaattcggcacgagggcgacgggggcggggacgcgacgcggctcccactcttccgcacgaataccgctctcctctagctggagcaataagggacacccggatgactggggcagacctggcaccagtaatggagttgaaggctgtggcaaatggaggaacatccactgacgttgttgcttctgataagaaggataataccaagatggaagaggctggcgagagcaaggatgttgcagtagcgaataccaatgccaaccaacagaataaagcctcagaaaatggcgctaagggctcatctgatgatgatgccaagatggaggaggctgaagatgcaaaggaagatgacaaagccaaagcagcagaacacgatgatcacagaacaggtggtgtggcagcagaacacaaggatcacagaacaggtggtgtggaggatgcagatgcaaatgaagacattggcgccaaggctgaagagttcaaggatggcaacatgaatactgtagacaatgcagatgcaaaggaagatgaatatgccaatgcatcagaacatgaagatgccaaaatggttgatgtggatgatgcagatgcaaaggaagattatggcaccaaggtagcagaacatgaggatgtcaaaatgggtgccgtggaggatactgatgcaaaggaagataacaacaccaaggaagcagaacatcaggatatcataatgggtgcggtaaagcatgcagatctaaaagaagataacagttctaatgtagcagaacgcgtggatgtcaaaatggcggaggctgagaccaatccaggagatgcagagctcgaagacaaagggcacaaggaagaaatggatgtgaacacagaggtcaagaagggaccgagagatgcagaaaaatgtggttctgagatgcatgatgaattgaatgggcaaggaaagaatggagcggctcggcagcaagaaaatacagctgaagaaatgagtgatgatgatagtcaaggggaagaggaagtagaagaaaagggctcttcagataagaaagaggaaggaggggatggtaaggcaaacgagaatgaagagaagctagaaaaagaaagtgcgaacaaggaaggaaaagatggcaaggtaacagaagaggaggccagcgaggcagacaagaatgtggaagagaataaggaggaaacacctaagaacaagagggcaaggagttctagggatagacgccagggacaggacaagaaacaacatgggtccaaatccagggaagccaaaagtttactgtacactcccagcccttatggtattgatcgccctcaacgtgagaggaaaatagtagagaggttggttgaagtgattgataaggagccaaacaggagcttcgtagttgagaagggtcgtggcactcctttaaaggatataccaagtgtggcacagaggttaacgaggaagaaacctgctgatcttaaatttcttcacaatgttctttttgggaggaaaggcaagactgtcgattttaaaggccatatacttcagttctctggatttgtgtggcatgagagcgatgaaaagcagagagccaaggcaaaggagaagcttgacaagtgtatgaaagacatgctggtggatctctgttggcttcttgctattccggttcccaaaacaaacatcagaaaggaagatatcgttgcaaagctgttggatttcattgctgaacctcgtcttatgcctgattctggcctctctgatgaccaggggtcaaattctaggaaacgcaagagaggaggtggtagttcgagcaagactttggatatcactcccaagaggtctaagaagaaatttgctgacgacatatctccaaggcgaaagcaagctctggagtatgatacggatgaagatgtgaagtctgatagcgaggaagatgcagatgaatctcatgatgagcaggaagatggctatgactctgccgaagataaggcaaataggaagtcctcggaagtaaaatattctgcaggtaaaaagaaggctgctgctgggagcacccataggacaagtccgccaaggacagcaagcaagactgcgggcaaaacatcaccatccaaaggttccaaggaaaaggagagccctgatgagagtgcaaaggtcttctctaggaagaagaaacccatcatatcaaagcatactccaagctctggaaaggtgatagaagaaaataagtcatcaggtaaagaggcaatgaagagcaaaggcgaatcagcagaagggggtctgcccagtaaggctgagttgaagaagaccattattggaatccttaaaaaagttgacttcaacacgtctacttttagcgacattcttaagaagctcgatgaccattacaagattgatctgaccgcaagaaaaggagctatcaaaattatgattcaagaagagctgacaaagttatgggagcaggaagacgatgatcaagacaaaaatgtagatgccaagatgaaacagtcacgacatcgagcaaaggtcgccgtctgaagcattgtgaaacaccatagcattagcgcccagtgttgattattttgtacttaatgcctacttcacttttgccttggtgggctcttgggcagtcctatgttaattatggttcttatgtttgcaaacaccaaaatcctagccctgtttgtgtatgcgaaaacataacctgtaggcagctccgtgctgggaggcacttctagctaacatttgtctgtagatttgcatatgctttccaaaactcgaatggttgtagcagagcatgtggaggtgggtaataggttnaatagaat

SEQ ID NO: 21859 - DNA, 1208 bp, Triticum aestivum
  Clone ID: PAT_TA_21859
gctgcagggaatttcggcacgagggaaaaaaacgccgtcctccccaagcgcccccctcactcaggaaccaaatcgaacaacccagagaagccatggagcggctgcagcggatcttcggcgccggcgggatgggccagccgccgtcggactcgccgctgctcgactcctccgagcaggtctacatctcgtccctcgccctcctcaagatgctcaagcacgggagggccggcgtgccgatggaggtcatgggcctcatgctcggcgagttcgtcgacgactacacggtccgggtggtcgacgtcttcgccatgccgcagagcgggacgggggtcagcgtcgaggccgtcgaccacgtcttccagaccaacatgctcgacatgctcaagcagaccggcaggccagaaatggtggtagggtggtatcactctcatcctggttttggttgctggctatcgggtgttgacatcaatactcaacagagtttcgaagctttgaaccccagggcagttgccgtcgtgatcgaccccatccagagtgtcaaggggaaggtggtcatcgatgcatttcgtctcattaaccctcagaccatgatgcttgggcaggagccacgtcagacaacatccaatgttgggcacctgaataagccatctattcaggctcttattcatgggctcaatagacactactactctattgcaataaattaccgcaaaaatgagctcgaggagaagatgctgcttaaccttcacaaaaagaaatggactgatggattaattctgaagaaatttgacgcacattcagaaaccaatgagcagactgttcaggaaatgctgagcctagccatcaagtacaacaaggcagtgcaagaggaggatgagttgtcccctgagaaattagcgatagctaatgtgggacggcaagatgcgaagaagcatctagaagagcatgtctcaaatctgatgtcgtcgaacatagttcagaccctaggtaccatgcttgacacggttgtcttttagtctaccactactgttgttccaaatcattcatgttatgtatccaaagcctgccacaacgcagcaaggcaattcgtgttctaacagtttgctcgacagactcaattttctgtagtactatcttctgtatgtttaatttcgcagcaattttcatgggtgtactttaaaattgcaagttctggttcaaaaaaaaaa

SEQ ID NO: 21860 - DNA, 1069 bp, Triticum aestivum
  Clone ID: PAT_TA_21860
gccggcccgggtcgggacctcccacctccacgtctattaaacgcagccgcctcctgcttctcgccttccccccaaatttccgccgaagcagaaaaagcatcgtctcgtctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcatgccgaggcaaagcatccgaagagcgagctcgtccagtgcttccctcacctcaagcagtgatatctgcccaatcagacagagagagagataaaagagagagagagagagaagctgtcataatccacctactattatcatgttccgcaatgactgattgttgacctaagcttggggtctgaactcggtgtgctgctgtcccggctgctttggttgtgtgcccatctactatgtaatcgtcctctatcagcctgttgtgctacattatcttaatcctctgtggatttgctcaaaaaaaaaaacccagctagctacagcccacccacgttacgatggcgtccttcgccagagctgcccgtttcatggtgctcctgcagatcgcgctcttcgccgtctccgcggtgatcatgagcagctccgtctgctacggagccgggatcagtcctggtgctctggaccctagccgccgccccatatgcagaggcaggccgtgcggacagcctggcctaccgtacggcggccgtcctcggccctacccttaccgtccgcagcccggccctggagcccctccgccgtacaatggagggattggacgaccatgatcatagcagtacaagttgctgcaacaaccttactgaaccgggagtgtaatatccggtcgtacgaataactcccgtttattactgcgaataaaactgcaaatctgccccccatatgtgaatgggtgtgtgaacgcgaaaaaaaaaaaaaaaaaaaggccccta

SEQ ID NO: 21861 - DNA, 556 bp, Triticum aestivum
  Clone ID: PAT_TA_21861
gccggccgggtcggggtcttctttccgccctacttgcgcctgcgccgccgcctccgtcgttgtagcagaagcagcgatcccccgtcaccaacagccgaagaaagcatggatacccaggtcaagctcgcagtcgtggtgaaggtgatgggccgcaccggctccaggggtcaggtgacccaggtcagggtgaagttcctggatgaccagaaccgtctcatcatgaggaacgtcaagggccctgttcgtgagggcgacatcctcaccctgctcgagtctgagcgggaggccaggaggctgcgctgagcggctgcttttcctgtcttcggaagtaaactctactgcatttaaatcaacttcttgaacgctggctttgtcttttgcctaggctatggaaatgtaagcagtacttaatatgttgcagttttcttctgttgcctgaattaaagtgcacttgatgttgtgagacttgataatccttgcacacctctgggttatttgaattgattggatgaatgatatattgtatcctatgatttgagtgctggtaaaaaaaaaa

SEQ ID NO: 21862 - DNA, 696 bp, Triticum aestivum
  Clone ID: PAT_TA_21862
gttttctctacccgccgtcgccttcctccctcgccctcgcctccccgccgccaccccaccaaagcagagagctccccgcttctctcccccacgaggttaggcaaggatggtgagggttagcgtcctgaacgatgctctcaagagcatgtacaacgctgagaagcgtggcaagaggcaggtgatgatcaggccctcctcaaaagtgatcatcaagttcctcatcgtcatgcagaagcacggttacattggtgagtttgagtatgttgatgaccacatctgacaagattgttgtggagttgaacggcagactgaacaagtgtggagtcatcagcccccgctttgatgttggtgtcaaggagatcgagggatggaccgccaggctccttccatctcgtcagtttggctacatcgtcctgacaacctctgctggcatcatggatcacgaggaagccaggaggaagaacgttggtggcaaagtgctaggctttttctactgaaggaaaattttgtgaaagttgtatttcagaccggtgtgataggatgttatctcaggacatcaaggttgtctactttttgcctgcatagctgctatgcctttgttatgttatgttggattcagttaattatgaggtgcacttttgaatttcgagtcgtacctgcgatgaattatgactttgaagatgcaaaaaaaaaaaa

SEQ ID NO: 21863 - DNA, 1303 bp, Triticum aestivum
  Clone ID: PAT_TA_21863
ctcgtgccgaattcggcacgagtaacaaccatctcatctcattgtagcgagatcagatccgagcctacctagctactcactcaccttcgtcaagaacttcaccatggttgtcccggtaatcgacttctccaagctcgacggcgccgagagggcggagaccatggcgcagatcgccgacggctgcgagaactggggcttcttccagctggtgaaccacggcatcccgctggagctacttgactgcgtcaagaaggtgtgctccgagagctaccgcctccgggaggcggcgttccggtcgtccgagcccgtgcagacgctggagaggctggtggaggcggagcggcgcggcgaggcggtggcgcccgtggacgacatggactgggaggacatcttctacctccacgacgacaaccagtggccctccgacccgccggccttcaaggagaccatgcgggagtaccgcgccgagctcaagaagctcgcggagcgggtcatggaggccatggacgagaacctcggcctggacaagggccgcatgaaggccgccttcaccggcgacggcctcctcgcgccgttctttggcaccaaggtcagccactacccgccgtgcccgcgcccggacctcatcaccgggctccgcgcgcacaccgacgccggcggcgtcatcctgctgttccaggacgacaaggtgggcggcctcgaggtgctcaaggacggcgagtggctggacgtgcagccgctccccgacgccatcgtcgtcaacaccggcgaccaggtggaggtgctcagcaacggccgctaccgcagcgcgtggcaccgcgtcctgcccatgcgcaacggcaaccgccgctccatcgcgtccttctacaacccggcgttcgaggcggccatctcgccggcggtgggggaaggcgccgccgccgcgtacccggactacgtgttcggggattacatggatgtgtacaacaagcagaagttcgatgccaaggagccaaggttcgaggccgtcaaggcgccaaaggcagcttaagattaatcaaggagattaaaagaaaaatatttacctattagctggcttttgttttacaatgaagaaaaaaaaaaaggtaattttggagtttattcagacgcgtagcaaatatgatgtgtggggataattgtgattggttcggtgtcaaataattaggaaatgaagtatggatttttcattgaaaaagtatctgattttttctaggggttaaaaaaaaaaaaaaaaaactcgagactagacctcggccgcgaccacgctaatccgaattccccg

SEQ ID NO: 21864 - DNA, 817 bp, Triticum aestivum
  unsure (1)..(817): unsure at all n locations
  Clone ID: PAT_TA_21864
tagcgtggtcgcggccgaggtacggtgccgcctctttcctttacgagctcatgccatccggcactcgaaactacgctcccgacgtctacaccatctcctcgttcttcggcgctgagcagaacgctgacggcagctggagattcaacggcaaggagaggattcctgacaactggaccaaccgtgtcgctccatacaccatgttcaatgtcggccaacagatcttcgagatgtacggcctgcacccagtcgagtttggtggtaacaccggctccggctccttcaacggcggcttgaatttcgagtccatccagaacggccagttcaagccagctgaccccaaggctgcgtcctgcttcttgtacatgctcaccaccgagcgtgtcccatcatacttcaactctgttttgactccaaccgtcgagtctctcagctttgccgccagcaagctgagcggcactgactttgccaaccttggatgtccccgcccgcttaccaagtaagtgtggtcatgtcaacgatcgggtacgttgatgatcacaggtctggcaagatcgtggttgaattgaatggcaggctgaacaagtgtggtgtcatcagtcctcgctttgatgttggtgtcaaggagattgagggatggactgcaaggctccttccttctcgtcagtttggttacattgtgctgacaacttctgctgggatcatggaccatgaggaggcaaggcgtaagaatgttggtggcaaagtgctaggctttttctactgaaaatggaaaatggaaaattcgatggaagtacctnnnnnnggcnnnnnngctcga

SEQ ID NO: 21865 - DNA, 2197 bp, Triticum aestivum
  Clone ID: PAT_TA_21865
gaattcggcacgaggtctcgagttttttttgtttttttttatctactaacaatgttatgttcatatttaagtcggtgccaagcaacagaaagagtacatgagccacagaaagagagcacatgatgctctgggaaatatttgcagagtactgctctccacaggagagaaacagataacaacaataaacaagagtgagtacaccaggcagttcgatcacatggatttttattaagaccagcaaccacaactattgcgaagctaggcgaccaatgactgactgagatgacgacgatgaagacctcggcacttactagggcataaccttttgaatcatcgtctcacggaattacgaggcagccctccccaacagctgaagggccaaccgggacaggtgcataaatggcatcatcaatttccaaatccacctgggactgaaccaaacaagcagcatcaaagatgtaggccttcacttcctcaaagcgtgcttccgacagagagaccacggcgaggagtctccatgcccgaagcttctgatgcctcctcgtagtcatccctacgtttcagtacaatgtggccactgatctcccaaacagcagggttcaccctgtgtgtccagcagttcctgactcacatcgcccagagcctgcttctcagcatagcactggggaaagaggaagatcttcctgccagagtctgaaatgagcacattgtaaggcacattgttgtcctgcagccaaatgcaagcactggaaaccacattggccagatcattcagggtgttgccttcctcaaaaaccagtcctctcacggggtagttcattagcttcgacaccttcactccactctttatcccgccctcagcaaggggaatcctctgggtagctgccttctcgacaggaaaaggcactgtcaagtagtatgcctgaaagtggaggtggttgatagttgcaaaggcacccaaactattgtaaccaagcctgaagtatggtctagctgcctcagcccgccatgtgcagtgctagcaagaagctctcttggtcaatcctctgaggcagatggtccaggacccgggggaataagaagaacatggccatattcaattgggctcacattgattgccacaacattaggagcacgatcagcaacagtgactgcggcactcctcaggaagtagctgtcatcactaccactgttctcaaattggaagagcacctcctcctggccaactttggtgaaattgaacttggcagagtcaaatggttgaagcacacgatccacacggaactctgtaggacgtttcttgaggtggcgcccttcatttagttgagcaacgaaaccaaggttgccagggatcaccttggtctcacatgcagtgacatcatatcgaaataagccttgggtcatcctgtcctcccactgcccaaggaggagattgatgaagaaatcagtaggaacagcatcctcctgtaaaggcagctttgttggatttgccttgaaagcatagacaggaagctcagaaacaggcaggcagcaatgtccgaggcagttcctcccacaccctccgcgtggccgctcgccagcgtcttcctggtagttggacacgacggtgggtaccctcttaatcgtcagcttcatctccaacgtcttacaaagaaaagtctcccactctgttggttgtactcctctgtttctctctcggagagtgagcccagtcggtcagtcagtcagcggatgatggttagggtgggatttggttagtgggcgggcgagaggctcagaggcgaccgccgcccgcgaggaagaggaggtcagatgggctgccgccggcggacgggagggccccgcggccgccgtgcgaggcggggctggaggaagcgatggtggccgttggctccacctgcgcagcagcgtggccgcgccggaaggctgcaacgctagccgtgatgactttcaacggcccaaaaggggagagggtgaagctccagttgggactgccgcgagggatccgaaatccctctccctctcttctcttctcttctccggcgaggcagagggcgtggcgatggcgccgtgtgggttcggttcagcgttgggaggcgagcggagccggagggggagtgggtctcgagtttttttttttttttttttaacaacctttttctttatctataaacactcgcacgaccacacaataaag

SEQ ID NO: 21866 - DNA, 575 bp, Triticum aestivum
  Clone ID: PAT_TA_21866
gattaaacgcagccgcctcctgcttctcgccttccccaccaaatttccgccgaagcagaaaaagcatcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcatgctgaggcgaagcatccgaagagcgacctcgtccagtgcttcccccacctcaagcagtgatatctgcccaatcagatggagagagagataaaagagagagagaagctgtcataatccacctagtattatcatgttccgcaatgactgattgttgacctaagcttgggtctgaactctggtgtgctgctgtcccagctgctttggttgtgtgcccatctactatgtaatcgtcctctatcagcctgttgtgctacaatatcttagtcctgtgtggatttgctcctaaaaaaaaaaaaaaaaaaggccccta

SEQ ID NO: 21867 - DNA, 1282 bp, Triticum aestivum
  Clone ID: PAT_TA_21867
ctcgtgccgaattcggcacgagcagataacaaccatctcattgtagagagatcagaccagagcctacctagctactcactcatcttcgtcaagaacttcaccatggttgtcccggtcatcgacttctccaagctcgacggcgccgagagggccgagaccatggcgcagatcgccgacggctgcgagaactggggcttcttccagctggtgaaccacggcatcccgctggagcttcttgaccgcgtcaagaaggtgtgctccgagagctaccgcctccgggaggccgcgttccggtcgtccgagccggtgcagacgctggagaggctggtggaggcggagcggcgcggcgaggcggtggcgccggtggacgacatggactgggaggacatcttctacctccacgacgacaaccagtggccctccgacccgccggccttcaaggagaccatgcgggagtaccgcgccgagctcaaggagctcgcggagcgggtcatggaggccatggacgagaacctcggcctggacaagggccgcatgaaggccgccttcactggagacggcctccacgcgccattcttcggcaccaaggtcagccactacccgccgtgcccgcgcccggacctcatcaccgggctccgcgcgcacaccgacgccggcggcgtcatcctgctgttccaggacgacaaggtaggcggcctcgaggtactcaaggacggcgagtggctcgacgtgcagccgctccccgacgccatcgtcgtcaacaccggcgaccaagtggaggtgctcagcaacggccgctaccgcagcgcgtggcaccgcgtcctgcccatgcgcaacggcaaccgccgctccatcgcgtctttctacaacccggcgttcgaggcggccatctcgccggcggtgggcgaaggcgccgccgccgcgtacccggactacgtgttcggggattacatggacgtgtacaacaagcagaagttcgatgccaaggagccaaggttcgaggccgtcaaggcgccaaagtcagcttaaggcttaagctcaatcaaggagattaaaaaggaaattatttacctattagctggcttttgttttacaatgaagaaaaaaaatgtatttttgagtttgctcagacgcgtagcagtatgatgtggggatacttgtgattggttcggtgtcaaataattaggaaatgaaatatggatttttcgttggaagtatctaaaaaaaaaaaaaaaaaaaaaaaaaaaacctcgagactagacctcggccgcgaccacgctaa

SEQ ID NO: 21868 - DNA, 1366 bp, Triticum aestivum
  Clone ID: PAT_TA_21868
aggaattcggcacgaggctcctctgccccgcatttccaagaacacctctcccttcccttgctctgccctctccatctccatctccggctccgggaagaagaagaagaggtagccatgtctccgctcgccgaccttctcagcctcgacctgtccggctgcaccggcaagatcatcgccgagtacatatgggtcggcggcacagggatggacgtcaggagcaaagccaggacgctgcccgggcccgtggaggaccccagcaagcttccaaaatggaattttgacggctccagcaccggccaagccacgggtgacgacagcgaagtcatcctctgccctcaagccatcttcaaggacccattcaggagggggaacaacatcctggtcatctgtgactgctatgcgcctaacggagagccgattccgagcaacaagcggtacaacgcggcgaggatattcggccatcctgatgtcaaggctgaagaaccatggtatgggattgagcaagagtacacccttcttcagaaggacaccaactggcccattggctggccactagggggttaccctggtcctcagggaccttactactgcgcccgcgggtgcggagaaatcttacgggcgcgacatcgtcgacgcgcactacaaggcctgcctctacgccggcatcaacatcggcggcatcaatgcagaagtcatgccaggacagtgggagttccaagtcggcccttccgtcggcatctcggccggcgacgagctctgggcggctcgctacatcctggagaggatcactgagattgctggcgtcgtcgtctccttcgaccccaagccgatcccgggagaatggaatggtgctggtgcccacacaaactacagcaccaagtcgatgaggagcgagggcgggtacgaggtgatcaagaaggcgatcaagaagctcgaggcgcggcacatggagcacatcgccgcctacggtgagggcaacgagcgccggctcaccggccgccatgagaccgccgacatcaacaccttcgtatggggcgtggcgaaccgcggcgcgtcggtgcgggtgggccgcgacaccgagaaggaaggcaagggctacttcgaggaccggaggccggggtccaacatggatccctacgtcgtcacctccctgatcgccgagaccaccatcctctgcaaggccggcctctccaatggcaagtagatgtcatctttgatgggttctgtcttctgtgtgagtgcccgtggttgtgtgtgtgtgtgtgtgtgtgtgtgtgcagtgatgagactggcagggtttgaataatgatgataaagcaataacatgtaatgtaatgtgcttgtgggcggatgtatttcctcgtcc

SEQ ID NO: 21869 - DNA, 800 bp, Triticum aestivum
  Clone ID: PAT_TA_21869
gagaggaacaagtaggagtagattctaatcaggtgtcaaattgtttcactcttccagcaaatgtactgtcctgtaaatcatcaggcaaaaggggagctacaagccttcatacacactgggaaaaccagcgaaaaggagcatgcatcgcgatgtgcggctgttctgggtggagacgagagtttctaaggagcggaaggtttcatttattcaaaacatccagaggagcagctgcccttccaatgtggatttacgcgaggcatgagtaggccagcgccttctcctccgacagctcctgggcggtcgcatccatcttcttcctcgagaactcatcgatcgggagaccttgaacaattgtccattcaccaccactgcacgttactgggaaggagtagataagaccagcaggcacaccatatgaaccatcagagtacacacccatggaaacaaatgttccctcaggggttcccagaacccagtcacggatgtgatcacaagctgagctggcagcagagagagcactggagagcttcctcgctttgatgattgcagcaccacgctgctggacagtggcaatgaactccccatttagccattcatcatcttgaacaagttcacgaacaggcttctctccactgggagtcttcacagtggcgtggttaacatcagggtactgactggacgagtgattaccccagataatagcattcttcacgtcagaaacttggacaccaagtctctcagaaatctgaccgagtgccctgttgtggtctaggcgggtcaaacaactgatgttcttctca

SEQ ID NO: 21870 - DNA, 711 bp, Triticum aestivum
  Clone ID: PAT_TA_21870
gccggccgggtcgaaatcttctctcccccctccctgcgccgccgcctccgtccgttgtagcacaagcagcttgcgccgcctcctccgtcgtcccatccccaacagccgaagaaagcatggacacgcaggtgaagctcgcggttgtggtcaaggtgatgggccgcacggggtcgaggggtcaggtgacccaggtgagagtcaagttcctggatgaccagaaccgtctcatcatgaggaacgtcaagggacccgtccgtgagggggacatcctcaccctgctcgagtctgagcgggaggccaggaggctgcgctaagaaatttcttcctttatacctgtctgtcttcgggaagaagaatgctgtactgttgccttcttagtctactgctttcgttatttgcctagctatgtggaggtgtaatgagtcttgttctgttgcctaaattaaagtgcacttgatgttgtgagacttgatcattgttgcagacctcttggtaatatgaaccgtgaatcgtctatattagatcctatatgatgtgcaaggcccgcatgaaggccgccttcactggagacggcctccacgcgccattcttcggcaccaaggtcagccactacccgccttgccctttcccggaccaaacaaaaaaataaaaagcgcactccgacgccggaggggccatcctgctgtaccagtaccccaatgtaagtttttt

SEQ ID NO: 21871 - DNA, 1140 bp, Triticum aestivum
  Clone ID: PAT_TA_21871
gcaaacacagccaaccgctccaaatcgccgaagctactctctcctatcggcgagaagaagtgggggagatcttcgtcttcagcactcgcgcgcgcaagctcactcgctccagatctccccttaccatcgtgtagatctcacgcccccaagccgccacgcccccaacgaaaccctagctcgcgcccctccgccgcgtaggggcgccgtcatgggcatcgtgttcacgcggctcttctcgtcggtattcggaaaccgcgaggcccgcatcctcgtcctcggcctcgacaatgccggcaagactactatcctctatcggctgcagatgggggaggtcgtttccacgatcccaacgatcggggttcaacgtggagacggtgcagtacaataacatcaagttccaagtttgggatctcggtggtcaaacaagcatcaggccatactggagatgctactttccaaacactcaggctatcatatatgttgttgattcaagtgatactgataggctggtaactgcaaaagaagaatttcattccatccttgaggaggatgagctgaaaggtgcggttgtccttgtatatgcaaataaacaggaccttccaggtgcacttaatgatgctgccataactgaatcattagaacttcacaagattaagagccgccaatgggcaattttcaaaacatctgctataaaaggggaggggctttttgaaggcttgaactggctcagtaatgcactcaagtccggaggcagctaatgtaggaggcccagcctccattccgtgaatcattgcttgatggtaaggaacagggacgatgacagccttctcgctagtctgcgtgaaaatgagaatctctttatttttactccggaagttatacacaatcagttttctgtagagtgcttgttgaagtttccagatacaacactaggtgtaccatgtcgagagcaagaatatatttgtagaaaataccgagcaaatgattacggtttgaaatatgtggcttcaccgcgtaaaatttcaccccattttcttttccaatgattgaactcgcaattttttttccgcgtctctttggctgggaccagatcagatgcctgaagttactcaatccctgaaatccaatcatgtcatttac

SEQ ID NO: 21872 - DNA, 914 bp, Triticum aestivum
  Clone ID: PAT_TA_21872
gttttttttttttttttttaatgaatgaatattctgcaaattacatttcatcaaacaaatacacaagtattacacatgcttaatgaaattactgttcaagcacacgcacgcgcgcgccccaatcgtatttatctcttgtagtacacagccaaactaggacaaattaatctcgccaaaggcagtgcatataaattaacacacgcaagaagaactacttaacaaccgaccgattattgcatgatgaaatcaaatttggaatgaacaactaaaataacatacatgcatacatgcactgacgatgcatgcatgcgctgagtgatggacgatttgctggagtgtaactgatgaactaagcgcactggaagcccttgggggcggtcttgccgcagtagttgaggaggaggctgagcttgacggggatgttgaggacgatgccgaggacgttggccttgagcgcggtgcagaggcacacggcggcctcgaggtcggccaggccgccgaggaggctgcagcacttgtcgccgccgccgctggggggcttgccgacgcccacgttcaccaggcccagcacgttggcgcaggcgcccagcttcagtgtgtccgtggggcacgacgtgccgccgccgccgcctgacgaaggaggtgggcacggcgtcgtagacggcgatggtgggggcggggatggggaggccggcggcggggtttggtgcttgcagctgccgcaggcatcgccggcgaggaacgtgttggccaccagcagcgccagcaggcacgccgccgagaaggtcctggacgccattgctgccggctagctagtaggtactgctggtgagagtgagctaggagatcaaattcgagttcgagccggtagatactattgattaactagataaaactaaagataaagaaggtat

SEQ ID NO: 21873 - DNA, 1154 bp, Triticum aestivum
  unsure (1)..(1154): unsure at all n locations
  Clone ID: PAT_TA_21873
ccacagccagataacaagtgcaggtagcacggatagctctggacttgtagcttaccatggccatgggttctgcttcttgcatttctctggtggtgctcgtggctctggccacgggcggcgtcggggcagctgtcatcgacgttctacgacacgtcgtgccccagggctctggccaccatcaagagcggcgtggcggccgccgtgagcagcgacccccgcatgggtgcctccctgctcaggctgcacttccacgactgctttgtccaaggctgtgatgcatctgttctgctgtctggcatggaacaaaacgcgggtccgaacgtgggggtcgctgaggggcttcagcgtcatcgacagcatcaagacccagctggagagtatatgcaagcagaccgtctcctgcgccgacatcctcaccgtcgccgcccgcgactccgttgttgcccttggagggccgtcatggactgttccactcgggagacgggactccaccaccgcaagcgcctcgctggcgaacagtgacctccctggcccaggctctagccggtcacagctcgaggctgcgttcctcaagaagaaccttaacacggtcgacatggtcgcgctctcaggcgcgcacaccatcgggaaggcccagtgctccaacttccggaatcggatctacggcggtgacaccaacatcaacactgccttcgccacgtctctcaaggccaactgcccccagtccggcggcaacagcaacctgggcgaaccttggacacaacgacgcccaacgcgttcgacaacgcctactacaccaacctcctgtcacagaaagggctcctgcactcggaccaggtgctcttcaataacgacaccaccgacaacaccgtcccgcaacttcgcgtccaacgcccgcggccttcagcagcgccttcacgacggccatgattaagatgggaaacatcgcgccgctcaacggggacgcaaggccagtttaggctcaactgctccaaggtgaactcntgatggacgtatgcgtcggcaacacgacacgtgaatgaataaggcacaaaaacagtggcagtacacttatcataccaacacttgaatcgtgtatttaaagcatgtcacacaaatntcatgatcactatgtacacggtgatccnaattcc

SEQ ID NO: 21874 - DNA, 660 bp, Triticum aestivum
  Clone ID: PAT_TA_21874
aaaaaaaaaaaaaaaaaaaaataaaaaaaaaaaaaaaaaaaaaaaaaaaaaaaaaaaaaaaaaaaaaaaactttttttttttccgccctacttgcgcctgcgcagccgcctccgtcgttgtagcagaagcagcgatcccccgtcgccaacacccgaagaaagcatggatacccaggtcaagctcgcagtcgtggtgaaggtgatgggccgcaccggctccaggggtcaggtgacccaggtcagggtgaagttcctggatgaccagaaccgtctcatcatgaggaacgtcaagggccctgttcgtgagggcgacatcctcaccctgctcgagtccgagcgggaggccaggaggctgcgctgagcggctgcttttcctgtcttcggaagtaaactctactgcatttgaatcaacttaatgaacgctggctttgtcttttgcctaggctatggaaatgtaagcagtacttaataggttgcagttttcttctgttgcctgaattaaagtgcacttgatgttgtgagacttgatcatccttgcgcacctctgggttatttgaattgattggatgaatgctatattgtatcctatgatttgagtaaaattatggttacctgtggtgacttctgtttctggaaaaaaaaaaaaaaaaaaggccccta

SEQ ID NO: 21875 - DNA, 750 bp, Triticum aestivum
  unsure (1)..(750): unsure at all n locations
  Clone ID: PAT_TA_21875
tgtaatttgcagaatattcaaaaaaatacaagtgttacacatgcttaatcaaattactgttcattcacacacgcacacccaatcgtatgtatctcttgtagtacgacacagccaaactaagacaaattaatctcaccaaatttccgccgaagcagaaaagcatcgtctctcgtctcgtcgaggaatcaacaaccatgggcggtggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcacgccgaggcgaagcatccgaagagcgacctcgtccagtgcttcccccacctcacgccgtgatatctgccaaatcggacggagagagagatanaagagagagagagaagctgccgtaatccacctagtattatcatgttccgcaatgactggttgttgacctaagcatgggtctgaactctgggtgtgctgctgtcccagctgctttggttgtgtgcccatctactatgtaatcgtcctctatcagcctgttgtggctacaatatcttaatcctgtgtggatttgctcctcgtgcttagtcagtatgctgtcacaaaaaaaaaaaaaaaaaactcgagggggggcccgggacccaattcgccctattgtgagtcgtattacatg

SEQ ID NO: 21876 - DNA, 1463 bp, Triticum aestivum
  Clone ID: PAT_TA_21876
ccacgcgtccgcccacgcgtccgctcgagctggagacctcatctcatatcattgccattccctccttgcgagtagcaccggcagcagcaatggccagcctcgccgacctcgtcaacctcgacctcagcgactgcaccgacaagatcatcgtcgagtacctctggattggaggatccggtatcgacatcaggagcaaagcaaggacggtgaacggccccatcacggacgcgagccagctgcccaagtggaactacgacggctccagcaccggccaggctcccggagaggacagcgaagtcatcctctacccccaggccattttcaaggacccgttcaggaggggcgacaacctccttgttatgtgtgactgctacacaccacaaggtgtgccaatccccaccaacaagaggcacaatgccgccaagatcttcaacacccccaaggttgcagctgaggagacatggtatggaattgagcaggagtacactctcctccagaaggacgtgaactggcctcttggctggcccattggtggctaccctggtcctcagggaccatactactgcgccgccggcgccgacaaggcgttcgggcgtgacatcgtggacgcccactacaaggcgtgcctctacgccgggatcaacatcagcggcatcaacggggaggtcatgcccggccagtgggagttccaagtcgggccgtccgtcgggatcgccgcctcagaccagctgtgggtggcgcgctacatcctcgagagggatcacggaggttgccggggtgggtgctgtccctggacccgaagccgatcccgggcgactggaacggcgccggcgcgcacaccaactacagcaccaagtcgatgcgggaggccggcgggtacggcgtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcggcgtccatccgcgtgggccgcgacacggagaaggacggcaagggctacttcgaggaccgcaggccggcctccaacatggacccgtacgtccgtcacctccatgatcgccggagaccaccctcctcctctgagctctgagcgaccagcagcccaatgcctaccacaccgccggacgacacttagcctctcgaccttctcgatcgagggtggccattgattgatttctgcaaaatgtttccgtgttttccgtttcttttgcaaggtctagcctgttttggggggcgtgtctttcactttactccgttcaagattaagagtaagagtcctcaagtgtgctcctgaaaataatgttgtttcctcattcccataaatgaaatcatggaaccttgtgatgtgattccgttcgatcacatgtcaaaaaaaaaaaaaaaaaaa

SEQ ID NO: 21877 - DNA, 914 bp, Triticum aestivum
  Clone ID: PAT_TA_21877
aggctgcgtagtggaacgactaaacagatctgccctctctctctctctcgtccgcggcgatacgatccgagatggcgatgagggcgtggaggcggagcgcggcggcgagggccccggcgcacctgtgcctgtggctggcgctcgtcgccgccaccctggtgctcgcccagggtaagaagtcgaacctgtcggaggtgacgcacaaggtctacttcgacattgagatcgacggcaagcccgcaggtcgggttgtcatgggacttttcggcaaggctgttcctaaaaccgcagagaacttcagagcactctgcacaggagagaaaggcatgggcaacagcggcaagcctctccactacaaggggagttcgttccacagaattatccccagcttcatgatccaaggaggtgacttcactcttggcgatggaaggggcggtgaatcaatctacggcacaaagttcgccgatgagaacttcaagctcaagcacactggaccaggctacctttccatggccaatgctgggagagataccaatggatcccagttcttcatcaccactgtaaccacgagctggttggatggcaagcacgtcgtgttcggcaaggtgttgtctggaatggacgtggtctacaaggttgaggccgagggcaagcagaacgggacgccaaagagcaaggttgtcatcgccgacagcggagaagtgccgctgtgatgagacctgaaatggcctctggtggaaagctacggtgactagttttcattgtagaaccgttatcgtcgggactgttttcgtgtacttccgtgtgaatttagacggcaaagttttttctcttactataaaaaaagtataataacttgcttactcatgatatggttggcaactttgaagtgctcttattattttttttcttgg

SEQ ID NO: 21878 - DNA, 860 bp, Triticum aestivum
  Clone ID: PAT_TA_21878
ttttttttttttttttttttgaatgaatattctgcaaattacatttcatcaaacaaatacaagtgttacacatgcttaatcaaattactgttcattcacacacgcacacccaatcgtatgtatctcttgtagtacgacacagccaaactaagacaaattaatctcaccaaaccagtgcatataaattaacacacgcaagaaaaactacttaacaaccgaccgatatattattgcatgatgaaatcaaatttggaactaaaataacatacatgcatggatgcactgacgatgcatgcatgcgctgagtgatggacgatttgctggagtgtaactgatggattaagcgcactggaagcccttgggggcggtcttgccgcagtagttgaggaggaggctgagcttgacggggatgttgaggacgatgccgaggacgttggccttgagcgcggtgcagaggcacacggcggcctcgaggtcggccaggccgccgaggaggctgcagcacttgtcgccgccgccgctggggggcttgccgacgcccacgttcaccaagcccagcacgttggcgcaggcgcccagcttcagtgtgtccgtggggcacgacgtgccgccgcctgacgaaggcggtgggcacggcgtcgtagacggcgatggtgggggcggggacggggaggccggcggcggggttttgtgcttgcagctgccgcacgcgtcgccggcgaggaacgtgttggccaccagcagcgccagcaggcatgccgccgagaaggtcctggacgccattgctgccggctaagctagctaggtagtgctggtgagagtgagctaggagggttttgtggtctcccgacccggccggc

SEQ ID NO: 21879 - DNA, 1673 bp, Triticum aestivum
  unsure (1)..(1673): unsure at all n locations
  Clone ID: PAT_TA_21879
gaattcactaagtgattagcgtggtcgcggccgaggtcccacccgccttccttcctccgcgacttgcctgcccgccctcagtcagccggccatggcgctcctcaccgatctcctcaacctcgacctcaccgactccacggagaagatcatcgccgagtacatatggatcggcggatctggcatggatctcaggagcaaggccaggaccctccccggcccggtcacggatcccagcaagctgcccaagtggaactacgacggctccagcaccggccaggcccccggcgaggacagcgaggtcatcctgtacccacaggccatcttcaaggacccgttcaggaagggcaacaacatccttgtcatgtgcgattgctacaccccagctgggagtgccaatccccaccaacaagagatacaacgctgccaagatctttagcaaccctgatgttgccaaggaggagccatggtatggtattgagcaggagtacaccctcctacagaaggacatcaactggcctctcggctgggcctgttggtggattccctggtcctcagggtccttactactgtagtattggtgctgacaagtcgtttgggcgtgacatagttgacgctcactacaaggcctgcctctttgccggtgtcaacatcagtggcatcaatggcgaggtcatgcccggacagtgggagttccaagtcggcccgactgttggcatttctgctggcgaccaagtgtgggtcgctcgctaccttcttgagaggatcactgagatcgccggagttgtcgtcacatttgaccccaagcccatcccaggcgactggaacggtgctggtgctcacacaaactacagtaccgagtcgatgaggaaggacggcgggttcaaggtcatcgtggatgccgtggagaagctcaagctcaagcacaaggagcacatcgccgcctacggcgagggcaacgagcgccgcctcaccggcaagcacgagaccgccgacatcaacaccttcagctggggcgtcgcaaaccgtggcgcgtcggtgcgcgtgggccgggagacggagcagaacggcaagggctacttcgaggaccgccggccggcgtccaacatggacccatacgtggtcacctcgatgatcgccgagaccaccatcctgtggaagccctgaagccgatcggcgccgatcgcccgtgcgatgatcagtgatgggttgggttggatttggtgggtggccactggaggatttggacgaaattcttccaacatatttgcttttccgtttggttgcatactacgcgtagtccgcttaggtaggtcgcatcatcgtcgtcgtcgtcatgcatcagggtgtctggtctctcttctctcgtctctgggtggtgggtggcaagaggcgtgtcaaacacacaagactactattgattgttttcccttgccgtttgggtgctctggtcctcgtgtaatcatcaattgatatggtaataaaatggtccgtaccgctgccgtggtaccacgcaaaaaaaaaacctcgggccgcgaacaacgcctaatcgaattccccgcgggccgcaatgggcgggccggggaacatgccnacgntcgggcccaaattcnnccccnatangtgaagttcgtattaaaatttnnctggccngtccttttaaaaacggtnnttga

SEQ ID NO: 21880 - DNA, 710 bp, Triticum aestivum
  Clone ID: PAT_TA_21880
gaattcactaagtgattcgagcggccgcccgggcaggtgtcgccttcctccctcgccctcgcctccccgccgccacccaacccaagcacagagctcccggcttctcccccctacgaggttaggcaaggatggtgagggttagcgtcctgaatgatgctctcaagagcatgtacaacgctgagaagcgtggcaagaggcaggtcatgatcaggccttcctcaaaggtgatcatcaagttcctcatcgtcatgcagaagcacggttacattggtgagtttgagtatgttgatgaccacagatctggcaagattgttgtggagttgaacggcagactgaacaagtgtggagtcatcagcccccgctttgatgttggtgtcaaggagatcgagggatggaccgccaggctgcttccatctcgtcagtttggttacatcgtcctgacaacctctgctggcatcatggatcacgaggaagccaggaggaagaacgttggtggcaaagtgctaggctttttctactgagcgggaattttgtgaaagttgtatttcagaccggtgtgataggatgttatctcaggacatcaaggttgtctactttttgcctgcatagctgctatgcctttgttatgttatgttggattcagttaattatgagatgcactttggtcttacctgcgatgaattatgactttgaagatgccaaaaaaaaaa

SEQ ID NO: 21881 - DNA, 1236 bp, Triticum aestivum
  Clone ID: PAT_TA_21881
gaaatacaggggtcgcagtagaagacggaagcagcaaggcgcagccgagaaaaaaaacgccgtcctcccgaagcgccccccttaccccggaaccaaatcgaacaacccagagaagccatggagcggctgcagcggatcttcggcgccggcgggatgggccagccgccgtcggactcgccgctgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccatgccgcagagcgggacaggggtcagcgtcgaggccgtcgaccacgtcttccagaccaatatgctcgacatgctcaagcagaccggcaggccagaaatggtggtagggtggtatcactctcatcctggttttggttgctggctatcgggtgttgatatcaatactcaacagagttttgaagctttgaaccccagggcagttgccgtcgtgatcgaccccatccagagtgtcaaggggaaggtggtcattgatgcatttcgtctcattaaccctcagaccatgatgcttgggcaggagccacgtcagacaacatccaatgttgggcacctgaataagccatctattcaggctcttattcatgggctcaatagacactactactctattgcaataaattaccgcaaaaatgagctcgaggaaaagatgctgcttaaccttcacaaaaagaaatggactgatggattaattctgaagaaatttgacgcacattcagaaaccaatgagcagactgttcaggaaatgctgagcctagccatcaagtacaacaaggcagtgcaagaggaggatgagttgtcccctgagaaattagcaatagctaatgtgggacggcaagatgcgaagaagcatctagaagagcatgtctcaaatctgatgtcgtcgaacatagttcagaccctaggtaccatgcttgacacggttgtcttttagtctaccactagtgttgttccaaagtctatcatccatgttatgtatccaaaagcttgccacaacgcagcaaggcacattcgggttctaacagtttgcttacagactcaattttctgtagtactatcttctgcatgtttaatttcgcagcaattttcatgggtgtcctttaaaattgcaagttcggttctgccgaag

SEQ ID NO: 21882 - DNA, 973 bp, Triticum aestivum
  Clone ID: PAT_TA_21882
gcggagactgcgtagtggaacgagtaaacagatctgctctccctctctctctcatccgcggcgatacgatccaagatggcgatgagggcgtggaggaggagcgcggcggcgagggccccggcgcacctgtgcctgtggctggcgctcgtcgccgccaccctggtgctcgcccagggcaagaaatccaacctgtctgaggtgacgcacaaggtctacttcgacatcgagatcgacggcaagcccgcaggtcgggttgtcatgggacttttcggcaaggctgttcctaaaaccgcagagaacttcagagcactctgcacaggtgagaaaggcatgggcaacagcggcaaacctctccactacaaggggagttcgttccacagaattatccccagcttcatgatccaaggaggggacttcactcttggcgatggaaggggcggtgaatcaatctatggcacaaagttcgccgatgagaacttcaagctcaagcacactggaccaggctacctttccatggccaatgctgggagagataccaatggatcccagttcttcatcaccactgtaaccacgagctggttggacggcaagcacgtcgtgttcggcaaggtgttgtctggaatggacgtggtctacaaggttgaggccgagggcaagcagaacgggacgccaaagagcaaggttgtcattgccgacagcggtgaagtgccgctgtgatgagacctgaaatgggctctggtggaagctacggtgactagttttcgttgtagaaccgttactagccggtctgttttttgttttcgtgtactttcgtgtgaaattcagacgacaaggattctcttgctataagaaagtataatgacttgcctacccgtgatctggctggcaactttgaaggcatcgcaaaaaaaaaaaaaaaaaaaaactcgagacttagacctcggccgcgaccacgctaatcactagtgaattc

SEQ ID NO: 21883 - DNA, 830 bp, Triticum aestivum
  Clone ID: PAT_TA_21883
ttcggcacgagcttgccgctctcgctccgcagacgccgccgccgccgccgccacggccagagctcgactcgctccctaggaggtaaggatggtgagagtcagtgtgctgaacgatgctctcaagagcatgtacaacgctgagaagcgtgggaagaggcaggtcatgatcaggccttcttccaaggtcattatcaagttccttatcgtcatgcagaagcacggatacattggcgagtttgagtacgttgatgatcacaggtctggcaagatcgtggttgaattgaatggcaggctgaacaagtgtggtgtcatcagtcctcgctttgatgttggtgtcaaggagattgagggatggactgcaaggctccttccttctcgtcagtttggttacattgtgctgacaacttctgctgggatcatggaccatgaggaggcaaggcgtaagaatgttggtggcaaagtgctaggctttttctactgaaaatggaaaatggaaaattcgatggaagtacctgagatgtgttagtaggatatttcccaaggaacacctaagttgtctttttttgtctgactagctgccgctgcttgttgagttattctggaatctgttatgcactttggaattgggtgcctttgtttgaaaactatgagctgtgcctgtcgttaattcttaaaaatctatatgcaatattatgttgttccgttgaggtagatgctgaagaggtttaaatctagtattctgcccggctcactgtagtttcaatcttgtctgtgagctcatgcttaattgttgatctttgagcttataattaaagtctttatcgtatccc

SEQ ID NO: 21884 - DNA, 992 bp, Triticum aestivum
  Clone ID: PAT_TA_21884
cgtccgcccacgcgtccggagtaaacagatctgctctctccctctctttctctctcgtccgcggcgatacgatccgagatggcgatgagggcgtggaggcggagcgcggcggcgagggccccggcgcacctgtgcctgtggctggcgctcgtcgccgccaccctggtgctcgcccagggcaagaaatccaacctttctgaggtgacgcacaaggtctacttcgacatcgagatcgacggcaagcccgcaggtcgggttgtcatgggacttttcggcaaggctgttcctaaaaccgcagagaacttcagagcactctgcacaggagagaaaggtatgggcaacagcggcaaacctctccactacaaggggagttcgttccacagaattatccccagcttcatgatccaaggaggcgacttcactcttggtgatggaaggggtggtgaatcaatctacggcacaaagttcggcgatgagaacttcaagctcaagcacactggaccaggctacctttccatggccaatgctgggagagataccaacggatcccagttcttcatcaccactgtaactacgagctggttggatggcaagcacgtcgtgttcggcaaggtgttgtctggaatggacgtggtctacaaggtcgaggccgagggcaagcagaacgggacaccaaagagcaaagttgtcattgctgacagcggggaagtgccgctgtgatgacctgaaacggtctctggtggaaagctacggtgactagtttccgttgtagaagcgttattatccggactgttttcgtgtacttccgtgtgaatttagacggcaagttttttcctctttactataaaaaagtacaatgacttgcttacccgtgatctggctggcaactttgaaggtatcatacaccaccgttctgttgtcagtatctcttttgctgcatatttgctggggttatttaccttagagacattgccgttatgcgccttttaatt

SEQ ID NO: 21885 - DNA, 1475 bp, Triticum aestivum
  Clone ID: PAT_TA_21885
cggccggtcgggctctcccctgcttctcgagccgcacacctcatctcatctcatctcatcatcgtcttccccccattgccattccctccttgcgagtagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccacaaggtgttccaatccccactaacaagaggcacaatgctgccaagatcttcaacaccccgaatgttgcagctgaggagacatggtatggtatcgagcaggagtacactctcctccagaaggacgtgaactggccccttggctggcccattggtggctaccctggtcctcagggaccctactactgcgcggccggcgcggacaaggcgttcgggcgtgacatcgttgacgcgcactacaaggcgtgcctctacgccgggatcaacatcagcggcatcaacggggaggtcatgcccggccagtgggagttccaagtcgggccgtccgtggggatcgccgcgtccgaccagctgtgggtggcgcgctacatcctcgagaggatcacggaggttgccggggtggtgctgtccctggacccgaagccgatcccgggcgactggaacggcgccggcgcgcacaccaactacagcaccaagtcgatgcgggaggccggcgggtacggggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggctgaccgcggcgcgtccatccgcgtggggcgcgacacggagaaggacggcaagggctacttcgaggaccgcaggccggcctccaacatggacccctacgtcgtcacctccatgatcgccgagaccaccctcctcctctgagccagcagcagatgacacacgcacacgctttcttcctctacctcggagtgagagagggcgacaatgaatttctttctgcaaaacgtctcctgtttccatttcttttgcaaggtctagtctgtttttggggcgtgcctttcgtgtctttcactttactcgttcagataagagtcttccgtgtactctgaaaataatgttcttctttccgcattccgataaatgaaatcatggaaccggttgtgattctgttcgatcacatgtcatgtagagttcacatacagtaaaaaaaaaaaaaaaaaa

SEQ ID NO: 21886 - DNA, 1583 bp, Triticum aestivum
  Clone ID: PAT_TA_21886
ttctatctgcggacacaaatgtataacctcgcagaataacgagacagcaggaccagatacccaaaaactcttagcatagcacaaaattaactagttcaccaggtcaaatagccattaagtaacaagcaaactattccaaaaaaagaccaactgtttcgacactgaatttcaagtcctagataggttctttgccaccgtcacgatcccaagcactgctccgcttacttgaagcacttggcgtccagcaaggcctgcccctcgaacggctcaaggtcctcgatcatggcttccacgcgcttcttctgggcctcgtcagagaggtcaaccttggtccactcgtagagctccatgtcatagacctccttcatgacgaactcagggatgtcctgcccacggaagagccacagccccttgaccttgaagggcgcctcagaaccaatcacgagcatcttgccaaaagcatacttgcggcacagatccatccgctgcaggaacccgccgaccttgttcagggtcacgtacgacacggtgttctcttcctggtacttgtagtcacagaaccacagagagtagccctctgggtcatacatctcccagaaacctttaacagcaacatcatggaagttgctcttagtgtttgagtatagcctcttccagtcatcaagtaccatcttgcttggtggcagtagatcaaggggatttttgggcttaggctttggtgcctcttcctctggtgcctcaactactgctggctttggggccgccttgggagcctctttcttggcctccttttgtttagcaggagcagccttcttctgaacaggaggtacaacctctgcctgcttgaattcgccaatgaccttcttgaagttaggctggttaaccatggtccagaagtacctctcaacatgagggaactcagatgtgaaagtcttggtcaagatccgagcaaaaccatggtagaggttgcatgtcatgacaatatcagccagagtgacagaatgcccaacaaggaatgtgtttgatgccaggtgtgtgttcaatgcttcaagggccctcttcaatccagcaatgccgaattcctcagactgggcattgtaaggcatataaccaagccttgggtacagccaccttgggatattgggatcaacctctgtggcaccaaagtccatccattgctcaacacgcgcatattcaataagagaaccaccccaaagcaggttgtcaccctttgagcgagcaacatagcgtgcaatagcattgctctcaaaaacagcaccatcaggagtctcaagaacaggaaccttgccaaggggattcatcttgatgaattcaggggttttgtttgagacacccatctcaaagttcttggtcagctcaaccttgaccccacagtactctgcagcaataagtgccttgaaggcattcttgttgccactgcccgaatgcaaaacgagcgccatgtcggcaggagctgcaggcctcgcccgattccaaatctcagatagagagtgcggatcgagacgagatcgcggcggaaacctcagcgggcgagggtgggaggagagcccaacccggccggc

SEQ ID NO: 21887 - DNA, 1447 bp, Triticum aestivum
  Clone ID: PAT_TA_21887
ctttcccctgcttctcgagctgcacacctcatctcatctcatctcagtcttcccccacattgccattccctccttgcgagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccccaaggtgtgccaatccccacgaacaagaggcacaacgctgccaagatcttcaacaccccgaaggttgcagctgaggagacatggtatggaattgagcaggagtacactctcctccagaaggacgtgaactggcctcttggctggcccattggtggctaccctggtccgcagggaccatactactgcgccgccggcgcggacaaggcgttcgggcgtgacatcgtggacgcccactacaaggcctgcctctacgccgggatcaacatcagcggcatcaacggggaggtcatgcccggccagtgggagttccaagttgggccgtccgtcgggatcgcggcgtccgaccagctgtgggtggcgcgctacatcctcgagaggatcactgaggttgccggggtggtgctgtccctggacccgaagccgatcccgggcgactggaacggcgcgggcgcgcacaccaactacagcaccaagtcgatgcgggaggccggcgggtacgaggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcgcgtccgtccgcgtgggccgcgacaccgagaaggacggcaagggctacttcgaggaccgcaggccggcctccaacatggacccctacgtcgtcacctccatgatcgccgagaccacgctcctcctctgagccacccacccacggccatgcctaccgccgccagatcatgacacccaggctctcgactctctcgatcgagggtggcgattgattaatttctgcaaaacgtttcgtgtttccatttcttttgcaaggtctagtctgtttttgggggcgtgcctttggtgtctttcactttactcgttcagataagagtaagagtcttcagtctactctgaaaataatgttgttttcgcattccgataaatgaaatcatggagccggttatgattctgttacaaaaaaaaaaaaaaaaaaaaa

SEQ ID NO: 21888 - DNA, 909 bp, Triticum aestivum
  Clone ID: PAT_TA_21888
tcacgggtcgacggggatacatatgataaatcatctcagaatatttctcctctctctcccaggagtcggaggacagaaaccaggaggcgacggaggggacgcaacgcgactccacactcttccgcacgaatcaccgctctcctctagctggagcaataagggtcacccggatgaccggggcagacctggcaccagtaatggagttgaaggctgtggcaaatggaggaacacccactgaagttgttgcttctgataagaaggataataccaagatggaagaggctgacgagagcaaggatgttgcagtagcgaataccaatgctgaccaacagaataaagcctcagaaaacggcgctaagggctcatctgatgatgatgccaagatggaggaagctgaagggcggcaaggggagccagctcgaggccaacaagaaggccatgaacatccagtgcaagatatgcatgcagactttcatctgcaccacctctgaagcaaagtgcaaggagcatgctgaggcgaagcatccgaagagcgacctcgtccagtgcttcccccacctcaagcagtgatatctgcccaatcagatggagagagagataaaagagagagagaagctgtcataatccacctagtattatcatgttccgcaatgactgattgttgacctaagcttgggtctgaactctggtgtgctgctgtcccagctgctttggttgtgtgcccatctactatgtaatcgtcctctatcagcctgttgtgctacaatatcttagtcctgtgtggatttgctcctcgtgcttagtcagtatgctgtcacaaaatttatctttttgataatgtttctcgcttccaatggcaccgatgctagcttggtcagagcacggtttacagccaagcagcatcaaaca

SEQ ID NO: 21889 - DNA, 1529 bp, Triticum aestivum
  Clone ID: PAT_TA_21889
ttcggcacgaggcccccacccgccttccttcctccgcgacttgcctgcccgccctcagtcagccggccatggcgctcctcaccgatctcctcaacctcgacctcaccgactccacggagaagatcatcgccgagtacatatggatcggcggatctggcatggatctcaggagcaaggccaggaccctccccggcccggtcaccgatcccagcaagctgcccaagtggaactacgacggctccagcaccggccaggcccccggcgaggacagcgaggtcatcctgtacccacaggccatcttcaaggacccgttcaggaagggcaacaacatccttgtcatgtgcgattgctacaccccagctggagtgccaatccccactaacaagagatacaacgctgctaagatctttagcaaccctgatgttgccaaggaggagccatggtacggtattgagcaggagtacaccctcctacagaaggacatcaactggcctctcggctggcctgttggtggcttccctggtcctcagggtccttactactgtagtatcggtgctgacaagtcgttcgggcgtgacatagttgactcccactacaaggcctgcctctttgccggcgtcaacatcagtggcatcaacggcgaggtcatgcccggacagtgggagttccaagttggcccgactgttggcatttctgctggtgaccaagtgtgggttgctcgctaccttcttgagaggatcaccgagatcgccggagttgtcgtcacatttgaccccaagcccatcccaggcgactggaacggtgctggtgctcacacaaactacagtaccgagtcgatgaggaaggacggcgggttcaaggtcatcgtggacgccgtcgagaagctcaagctgaagcacaaggagcacatcgccgcctacggcgagggcaacgagcgccgtctgaccggcaagcacgagaccgccgacatcaacaccttcagctggggtgtcgcgaaccgtggcgcgtcggtgcgcgtgggccgggagacggagcagaacggcaagggctacttcgaggaccgccggccggcgtccaacatggacccctacgtggtcacctcgatgatcgccgagaccaccatcctgtggaagccctgaagccgatcagcgccgatcgccgtgcgatgatcagtggtgggttgggttttggtggtggccattggaggatttggacgaaattcttccaagatatttccttttccgtttggttgcatactacgcgtagtccgtttaggtaggtcacatcatcgtcgtcgtcatcagggtgtctggtctctcttctctcgtctttgggtggtgggtgggcaagaggcgtgtcaaacacacaggactactattgattgttttcccttgccgtctgggtgctctggtctcgtctcgtgtaatcatcaattgatatggtaataaaatggtccgtaccgcagcccgtggtaccacgcaaaaaaaaaaaaacctcggccgcgaccacgcttaatcactagtgaattc

SEQ ID NO: 21890 - DNA, 1762 bp, Triticum aestivum
  Clone ID: PAT_TA_21890
agcggctaccaacagcaataacacgcttcacttaagtagatgctccatatggggacacaaatgcataaacctaatagaacaacagactgcaagaccaggtacccaaaaactcttagcatggcacaaaaattaacaagttcaccaggtcaaatagccattaagtaacaagcaaactcttccaaaaaagacaactgtttcgacactgaatttgagtcctagataggttcttttgtcaccgccatcacgatccaaagcactgatccgcttacttgaagcacttggcgtccagcaaggcctgcccctcaaacggctcaaggtcctcgatcatggcttcgacacgcttcttctgggcctcgtcagagaggtcaaccttggtccactcgtagagctccatgtcgtagacctcgttcatgacaaactcagggatgtcctgcccacggaagagccacagccccttgaccttgaagggcgcctcagaaccaatcacgagcatcttgccgaaagcatacttgcggcacagatccatccgctgcaggaacccgccgaccttgttcagggtcacatacgacacggtgttctcttcctggtacttgtagtcacagaaccacagagagtagccctctgggtcatacatctcccagaaacctttaatagcaacatcatggaagttgctcttagtgtttgagtatagcctcttccagtcatcaagtaccatcttgcttggtggcagtagatcaaggggatttttgggctttggctttggtgcctcttcctctggtgcctcaacctctgctggctttggggccgccttgggagcctctttcttggcctcctttggtttagcaggagcagccttcttctgaacaggaggtacaacctctgcctgcttgaaatcaccaatgaccttcttgaagttaggctggttaaccatggtccagaagtacctctcaacatgagggaactcagatgtgaaagtcttggtcaagatccgagcaaaaccatggtagaggttgcatgtaatgacaatatcagccagagtgacagaatgcccaacaaggaatgtgtttgatgccaggtgtgtgttcaatgcttcaagggccctctttaatccagcaatgccgaattcctcatcctgggcattgaaagccctataaccaagccttgggtacaaccaccttgcgatattgggatcaacctctgtggcagcaaagtccatccattgctcaacacgtgcatattcaataagagaaccaccccaaagcaggttgtcaccctttgagcgagcaccgcaagttccttatcgtcatgcagaagcatggatacattggcgagtttgagtatgttgatgatcacaggtctggcaagatcgtggttgaattgaatggcaggctgaacaagtgtggtgtcatcagtcctcgctttgatgttggtgtcaaggagattgagggatggactgcaaggctccttccttctcgtcagtttggttacatcgtgctgacaacctctgctgggatcatggaccatgaggaggcaaggcgtaagaatgttggtggcaaggtgctaggctttttctactgaaaatggaaaatggaaaattcgatgaaagtatctgagatgtgttagtaggatatttcccaaggaacacctaagttgtctttttttgtctgactagctgccgctgcttgttgagttattctggaatccgttatgcactttcggattgggtgcctttgtttaaaaaaaaaaaaaaaaaaggccccta

SEQ ID NO: 21891 - DNA, 1350 bp, Triticum aestivum
  Clone ID: PAT_TA_21891
tcgcccacgcgttcgcccacgcgttcgcccacgcgttcgtccacgcgttcggcacaaacacacacatgcacacacacacacacacacacagatggcacttcctgctaatgccgctgcctcgttgagcttcccggtgatccacatggagaagcttgagaccggggaaaggggcgcgaccatgggggtcatccgcgatgcctgcgagaactggggattcttcgagctgctgaaccatggcatctcggccgagctgatggacgaggtggagcgggtgagcaaggcgcactacgcggcttgccgggaggagcagttcaaggagttcgcggcgaagacgctggaggccggcgagaagggcgacgacgtgaaggacgtagactgggagagcaccttcttcgtccgccaccttcccgcctccaacctcgccgacctgcccgacctcgaccaccactacaggcaagtgatgaaggaattcgcggcggagatcgagaagctggcggagaaggtgctggacctgctgtgcgagaacctgggcctggagcagggctacctgaagcgagcattcgccggttcaaggggcccgacgttcggcaccaaggtgagcagctacccaccgtgcccacgccccgacctggtcgccggcctccgcgcgcacaccgacgccggcggcgtcatcctgctgttccaggacgaccaggtgagcgggctccagctcctcaaggatggagcatgggtggacgtgccgcccatgcgccacgccatcgtcgtcaacatcggcgaccagctggaggtgatcaccaacgggcggtacaagagcgtgatgcaccgcgtgctcacccgccccgacggcaaccgcatgtccctcgcctccttctacaaccccggcgcggacgccgtcatcttccctgccccggcgcttgtcgaggagctgtcggaggaggaggcggagcgtgccgggagcgccgtgtacccgaggttcgtgttcgaggactacatgaacctgtacttgctccacaagttcgaggccaaggagccgcgcttccagggccatgaaggcggacgccgcgcccatcgccaccgcgtgattagggacgtggtcgtacgtgccagagtcccgaacaagagtattttgggacgtattgaagtggtgtatcgtagataatttgtgtatgcgtgtgtaatgttttcgctggtggcttcgcagtgcgccagtgcatgccgtgatgcttgttttaccgtacgtgtgagtcaacttctttttatagtatgtgtgttaagtaatgtactccctccgtccaaaattgaaccaagtcagagacatctattttggtacaaaaaaacccccccccaccc

SEQ ID NO: 21892 - DNA, 873 bp, Triticum aestivum
  unsure (1)..(873): unsure at all n locations
  Clone ID: PAT_TA_21892
ctgattacgccaagctcganattaaccctcactaaagggaacaaaagctggagctccaccgcggtggcggccgctctagaactagtggatcccccgggctgcaggaattcggcacgaggcctgcttgccgctctcgctccgcagacgccgccgccgccgccgccgccacggccagagctcgactcgctccctagaggtaaggatggtgagagtcagtgtgctgaacgatgctctcaagagcatgtacaacgctgagaagcgtgggaagaggcaggtcatgatcaggccttcttccaaggtcattatcaagttccttatcgtcatgcagaagcacggatacattggcgagtttgagtatgttgatgatcacaggtctggcaagatcgtggtcgaattgaatggcaggctgaacaagtgtggtgtcatcagtcctcgctttgatgttggtgtcaaggagattgagggatggactgcaaggctcctgccttctcgtcagtttggctacattgtgctgacaacttctgctgggatcatggaccatgaggaggcaaggcgtaagaatgttggtggcaaagtgctaggctttttctactgaaaatggaaaatggaaaattggatgaaagtacctgagatgtgttagtaggatatttccaaggaacacctaagttgtcttttttttgtctgactagctgccgctgcttgttgagttattctggaatctgttatgcactttgggattgggtgcctttgtttgaaaactatgagctgtgcctgtcgttaattctgaaaattctatatgcaatattatgttgttccgtcaagatagatgccgaagaggtttaaatctagtaatctgcccggctaaaaaaaaaa

SEQ ID NO: 21893 - DNA, 759 bp, Triticum aestivum
  Clone ID: PAT_TA_21893
aattcggcacgaggcttgccgctctcgctccgcagacgccgccgccgccgccgccgccacggccagagctcgactcgctccctagaggtaaggatggtgagagtcagtgtgctgaacgatgctctcaagagcatgtacaacgctgagaagcgtgggaagaggcaggtcatgatcaggccttcttccaaggtcattatcaagttccttatcgtcatgcagaagcatggatacattggcgagtttgagtatgttgatgatcacaggtctggcaagatcgtggttgaattgaatggcaggctgaacaagtgtggtgtcatcagtcctcgctttgatgttggtgtcaaggagattgagggatggactgcaaggctccttccttctcgtcagtttggttacatcgtgctgacaacctctgctgggatcatggaccatgaggaggcaaggcgtaagaatgttggtggcaaggtgctaggctttttctactgaaaatggaaaatggaaaattcgatgaaagtatctgagatgtgttagtaggatatttcccaaggaacacctaagttgtctttttttgtctgactagctgccgctgcttgttgagttattctggaatccgttatgcactttcggattgggtgcctttgtttgaaaactatgagctgtgcctgtcgttaattctgaaaaatccatatgcaatattatgttgttccgtcgagatagatgttaagaggtttaaatctagtattctgcccggctcactga

SEQ ID NO: 21894 - DNA, 732 bp, Triticum aestivum
  Clone ID: PAT_TA_21894
tccacacggacactggcacgcgcaagttgcccgcgattgattgacgccaacgtcggcttccgcctccacctcccacctccacgtctattaaacgcagccgcctcctgcttctcgccttccccaccaaatttccgccgaagcagaaaaagcatcgtctcgtctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcatgccgaggcaaagcatccgaagagcgagctcgtccagtgcttccctcacctcaagcagtgatatctgcccaatcagacagagagagagataaaagagagagagagagagaagctgtcataatccacctactattatcatgttccgcaatgactgattgttgacctaagcttggggtctgaactcggtgtgctgctgtcccggctgctttggttgtgtgcccatctactatgtaatcgtcctctatcagcctgttgtgctacattatcttaatcctctgtggatttgctcctcgtgcttagtcagtatgctgtcgcaaaaaaaaaaaaaaaaaaaaactcgagactagttctacctgcccgggcggccgctcga

SEQ ID NO: 21895 - DNA, 826 bp, Triticum aestivum
  Clone ID: PAT_TA_21895
tttttgtttttttttttttaataaaaaaggaaaacttgctctgaggctgttattgtctttaccataggtggttaaacattgagaagaccacaccacacacacgagagaatttacacacgcatggagcttacacagagcacacacatacacccatcactcgctagcatgcagcgagcataccgagccaagaaaataaagttacaagcactagtagacagtagtacgaagctgaagacaaaccacatgcagcctcggacagcaacgtacgctacgcaggattagataaccaaaagagcagcaaacatggcggcgtcgcacaagttgttgagcaccctgccttcagttctctggccgacggctcttatttagcggtggttgctccttgtcctcgtctcgtcgctgtaaagccagtcgtagacggtgggggagttgggctgcgggcggtcgaagaggttggcgccgaggctcttggtggccaggttgctcccggggtggaaaacgctccgccacacgctgccgccgcgcggcggcgtggacgacgacggcgtcaccggcgtggtcggggtcgtcggcatcgacggcgactgcttaatcgcctcccctgcagctgtgttgatggcgaggggttgggtggcggcggcccggcggagcttgtcgaggcccgtctccgggcgaggcccggccaccacgtcgtcccacagcttgtccagcatcctgtgcagaagttggatctgatcggtgcaagaactagtgtcactcgcttgtagcactaccaccgataagatcaagtgcactgccgactcccgcccgccgcctcgagcggccg

SEQ ID NO: 21896 - DNA, 1392 bp, Triticum aestivum
  Clone ID: PAT_TA_21896
ccggtataaccgtttctggggagtttttatgtgacttgttgtagatgctctaagagaaaaacaagttgattctaatcaggtgtcaaattgtttcatccttccagcaaatgtactgtcctgtaaatcatcaggcaaaaggggagctacaagcctcattcatacacactgggaaaaccagcgaaaaggagcatgcatcgcgatgtgcggctgttctgggtggagacgagagtttctaaggagcggaaggtttcatttattcaaaacatcagaggagcagctgcccttcgaatgtggatttacgcgaggcatgagtaggccagcgccttctcctccgacagctcctgggcggtggcatccatcttcttcctcgagaactcatcgatcgggagcccttgaacaattgtccattcaccaccactgcacgttactgggaaggagtagataagaccagcaggcacaccgtatgaaccatcagagtacacacccatggaaacaaatgttccctcggcggttcccagaacccagtcacggatgtgatcacaagctgagctggcagcagagagagcactggagagcttcctcgctttgatgattgcagcaccacgctgctggacagtggcaatgaactccccgtttagccattcatcatcttgaacaagttcacgaacaggcttctctccactggaagtcttcacagtggcgtggttaacatcagggtactgactggacgagtgattaccccagataatagcattcttcacgtcagaaacttggacaccaagtctctcagaaatctgaccgagtgccctgttgtggtctaggcgggtcaaacaactgatgttcttctcagggatagatggagcaaactccttcaggatgagagcattggtgtttgctgggttggcaacaaccaaaaccttgcagttgggggctgcatgagcttcaagagcagatgcttgagctttgtagattgaaacatttttcgtcataacatccttcctttccattccttccttcctggggaatccaccaaccataaccgcaacattcacaccagtgcaggcctcgacaacatcagttgttgcaacaactcccttgagaagtggaaatgcggcatcgatcaactccatcttgacgcctttaagagcttcagcagcaaattcaatatccagcatatgcagaataacaggctggtctgcaccaagcataactcccctggcaatcatgggaacaagagcatatccgatttgtcctgcggcgccggtgacgagcacgcgcatcggttccttcgccgccattggagccggggggtagcttctggacacggggatagggagagtggtttaggaggaggcgacgacaacgggagagatagtgagacgaggcgaatgg

SEQ ID NO: 21897 - DNA, 1142 bp, Triticum aestivum
  Clone ID: PAT_TA_21897
gcaaaaggaaaaacttgctctgaggctgttattgtcttaccatagtaggtggttaaacattaagaagaacatcaccacaccacacacacaagagaatttacacatggagcgtacacaaagcacacacatacacccatcactcgctagcatgcagcgagtagaccgaggcaagaaaagaaagttacaagcactagtagataagtagtacgaagctcaagacaaactacatgcagcctcagacagcaacgtacgctatgcaggattagataaccaaaagagcagcaaacatggcggcgtcgcagaacttcctgtcttcaattctctggccgtcggctgttatttagcggtggttgctcctggtcctggtctcgtcgctgtaaagcctggacatggagcgtacgtggcagcgttatttttttccccatgttttaactatttgccatgttcacccgtttcaagttcccagtagatcgtgttattaacactgatattatattgtgagatagatcatgagccagcgtaccagtcgtagacggtgggggagttgggctgcgggcggtcgaagaggttggcgccgaggcttttggtggccaggttgctcccggggtggaaaacgctccgccacacgctgccgccgcgcgggggcgtcgacgacgacggcgtcaccggcgtggtcggggtcgtcggcatcgacggcgactgcttaatcgcctcccctgcagctgcacctccaccaacacccatgtaaaccaccatcagttcacacaatgaacccaatagatcctccgcttaaacatcaaatcttcttctgaaaaccactggtgctagactgaccgctagttcttacgttcttccagtttcaggccatgtcggtacctctgtgctaacgtatgtaaactgcacctgtgttgatggcgagaggttgggtggcggccgccctgcggagcttgtcgaggcccgtctccgggcgaggcccggccaccacgtcgtcccacagcttgtccagcatcttgcgcagaagttggatctgatcggtgcaagaacttgtgtcactcgctcgtactactacccaccgataagatcaagtgcctcgtgccgctcgtgccgaattcggcacgagctcgtgccgaattcggcacgag

SEQ ID NO: 21898 - DNA, 1506 bp, Triticum aestivum
  unsure (1)..(1506): unsure at all n locations
  Clone ID: PAT_TA_21898
ttttttttttttcacccctgaattgacaccntnntaaccagtttttgggagtttttatgtgacttgttgtagatgcttcaagagaaaaacaagttgattctaatcaggtgtcaaattgtttcactcttgcagcaaatgtactgtcctgtaaatcatcaggcaaaaggggagctacaagcctcattcatacacacttggaaaaccagcgaaaaggagcatgcatcgcgatgtgcggctgttctgggtggagacgagagtttctaaagagcggaaggtttcatttattcaaaacatccagaggagcagctgcccttcgaatgtggatttacgccaggcatgagtaggccaacgccttctcctctgacagctcctgggcggtcgcatccatcttcttcctcgagaactcatcgatcgggagcccttgaacaattgtccattcaccaccactgcacgttactgggaaggagtagataagaccagcaggcacaccgtatgaaccatcagagtacacacccatggaaacaaatgttccctcggcggttcccagaacccagtcacggatgtgatcacaagctgagctggcagcagagagagcactggagagcttcctcgctttgatgattgcggcaccacgctgctggacagtggcaatgaactccccatttagccattcatcatcttgaacaagttcacgaacaggcttctctccactgggagtcttcacagtggcgtggttaacatcaggatactgactggacgagtgattaccccagataatagcattcttaacgtcagaaacttggacaccaagtctctcagaaatctgaccgagtgccctgttgtggtctaggcgggtcaaacaactgatgttcttctcagggatagatggagcaaactccttcaggatgagagcattggtgtttgctgggttggcaacaaccaaaaccttgcaattgggggctgcatgagcttcaagagcagatgcttgagctttgtagattgaaacatttttcgtcataacatccttcctttccattccttccttcctggggaatccaccaaccataaccgcaacattcacaccagtgcaagcctcaacaacatcagttgttgcaacaactcccttgagaagtggaaatgcggcatcgatcaactccatcttgacgcctttaagagcttcagcagcaaattcaatatccagcatatgcagaataacaggctggtctgcaccaagcataactcccctggcaatcatgggaacaagagcatatccgatttgtcctgcggcgccggtgacgagcacgcgcatcggttccttcgccgccattggagccggggggtagattctggacacggggatagggagagtggtttaggaggaggcgacctggtgccgaattcctgcagcccgggggatccactagttctagagcgggccgccaccgcgggtggagctccagcttttgttccctttagtgagggttaggtcgagcaaggagnatcttc

SEQ ID NO: 21899 - DNA, 1672 bp, Triticum aestivum
  Clone ID: PAT_TA_21899
agcgggtagcaatagcagcaatataacgattcacggaagtaggagtagatggctctatctgcggacacaaatgtaaaaacctcacagaataacgagacagcaggaccagatacccaaaaactcttagcatagcacaaaattaactagttcaccaggtcaaatagccattaagtaacaagcaaactcttccaaaaaaaagaccaactgtttcgacactgaatttcaagtcctagatagtttctttgccaccgccatcacgatcccaggcactgttcgcttacttgaagcacttggcgtccagcaaggcctgcccctcaaacggctcaaggtcctcgatcatggcctcgacacgcttcttctgggcctcgtcggagaggtcaaccttagtccactcgtagagctccatgtcatagacctcattcatgacgaactcagggatgtcctgcccacggaagagccacagccccttgactttgaagggcgcctcagaaccaatcacgagcatcttgccaaaagcgtacttgcggcacagatccatccgctgcaggaacccgccgaccttgttcagggtcacgtaggacacggtgttctcttcctggtacttgtagtcacagaaccagagagagtagccctctgggtcatacatctcccagaaacctttaacagcaacatcatggaagttgctcttagtgtttgagtatagcctcttccagtcatcaagtaccatcttgcttggtggcagtagatcaaggggatttttgggctttggctttggtgcctcttcctctggtgcctcaacctctgctggctttggggccgccttgggagcctctttcttggcctcctttggtttagcaggagcagccttcttctgaacaggaggtacaacctctgcctgcttgaaatcgccaatgaccttcttgaagttaggctggttaaccatggtccagaagtacctctcaacatgagggaactcagatgtgaaagtcttggtcaagatccgagcaaaaccatggtagaggttgcatgtcatgacaatatcagccagagtgacagaatgcccaacaaggaatgtgtttgatgccaggtgtgtgttcaatgcttcaagggccctcttcaatccagcaatgccgaattcctcatcctgggcattgaaagccctataaccaagccttgggtacaaccaccttgcgatattgggatcaacctctgtggcagcaaagtccatccattgctcaacacgtgcatattcaataagagaaccaccccaaagcaggttgtcaccctttgagcgagcaacatagcgtgcaatagcattgctctcaaaaacagcaccatcaggagtctcaagaacaggaaccttcccaagggggttcatcttgatgaattcaggggttttgtttgatacacccatctcaaagttcttggggagctcaaccttgaccccacagtactctgcagcaataagtgccttgaaggcattcttgttgccactgcccgaatgcaaaacgagcgccatgtcggcaggagctgcaggcctcgcccgattccaaatctcagatagagagtgcgtagcgagacgagatcgcggcggaaacctcagcgggcgagcgagggtggggaggagaggggtttagaaaggggacgggggcgcggctttatggcctcgtgc

SEQ ID NO: 21900 - DNA, 1482 bp, Triticum aestivum
  Clone ID: PAT_TA_21900
ctgcaggttccattgtaggtaacgtatttggtttcaaagccctacgtgctctacgtttggaggatctacgaattccccctacttattcaaaaactttccaagggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctggagagaccgttttgtcttttgtgccgaagctatttataaatcacaggccgaaaccggtgaaatcaaggggcattacttgaatgcgactgcgggtacatgtgaagaaatgattaagagagctgtatttgcaagagaattaggggttcctattgtaatgcatgactacttaactgggggattcaccgcaaatactactttggctcattattgccgcgacaatggcctacttcttcacattcaccgtgcaatgcatgcagttattgatagacagaaaaatcatggtatgcatttccgtgtattagctaaagcattgcgtatgtctgggggagatcatatccactccggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtagcttcaggtgggtattcatgtttgggcatatgccagctctgaccgaaatctttggggacgattctgtattacaatttgggtgggaggaactttagggacatcccttgggggaaatgcacctggtgcagcagctaatccgagtgggctttagaagccctgtgtacaagctcgtaacgaagggcgcgatcttgctcgcgaaggtaatgaaattatcccgaagcagcttgcaaaatgggagtccctgaactagcccgcaagcttgtgaaagtatggaagggcgatcaaattccaagttccgagcccggtagatactattgataagttagataaaactaaagataaagaagagaagggtttaattatatgtaagcgacggaaacagaataacgatctctgtgggggggccggtacccaagctatcctgtggtcataccgttccttcgccctggacttcagattcactaattcactgctcaaactctgctgcccgggacgagcggtggggtggacgccgtccacccgccaactcccccacgagtgcagcccggccactgtcacgtgctcattagcgcatattctctactattcctatacacggtctggatgtctagtctaatattctcctcatggatacgttgcgctaagcgtctagcattagacgatcaaccactttcactatgctggggagtttatgtg

SEQ ID NO: 21901 - DNA, 1783 bp, Triticum aestivum
  unsure (1)..(1783): unsure at all n locations
  Clone ID: PAT_TA_21901
tcgagcggccgcccgggcaggtacgatcggatcagcgagccgaccagaacgtacttttgtacaagctttttttttttttttttttttttttttttttttatttataccttctcttctttatctttagttttatctacttatcaatagtatctaccggctcgaactcgaatttgatcgccttccatacttcacaagctggggttagttcaggactccatttgcaagctgctcggataatttcattaccttcgcgagcaagatcgcgcccttcgttacggagcttgtacacaggcttttaaagccactcgattagctgctgcacccaggtgcatttccccaaggatgtcctaaagttcctccaccaaattgtaatacagaatcgtccccaaagatttcggtcagagctggcatatgccaaacatgaataccacctgaagctaccggtataacacctggcatggatacccagtcctgagtgaaaaagataccgcgagcacgatctttttcaataaaatcatcgcgcaataaatcaacaaaacctaaagtcatttcgcgttccccttttaacttacctactactgtacagtagtaggtaagttagaaggggaacgcgaaatgactttaggttttgttgatttattgcgcgatgattttattgaaaaagatcgtgcctcgcggtatctttttcactcaggactgggtatccatgccaggtgttataccggtagcttcaggtggtattcatgtttggcatatgccagctctgaccgaaatctttggggacgattctgtattacaatttggtggaggaactttaggacatccttggggaaatgcacctggtgcagcagctaatcgagtggctttagaagcctgtgtacaagctcgtaacgaagggcgcgatcttgctcgcgaaggtaatgaaattatccgagcagcttgcaaatggagtcctgaactagccgcagcttgtgaagtatggaaggcgatcaaattcgagttcgagccggtagatactattgattaactagataaaactaaagataaagaaggtataaataaaaaaaaaaacgaaataaaaagagaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagntgcgcagcctgaatggcgaatggagatccaatttttaagtgtataatgtgttaaactactgattctaattggttgngtattttagaattcacagtcccaaggctcatttcaggcccctcagtcctnacagtctggtcatgatcataatcagccataccacatttgtagagggttttacttgctttaaaaaaaccttccacacctccccctgaacctgaaacattaaaangaatgccaattggtggntggtaacttggttnattgcagcttataatgggtaccaaataaangcattagcattcaccaaatttcacaaaataaagcatttttttcactggnattctaaattgggggtttgnnccaaactcatcaaggnattttaacgcgtaaaattgnaagccgtaanattttgttaaaaatcccgtaaattttggtaaatcactcanttttaccanangccgaatnggcaaanncctttaaatcaaaagaaa

SEQ ID NO: 21902 - DNA, 467 bp, Triticum aestivum
  Clone ID: PAT_TA_21902
gggctattttcaaaattagaaaggaagggcaagattgaagatgcaaacaaaaatatagttggacacttccattctcaactcactcaagacatggatatcttgcatagaaacatctcaacttcggtctctcaacaggagagccaactgaaagtacttgaagaggagatgcaatcttttatcacctcgaagggcaaggttgctggaggacttcaaaatcaagtaagagaaatgaaagagagcttcagttcaaggattacagaattgcatggctttgctagtgagctcaacctcaaatcccaattaagctctgagaagctgaatgcccaagttagcgcacacacatctgatctggaggattgtctgaagggcctcttagctgatgctgaccaattactcattgggctacaaaatgggctctctcagcaagaagagagcttaactacattagttgagcagcaacatgaagg

SEQ ID NO: 21903 - DNA, 553 bp, Triticum aestivum
  unsure (1)..(553): unsure at all n locations
  Clone ID: PAT_TA_21903
aaatgcgagcagtaatattctccttaattatctcaaaggagaacgtgacactgtggaaaataaaatcaggaatatagtggatgtccgtgatgttgccgatgctcttctgttggcacgcgtccgtatgaaaatccagaggcgtctggacggtacatctgcagttcaaaaccagtaaaagtctctgatatgataagcgtactgaagaccttatatccaatgtacacttatcccaaaaactttacggaagtggaagaaaataccatttatagttcagagaaacttcagaacctagggtggaccttcaggcctttagagaagaccctgggggacagcgtggaatcctacaaagcatctggcgtcctgaactgagcatccaaccagggaaagtttggctgttaatgcttgcaaactccttgtggttcatgtaagcagtgaaacaaaataagttggtgacacaatcgtcacgagagtctgtgtgaacatgaacaaagcatgaatcgtatgcgcgcctttcttttggggtgtcttaaacttgaggtgttttgaggcanat

SEQ ID NO: 21904 - DNA, 2573 bp, Triticum aestivum
  unsure (1)..(2573): unsure at all n locations
  Clone ID: PAT_TA_21904
aggcgctagaagggcngggaaagggggagcngncagcgccaccngcngaacacacagcgccgggatataagcgtcgacccagcgtccgggcatccgctgtccacttcagcgcagcgtgaagagacgcggagcaaccaaactccgcgcagcagaggggactagagccggagcggggaggaagaaggcatggcggcggcggcggaggaggagcgttgtgtgcgtgaccggcgcagggggcttcgtcgcctcgtggctcggtcaagctcctcctctccaagccccactacaccgtccgcggcaccgtgcgcgatcccggtaatgccaagaatgctcatctcaaggcgctagaagcgtgctggggaaaggctgcagctgcttagcgccgacctgctggactacgacaggcattgcgtcggcggttgccggactgtgagggcgtcttccatgttgctagccctgtcccttctggcagatcaaccaatcccgaggaagaagttatagcccctgctgtaacaggcacactgaatgtgttgaaggcttgctacgaggcaaaagttaagcgagttgtcatagtgtcttcatgtgccgctgtgttcaataatcctaactggcctaagggcaaagtatttactgaagacagctggtcagacgaggatctctgcagaaagggtgaggacgtggtatttgctttccaaaacgcgtgcagagcgtgaggcttttgcttatgcagcaaaaactgggctggatgttgtagccattttaccatcgttggtacttggccccttgatgcagtctacagtgaatgcgagcagcaaaattctccttaaatatctcaaaggagaacatgagactgtggaaaatagaagctggaatctggtagatgttcgtgatgttgccgatgctcttcttctggcatataaaaatccagcggcatctggacggtacatctgcagtccagtacgaataaaagtctctgttgtcataagcattctgaagaccttatatccaacatacacttatcccaaaaactttacggaggtggaagaaggtaacgttatgagttcagagaaacttcagaagctagggtggaccttcaggcctgtagagaagaccctcggagacagcgtcgaatcctacaaagcatctggcatcctgaaatgagcatccaactagggaaagtaataatgcttgcaaactccttctggttcatgtaagcagtgaaacaaaataagttggtgacacaatcatcaagggaatcatgtgaaataaaagaaaaatttgaatataatggatgttttgctgttaatgctcgcaaaagccatgtggttctgtaagcagtgaaacagaataagttggtgactcaatcgtcaggagatttgtgtgaacatgagcaaagcttgaatcttatgtgcgcctttcttttggggtgtcttaaacttaaggtgttttgaggcatagtgctatgtccggggtttctatgggaggcgggtggtctcggggttggctgcagaatcaatccctggatagtattatctggttcgagacgtcgtttcttgccttccttactcgccgtctgggcggtccgcctgtttgcctactctatccacccagtgccctgctctcacctcggctctcactgcgcctccggatgcttccctggccacgtccactgcgtttcgctagtgcgcttcagtgcttgcatggcggaagtgcatggctttcccaatggcctccaccgcaaaccccgatcaagctccggcccgctgcacgcccctgtccgcgcactctcctctgtgcgggcgccttgtttgcacggccccgttgctgtgcctcgccattttcgcattgggcgccaaagggggctcgctcacccagctgtgtgctggtcttcattaccttgtgcggcaaagttcttgttgatgaagctcacacgccgtccgctgagctggagaatacaacagacgatctatctgggctattttcaaaattagaaaggaagggcaagattgaagatgcaaacaaaaatatagttggacacttccattctcaactcactcaagacatggatatcttgcatagaaacatctcaacttcagtctctcaacaggagagccaactgaaagtacttgaagaggagatgcaatcttttatcaccacaaagggcaaggttgctggaggacttcaaaatcaagtaagagaaatgaaagagagcttcagttcaaggattacagaattgcatggctttgctagtgagctcaacctcaaatcccaaatcagatgtgtgtgcgctaacttgggcattcagcttctcagaaaaactttacagaagtggaagagaataccatttatagttcggagaaacttcagaagctagggtggaccttcaggcctttagagaagaccctgggggacagcgtggaatcctacagagcatctggcgtcctgaactgagcatccagccagggaaagtttggctgttaatgctcgcaaactccatgtggttatgtaagcagtgaaacagaataagttggtgacacaatcgtcaggagaattgtgtgaacatgagcaaagct

SEQ ID NO: 21905 - DNA, 730 bp, Triticum aestivum
  unsure (1)..(730): unsure at all n locations
  Clone ID: PAT_TA_21905
gcacgaggctatctcggacatgtcattactatcataaggaatgccgtcgcaaatgccgatgcttttgaaagtatagctgagcaactgaagaagggaaggctggaagagttaatggcggcagaagcgaaggacggcagtgaagacactgaaatgattcctgccgtcgatgctgatagtaatgaaagtaatcttcagctgattgctgcacctgatgtagctcccacagtgattacaaatgtccatactgcttctttctgtaccgggaatgttacgagcggagcttctttaggtaatttgcaactagataacatcacacctgaaaccaagagctttggggcgttgccaggcgctaccgggcaagcagatacagtgataccgggcaatggtggtggtcagcagcaagtaataaaggcaacagttcaagtatcgaagagacctacggcttttgggtgctctgttaggaaaaccctctaccgcaagaaggccaaatctatttccaggattttcaagtgaccagagtaaaagcaaggtggagaagatcaagtctnccgtgggactgcctttccatcatttctcaggtggtgcaaatcctccagcaactacccccccggtcgaatcggtggaactgaagcggaatcatgtggaggatctgctcncggatggaggaatgatcactggcacggganaangnccagaaacggaaccanntgcaaatgntgaacctgagaac

SEQ ID NO: 21906 - DNA, 672 bp, Triticum aestivum
  Clone ID: PAT_TA_21906
attccagctccaacatctctctcctagctacatctctccactgtctgtttgcctgtcgaggccgggcgccagcagcaacaatggcgaggatgatcagccggccggccgtcctcctctcccccctggccatgatcgtcgtggccgccgccgtcatggcgctggcaccggcgccggtggccgcgaccaagtacaacatcaccaagattctggcgccctacaaggagtactccaagttcaacgacatgctgtccaagacgcgcctcgcgtacgacatcaaccggcgccagaccatcaccgtgctggccgtcgacaactccgccatgtcggcgctcgaccactactcgctgcagaccatccgccacatcctcgagctgcacgttctcgtcgactactacggcgacaagaagctcaagaagctcgcccatggctccaccgcttcctcctccatgttccaaggctaccgggtcggcgtctggcatgtcggggtccgtgatcaccgcccggacggacggcacgcttacctgcaccaccgagcgcgcccgcccctccgcggtccgccccggttcccccaaccgccgacgcatcccctccgacatcgccgtgctccaagtgagtccatcatctcgtccgccgaggcgaagcgccggtgccgccccggcgccgttgactcga

SEQ ID NO: 21907 - DNA, 384 bp, Triticum aestivum
  unsure (1)..(384): unsure at all n locations
  Clone ID: PAT_TA_21907
gggagcccaagatcgtcctgcgggacggcttggtgctcatggaggatgatttccgggagcgcctgaccgtgcccaagaaaaccaaggcctaaattgccctgcanttggggaagaatatccacacggggaagcatactcatagtcgggctcgtcattatttgtggccacatttcattacggaatttgagttccaataaacttaatattcctttgtcgttcaccttgaaggattgtattattagaattttcatacagggctggccattcgagtctctgcctacgcagatcttgtggtacttgtgtttgtagccaatgtgtgagtaaaagtcgattatagcaatcttgatgccattttgggcttattgttcgctcaaaaaaaaaaaa

SEQ ID NO: 21908 - DNA, 547 bp, Triticum aestivum
  Clone ID: PAT_TA_21908
ccatttcaccaccacgcgtcatgcgggatgcccggcttattactgcggcatcttctcagtggcaaacgtttactgtccacttccaaaccacaaggccgtatcgcccccatcaccgccgtacgctgcaccgcggcgcggaaaccgaccacctgcacccgcaagcctgcccagcaagaaggcaaccaggagcaagaacccacgtccgacgaggccgacgccaacccccaccgcattcccgacgacgagaccccgccgtcggggactgcgaccacctccttctcggtggtccggcgcatgccgtcggccatctcgacggacggccgcctccgccggacggcgctgacgcaggaggagccgcccaactacgagatcgggtggaagcgcaccaagaatctccccctggagaagcccaaggggtgggccatcgccgactttctggagaagctggaggggctgatggagcgcgggcggtacgggtcgggcgcgctgctgggcacggtggcgggcgtggtgactgagcgcgcccgggaggaggcggagatcctga

SEQ ID NO: 21909 - DNA, 621 bp, Triticum aestivum
  unsure (1)..(621): unsure at all n locations
  Clone ID: PAT_TA_21909
ggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcggaggtggggtcctctgacaccattgacaacgtcaaggccaagattcaggacaaggagggcatccctccnagaccagcagcggctcatctttgctgggaagcagcttgaggacgggcgcacgcttgccgactacaacatccaggaggggagaacctccacttggtgctgcccccaagggaagcatgcgtttctggtgcctgccggnaagntataccccaggaggagctcanacatcgantcangcaggtcangcaggggatcccaggnagangggtacttgtggaa

SEQ ID NO: 21910 - DNA, 631 bp, Triticum aestivum
  unsure (1)..(631): unsure at all n locations
  Clone ID: PAT_TA_21910
tcgccccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctgggtgtccgcctccccggccttccgcgaccgctggctgcgcgagtacggcgcgctcgggcctactcgacgccgaaggacgaccttggacgacgacgtcgacagttcctccccgacgattcttctcgcctccgggccccgcgctacaaaaccgagcgggaagacccnccggcaagaaggcnggcccagggtttaggtggcggcttggggatccacaagtgtggaggccccgcgggccccggaacccaagtaccggaaaangccccggaggtgccccncccaaggtgaccccgccatcaanacccntnaagacaatccttancacgacggaacgtgccatatgcaatntgnangggaaaaagncaaaaaagatctttaacanntttntggtccccn

SEQ ID NO: 21911 - DNA, 307 bp, Triticum aestivum
  Clone ID: PAT_TA_21911
ggagctagaggcttagctagttgcttgtgtttggtggtagtcatggtctgtgttctggcgtgtcaggtattttaggaatagaaggatgattaactgggttttgcaatgatggatcatgggttttgaggctgtatttttcgtttatttgcctttcctctctggattctagttcctctctctctctctctctctctctagattctggacaagtgtagtgcttattttaagttggttggtttaagaacctgaaatgaacatgggaattctatcaagcatttacaaacttactttcctcaaaaaaaaaaaa

SEQ ID NO: 21912 - DNA, 489 bp, Triticum aestivum
  unsure (1)..(489): unsure at all n locations
  Clone ID: PAT_TA_21912
atatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcaggaagtcggtcgctgcgtgaggcgtacaagaagaagaagctgctcccgctcgacccccccccaagaagacccgcgccatccgcaagcgcctcaacaagcacagtctccttgaagaccgagaaggaaaagaacgtgagaatattccccatgagnatacctatcaagggctaatcattgaaagaatttacctgtcagttttgccaaaattacttgatttnaganaatctactccanccaagtacaagttac

SEQ ID NO: 21913 - DNA, 468 bp, Triticum aestivum
  unsure (1)..(468): unsure at all n locations
  Clone ID: PAT_TA_21913
cctcggcgtcccagcgtctccccaggccgcgggcagcgggtacatcgaccccggcaccctgacgggcacggtgatccccgccatccgaggcattggcaactacggcggcatcatggtgtgggaccgctttaacgacgtgcagaacaactacagcagccaggtgaagggcagcgtctgatgggcataccgcatacgaagcttcaagctacagcacctagccatgcatatatatatagtggctattcgtcaagttatcggactgctagatacaaatataataagagcggatcatcgggagacaaagacgcatgtcagctattgtctcgttttctaagcaacgagcgagagctgcatgcgctggttagatttaatatggatattgcccatacgttatgtaattaaatcaaataaatgttaagttcatattgatgtgtccatcccaaggtacaacctatttnnaaaaaaaaa

SEQ ID NO: 21914 - DNA, 690 bp, Triticum aestivum
  unsure (1)..(690): unsure at all n locations
  Clone ID: PAT_TA_21914
gtgtctgtcagttctactcgcacgagtggacgtcagatcgtgcaagtgggaaggtccccgatggtaagaacttgttctattcctgctgctatcaacctgtttgttgatgtgcttataagaaatgaaatatcctttttgatatttctttgttgccaactaaaaagctaatatttatggacatgtgcagtatattcagttcaacatctggtgcttcttcagttcatcgtagtgtgcattttcacttcatcttgcaggtatgatcattctctgcccttgctaatgtattttgtagtaactttgtaaacaaaagagatagcacactggaacaaaacagtagtgaagaaagacaccctatgttaattttggtgactctagttcccgttccatcacttgtagatgtatgcctgaccattttttctcaaatttggcatagttgtggttctacccattcccgtgttcatgcttacggttaaatgttgaatttaggatatgagattggtaagaccataatccatggaccagtcttcaattggtatcctgtagttcatttcggtcttgaggggatttgtgtccaaaatgggggttttgattgttgctggttgaatctattgacaacacaagttttgatttcttctgggtatgtatctcatggtggntcacacgtagaagatgggatattcagaagctact

SEQ ID NO: 21915 - DNA, 714 bp, Triticum aestivum
  unsure (1)..(714): unsure at all n locations
  Clone ID: PAT_TA_21915
tcgtggttagtgattacgaccagcaagtcacaagtgagggcgggagaggttgaggttgaggaagagcagaggaatccattccaggagtgtttaatggcgggaggcaaggaagcgcacgggtgggcagccagggatgtctctggtcacctctccccttaccacttctcacggagggttcagagagacgacgacgtcaccatcaaggtgctcttctgcgggctttgccacactgacctccacgtcatcaagaacgagtttgggcaacgccaagtaccccgtcgttccccgggcacgagatcgtcggcgtcgtcaccgacgtcggctcccggcgtcacaagcttcaaaccccgggcgacacggtgggcgtgggctacttcgtccactcctgccgcaagctgcgacatgctgcaagcaaaggggtacgaaggctactgcccccagctcgtgggggccccccggcggttcccgggccacctactgcgcgcggccccaacgcgggtcgccgccgcccctcgcctcaacgccgcttctcggcccgccccgccgccgccccccccgccccgccgcccggtcccggggtacgtttnacccatgggnatangcttaaccccnggaaaactggggntcgctcggggctcgnactgctccctngaaggttcgataagccctaaaaattctggaangaaagcccgnncccgncaanttttgancanc

SEQ ID NO: 21916 - DNA, 566 bp, Triticum aestivum
  unsure (1)..(566): unsure at all n locations
  Clone ID: PAT_TA_21916
gcgtcgcgtgccacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagctccagcgcacggctcgggtcctcctcaccgttcccggcgatggaccggcggcaggagctctgcaggaacttccagcgcggcagctgcaagtacggatcgcactgcaggtttgtgcacgcctcctctcagcagcagcagcaggcgaaagcccaacccgtttgggttcggcttaaggagtaggcagcagcaacagcagcagtcttcgtttcgtgcgcagttccaagcagcagcagcagcaagaagcccaaccgtttggatttggagtgcaaggcaatgcggctgcacagtccaaaaagctcctggcaagcaaagcaattcaaaataaatggtaagggacctcaanccaagangcaacnggagcgganagcacaagcagaancanactctt

SEQ ID NO: 21917 - DNA, 516 bp, Triticum aestivum
  unsure (1)..(516): unsure at all n locations
  Clone ID: PAT_TA_21917
ctgccactcgccacgttccaccagccggcgccccttttccttctcactccgctggcgccggcgccgccttatccatggcgtcggagaagaagcaatccaacccgatgagggagatcaaggtgcagaagctggtgctcaacatctccgtcggagagagtggggatcgcctcacccgcgccgccaaggtcctggagcaactgagtggccagtcaccatgtgttctccaaggctaggtacactgtcccgttcctttggcttcagngcgtgatgaagaagattgcctgctagggtactgtaaggggtgagaaggcaatgcagcttctggagagtggacttaaggtcaaggaatatgaactgctaaggaggaactcagtgacacaaggtgctttgggtttcggaatccaagagcacattgatcttggnatcaantatgatccttcaaccggtatctacggnatgggtttctacgtctccctggagcgcgctgggtaacgtgtcgcccgacccnaangtgan

SEQ ID NO: 21918 - DNA, 783 bp, Triticum aestivum
  Clone ID: PAT_TA_21918
cgattccgtggggaagcatccttcggctcagcccctctgtgataagaggcgccgggcgagggagactcccatgggcggccacggcctcctcctcctccgccgccgccgccgccgccgccgctcttctccatgcctctccactccccgcttcccaccgcgctgcactacctcgctaccgtccgtctccctctcttccgccgccgctctcagttgccttccgttccccggcacgtgccctccctcgcggcggcgacgccttctgggaggagccagacgacggctccgggggcgacgaggaggatgacggaaagcaagcgacccaaagaagaagctctcctttccctccccccttccctctctccaggctcgttgcaacgcggcagcaggagcgtcaggagcaggatctccggagagaaatcgagcttctcttagccccggaccaagggctatcttggatcagaatgagactgctgatgtcaccaaaatttcatcaccaaaatggcatccgcttcatacatacgcattggcgctgcagatacctctgatggacaagctgctcgacaatggtgttgatatcgatttagttgataaagatggtttcactcctcttcacaaggcgataataggcaaaaaggaggctgtcattagccatctcctaagaaaaggagcaaatcctcatgtcacagatagggatggagccacaccattacattatgcagttcaagttggtgccctgcaaaccgtgaagctgctgattaagtacctgcccgggcggccgctcga

SEQ ID NO: 21919 - DNA, 568 bp, Triticum aestivum
  unsure (1)..(568): unsure at all n locations
  Clone ID: PAT_TA_21919
ccaatatcgatccaaccattcatttcagttaagtgttccaaccattcgtccttcatggtcatttcactgacactgtttttcctgcttgcaagttcgcattggtgcaatatacctactgtctggttttagtggcagcgtgttgtctgcactcttcctacggaacagctacatctccgttggtgcttctgggagctctatttggcctgctgggatccatgctttctgaactactcatgaactggactatatactccaaacaanggcagcagctatattaacactattgtttagtattgccctcaatttgggctattggggatactacctcaacgttgacaactttggctcaacattggggggattccccacgggtttccccttggggtttgggcccggttggganaggcctcaatttacctggatgggaatgtcatggagtggccacacactaacaaccttccaagtncaaagcttccctgttttgtggggggggggtgggcccgcggtagttgggttgngattcacggggntgtttcannggaaaacggatcanggtgccattggggcc

SEQ ID NO: 21920 - DNA, 661 bp, Triticum aestivum
  unsure (1)..(661): unsure at all n locations
  Clone ID: PAT_TA_21920
nggggcgctcgttttcgatgccccagcaccgctacgcgccgcacttcgcccccttctctccctctcatgccgctggttgatctctcgtcatctcctcctccaagcacggatcttctcgtcgtctcctccaagcacggatcaggagcactgaaattctatctcaaccggttctgccgactggataacttgaattctaaaggttgatccaagcaggaggtgaatgtgtgatggttggttattttgcatttcttctaggttgatgcatgacggttcatggagaaggctggtggttgtgatagctatcacacactcttttggttaataattagatactctttttgttgagcaatgtgaacctttaatggtgtttatgggtcctgtgggagttgtgatggggctattatgaagatgctatggcctgttatggatgaatggacatgtttatgggctcnaaaattaacctgtaagntgggttcccaaagaaanaaaaaaaaatcccaggggggcccgtaccaattccccatagggagcntatagccncgccaatggcgtcgtttaaacgccggacnggaaaacccggcgtaacaacttatcccctgagcaatcccttccagtggggaaataanagccccccatncctccanattccncgatgtanttg

SEQ ID NO: 21921 - DNA, 801 bp, Triticum aestivum
  unsure (1)..(801): unsure at all n locations
  Clone ID: PAT_TA_21921
cacgtggacggccacccggtgagctccgaggccgagcgccggcgcgtcgtccagtgcctcgaggcggccgtggagcgccgcaccgccgacgggctggagctggaggtccgcaccgacgaccgcgccggcctgctctccgacgtcacccgcatcttccgggagaacgggctgacgatacggcgcgccgagatatcgtccgaggacggggaggccgtggacaccttctacctgtcggacccgcagggccacccagtggaagccaagacgatcgaggccatccgcgcgcagatcggcgaggccgcgctgcgggtaaagaacaacccgctggccgacgacggcggttccagctccgacgtcgccgccggctcgacggcattcctcttcgggaacctcttcaagttctaccgtccgttccagaacttcggcctcatcaagctctactagaactagtaatactacatacagaaatcatatgtagggttcacagatacagatctcagtgtacatattggtccagtccttccggtcggaagatgatggtgatgatcaagctagtctggtgtagataggttgtgtagacagggtancacagactagctctggaaggatgtgtgtggccagctcagatacgtcagtctcaagttgctcgggattagcgggggtgctgactgaaattcggttgtaccgccgtgaatcccggtggtacncaccttgtacataaancctggtggagaaatattttcnntaagaaaacttgtnagnaantatccttagaaatnnggggggggcccggtacccaat

SEQ ID NO: 21922 - DNA, 574 bp, Triticum aestivum
  unsure (1)..(574): unsure at all n locations
  Clone ID: PAT_TA_21922
gttttttttttttttttttcttctgtacagatcaattcacaccaaaacctcaagtggttagttctcccatcacttgcattggctctgccgctgtgcatttagatacaactcatctacatcccaatacaacttacaaggacctaaatatatgatacctcgagtggcttgcaacaagaactggccgacctactgacagcatcctccacttcggtttgcattctcctgcttttgtttcagagtcagagtgttcctcttaacagccgaagagccttcctccaatagactgggaacctgngagaatctttaatgcaagctcttcaaacccatttttccacggttttctcttgttttagcactactctcgacaaagagacatccacgttcttgtgcaaatgcaagaccttcctcctttggcaacaatccgnnctcaacctggccaacttattccaaaaaggcattttgatgcatccttattggttgagtgaacncnattcctgggccanacacaancaaattgtgaaacctcctctggaacgcataacaaataaccaaganacccgtagaagactgnaat

SEQ ID NO: 21923 - DNA, 469 bp, Triticum aestivum
  Clone ID: PAT_TA_21923
aacttgctgctccggcctcccggcgacgcctcgccggcaggcgggccaccacaccctcccactcccggcggcttgtggcctcgccttggcccccgaattcggctcttatggccgccgcggccgtcctcctccgctctgctgcaccagcactgcgcggactcgggtggtcgcttcttgttccgttcccaggaggaatgtagtaaccacactgctatccgcttcaacgttgctacttctcggaccaagacagatcaccttagctgagaccaccggcggtgcattcagggagtacatcgacacatttgacggctactccttcatatacccaaagggctggatccaggtcaaaggagctggcgcggacatattcttcagagatccggtcctcctcgacgtgaacatgtccgtcgacatatcatccccttcttcgtcagcatacaagaccgtcgaggacctaggcccccctgag

SEQ ID NO: 21924 - DNA, 669 bp, Triticum aestivum
  Clone ID: PAT_TA_21924
gtggaagtggaacagctatttacctattgataggtagtactgactaatcatttgcttacagggtaggtgatggaccaataccaggatcttctgcatatggtgatgatgaagttggggcttgtggagctactggtgacggtgatattatgatgcgcttccttccatgttatcaagtagtagagagcatgcgacttggaatggagcctcgagatgctgctgtggatgctatatcaagaattgctcgtaagtacccagattttgttggtgctgtatttgcgcttaacaagaaaggagtgcacgccggggcgtgccatggttggacctttcagtattctgtcaggaattccagcatgctggatgtggaggtcatcacagtaacaccttaacatatgcagatccttattaaaacaaaaggctgattcgccaataaggtgtattcctttatgccaagttctctacattcactcccatggtaatgcaacaatattatgttgggcttgttccctgagtcatctattggactgcaattttctattgaaactgccatgttatataggtagtagattcattgaatgcattgtatacttcttgagaaaaggctggaattgcacatagtcaacttttgtcttgcaactacgagtttaatgtactagccaggtgtgcttcttt

SEQ ID NO: 21925 - DNA, 1811 bp, Triticum aestivum
  Clone ID: PAT_TA_21925
agtgatcaccagtagtgccattccccaatccacacctcaaccgcccagcttccatggctcggagcaacccggggcttctcctggggctcctgctgctgcggctcacctggtgcgtggccgtggatggcggaggcgtggaggaagggggcttcgtgtttccggtggtggtgagcacctggccgttccgggaggcggtcagggcggcgtgggacgtggtgaaaaccggtggcgcagggggctcggctgtggatgctgtcgtcgctggctgctccgcctgcgaggagctccgctgcgatggcacagttggtccaggtggaagtccagatgagaacgttgttactaccttagatgctcttatcatgaatgggaaaactggcagaagacaatggaaattggagctgtggctgccatgagatatgtgaaggatgcaattatggcagcaaagttggtcatggagcataccgggcatactcttcttgttggagagaaggcgacatcctttgcaatttcaatgggtcttgcaggaccacctgacctgagttcacagagtcaattgagaaatggccaaattggacacagaataattgcccacctaacttttggaaacatgttgctcccgccggcaactgtggtccgggccatcctataaatatacctaaggaccctgttaaaagtgctgtatgggagaatcaaggaatcacttgtcaggaatggctcgaaaatgataatttactagaaccgacaaactcccatttcaactctgttaatcgccacaaccatgacacaatctctatggccgtcattgacaagatgggtcatgtagcagttggcacatcaactaatggtgctacgttcaaaattccaggaagggtaggtgatggaccaataccaggatcttctgcatatggtgatgatgaagttggggcttgtggagctactggtgacggtgatattatgatgcgcttccttccatgttatcaagtagtagagagcatgcgacttggaatggagcctcgagatgctgctgtggatgctatatcaagaattgctcgtaagtacccagattttgttggtgctgtatttgtgcttaacaagcaaaggagtgcacgccggggcgtgccatggttggacctttcagtattctgtcaggaattccagcatgctaaaatgtggaggtcatcacagtaacaccttaacataggcagatccttattaaaacaaaaggctgattcgccaataaggtgtattcctttatgccaagttctctccattcactcccatggtaatgcaacaatattatgttgggcttgttccctgagtcatctattggactgcaattttctattgaaactgccatgttatataggtagtagattcattgaatgcattgtagatttctagagaaaaggctggaattgcacactgtcgtcttttcactcccataaatatacctaaggaccctgttaaaagtgctgtatgggagaatcaaggaatcacttgtcaggaatggctcgaaaatgataatttactagaaccgacaaactcccatttcaactctgttaatcgccacaaccatgacacaatctctatggccgtcattgacaaggtacctagcgcgtttaaaggaaagtcactctttctattaatatgaaactaaacagtgtgcttttgttaagatgggtcatgtagcagttggcacatcaactaatggtgctacgttcaaaattccaggaaggtaagcatcttgcctctgttaggaaatttgaaatattgacattacaatttagttggccacctgttttttgctaaat

SEQ ID NO: 21926 - DNA, 661 bp, Triticum aestivum
  unsure (1)..(661): unsure at all n locations
  Clone ID: PAT_TA_21926
ccggaatccgaggatgatgagatccttggcaccgaggactacatcgtccccgaggaccctttcatacaagagcgcttccggcggcacctcattgccatggctcggagcatgaagcgcaagtagcagcaactgtaagccaacactgactcactaagtgaaaagtgggttgaagtgctctttgccgagcaagacatggaaagaccggcgccatagtgcacccgaatcatacccaacgcaaggagtctgctgccaagagtttgatgaggagttagcaccggatgaacctgaccgaccccctaagaggtttggggataagcctaaggcgggaaatctccgatgccccgaccactttccacgccatttatggcaaaccccgtgggctactttagaccctccacgatgtacgatgctgtattgccggtaaacaagnactcctcgggccatcctacggttaaagaggactgcgcccgccaacttngacggtacgagcctaagtngacaggaacgacatggccgagacaagctaccacggtctccctgatgccgatgaatcccccggttcgagggtggcaaccgtttctaccaacagggtatggaaacaattcctgagggttagccacatatgaacattgnggacacatcaattggttngnntcttcca

SEQ ID NO: 21927 - DNA, 165 bp, Triticum aestivum
  Clone ID: PAT_TA_21927
gattattctccggttggtttgtactattttttttttacctcatataggttggttgtgaaagatgggggtgcattgtgttaaaagttgttttacaggatggtggtgaaatcttcgttagaacatggataataattagtactatagattctttctaaaaaaaaaaaa

SEQ ID NO: 21928 - DNA, 230 bp, Triticum aestivum
  Clone ID: PAT_TA_21928
ctcgtgccgcttccgcggcacgggcacgcgggtgcgctacgacgccgaggtcaccgcgtacgtggaggacggccggatgaagcgcatgaccggggtgcgcagcaagcaggtcatgctctgggtgcccatcgtcgagatgagcctcgacggggacaagcgcgacaagatctacttcaagtccaacgtcgggattcggccgctccttccccccctccgccttcgctgacgcg

SEQ ID NO: 21929 - DNA, 693 bp, Triticum aestivum
  unsure (1)..(693): unsure at all n locations
  Clone ID: PAT_TA_21929
ccaagagagagaaggagtagagatgatcgttacgaacgaagaacctgtcgcagaagcaagaattcgtaaaggaaggacaagtcataaaggagctacacaaaatgaagacatcaagctcatgttggtgaatgggtatccgattccgactccaacaatcgctctgagagaagttatcactccgactccgaatatactcaaagatgatggtgttgccgatctagcacttggtgtcaaccaactcctatgacatatttgactccaccaaatggaaggaattggaagttgcttccatgggctaaaggcccaaaggtatcacacccccgagtatgttgatttccaataagtgatgaagatgatttgctaggtgatggatgatttactccctggacaactcctaaatggatggaaactatttatgaactccactattaaccatgctaatccaagataaaacgaatgacgatgataagtagatgattgagcacctaacttaaagactacctggagttactcaaggaactacttagaagtcacgagaactttaaactcgtgagaactcccttgaaagncaacctngtaaaaggtgggtctaaaggaatcatgntgtctcatagaagtctctaatgcagcattacctgcacttatcaaagtaatcagacaggcagagttctctcagaaaatacagtaattttt

SEQ ID NO: 21930 - DNA, 477 bp, Triticum aestivum
  unsure (1)..(477): unsure at all n locations
  Clone ID: PAT_TA_21930
ccccgatccaccattcctcctccggatttcgcagtcagcggtggtgaaggtagcgggcgcggaggaagatggggctcgcgttcgggaagctcttcagccggctcttcgccaagaaggagatgcggattcttatggtccggtctcgacgccgccgggtaaaaccaccatcctctacaagctcaaagctccggcgagatcgtcacaaccatccccaccatcggttccaatgtttgaaactgttngagtacaaagaacattacttcaacggcctgggatgtccggggggcaaggacaggtttagccccctcctgggagttttccccccacaacacacggctcccttcgttggggggtgggatacaatgaccntaccgttttgttttaaancaaagatnacttcacaggatgcttaacgaggatnactacttatgctttctgctgtttccnccaacaananttttcctaatgccatgatgc

SEQ ID NO: 21931 - DNA, 669 bp, Triticum aestivum
  unsure (1)..(669): unsure at all n locations
  Clone ID: PAT_TA_21931
gaacacagggcacacgcactacacgcacggcacgcagatacatatagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgcccgggccgggccgggcagcagggagataacccgaggagggcaggtgcgacctgggacaagagatacgtgagtgactcccccgtctacgacggccgcggccccgacgccagccttggtggccgcgtgcaagggatctaccaacgaaacccggaacgcgcacaactgttcgtcccttgttttccaaaccgacagtcaaggctccacgctcctcaacaatggcgtgataacggcgggtctgacaattggcatttaaggggggcccggggtgttccatgcaagggctcctaaggacaggtgccccccgactccccgggggagcccggcgcgaccctgatgccccccgccgggtgcctcccggcctgcttttgtcagtctcggnacgcctactccagactgcgcggggccagntctaacgtcacaagatgggccatgnggggtgcccggagc

SEQ ID NO: 21932 - DNA, 853 bp, Triticum aestivum
  unsure (1)..(853): unsure at all n locations
  Clone ID: PAT_TA_21932
ccctcccctanncgccgccgccgccgctcgtctccctgagaggtgccgggaccgaggaactggccgagtactaggtagagaatcggtttttcttgtctcaacccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctggataatcgaccagttccccagtcttgctccttgcactcctccctccatctccagcattgtgttctgattcacctgctccaatggctgttctttctgctgctgatgcttccccggtctcaagctatcgggtttgagggctatgagaagcgccttgagatacattctctgaggcactgtctttgtggaccctcaagggcgtggttgcgtgcctctcaaggccaaatgacccgttctgggtctgcacgggcaaatgggtcgactccaacagggttcaccanaggcttcgagcaactgttacaccccgaaatggcccagcctggaacaacgccccnacatcagacctngttcgaanntcaacaattcgcgnaaancccggantaatt

SEQ ID NO: 21933 - DNA, 611 bp, Triticum aestivum
  unsure (1)..(611): unsure at all n locations
  Clone ID: PAT_TA_21933
ctcaggtacattgacatcgggaagcgcgaaggcgccacgctggtcaccggagggaagccctgcggcgacaagggctactacatcgagcccaccatcttcacggacgtcaaggacgacatgacgatcgcacaggatgaaatctttgggccggtgatggctctcatgaaattcaagaccgtggaggaggtgatccagaaagcgaacaacacccggtacggcctggccgccggcatcgtgaccaagaacatcgacgtcgccaacaccgtgtcgccggtccatccgcgccggcgccatctggatcaactgctacttcgcgttcgaccccggacgcgccgttccggcgggtacaagatgagcgggttccggcaaggacattgggcatggacgcgctccgacaagtaccttgcagaccaagaccgtcgtcaccccgcttgtacaacactcccatggccctgaccgacctcatcctgtcccgatgaacagttcacatcaacaaacaagaagacacacctcggtaagctcccccccaagggaccgtgcctgtaccgtaccccttactcctgcgtgtgtgatctgcctgcatgtnntncaagacattaaaatntcccggn

SEQ ID NO: 21934 - DNA, 619 bp, Triticum aestivum
  unsure (1)..(619): unsure at all n locations
  Clone ID: PAT_TA_21934
tcgagtttttttttttttttttttttacgcgctggcaaaacatgcatatggagaaaagatagtacagtactacacataccaactagtcactcactactatatactaggagtgacggcacatatatcactcactccataacataggtcaaattaaacggcggagacaccagcagaacaagaacaacaatacacaaacacaagtatatatatagtgatgactagctataatagagcatgcgtgcgttttaagataaccacaaggaccaagcaaacatggcctcttcactgtccatccatctcgcccgatctagcggtggttgctcctgggctccgtcgctgttagagccagtcgtagacggtgggggagttttggctgcggccggtccgaagagttggcgcccatgcccttggtgggcaagttgctccccgggtgggaagacctgcgcaacctttcccgngcgccgcgcgtgtcctcacccacacgncacggtcctcggncaaggacacgcccctntactcgctcgctctgtnatacacggcgcgtggngcttcgantttccagggcgncatnnccaaaggtnttacccccangctntttnactcnacggaacctggtcnn

SEQ ID NO: 21935 - DNA, 1197 bp, Triticum aestivum
  Clone ID: PAT_TA_21935
tttttttttttttttttttttttttttttttttgggccagcaacgtcccataatttcattatcagagaatcagataccaattcaactcagcagagacatactaacaacaggatgtacaaccgtatagagaacactccctttatcacacactattgttccagcacaaagggaaagagacattccatcgttcaacaaattgcagtggtatatgatgcaagatacaatgaatttgtccatgcataaacaacgtgccgaccatttacaacgagatcaaaatctacaccatagcttttttgttactttcattcaggtacgaattgatgcgtgcggcacggtaggcagtcccagttcatcctcctgctgccggttcgccgggactgctgcatgaccacttggtgcagcaggtaggttaagctcagaatcaagatcggtctccttgtctggttggaggtacgatgggactgaattcgactcaaagtccatatcggcttccaaagcatcaagctcccccataagttcctcctcatcgatgtcatctgggacattgtagcttctaccaagagtttcttgtatttcattgctcacatccataagatccatcatctcgtcttgcatgctatctatatcttcaatcctgacagtcttcatcatccctttcagctctttattggcagctttcattgcagtcatagtttgttgagcatctttaattccctctgatgcgaaagcaacttggtcaagattataagtttggttgtacagcatgtcacgctgaccttcatacatcttgcgctgcttgaggatcctcatggcgcgcgccttgacggcctcctgcgcggggcccggcctggtcttcttgatctgctccttgtagcgcgccagctccgcgtccagcttcttgatcttctcgtccaccgtgtccccccgcttgtatatccggtcggtggcgtcctggatggacggcggcgggtcctggctcttcttggcgccgaagatcttcttcatcgctcctccgcctcctccgcgcgcgagaccaggtagaatcgaaccgcctctctctcgaggttgatgatggggatgctccgactggactggatcgcttgctggcgcggggtcgcagccgtcgcgtgcaggattggggatggaatcgggaggggaatcgggagagcaggagcagaggagcgtcctggccacgag

SEQ ID NO: 21936 - DNA, 692 bp, Triticum aestivum
  Clone ID: PAT_TA_21936
gagcgacggaggagagatcgtcaagaaggaggaaatccaggagctcgccgacgtcgcgagcgacggaggggccgtcgtcaaaaaggaggaaatccaggtgctcgccgacgtcgcgagcgacggaggggccgtcgtcaagaaggaggaaatccaggtgttcgccgatgatgcgagcgacggaggagccatcgtcaagaaggaggaaatccaggtgttcgccggcgtagtgcgggcgcgactcgacgtgctccagggaaggatcgacagcaggtcacaaaagaatcccccgccgccgccggagagcgcgaggcgggtggtcgtgtacctgacgagcctgcgcggcatccggcagacgtacgaggactgctgggcggcgagcaccatcctgtccagctacggcgtgcacgtggacgagcgcgacctgtcgatgcacgcggggtacaaggaggagctgcgcgacgcgctcggcgcaggcgcccccgccgcaagcaccggcgtgctgccgcaggtgttcgtcgacggctggcacctgggcggcgccgaggaggtgcgccgcatgcacgagtccggggagctggcggaggccctcgaggcctgtgagccggcgccgggcgccgcctgaggcgggaaagatgggccggggggctttgccgcggagccgtgcggcgggtgctggggcgcgcggttcgtgc

SEQ ID NO: 21937 - DNA, 642 bp, Triticum aestivum
  unsure (1)..(642): unsure at all n locations
  Clone ID: PAT_TA_21937
gtggtacccctggtactacaagacgccgccgccgccgccgtctgcggcggcgagggggaccggttctagtgttcttggcttggccgccgtgctagccgctggccagctgatcgtggcttaggcgcttagccgcagcacctgttcgttttgcttcttcgttcgatattctctccgccctgatgcagcagagctgcagaggttatttctccctccccctcttttgttataatttattcaagcaggattatattcatgaatatatatatatatacatatatatatttatccaagttccttgattaccactgcgcttttcgagtagtgggagcaactaccatcgcagcatccgctagtcttcatgagagagagacagagagatcatgtatatgtgcatggacntggtaagtgactacaagaatatttccttttaaaaaaanaaaaaactcccaaggggggccggtaccaatcncctatangagcntataccgcgtnatggcgtcgtttnaantcctnactggaaaactgngtaccactaacgccttgagaaacccctttccactgggaaaacanagccgaacgttgcctcaaagtnccacctaatgaatggacccctgtanggntagccggggtttnggtacccaa

SEQ ID NO: 21938 - DNA, 583 bp, Triticum aestivum
  unsure (1)..(583): unsure at all n locations
  Clone ID: PAT_TA_21938
tttgaacatccaacattaaccaattttattcactcgctatagttcacaagaacgaacatgacgttacaagtcttagggtacatcactatcagccagaacaaacacaggcctgtttacacagcaggtgcagggcagcagtatgaacattgctttgtgttcatgtgtggcatcgccctctcaaggcacggatggcgatccctccctgctgcatctccggccgtgggggcatccttgtccggcggcctccgtccgtcgtccgctctccgagcaccggcaggtgtcccttctcctggaggtccttcaccgtgtccgtaaagcgactgggctgaccggccgggaactgcagcccaggccccggagctcctggttggagaacttgtacggctgcttccgcggttcactcgtccggagcactgggctgggacggggaccccgggaagacttggcgaggatgcggacgactcctcccgtggaggaacccctcggcgcaaaaggggcggccggaccccgggggtcccaaagaccgaggtgcnctcggcaagtcngcaagtcaantaccctgcacgnnttgcaaagngcggcc

SEQ ID NO: 21939 - DNA, 630 bp, Triticum aestivum
  unsure (1)..(630): unsure at all n locations
  Clone ID: PAT_TA_21939
ccaccgcntgcgcctacctcaaggacgagagggggtgtgacatttgcgacatttagatcgtcgatcacgcgccgactgtgacggcccacccgttccgcaggagcaccgcgttcctcttcggcaatgagggtacaggactctcacaaaaggagtgtgaggtctgtgacttcttcgtctacattcctcagtatggtggtggaactgcatcactcaatgttaccgttgcagcatcaattgttctccaccacttcggggtctgggctggctttcctgaaagagggcgagaaggcaataaatttgtggtagctgagaaaccaagggggcagtcgagggggctgtactgctcagattcaattgaagacttgattgaagagcgcaaggcacgcagagaaaatgcctgcgatatattcgaggaaaatggaagtaaccatccgcaagaatcaaatggcctaggaatgatgtttacagactagagtgtttattcgatctcatatctgtttctaagcaagcccctggatgataagggcttgataaggtgaatttgcaatacataagacatgatgtggcgctgtactgtgttcccccgtgggagggcagctttgggtggtcagttttttttaaaaaaaaaaa

SEQ ID NO: 21940 - DNA, 681 bp, Triticum aestivum
  unsure (1)..(681): unsure at all n locations
  Clone ID: PAT_TA_21940
tcacatcgacgcggttcggttccagtttcactcccactgccgtctcggcaacctcccctgttccacgcttcgtcctcgcctgccaggctgccatggccgcgacgtcccccttcgactgcgtcctcctagacctcgacgacaccctgtacccgggcgacaccggcatcggcgcggccctgaggcgcaacatcgacgagttcctccaggccaagctcggcgtgtccggccgacgaaggccgccgccacgcgcgccgagctcttccgcggcgcacggcagctccctcgccgggctcatcgcgctcggctacgacgtgnacccggacgagtacacaactacgtgcacggcaggctaccgttacgacaggatcgcgcgcgacccgcanctggcgcggtgctgcagacatcccgcaacgcaaatgctgttcaacaactccggaccgcgcganatggaccggcgccgaaccgcgggcctggacaaggcccttcgacgccgtcgttgctccagacatgaccccactgttccgggacaacgggggacggcccgccttgggtaaacgggggggcgatctcccgggtgccccgctgtccaacaagcggcgcgtctgacatacanggaaacccggggaaagctcgctcgacgctgttgaaagggaganaaganggtnccgngaaaaccccccg

SEQ ID NO: 21941 - DNA, 551 bp, Triticum aestivum
  unsure (1)..(551): unsure at all n locations
  Clone ID: PAT_TA_21941
atcagatcgactgctaagagagtcgtcccagactatcccgccgggtagctaaccttatcttcccatggagccagcgaagctcgcagctttccttgccgtcgctgccgtcgcctacgctgttgccgtcgcaccggctgccgcgggaatactccggcggcgcgaccgccccagaaagctgccagacgcaaatcatgtacttcaccaactgcctggncccgtggatgagatccgcgggcagtgctgtagcgtggtccaagagccgcgagtgcctctgccacctgaagcgggaggtggcgctgccctgcagcctgcatcgccaccatcaacgcagatgctccaaggaagggtcgcctccacggtcggtgaagctggccgagctgcagcgcctcccatgcttcaagacactcaagtgctaggagccgttacgagttcgtatttttgttttgtgtacgtgtgcttttgtttgtttcacaattgttccctgttacngttaattcaatcagcttgctatggatgtaggaactgtgctgtccgttgagaaaaaaaaaaaa

SEQ ID NO: 21942 - DNA, 536 bp, Triticum aestivum
  unsure (1)..(536): unsure at all n locations
  Clone ID: PAT_TA_21942
gctgtacagccctagcgtgttcaggagcgcgggaatcaccggcgacaacaagctcctgggcgtcacctgcgccgtgggcgtcaccaagacgctcttcatccttgtggccacgttcctgttggaccgcgtggggcgtccgcctctgctactgaccagcacgggtgggaatgggcatctcgctcatcagcctccgggacggcgctcaccgtccgtnggggcatcaccccggacgccaagatcccgtccggtcctccctcctgtgcatcgcgtccaccctggccttcctcgccttcctctctaccggcctcgggcccaccacgggagtgtacaacccggagatatccccactacagctggcgcgcgctgggctttgccgtccgcgntggcgtgcaaccgtgttaccagccccgtctcctccctgcccgcctctccctcgcatacatccggcggcggccgctccccccgctctccccccggtgcgcccccgccggccgcgggtccccggcacccggctccgggaagttcggatcagcagg

SEQ ID NO: 21943 - DNA, 379 bp, Triticum aestivum
  Clone ID: PAT_TA_21943
gtcggccagaacttcgcgctggtcgaggccaagatggcgctcagcagcatcctgcagcacttctcgttcgccctctcgcagtcctacactcacgcgccgttcccggtgtccactctgcagccggaacacggggcgcatctcatgctcaagaaactctagtgcccacatcttttgctcaatttcgacaagcatgctacaacgaactacccaactcttccaagtactttgatactccctatttggatatctggatcttggtgaaagacgttagaaatttacattttagcctatctccgagcagttacttttctcatctctcattttgaaaccacactatacaattacagacagtgttcctatagtaaaaaaaaaggggggg

SEQ ID NO: 21944 - DNA, 645 bp, Triticum aestivum
  unsure (1)..(645): unsure at all n locations
  Clone ID: PAT_TA_21944
gccacgcttcctcgtcctcccccagcctggattcctccgctcggtctgccacggcctctgcgcccgctgtctcttctgcttcctgctgctcctcgccttcgcctgcagctccagctccggacgggtggtggtcaccagcttgcctgggcttcgacggcgacctccccttccacctcggaaacagggtgcgccgtgcccgcgtgggcgtgtctactaagtaagtatcctccttcttcttcttcattcattcatcctgggtggtgtactaactaagactactactaagtagcccacgcgcgcggcacatgttagatgtagcctcctaaccaccgttgctgccctggaacccaaaacgaaggacgtggaggtggaggaaggacgccggcgtggagtcttcctactacttcgtccaagccgagtccggcgccgccggccggcgccgaatgacaccctttcctcctcctggtcaacggcggcgacgctgctccgtcttaacggctcgcctacaagttggccacaaatcgcctgggacctanaacggacctgccgccctgcgataaacacaatctggcaagggtaatacccctcgcattacggttggctgatttcctccagggncggancaatcncaaagagccataccgg

SEQ ID NO: 21945 - DNA, 756 bp, Triticum aestivum
  unsure (1)..(756): unsure at all n locations
  Clone ID: PAT_TA_21945
ggctcttggcccatgccctacaagaccctgaaaaccagcattttgtcttgctttctgagagctgtgtctgtgtgccacttcataactttgattatatatatagttatctcatggagacaaacgtcagttttgttgactgttttgatgatcctgggtccacatggagcaggtagatattctgaccatatgttacctggaaatggtgaagaaagatgggagaaagggtgcacaggggtttacaagtgaaacggcagcatgcagtccttattcttgctgacacccttttactaatgggaagtccaagcgttactggtaagccaaggaaatgagtggcataactggctattcaagaatgagcaactacttgccaacccccttcaaatatggctgaccccgactgggaatggcaaacgggcaattgaccaacgttagattgggcccgaaagggaaatggcatccccaaatcctacaaggctgtnggatacaacttccaactgccccaagacatctcctccattggatgagacgcccgtcttcaccacccgcgccgtccgtttcgcggccgcggccggccggttgaccgctgcacccgcccgctgccgccacgcctgatctgtccaaagcgctggcgcccgatcacagggcncaaatnacgtcatcnaacaactaatggaggaggacacactaacaatncgtcgntaatcaactcncaatacgnngccaanccataanaattccggatgcgcgacnaggtnt

SEQ ID NO: 21946 - DNA, 795 bp, Triticum aestivum
  Clone ID: PAT_TA_21946
ttcggcacgagggtcctccatctccaccttcgccttcaccttcgcctctgctccggggagaagcttccagaaggttctccggcccgtaccccggccatcttccggatggaggcggcgcgtcacgcggggaagaagcggggtccggacgacgaggcggaggcggaggtgcaccacacgttccggggcgccgccaacgcgctctcgcagctctacgcgcaggccgtcgccaaccagaaggcctccttcatcgccggcgagcgccacgccatggagcgtacccatcggtggatatccagtcagcatgaagaagcatcgggagtgtctgttgctgatgtacttgcttacttgcagaatgagattgagagcagaggaggcatggcagggtcttcccaacatccaactccacagccagcatatggtcttccttctgcaaatgtccaaatcaactccttctcatttggaaatgtggcagctgcacttgactctcagctgtaccaaaccgatcaaacaagaactgcaggcatctcaaatgttttcagcagtccttcacagcaaaattcccattcaaaccatctggttctgtgctcagggcccggccctgcccgccccccgcccagtggcagctgacctccgcccgaccatgcccctcagcccctggactcccccctgcccacttcggccccgccctccacgcatatgaaccatgatgctcccttgagttgtgaaccaccatatgaaaggtgacaacagcatcagtcagtttattggacctccaatatctgatccttatttgct

SEQ ID NO: 21947 - DNA, 415 bp, Triticum aestivum
  unsure (1)..(415): unsure at all n locations
  Clone ID: PAT_TA_21947
taggggccttttttttttttttttttttttnnttaaccatcaaactgctttatgatgccatcagtcacagtcagattttattcgccttctccatgggtggcctcttcacccaacaatcttaaccacctccgactaataacgaccaaagcatgcacacaggcaggcacgggataaacaaccaccaaggtttgttttacagacagaccttgttctactcaacacacaaccaactgggggcaccagagatgagagccctcctaatacaggtcgccctccttgtgggtgtggatgacgcagtccgacttggggtaggccacgcacgtcagcacgtagccctcctcctgctgcgcgtcgtccaggaacgaccggcccgactggtccaccgcgccagcctcgatcttgcccgcgcaggtcg

SEQ ID NO: 21948 - DNA, 837 bp, Triticum aestivum
  Clone ID: PAT_TA_21948
cccacgcgtccggagaaaagagtgtcttggctaaagactcttccatgcccattaatcgagttacatggagccctgatggagacttgattggagttgcattcgcaaaacatttgatccatctgtacgcataccaacaacctaatgaagcacgccaagttttagagattgaggctcattctggaggagttaatgacatagcattctcccggccaaataagcaactctgtgttgtcacttgcggagatgacaagctgataagggtctgggatatgcatggacagaaaatatattgtttgaagggcacgaggcacctgtgtattctatttgccctcaccacaaagagactattcagtttatattctcaacttccattgatgggaaaattaaggcatggctttatgacaatgcgggatctagggtggactatgatgctccaggaaaatggtgtactacaatgctttatagtgccgatggaactaggctgttgtcatgcggaacaagcaaagagggagactcacatttggttgagtggaacgaaagcgaaggatctatcaagagaacatattctggattccgcaaaaaggcatctggtgtagtgcagggtgttgtgcagtttgatacagctcagaatcacattttagctgccggggaagataaccaaattaaaatttgggatgttgataacaccaacatgcttacctttattgatgccgatggaggcttgccaggccttccccggttaaggttcaataaagaggggaatcttcttgctgttactacagtagacaatggcccatcagaatttgcaagcactgatgggctcagaactctacgggc

SEQ ID NO: 21949 - DNA, 789 bp, Triticum aestivum
  Clone ID: PAT_TA_21949
aaaaccatgaaactgcattttagtcccttatttctcattctcctccatctccatctccatctccatctccatgggtgggttcacccaacaatccgactaacgaccaaagcacacaggcaggcaggcaggggataaacaaccatcaagattggttttacagagcatcaaggttctactcaacacaaccgggggagccagaggtgagacccctaatacaggtcgccctccttgtgggtgtggatgacgcagtccgacttggggtaggcgacgcacgtcagcacgtagccctcctcctgctgcgcgtcgtccaggaacgacccgtccgactggtccaccgcgcccgcctcgatcttgcccgcgcaggtcgagcatgcccccgcccggcacgagtagggcagctccacccccgccgtctccgccgagtccaggatgtaggcgtcgtccggcgcctcaaactcgtgctcctccccttccggggtcaccagcttcaccttgtacgtggccgccgctgagacatccagcttcttctttgaggaggacctcaggctcggcagctgcagcgcgcctcggccaaggaagctcacacggctcttgagcgctttctgggggacatcggttgtccgagcattgcccaagagcacgcaggaggtcgcaaacgtgcaggttgacatcttgaaacctgtggcggcgggccggcgaggagggacggggcgggggcggcggcggcggcggcggcggcggcttcccttgcctcctcctccttgcgtgtgttctctgacgcggggtgga

SEQ ID NO: 21950 - DNA, 2509 bp, Triticum aestivum
  Clone ID: PAT_TA_21950
caagaatgtttttttgttttgtaaccggatggttttcgcttattccaaaaccaatcaaactgctttaatgatgccatcagtcacagccagattttattcgccttctccatgggtggcctcttccacccaagcaagtcttaaccaccttccgattaataacgaccaaagcacgcacacaggcaggcacgggataaacaaccaaccaaggtttgttctactcaacacacgaaccaaccggggggcacccagagatgagagccctcctaatacgaggtcgccctccttgtgggtgtagaatcacgccgtccgtcttggggtaggccacgcattgtcagcaggtacccctcctcctgctggcgcagttgccgccgccgtgataggcaacccccacccgtgccgctatcggtgccgcattgccccttcgcgtttggcgacgcgcccggcccgggctccgtgcaccccccgcgtcccccgacgacgcgtccgggcagccgccacgccccaccgcgcccgccgtcgatcttcgcccgatgtcaggggtcgagcagtgcccctgacccgggcgcgcgtcaccgctcctggcgtcccccagcgcccgctctccgcgtagccgaggatgtgggtgtcgacgcggcgccctcaaactcgtgctacgtcccccttcgggggccccgctggcttccaccttgtacgtggccagccgagggagacgtccagcttcttcgaaggaggaggacctcaggctcggtcgcccgcacggcgccctcgggccaaaggaagctcaggcggctcttggaccgctttctggggggcatcggttgttcgagcattgcccaagagcgcgcaggaggtcgcaaacgtgcaggttgacatcttgaaacctgtggcggcgggccggcgaggagggacggggcggcggcggcggcttcccttgcctcctcctcgtgctccttgcgtgtgttccctcttgtctagtggtgggcggtcggccgcggtggcgacgcttagataggcggccaagaatctcagaagaaaaacctgataaaggcgaaaccttgggagctgatggaagttctaaatccccagcaattccgtgtagctacattgccagaaactccagaccaagccagcaaggttgccaggctgctgtacacaaattctggtgtcggtttgttagcactcggctctagtgccattcaaaggctgtggaaatggaaccgaaatgagcagaatccaagtgggcaggccacggctagtgttgtgccacagcattggcaaccaaacagtggccttgtcatggcaaatgatatcggggaaacacctcctgaggagtcagtcccatgcattgcactctccaagaatgattcttatgtgatgtctgcatgtggtggaaaggtctcattgtttaatatgatgacatttaaggtgatgacaacattcatgccacctccaccagcatcgacctttttagcatttcaccctcaagataataacatcatagcaattggaatggaagattcaaccatccacatatacaatgtcagggtagatgaggtcaaaattagactcaaaggacatcaaaagaggataaccggattggccttctccaacagcctgcatatacttgtttcttctggcgctgatgcacagttatgtgtgtgggccaccgattcttgggaaaagaagaaatcggtcgctatacaaatgccagctgggaagactccatcaggagacacaagggttcagtttaattctgaccaaaatcgcttgttagtagtccatgagactcagatagctatttatgatgcatccaagatggagagaatctaccagtggatacctcagggcactttgtcagctgccatatcacacgcatcgtactcgtgcaatagccaactagtttttgctgcttttactgatggtaatgttgccatctttgatgcggataacttgagattacgatgccgaattgcatcatctgcttacatgtctacgacagccataaacagcaatccacccgtttacccttttgttgtcgctgcacacccccaagaaccaaatcaattcgcagtcgggctttcagatggatccgttaaagtgatggagccgttggagtccgacgggaagtgggggacgcctgctccagtggaaaatggggtggccaacggaagggcgccagcatcatccgctacaagcaatctagccacagatcaaaaccaaagatagatgcatgttgagttaattgtaaaatcttgtcatccgcatgttggtgtcagcaaggttattgttgcgtttcttgggaatgtaagattagctgtgtgtttatgttgtagttgtgagatgattacccttgctcctatgagtgatgatcttgtgatagggataaagttcataagaaggttcgccttaggttttgggcagtttaaacggaatagccggaccctgtaggtatcttgatgcataatgatgtaaatcagttcatggttttgcatccaaaaattttttcggg

SEQ ID NO: 21951 - DNA, 460 bp, Triticum aestivum
  unsure (1)..(460): unsure at all n locations
  Clone ID: PAT_TA_21951
gtcgtcatcaatcacggtgaccttgccctcgctgcccgactggaaccggacgctgctgctgctggtaggctgacagcgaggaggacgagacgagggggccatggctcagatcttgctccacggcacgctccacgccaccatcttccgaggccgagtcgctctccaaccccgcacccgcgccactgggcggcgcccccaagttcatcccgcaagcttgtggaagggttcgaggacaccgttgggtgtccggcaagggcgccaccaaagatatatgccaccgtccgtctcgccnagaangcccgttttccgggcggcccggattatctcccaacgaccccgtnaacctccgttngtacanccttccanatctaactgcgcgacatggcgccgactcacttcaacgttnagatngaactccnatcnggctcgctcaatcnggaagcctattncctgtccancg

SEQ ID NO: 21952 - DNA, 510 bp, Triticum aestivum
  unsure (1)..(510): unsure at all n locations
  Clone ID: PAT_TA_21952
ggccgccgctcgctcgctcgctgcagctacgcacgcacgcgcctgctcctccccttagcttccacaaggctcgactcggccggcggcgatggcgcggaagaagatccgggagtacgactccaagcgcctcctccgggagcacctcaagcgcctccgccggcatccgacctccagatcctctccgcgcaggtccacacagtccaacggatttcactggagctggcaaaccaaggagccgtggctctcatctatgaagttgggttggtgaaacctggacatgctcttttggggaaacgtgggaagagttgggctggtggcctccaacctagattcttgccccaagtccgccaatttgtccaaggaccggtgggagtttgagtcccagatgggtggctgcaaactcccaatttacaacttcatagttgaacatttgtgccacatgacaaaganactactttccattgtatctgaaagnttgggaaacattatctctcaaaaagtggaggatga

SEQ ID NO: 21953 - DNA, 338 bp, Triticum aestivum
  unsure (1)..(338): unsure at all n locations
  Clone ID: PAT_TA_21953
cttgcaaggaaagaggaagacgaacggtttgcaagtaggaagaacagagatccggagaacctttttttgcctcctggattaagctgtctgttcttgcacgcctttttgttgttgtttcttttagcttcttttgttttggttcttccttttagcaagcaagaaagggtcgtttttaagccccctttcaggctgcaccaaccaaaccattgaccaaaccaaccatcctcctgttcttcgcttttatactgaggaaacaggccttatttttccaattttttcttttagatagttccatctccagctcagttttggcaaacaaacacaanaaaaaaaaaaaa

SEQ ID NO: 21954 - DNA, 632 bp, Triticum aestivum
  unsure (1)..(632): unsure at all n locations
  Clone ID: PAT_TA_21954
tgcgacggtcccgatgagctggtcatggctggtgccacagtacgtgatggtcggggtggcggacgtgttcataatagttgggatgcaggagttcttttatgaccagatgcccagcgagcttcgtagccttggcatagcgctctactgcagtgtgattggcatcggtggcttcatcagcggcactctcatctcactcattgaccgcatcacatgcaaaggcggtggcgatagctggttctctgacaacctcaaccgcgcccacctcgactacttctactggctgcttgccggcctcagtgcgggagagctcgcgctctacatctgcttcgctagagcctacacctacaaggacaagagagacttttgagagtgataacctagaactagaagtagacaatctgcaaacagtttgccactctatttgtatttggtcacttatgtggtacttgaagactatgcatctttggttgtttaacaaacctgtttcattttattgtttctggcacttggccttgtaacaacttgagaatgtatgccaggaaggnaataaaacatttcctttactaagaanaaatacatgtnaagaagnngttggnaatacgtcctantggcnatnatattgtattatttga

SEQ ID NO: 21955 - DNA, 365 bp, Triticum aestivum
  Clone ID: PAT_TA_21955
atccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatggcctggcctggcctgccccaccaccgccaccgacggcgccgccggccgcatcctcattccaatcataatagacgacccgcagcattaattatccaccggctttttttttgggctctttcttgcccctgtaatctttctcctcctcttccttcttgggaattgtccgccgccgtttcgatacgtaaatcacgagatcgggtaatacagtaatgctcctcaatttttccaaaaaaaaaaa

SEQ ID NO: 21956 - DNA, 322 bp, Triticum aestivum
  Clone ID: PAT_TA_21956
cgcttagccgcctccaggaccgggacgtcatcaacaacctcatcgccgaccttcgatcgatggccttcagcttggcgctcccgctccccccgccacctccggagccagactagatgctgtgcagcaccctatttgtgcgtgccttttctgcttttcagggcttgttgagctgtgccctcaacattaaccctatgacttcttgccgtggtcaagacttgtgcgtgtgtgtgtgttgtgatccgaactatgtttggatgttgggctttatctataaagcggggcgaaagcctttttccggtaattaagattcaaaaaaaaaaaa

SEQ ID NO: 21957 - DNA, 755 bp, Triticum aestivum
  unsure (1)..(755): unsure at all n locations
  Clone ID: PAT_TA_21957
gaattcggcacgagggaggccctgctcgccgtgcgccagaggccgctgatgtgttggtcgcgtggcgcgcgccctgctccggcgagagggctcgggcgcgtgtgattcggcggcggcggcggcggcggggacgaagccgctgcagccggcgtcttggtccagtgcggggccgaggccgggcggggccccagcccggcggtgcctgcgcccgtcggccgccgtccagagcacggacaccgtcggcctcacagcgggatgggcagacattccccgcgagctgcttccagttgtgctctcccgcctgccatgtccggtagatcgtctccggttctccgtcgtcaacaaagaaatggcacgggttcttggaacaacaccgtcgtgatctccatcttcctccaactaactccccgtcatttggtgctaccgtcgtccttccccagaaagcaccctcctgggtccaacgttaacacaagggaagggaacacccggcgcctcnggactcccaccaagacatcaagcagagagacaagtttctgtgggtcctaccaaagggggggggttcgccccccctcctgatgggccactgggcaacagactgggcaacatattcccccccggcagcgttcccctgcccccgccgacaatggtgggcgggcgggcgcgggatnanaaattaacccanttttnggagaaaaatctctcanggggtcccaattnttgggccacaaaaaaaaaaaaaaanaancggggngaat

SEQ ID NO: 21958 - DNA, 670 bp, Triticum aestivum
  Clone ID: PAT_TA_21958
tgatatccatgtagatgctgtcttaaatgtgactcaggcaattctgggaggtactgttcaagtgccaactctcgctggagatgttgttctaaaggttaagcctggtactcaacctggtcagaaggttgttctgagaggaaaaggaatcaagacgagaaactcgtattcatatggagaccaatatgtccatttcaatgtcaaaatccctgtgaatttgacgcagaaacagcgcatgcttctcgaggagttcgagaaggaagagaagggcgaggacgacaaggatgcggaaaaggctgctggtgcatcaggatagccggtcttaggagccaagccgcccagcatttcatgggcggtttagctcatcacacaccacaagatagagtaggatgctgcctggaattcacaggtttaagttatatagttaggttgcatggaattcgcatggcaacacatagatcttggtttcgagttattgtagctgggaaataatgctacaccctgccgcctggcacgtattcttctcccaagagtgaggcatgacggttggcggcatcttgtattgtataattgatcttgttatgttttagagacacactgaacacacggtgccactgtcttattcatgtcgctgggtcaagaagatttgtcattggggaacaaaaaaaaaaaa

SEQ ID NO: 21959 - DNA, 670 bp, Triticum aestivum
  unsure (1)..(670): unsure at all n locations
  Clone ID: PAT_TA_21959
tcagaattaaaggaaaagtggacatgcacacacatggaaacaatggattacctggccataatgcttggaaacgcaagtaggtatgaggttgtaagcaaaggctgcatccctgttgggtttatattgaaggggatatatggctcaacctctgtaactggggagttttcgttcctacaaaagattggggaagggaaatagaagggaaattataaggattcaatctactatcagcaaaatttccgttccgatgggtgatggtaaccatcaaagtaatttctgttgggtcaaaaatgcatccagcatcctcattatgacataccaagggtaaagctaaacagtgggtagaaagagtacaacaatacatgctaaaagtacaccgaaagaacaccgtgggtttcctgagtgatgttaagtattccttattaagaaatttataatagaagctcctcccttcctcggtaaataactgacagttaaggcaaaaaaaaaggtcctggcgaaacattccttgacctggaccgtatacagcagacaacttaagaatcagcttacctaccaaagacagatagagtgacggtatcatgactaatgccgcatcccaagatagtaatgantaccagtacctatttataatcatttaggaaacagcgctatagtncccaagnacctt

SEQ ID NO: 21960 - DNA, 690 bp, Triticum aestivum
  Clone ID: PAT_TA_21960
gcctcggtccgtcagctcgtgccacgatcctcctcctcctccgccgccgcctcctcgctccggcgaccgctcctctgactcctgacagcagcttgtggtcagcagtgccgtatgaggttcgcggggtggtacctgaagatcgccgtcggcggcgcggccataggcgccgccatggagcttttcatgatccacaccggcttctatgagaaggtaacggtactggagtctgaaaaacgagcttgggagagcagtccagaagcacaagccatgagagaagccttgaatccatggcacaagcgcgatgaacaagagaaaaaataggcaacgataggctcatcggtcctcctttcaagtaattgcattcccacccttccattgtatcgtaaccccttgaacaaggtaatagggatgtggcgtttttgtagttgttcgaacctgtctctctggggttgctggacgatagcttccagcaatgttctaaaagagttatgctcatatcatatccacaagtcttcttgctaacaaggattcttttactgtttccacgcatatgcgtccattttgaatgccattcacactcagtatctgctatgtttagcaatgtaacaaagaattttagacttgtagaggtcaaaccaatctattcttccattcaaggacttcttttctgtgaaaaaaaaaaaaaaaaaa

SEQ ID NO: 21961 - DNA, 666 bp, Triticum aestivum
  unsure (1)..(666): unsure at all n locations
  Clone ID: PAT_TA_21961
atcgaacttctcctgtcgtctgcctaccagtagctagctctaatacatagcagccctcgctcgcaaggtactgcactacgatggccgccacctcctcctcctcctcctccacggtagttgcacttgcggcgcttctcttcttgctccttgtaacgtgtggctccgtgcgccgaagaccggcgagctttaacgcctccgacttttaccgccgaccccaactggggaggctgccccgggcacctgggtacggttgcgcccaccggcgcccggcctggatgacgacggtggtgcctggtggttccaaaacgtgaacctgccgccgtctccggcgatgacatcntgccggcaacgaccctcttttaaaggacggcaagggtgcgtcctgctaccaaatacgatgccnaaacaaccaacctgctcccgggaacccggaaacggtgatcacaaccgacatgactataccccgtgggcaaatacanttcgactcaaacggacgggttcgggccatggcaacccggcgnacgaacagttcgcaagccggataacgcatcaattaagaggggcctgaactacccgggaaaagngacntcaaatcagggggccaaccggtcctgcgggccccatttgggggnggaactgtgagggctatggcaanncggttgncna

SEQ ID NO: 21962 - DNA, 569 bp, Triticum aestivum
  unsure (1)..(569): unsure at all n locations
  Clone ID: PAT_TA_21962
cgaccttgcctcctcctgcagcagcagcagcataaccagagtgcagcaagccgtttcgagagacagctttaggctactgctagtgctagcagtatggcttacgctgcgcgcttcctggtggccgtggtcgtggcgtgcgcactcctggccagcaacaactgccacgcggcacgccacttgngccgacacggccgcggctcccgctgctgctgggtgtcgtccctggcctccccgctgtgccgaccttgccaacggtgccgccaagtgccacaggtggcacggccacccatgccggccgtgcccgcggtcaccgtgccccaagatgacgctgccgcccatgccaagcggcccccaaggtgtccgtgccgttgccgccaatgcccgccgtcccgttccgtgctgcccaagctgaccctgccaacgatgcccgttgtcgtccatctgtcgtccccaaggtggtcttgccgccgatccgtcagtcctacgtgccatccgttcgcggaacgactcatcgggtagaccgcgtgctctgaagttgcgttgccgtaccacatgccaggtgggcggta

SEQ ID NO: 21963 - DNA, 692 bp, Triticum aestivum
  Clone ID: PAT_TA_21963
gcccttccgcacaagctgctgctccttcttcttcgctcccgtcccctgcgctcgcggcggcggcggcggctttccacgtttccttttgctgtggaagttcatacccactagatggggaaggcaaagcgtgcatccatatttatcaggctcgtttcagcagctggaactggttttttctacgtgaagcgtaagaatcctcggcggattacagagaagcttgagttcaggaagtacgatcctcgtgtaaacaagcatgttctatttacggaagccaagatgaagtgagacagtgcagcctttttttattcttgacataagacctctactgttcattttcgttgaagacaatgctacctttattagcctgttccagatttgagagtttcatgtgggcaccaaatcagcatggatcttgctctgcctgccttgtttatttgtattgtaagtttgtaacttgaaatgagctgcaagcctgcaaaagtaatgcccatctagtgttgtgatgattatcatgtggatgcttggttctgaaacttaaagcagccacagatcaagggtagagggtctgaaccaccaagataaatgtaagttttttctttccttttatgttcttttcctttcctgtttaatacctgaaatatttatgctgtctccgcaaccgagtatcagatagctgagaggcatgatttgct

SEQ ID NO: 21964 - DNA, 1208 bp, Triticum aestivum
  unsure (1)..(1208): unsure at all n locations
  Clone ID: PAT_TA_21964
cctatcctccgcggcgcccccaccctctccctcacgcgcgaggccgccgtcgccgttcactgttcatcctcggcgcatccatgctgtctcagccccgtcggcaattttggccattggcctccgaggtgcgtcagccctaggaggggagaaaatttcagaagccaagaaaggtctcacgagcagagtaggggaggactttgttagtggactcagagcattgcacgtgcttgtagatggagaggataaccaccaacccgttctatacctctggaatcccagtaactgtgccatcacctctgccttcaaccaccatggatgaaagctttgcaaggcttccagatgcgcagaatgttttngctggagagggaactgagaagaacccctctcccgcctcatcaaagtactgttgctcctatttgcgggcagtttcaccccagtactgggatctgtcgggcctctgcgttcgcccccggctgtaaggttctcttcagttccgaaccctgagcaatacaacggtgccaatccttacatttctcagacgccaagcactggaagttcttctgcgatgatttatggatcacaccatgaaggctttgaacctacttttaatgattttccaagagatgttggaccaacgtggtgccctgatccagttgagagcatgcttggattctccgatgatgtccctgttggaaacaatttggctggcatcagtcctattgcagctacagatgagctcgctaagcagactgaatggtggacggatttcatgaatgacgactggaaggacattgctgacaacgcaggtgctgctaaaactcaaccacaggctggaccgcctgtgcaatcatcgatttcagttcaccaatcagccagtcagcaagctggtacaacttcagttcaccaaccagccctccagcaaatagttacaactcaacctatagaatcatctgtagttgctgcaccctcaccctctgccagctccaacacctccaagacacgcatgaggtggactcctgaacttcatgagcgtttccgtgggacgctgtcaatctgcttggtggcagttaaaaagctactccaaaaggcgtgctaaaagctaatgaaggcagataatttgaccaattacatgtaaaaagtcatcctcanaagtncagaactgccgatatagacagaatttctgaaggtcacagaaaggttggaggccn

SEQ ID NO: 21965 - DNA, 593 bp, Triticum aestivum
  unsure (1)..(593): unsure at all n locations
  Clone ID: PAT_TA_21965
gcttggcggacagtcatgccggtggagggaaggaagaagggcgtgccggcgctggggtggtggctaatgctggtcggctccctccgcctcgcctccgtctggttcggcttctttgacatctgggcgctccgcgtcgccgtcttctcccagacggacatgactgatgttcatggccgtacttttggtgtctggactcttctgacctgcacgttgtgcttcctctgtgcactgaacctggaaaataggcctctgtatctggccaccttcctatcatttgtctacgctcttgggccatttcctcacagagtacttgatatatcacaccatggctgcagcaaatctgagcacagttggcttccttgcaggaacgtcaatcatatggatgctcctccagtgggaattatcatgtgaatccccatggtgcccaagctgtgaagcantcatgattgatgcttgggctgttagctttatgtggccagggggaagaaggggtccctaaaaacntcagaaagctcaattaaactcaatttaacagtaattggtgatgagcattntcaactgagtaggatgaaancaattattntgcaaaaaaa

SEQ ID NO: 21966 - DNA, 629 bp, Triticum aestivum
  unsure (1)..(629): unsure at all n locations
  Clone ID: PAT_TA_21966
ctagnatccgcagttcccccgcgcccgagacgcaaccccgcgccaggagtaagtttgttcttttatcgatatggcgagggaggagaatgtctacatggccaagctggctgagcaaggccgaaaggtatgaagagatggtttgagtatatggagaaaggtggctaaagactgttagatgtggaaagagctcactgttgaaggagccgtaacccccgtcggccgctccccatttctgagtggggtcccccggcgtccgccggccttcccctgcgcgctttcactccggccctcctggtacaaccaggcggttcccccttcaaggacgcttgaaatgtgggccttttccaaagctgtccatgcgcctgactcctggccccaaccgggcttctccgggggggggaccccggctcctccctgatcccctacctaatgcctccgcctacggcgcctgaaccaaggccccctactcctatgctgagggccacgactccgggaccgtccccgtctaaggcgcccccgaancggtcggactgcctacacacgatttcgctacagggntgcttaccanatgnctggtgactggactaccatcgataaggcttggcttgcctaanttccatgtcatagga

SEQ ID NO: 21967 - DNA, 921 bp, Triticum aestivum
  unsure (1)..(921): unsure at all n locations
  Clone ID: PAT_TA_21967
gtctctcagcaagtgacatcaatctcacctcctctcaagcaggcaaaagtagccgaggatgatcggtgaaatggatgcggacagtgttgtaggatatttcaggggcaagagtatcctcatcactggttcaactggcttcctaggcaaagtgctcgtagagaagatactgagggttcagcctgatgtgaagaagctctacctcttgattcgggcccctgatgctgaatccgcgaagcttcggattcagactgagatcataggtcgggagatctttcatgtgctaaaagaaaaacatggtgtgcggttcaataatttcattgaggaaaagatatgtccgttggtgggagatatcatttatgaaaactttggactagacagtgcccagctaggggaattgtccaaggacgtagatgtcatcgtcaacggagctgcgactacaaatttctttgaaagatatgatgtggctttcgatgtgaatgtcttgggtgtgaagcacgtctgcgcatttgcagcgaaatgtcctaagctcaagatgttgcttcatgtttcaactgcctatgtagctggtgagcaagaggggataataccagagaagccgatcttgatgggcgagaccttaaaggtgggcacacatctgggacatccgatccgagttaatttagtcaaggagaccatgccgagaactaaaagctagctgctccacagagaaggctgggaaaggaaaaccatgaaaggagcttgggcatccaagagggcacgacactttccgggtgggccaaacaccttatgtcttccaccaaaggaatgggggagatgatgatgggggaacctaccaataactttccggttgtcacanccgccccgagcattataccanaccctcaaaagaccattgcctggatggatgggaaggacaagaca

SEQ ID NO: 21968 - DNA, 618 bp, Triticum aestivum
  unsure (1)..(618): unsure at all n locations
  Clone ID: PAT_TA_21968
cgcgcaccgggcggtttttcgttcctttctttttttttcccctcttccccttccccttctccttccagcggcgctcaggccaccgccggccaatcccatcacccgccggatagggatcgacccgttcgttgattggcgcgcgcctgcgatcgatcgattgggattgcagggttagggcggccgccgtccgagatagatcgatccatccatcgatcgattgggttttgttggtggttcggagatattcattcgggtccatgggccggctgctgctgggtgagcctcccggcgacgggcgccgtcatctaccgctgcaagcactgcgacacccacctcgcctaacgacaccgacatcatcgcaaggacgtcccgctgcaaagaacggcaaggcctactcctcaaccagattnctgaatgtgaatgttggtacgaaggaggaggaccggatgatgacaacgggcctgcacaccgtggtgcgacatcttcggctcccctgnggacnaacccggnggaaanactcgtcncttcnaaanancagggtaaaggaagnanntaacccgaaggcaacncttggaacccnccnggatccgtgtnacanaaaanaaaactcgtaaaanc

SEQ ID NO: 21969 - DNA, 735 bp, Triticum aestivum
  unsure (1)..(735): unsure at all n locations
  Clone ID: PAT_TA_21969
ccgacgactccttgaactgcgcgggcaagaggcggcggaggaggaagaggagcggtggtccttcttggcgctgctctttgagctactgcggaagtcgttgctcgggtgcaggaccgtgggcggcggcgaaggcgaacacggcggctgcgggatggagattgggttgcccacggacgtgcagcacgtggcgcacgtcacgttcgataggttccacggattcctaggcctgcccgttgaattcgagcccgaagtgccccgccgtgctcccagtgccagtgcaagtgtcttcggtgtttcaacagaatcaatgcagtgttcctatgattccccgaggaaacagtgtcccaaccatccttttgatgatgcaagagacgcctttatgaacagggtgggtcttcaaggcagaaggtatcttcccgtataaatgcaagaaaataccaagaagatttggtgagagaccaactaaatagtggattgtcccaagatggcatttgatgtccactggtttggcaggcctaatttnaacctgggtttaanagaatgccnnagggtgtactgggccctacccaacctgaacaaggtgatgcatgccancctgnaagagactgtctcncngaaccgaatgctccaacaactgaanactttgctntacnggggctgtgncctgatggccgagttaccaagaagacacattncaaagatgacgatncaatatgcatgggctccacaaatatg

SEQ ID NO: 21970 - DNA, 675 bp, Triticum aestivum
  unsure (1)..(675): unsure at all n locations
  Clone ID: PAT_TA_21970
gcacatctctgtctcgctaatcgccttcataaacccctgccgcagccgcgctcgccgcccagaccaaccaaacacacacaactgtagccgtcgtcgtcgttggcgtgcgtgttgctctgctttcggagcccgtgcgcgagcggaaccaaagtaccagaccatggagggcctgctgccgttcctgtaccgggccatcctccacctccgccagcggcgggcagtccgcccatccggcaaccccttcttccgcgacgactccgccgccggagtccgccgctgggcggcgcactactacgtccgccccgccgccggcgccgacgtgcccggcttcctctcctccgncggcgcgcggttactacgaccgcgggttgagagcccgcccggaccaggaacgaccctggcctgggcgtgcgagcaggaatcccccctgtgcccttcaattgctgtttcagatgtgggtctcctccctctcttccgggtggggcctggaatctcctcccctccccctcctttctccttgggataaagnatgatggatgaagccaaccaccaagggnccgtcgttcttcaaatgganataggcatatanactgataatcgggtgtgcaaatgtantctaganaggggatatatacgattaattnatatacnccaaaaatattcaaaaaaaaaaaa

SEQ ID NO: 21971 - DNA, 445 bp, Triticum aestivum
  Clone ID: PAT_TA_21971
agatcttcacgccaatgtacttctttcttgttcggaagcctcttctggaatgagctcttggatcaccttttcagagagagaaggcaagtggtcatttcgaagaagccgaggagagggaacctggaatcaagaaaaccttcagctctcctgtgtaggaggaaagttaacgaacagtgtagtaactgttcagctttgtgtttattcaagttgttttgctgcttggaggttattccgtttctaaggtgggggttgggaatccttttccgccataaaccctctcaagtgggcataaataagatggtttgcataaagagtacttcatgggataccgttaagggctactactgaaagagaaatgtttaagcagcatggtatgttgagcaactaagtggataatatccatccttttttttaaatataaagcaggatttttgtcaaaaaaaaa

SEQ ID NO: 21972 - DNA, 538 bp, Triticum aestivum
  unsure (1)..(538): unsure at all n locations
  Clone ID: PAT_TA_21972
ctcagctcctcctcctgcttcctctgaggacgcccctcccgcctcggtcgcctcggcgccgcgccgctgctgcggcgcgcccctagcatccggtcaagcgtgtgtttgcggtcgtcgggttcaagattggcttttgttgcgttcttggcgagacgaagggactagggcgcagtgagcggacaagaatcagcatgcatccgagcgcggtcagtttcgactccgggcggcgcgcggcggcgcggcggcgcgcagatgctgctcttccggcggcggaggcagcgccaacagcaacggcttcttccgaggtgttcccgatggcggtcctggcgcatggacgacgcgacgcgcgtggggcaagcggcccttcttcaacgacacacgaggagctcctgagaggaggagtactacgacgagcaagcgccggagaagaagcgccgtctgacggcggagcaagtgcaactgctggagcggagcttcaagaaaagaacagctgganctgagcgcaagacgaactggtcncncctggggatgngccccc

SEQ ID NO: 21973 - DNA, 584 bp, Triticum aestivum
  unsure (1)..(584): unsure at all n locations
  Clone ID: PAT_TA_21973
cgcaaacacgcacgcacactctggacgcgcgctggctggctgcaactgcaaggcgtcgccaccaaccgcagctataataggtgtattgaacaggcaggcagagcagggcaggcagtgtaggctccatcagatccaacgccaccagctagcagcagcagcagcagcatggccaccaccagcacgcctcgcctcgccaccctcctggtgctcctggcggcggcgtcaccgctgctgagcgcagctcaaaaggccgccccganaggctccggcgggcggcgaaggctggcgccagggccggcggcgtcgtcggtcgtccggcgcgggcgcggcggacgcggcccctcccacagacgtgaacaaggcgctcaaggacgaccagttcagcgagtccaagcaagctgctgcacgccacgcgcgtggacacgcaggtcaacgcgcagctgacggacagctacaacgggctgacatcatggcgccacaacgccgccttcacaagatgaaggcgggtgctcaacgggctgtcccgcaggacagttaactctctcnatgctgctcccgcttcanaccttcatctcggacctcaa

SEQ ID NO: 21974 - DNA, 672 bp, Triticum aestivum
  Clone ID: PAT_TA_21974
gagcaacactggaggagatatcagaatcatcaattattgttcatcttgcagatatcagccatccattagctcaacaacagataggtgctgttgacaaagtactgaaagagctggatatagactcggttccgaagttggttgtgtggaataagattgacaataccgataacccattgagagtgaaggaggaagccgagaaacaagggataatctgcatatccgccatgaatggtgatggtttggaagagttctgcaatgcaatccaagcaaagttgaaagactcactgggtgcccatagaagcttttgttcccgtaatgacaaaggagatctgttaaatgacatacataaggttggaatggtttgagaaaacggagtacatggaaaatggcacgtttgataaaagcacatgtgcctctacctccttgcaaggcttctcacgccgttgccgcagcaggtggctgctcctctatgatcatcccttttccagctcgagtccatcatcggccgcccgtggttttgtggctggccgcgccatgttcagtgggagggtggcgggtccacgtggcttgttcgctcgcgtctcctctccctccgcctggacctctttttcacactaaaaactttacaaaatacgaaatatggcatataactttgttcctgtgttcaaaaaa

SEQ ID NO: 21975 - DNA, 650 bp, Triticum aestivum
  unsure (1)..(650): unsure at all n locations
  Clone ID: PAT_TA_21975
gagcaacctgcaggccagttccaccaagctaaggaggtgagaatctctgtaaaacgctaaagaagaaaaaaaaatgaaaggatccagcgagcctggcgagacctcgaagcaggcgcccctgggcagcagcaggggtgtcagcaaaggagtgtccgtgctcgatctaatacttccgcttcattgccatcatccggcaccctccgctagcgccattgcaatggggcaccaccaacgagacgctgctttcttcacgcattcatccggttcaaaggcgcaatacagcgatttccctactctcacttcttccgtcctggcgattccattgtctgcgcttatctcaccctgtcgctccccactatctatagtgcacatcatttagagcaaggcctaatacagcagntgctcttggtccttcctttacgccggaatgctacactgggtgactgcgggacatctgccggaacggcattgtgtctttacgcacaaaggaactcaagacaaanggctgcattgcaacaattgacccttctgcaacgtacncggttccctntggtcttcgancatggcatccctacgctgcaaaaccccgcattctcacagcctaggcgtgctnttcgtantgccccgacctggtaccacttgcattcctc

SEQ ID NO: 21976 - DNA, 939 bp, Triticum aestivum
  unsure (1)..(939): unsure at all n locations
  Clone ID: PAT_TA_21976
ctgtgatgttcttgtcccctgcgccttaggtggagttcttaacaaggataatgcaccagacgtgaaggccaaatttataatcgaagctgctaaccatccaactgatccagaggcagatgagattctcgccaagaaaggagtagtagtattacctgatatctatgccaattcaggtggcgtggtcgttagctactttgaatgggttcagaacattcaaggtttcatgtgggccgaggaaaaagtaaacgatgaactagaaaagtacatgagcagtgcttttcaacacatgaaggccatgtgcaagtctctggattgcgaccttaggatgggggccttcaccttaggagttaacagggttgctcgtgccaccctcttgagaggctgggaggcatgagaccattgaccgcgcattacagattcgacaggtgcattcaataattccgtgtccaacaacgttgggagcattagtgtctgatacgggaaaatcatcaagaaacgaccggcttgggaatgacccgtttgaaataacatctgggtgtttgtgcttggtgatcctggagttaaccaatggtggtcaccattcttgggtgatgattaagtgaaaatttaattaaaccgttttaattgtatttaagaaacttattttngccccnacagattactgtactttttcatttttaaatgaattcctggcctggggtttgaattcccaagatgttaatgatttntcaaaaatncanaaggtttccaaataaacattttcaccacacattttaaagcaannnaaaaaaaaaccaagggggggcccgtaccaatcccctanatgatctataccnnccatgcctcgttaaactctnacngaaaaccgngtnccaattanccctgaaaaancccnttccagtggtaaacaangcccccnttcctcaaatgcactaagga

SEQ ID NO: 21977 - DNA, 2673 bp, Triticum aestivum
  Clone ID: PAT_TA_21977
acgaccgcgaggaacggcgccgcgaccaccaaccaagcccgtatccgccgccgccgtcggcgtggccagcgcacccacagcgaccggcccccctttccctttctccacgaggtgcatttatacgctcccacagcttcctcacacttcctgtaactctcgctctcagctgactcccgtcaatctcgatttgccagccctccgcgacgccggcgagcccgactgcaccccgtagcggacatgggatcgacggcgctcggtggtgcggctccggcgcgcgccggattggcccccaagaatggagtccttggatctactttcaagccatgcggtgtggtcaagctcaaaacaactcctaaggttggacgctcttcagtctgtgtgagggcatccattgcttcttcaccacaaaaacagtactctcccaagacaccagcagttcaatcaggggaggaagtacgcattgcagtgctaggagccagcggttatactggggctgagattgtgcggcttctagcaaaccaccctcagttccgcatcacagtgatgaccgcagataggaaagccggtgaacagtttggatctgtatttcctcacttgataacacaggacctgccaaatttagttgcaattaaagatgcagatttttcagatgttgatgctgttttttgttgcttgccgcatggaacaacacaggaaattattaaaggtttaccccgccccatccccacggggccgaacccaaagttactatcagcttcactccaaatcttatctgcatgaaacgtgggatgcaatctactatgtttgttgaaatggcacctggagtgactgtcagtgatttgtatcagcatctcaagtctacttatgagggtgaagaatttgtcaagctgttaaatggcagcaatgttcctcacacacgccatgttgttggatcaaattactgcttcatgaatgtcttcgaggacagaattcctggaagggccatcatcatctctgtcatagacaatcttgtgaagggagcatctggccaggccgtgcagaacctcaatctgatgatgggactgcctgagaacatggggctgcaatatcagcccctatttccttgatatgttgtgcctttgttgtgctctttttcgatgatgctttggagttaagcacccatctctgttttccgttgagaagcaaagagctgaatgtcggagtgtaaccaaactcgctcaacagcaaaacttggtttgtgctggtgtagtatttagagatgagcaacaattagcagttgaataagagtatgaactgagtggcttggtgtaatgaaagtccgaaggctattatatcctacagtggatttttgtcatgagatcaataaagcagtgtaaaacctgattcagagacatcaaccattgctgtcagcatcggattttagtcagtagtgtgtgactcttgattcttaacggatctacggcgtgacatcaatgagtatgctgagtggtatggccatgctcatagggcaccagaacttcaggaagaggctgtttatggtttgacggaggttcttcgagatgaaataagaaatgcacggcttgttgccaacccgggatgttatcccacgtctattcagctccctcttgttcctctaataaaggcaaaactgatcaagctgagcaatataataattgatgcaaaatctggggttaccggggcaggacgtggagctaaggaagcaaatctgtacaccgagatagctgaaggcattcatgcttacggaataaaaggccaccgtcatgttcctgaggttgaacagggattgtcagaggctgctgaatccaaagttactatcagcttcactccaaatcttatctgcatgaaacgtgggatgcaatctactatgtttgttgaaatggcacctggagtgactgtcagtgatttgtatcagcatctcaagtctacttatgagggtgaagaatttgtcaagctgttaaatggcagcaatgttcctcacacacgccatgttgttggatcaaattactgcttcatgaatgtcttcgaggacagaattcctggaagggcaatcatcatctctgtcatagacaatcttgtaaagggagcatctggccaggccgtgcagaacctcaatctgatgatgggactgcctgagaacatggggctgcaatatcagcccctatttccttgatatgttgtgcctttgttgtgctctttctcgatgatgctttggagttaagcacccatctctgttttccgttgagaagcaaagagctgaatgtcggagtgtaaccaaactcgctcaacagcaaaacttggtttgtgctggtgtagtatttagagaggagcaacaattagcagttgaataagagtatgaactgagtggcttggtgtaatgaaagtccaaaggctattatatcctacagtggattgttgtcatgagatcaataaagcagtgtaaaacccgattcagagacatcaaccattgctgtcagcattggataatagttagaagtgtgttacttttaaatattaaaggataaattagttttcaaaaaaaaagtaaaaaagggggggggggggcgtgaccagatcctaaactttaccacaataatgcaactaactggtcattgtgttttaaaaaaaaaaaaagtcgacgcggccgcgaattcg

SEQ ID NO: 21978 - DNA, 575 bp, Triticum aestivum
  unsure (1)..(575): unsure at all n locations
  Clone ID: PAT_TA_21978
cgccgaggaagcagcaagcagcaaggtcgacatgtcgtctccgccgccggtgaagctgatcggcttcttcggcagcccgtacgcgttccgcgcggaggcggcgctgtgcctgaaaggcgtgccgtacgagctgatcctggaaggacctgttccggcagcaagagcgagctcctgctccaccacaaccccgtgcacaagaaggtgcccgtgctcctccacggcgacggccgggccatctccgagtccctccgtcatcgccgagtacgtcgaacgaggccttcgaaccggcgccgctgctccccgccgacccctacgcgcgcgccgnccgccgctttctgggccgactcaatccagacaagtcaacaaccttcttcatggcattggggtggaggnaacgccaaacgcctggngttccnaggaaggaagcaaggactccttgcgctnctggaggggcanctcnaggaaagagttttccccggnganaagccggnactcnaacttgcccgtcgcctcggcctggccaactcatcaaggactaacgttggcctctaacaggatacaccaacttgcgtgan

SEQ ID NO: 21979 - DNA, 1358 bp, Triticum aestivum
  unsure (1)..(1358): unsure at all n locations
  Clone ID: PAT_TA_21979
tccctctgtttgggaagattgcattctttacntgccccgtanntnnagtnaatttgccccactagnnggacccccgggctttttgaatgcggcacaagacacaaccattaaatcttacgacgcgtcctcctcccactcctctcctcccacgcgtccgcatggccggccgcctcctcgccgcccctctcctcctccttgtgctcctccagctccccgtgccgtcccaggtgcacgcgtacccgctcgcggcggcacactctggtcggtgccgaaggccggaggagaggccgccgccgttcctccaggggctccggcgaacctgccgcaccgcgacggaggggcacccggccgaggaggttaatggggaggaacttatcagagagttgggtggaaaggagtacactgctgtcctcttctatgcatcatggtgccctttctctcatagaatgagaccaatcttcgacgatcttagctcaatgtatccacatattaagcacttggctgtagaacagtccaacgtgatgccaacagttttatcaagatatggtgtccgcagccttccttctatactaatagctcatgagtcatatgcattttggcctcttgttgccaaagatctcaactcactggtcaacttctactctgctgttactggacaagaaccagttgcatatcttggtccacggaagtggaacacaaccgaaagaagcacacagtatgtgaagctttggaatggttcagtcagcgaatcagtgaagagcgagccctacctagcattcagcatcctctttatttgcctaaggatattctcgttcttcttcccaaagttcttcgcctgcatcaaaggcttgtgggctcaatacttccggcacgccaactttggagtccttgccaaattgacgcagctgctcgaatgtgtgccccatgccgtggatgtaaggaagatgtggagcaaatggaggctcatgtttggagccataaacatgagagtctgggcatcatctcttgcttccgtgtctcttggtgggcaatcttctccccgagctgctagattggattgatgatttggattttaacgtcgggcgggagagcatgcgggctgtctgaattgcgctggatgtggaagctcttgtaactcacatgaacatgtagtggaacatcttgtttgtagcatgtaaatcttagggatactgttgagcctgtgtagacacactgtaacattaatcatgagcaccaattgtcatagtttttgagcaactgggcacacatcataagcccttgtactatttttcacatgtaatctgcaattgcagtatgttcatctgtcttgtactaataagtgaaagacatttcgacct

SEQ ID NO: 21980 - DNA, 577 bp, Triticum aestivum
  unsure (1)..(577): unsure at all n locations
  Clone ID: PAT_TA_21980
tttgggggattngtacgggcccccncctttgtcgattcgcagngtccanccaancnttgtaccnccaggnggaggttacagcttgccttcagtttagcgccgccgctgcaggtgcaaggctcgaccaccgatgctgcggctaacccgtcgcggccggctgggcgaccgcgcgagctgcgctgcggagcctgccgatgttgcggcgacccgtcgcatccggcgacggcgaccgcgcgagttgcgacgcggcggagggcatcccaatggcagtgctggaaccggcttccagttttgctacaaccggcgaggcgaatgcggcggccacggcgtgctgcatccggcggcgcaagatgctgggaccggctgcgaggaatgctacaaccatggcttggagatgctggaaccgagactcgccgtgttgcgatcggccgaccggcgacggtaattttgctggatagagccccattttttgctaccaccgtctggttgtctttgctgtaactaagtgcccagcttggagctacagtacaatataaagaccaccgtccatttttccctaaaaaaaaaaaaaaaaaaa

SEQ ID NO: 21981 - DNA, 665 bp, Triticum aestivum
  unsure (1)..(665): unsure at all n locations
  Clone ID: PAT_TA_21981
tcctactccagcagttccgctcctcgcccccccgccgccgccgccacgatgccggaagacgtgcagatgaacgactcggagccccagcctgcggccccagctcccgccgccgccgcggcgccggcgctctccactctacaccatctgaaggagatcgcgtccgtgatcgaggccggttctctgtccaaggaggtccgccggatctcccgcgccttccgcctcaccgtcgcgctccgctcgccgcctcgccgcgcgggaacgtctccgccttcctcgccttcgcgctacccggcgtcctccgaagcctaccggcgcctcaatcgccctgggtgcccaagggagatgataccgagatggacgttgatgctgtggctccagaactcaagattcaatcaaacatggtctcctgagattgaatatattgctacttgcttgactgattttcttaatgntcaagangaaatacatganggtaaagtattgnaagntgagattgtcgccgaagaatctaaacggggaangtgaggcttggatcccncggactttntacctaggggagagtnacaaanctnntgaaccggggantgtgtcnaangaggaanttgatntacacnggcagaacctgnatctccctcnattcncaataattgtgtaaggaaanntnt

SEQ ID NO: 21982 - DNA, 666 bp, Triticum aestivum
  unsure (1)..(666): unsure at all n locations
  Clone ID: PAT_TA_21982
ggntttgactgaggcctgnggnctgaggaatgctgaacagtcaatatttgtgggatgagttcacttaaggggtaaattgatccagtgtggantgtatntattggacccaaatgatcttccaactgcatctaatttgaatatgntgcacatatattatttaatatattgatattaccngacctactttgagttgaactaatttggttttaaaatttggaattcaatgttgaacntatttggtttaaaaaatttgaattcaaccttatggttttggagatcattgcatttgtaaatcatattttatatatatagggagcaaatctttgttgtgctttttgaaagtatatattaaaaatgatgcatatagaatttgtattccaatcgaaaatggatcccgcccgataaaatagaatacaaactggattcgaagtgagttggcaccgttaacatgcacacattttctgcaaaattatgaacgaagcagggaaactcgcactaaccgcccgaaacccaaatctacgagatggaaattactactgcctatccctgccacacaaagcctatctgctcgatttctataggtttcgataggggtaggcttgtaatttcactcaaacatgacataaccgcctctcacccagattcatacacggtgggcactaaaac

SEQ ID NO: 21983 - DNA, 584 bp, Triticum aestivum
  unsure (1)..(584): unsure at all n locations
  Clone ID: PAT_TA_21983
ggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggattccgcctcatcctcgcccaagtccttccgtgaagtccaccgtctccgcccacgacgtcctcaatcttctccaantcatactgccccgttactgcaaaagagcaaaggccgtgtttaaaggancttgatttaaagaaagaccatatgtttgtggaccttgatnccccgaggggtggctccagaattcaagatccttaacttnagatatttngaagctactgtcccncaattttttgtccaatggaacaactggtggtnctgacanacngtgaccccnacaaagntgaaactggcaactntnaaatcgggtcaaggcacttttattantcnaatcgtcaccgtccttggtcaaccgtacggtcanaatcaaatgtttgcccaaggtaactcaatcaaaactattaccgacaaatcaaaatcctgttatacaggatttggtannaaaaatn

SEQ ID NO: 21984 - DNA, 284 bp, Triticum aestivum
  unsure (1)..(284): unsure at all n locations
  Clone ID: PAT_TA_21984
ggaagtcctacgacgccgtggtcaccaagatgccccgcgtccccaccaggtactacaagccctcgtagattatattcttgtacagagggacgccttgcgtttctcttttgtcgttgcggcttgttcttggcagattgtgttaagcattgcaactgtaacttctgtgagattgtcttacggttcacatttcatgttatgcctgcctaataagccttcttttccccaaatacaaagcatgcatgtgcctaagtgaaaaaaangnaaaaaaactccaangggggggg

SEQ ID NO: 21985 - DNA, 558 bp, Triticum aestivum
  unsure (1)..(558): unsure at all n locations
  Clone ID: PAT_TA_21985
ccggtggggagtctcgcatgcgtggatggcaagtatatgtgtccggatatcttattcctctctgtaaaaaccaacgttgtacaaaccctaagcccctccggtgtctgtataaaagggagggttagagcagaggcaggatcataacattgctaggctagctatctagggttagccaaaccgatctcgtggtatatcaactattgtaacctctatatcctccgaatataatcgagcaggagtaaggttttacctccattaagagggccaaaacctaggtaaacattgtgtcccttctccattgttactattgatcctcaagacgcacaacttngggccccctacccgagatctgccggttttgacaccgatagcgtgctcaatgatttcaccctgccacctgctgggtgagcccaatggggcgccaacaccgctttggcaacggttcttctcaaggaaaaccctgacgaaggaaggaagaacaccaaaagacaattgctggcggccgctcggacagggaaaacaaacactncagtgaaggccntccaatttccctcgtaa

SEQ ID NO: 21986 - DNA, 397 bp, Triticum aestivum
  Clone ID: PAT_TA_21986
tgcggctttcgttcccccttcgtcgcccggcgccgtcgtggccggagtgatttctgggaatgtgatatttgggccgccgctcccaggaagtactgggcagagaagcagcagcaagatcaggcggcaaaagaaggccaaactgggtcgacttaacggaggaatcttcatgtttcgcttgagtcaatgtcgccatacttcccttgatcaatcgcagagaaacaattctgaaactaaatacagtgatgtgaagtgtacttgggtttattcgatagcctcgttttttgttagctttgcttgaattagctgccgtagctttggtactggaaggtatcatttgtaccatgtacagaatgaattcgaatccaatccatcattttggtcaaaaaaaaaaaaaaaa

SEQ ID NO: 21987 - DNA, 609 bp, Triticum aestivum
  Clone ID: PAT_TA_21987
attgcatttagactgtcccataaggaaaggcaacatcaagttcggtatggtcattagattacaaaagctaattagatgacattaggtacaacacttagcaggaacataagagagcaaaagcaaaactaatgcatgagattaatatgtcagatagaagagcctccgtttacaatagcaaaggagataaattagtggagatcccatccaaactactatagagacctcatcccgccccgtgatggtgttgaccattttccaataggggggaggagtcaagcaatgacatcacatccaaaaccaaagctgaaaggactactgagaatggagctaacatcacatcattggaatatatatccacggatagatcgaaactttaaacttcttcaaatactggtatagagttgcaagtactaatgatggtgctccataatgcagggaaatcataccaaacctactgctactttagcagtgataaacttaaggaccacttgattgattaagtgatcatcatccgaggaaactcacaagcacgttcagagcagcgagcgtcgccatcccttcacgcgtcttggatgttgatgcgatgtgaggcacgacgacgacattctt

SEQ ID NO: 21988 - DNA, 947 bp, Triticum aestivum
  Clone ID: PAT_TA_21988
tcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctggggtcgtccaaaaggtgtcaccccaaagtacagcttgaagcctcttgttccacgcttgtctgagctccttggagttgaagttgtgatggccaatgattgcattggtgaggaagttgagaagttggctgccgctttgccagaaggtgggagttcttctcctagagaatgttagattctacaaggaggaagagaagaacgagcccgagtttgctaagaagctagcatctgttgctgacctttatgtcaatgatgcttttggcacggcacacagagctcatgcttcaactgaaggagttaccaagtatttgaagcctgctgttgctggcttcctcatgcagaaggaacttgactatcttgttggagctgttgccaacccaaagaagccttttgccgccattgttggtggatccaaggtctcaactaagattggggtcatcgagtctctgctggcgaaggttgatatcctcatccttggtggtggtatgatctacacattttacaaggcacagggatattctgttggaaaatctcttgtggaagaagacaaacttgagcttgcaacttcccttattgagaaggcgaaagcaaagggggtttctcttttgcttcccactgatattgttgtagcagacaagtttgcagctgatgctgagagcaagattgttcctgccactgctat

SEQ ID NO: 21989 - DNA, 914 bp, Triticum aestivum
  unsure (1)..(914): unsure at all n locations
  Clone ID: PAT_TA_21989
ttatttgcaactggaacaatggtatctttccatggaccaaggccccacacatagntactaatatatgcaaggtagtcatctgaagtgatttcccagtatgactggtcntgtgtcttgtgttctcactgtgatatcatcaatcagaaagatcttcggagctcttgcttgatatatataatcattcattcattcagtactgctactccatgaggatgagggcattcatacatatatactggtaaggagctatatatgcatagcatcttagcaagtagtagtagtagtagcagtgattcatccatctctgcctctgcctctgcctaaagcttggaagatggcaggccgagttgcttggcgttaacgatgcttgggcaggcagggggcggcgccgccttctcgtcgaggaagggctccaccgcgttcgggttcccccacaccgggtaccccttgatcttaccaagcacgttcagagcagcgagcgtcgccatcccttcacgcgtccacttcgatgcagatgcgatgtgaggcacgacgacggcattcttcatctcagccagccctggcttcatgtaaggctcatcctcaaaaacatcgaggccaacacggaacatgggattcgccctcaggtgctccaccagtgcaacctcgtcgatcaccgggccacggctggcgttcaccaggcactgcctccttcttcatcatcgccagccgctcagggtttatcaggtggtacgtcgtcttgtccagcactgggtgcaggcttatcacatcggcctccctgagaacttcctccatgctggaggccctcttccatgtcacaggctgctcaccattggctttcaggaactggccatacgctgtgacgaatttctcgagccgtgtggactggtacagatcgaagtagatcaagttca

SEQ ID NO: 21990 - DNA, 916 bp, Triticum aestivum
  Clone ID: PAT_TA_21990
gaattcggcacgagctcaaaggtgtcgtccaagattggggttatcgaatccctgttggagaagtgtgatatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggcccgagcttagcaaaaagggtgtgacaactatcattggaggcggagactccgttgcggctgttgagaaggtgggagtggctgatgttatgagccacatctcaactggtggtggcgctagcttggagctgttggaaggaaaggagctgcctggagtcgttgcacttgatgaaggtgtcatgacgaggtcggtgaccgtatgaggctaagcttcattttgtcgcgtctcaattcctttcatgtaccgttctaaacctgccatgttgtcctccctcctttgctcgtcttcaaccactcgaaatgtaagagaccaatgttttatagagaaatactgggagctgtttgaataacaccccccagcaatttgtgctcacttgagttgccttttctcagctcacataattagcaccagcaaatgttttatttataaggcaaagatggaatgatgttggttgaggatgttaaaaaaaaaa

SEQ ID NO: 21991 - DNA, 1745 bp, Triticum aestivum
  Clone ID: PAT_TA_21991
gcacgaggctccaccctcccctccttcccgatcccagccccagtcccaatggcgtccaccgccgcgccgcccgccgccctcgtcgcccgccgcgccgcgtccgcctccgccgccgccgcgccgctccggcgcgcggggctcgcggccgggtgccagccggcgcgctcgctggcgttcgcggccggcgccgacccgcgcctcgcggtccacgtcgcgtcgcgctgccgggccgcgtccgccgcgcgcgggacccgcgccgtcgccaccatggccaagaagagcgtcggggacctcaccgccgccgacctcgagggcaagcgcgtgctcgtgcgggccgacctcaacgtgccgctcgacgacaaccagaacatcaccgacgacacccgcatccgcgccgccatccccaccatcaagtaccttctcagcaacggcgccaaggtcatcctcaccagccacttgggtcgtcctaagggtgttactcctaagtttagcttggctccccttgtgccacgattatccgagcttcttggcattgaggtgaaaaaagcagaagatgttatcggcccagaagttgaaaaattggtggctgacctggcaaatggtgctgttttgctcctggaaaacgtaagattttacaaggaagaggagaagaatgacccagagtttgcaaagaagcttgcttcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccattcgctgccattgtgggtggctcaaaggtgtcgtccaagattggggttatcgaatccctgttggagaagtgtgatatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggcgttacaactatcattggaggcggagactccgttgcggctgttgagaaggtgggagtggctgatgttatgagccacatctcaactggtggtggcgccagcttggagttgttggaaggaaaggagcttcctggagtcgttgcacttgatgaaggtgtcatgacgaggtcggtgtccgtatgaagctaagcttcattttgtcgcatcttaattcctttcatgtaccgttttaaacctgccatgttgtcctccctcttttgctcgtcttcaaccactcgaaatgtaagagaccaatgttttatagagaaatactgggaactgtttgaataacaccccccagcaatttgtgctcaaaaaaaaaaaaaaaaaaaaaaaaaaaaagggcggccctcgcgatctgaactggccggacgcgggaaggacgcggggtcgac

SEQ ID NO: 21992 - DNA, 1704 bp, Triticum aestivum
  unsure (1)..(1704): unsure at all n locations
  Clone ID: PAT_TA_21992
gggccagccccagccccaatggcgtccaccgccgcgccgcccgccgccctcgtcgcccgccgcgccgcgtccgcgtccgtcgccgcgccgctccggggcgcggggctcgcggccgggtgccagccggcgcgctcgctggcgttcgcggccggcgccgacccgcgcctcgcggtccacgtcgcgtcgcgctgccgggcggcgtccgccgcgcgcgggacacgcgccgtcgccaccatggccaagaagagcgtgggcgacctcaccgccgccgacctcgagggcaagcgcgtgctcgtgcgggccgacctcaacgtgccgctcgacgacaaccagaacatcaccgacgacacccgcatccgcgccgccatccccaccatcaagtacctcctcagcaacggcgccaaggtcatcctcaccagccacctgggtcgtcctaagggtgttactcctaagtttagcttggctccccttgtgccccgattatccgagcttcttggcattgaggtgaaaaaagcagaagatgttatcggcccagaagttgagaaattggtggctgacctggcaaatggtgctgttttgctcctggaaaacgtaagattttacaaggaagaggagaagaatgacccagagtttgcaaagaagcttgcgtcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccatttgctgccattgtgggtggctcaaaggtgtcatccaagattggggttatcgaatccctgttggagaagtgtgacatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgccagcttggagttgttggaaggaaaggagcttcctggagtcgttgcacttgatgaaggtgtcatgacgaggtcggtgaccgtatgaggctaagcttcatttgttgcatcttaattcctttcatgtaccgttccaaacctgccatgttgtcctccctcttttgctcgtcttcgaccactcgaaatgtaagagaccaatgttttatagagaaatactgggaactgtttgaataacacccccagcaatttgtgctcaaaaaaaaaaaaaaaaaaactcgagggggggcccggtacccaattcgccctataagtgagtcgtantacgccgcgc

SEQ ID NO: 21993 - DNA, 1892 bp, Triticum aestivum
  unsure (1)..(1892): unsure at all n locations
  Clone ID: PAT_TA_21993
ccacgcgtccgcccacgcgtccgaaaccagagccaagcccatcgccactccaatccagcgaccacctcgcccagatcgccgccgattcgatccggttcctcgacgggatggcgaccaagaggagcgtgggcaccctcggggaggcggatctcaaggggaagaaggtgttcgtgcgcgccgacctcaacgtgccgctcgacgacgcccagaagatcaccgacgacacccgcatccgcgcctccatccccaccatcaagtacctcctcgagaagggcgccaaggtcatcctggccagccatctgggccgcccaaaaggtgtcacccccaagttcagcttgaagcctcttgttgcacgcttgtctgagctccttggacttgaagttgtgatggcccctgactgcatcggtgaagaagttgagaaattggctgctgctttgccagatggtggtgttctactcctagagaatgttagattctacaaggaggaagagaagaacgatcctgagtttgctaagaagcttgcgtcagttgctgacctttatgtaaatgacgctttcggcactgcacatagggctcatgcttcaactgagggtgtaaccaagtttttgaggccttctgttgctggcttcctcatgcagaaggaacttgactatcttgtcggagctgttgccaacccaaagaagccatttgctgccattgttggtggatcaaaggtctcatctaagattggtgtgatcgagtctctgctggccaaggttgatatcctcatccttggtggtggtatgatcttcacattctacaaggcccagggattagctgttggaaagtctcttgtggaggaagacaaacttgaactggcaacttcactgattgaaacggcaaagtccaagggtgttaagctcttgcttccgactgatgtcgttgtggctgacaagtttgcagcagatgccgaaagcaagattgttcctgccactgctatccctgatggttggatgggtctggatgttggcccagattccatcaagacttttgcagaagccttggacaccaccaagactgttatctggaacggtcctatgggagtctttgagtttgagaagtttgccgcaggcactgatgcgatcgcgaagcagttggctgagcttactgggaagggtgtcacgaccatcattggtggaggtgactccgttgctgctgttgagaaggctgggctggccgacaagatgagccacatttccaccggcggtggcgcgagcttggagctgctggaaggcaagcccctccctggtgttcttgcccttgacgaggcgtaggttgattcggtttcacctatcagcttgctgcgtgccccttttgtttgggatctcatctcggtgtaacgctggaacgttatatgtcccaaggaaactttgagataggcttgtcgccaatttttgctagtagatgagtcgtgaataattatcaacttcctctgtgcgtgtgaagtgatgtggctggaatttaacgtacccctgtggatgtgtatggttttatgctcaaagtctttgtctccggtttccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannaaanannttaaaaaaaaaaaaaaataaaagggggggggnaagaaaaaaaaaaaagttttattaggggggggtgagagaaattatttttttttatgttgaaccaaaaaaaaattggggggcccgtgttttaccccctttggaggggaaaaccccgggcccccccccaaaaaatggccttgaaaaaaaaccccttttccccgggtggcttt

SEQ ID NO: 21994 - DNA, 1717 bp, Triticum aestivum
  Clone ID: PAT_TA_21994
aaaataaatgcataattgatcaaaaatctcttgcttgatatatatactcattcattcattcattcagtactgctactccatgaggatgagagcattcatacatatatactgggaaggagctatatatgcatagcatcttagcaagtagtagtagtagtagcagtgattcatccatctctgcctctgcctaaagcttggaagatggcaggccgagctgcttggcattaacgatgcttgggcaggcaggggggcggcgccgccttctcgtcgaggaagggctccaccgcgttcgggttcccccacaccgggtacccctttatcttaccaagcacgttaagagcagcgagtgtcgccatcccttcacgcgtccacttggatgcagatgcgatgtgaggcacgacaacggcattcttcatctcagccagccctggcttcatgtaaggctcatcctcaaaaacatcgaggccaacacggaacatgggattcgccctcaggtgctccaccagtgctacctcgtcgatcaccgggccacggctcgcgttcaccagcactgcctccttcttcatcatcgccagccgctcagggtttatcaggtggtacgtcgtcttgtccagcactgggtgcaggcttatcacatcggcctccctgagaacttcctccatgctggaggccctcttccatgtcacaggctgctcaccattggctttcaggaactggccataggctgtgacgaatttctcgagccgtgtggactggtacaggtcgaagtagatcaagttcatcttgaacccctcaatcatcatccttgcataagctgagccgatgcggccagctccgatcactccaacagtctgccccttgagcaagttcccaacaaacaagtgcgggagccatccgtcgtagagaccagccctcatgaattggtcggcctcaacgatcctccgggcagccgccaccgacagcgatgccgccagctccgccgtcgtctcagtaagaacaccaggcgtgttgccgatggcgatgccattcctgttggcagcatctacgtcgacgttgttgtaaccgacggccatgttgctgaaggctgtcccgccagcgcgcttgagcgcagagaagagcacttccccccagtcctctgttagctggccgatgacaccatggcagtgatcaccgatgagtgccagtatgtcgtcgacagagaggatggtcttcttctccgtgcatatctcgaggcggcagtcgttgtcagtgaggagcttgatccagcgggtgccgggcatggacttggtgctcaccacacggtacttgccgctggggttccacacctctatcgatatcggcttcgccatggctggagcaggggggagcagctgcaaggaggagaaacaagcgcgagcggagaagaggagatcaggatgcggctttccttgccccttgtcgccggcgccgtagtggctggagtgatttctgggaatgtgatatttggaccaccgctccagaagtactgggcagagaagcagcagcaagaacaggcggcaaaagaaggccaaaatgggtcgacttaacggagatatctttcatgtttcggtgagtcaatgtcgccatacttatctcgatacagacaaacaattcacaaacaaactaatacagtgatgtgaaaatgtacttgggttattcgatagccttggtttttttgatgcggtgtatctcccctttt

SEQ ID NO: 21995 - DNA, 1716 bp, Triticum aestivum
  Clone ID: PAT_TA_21995
tcggcacgaggcgccactccaatccagcgaccacctcgcccagatcgccgccgattcgatccggttcctcgacggtgagccctccccccccgcctctgatcacgatccgcggccgcctacctccctccctcgcgggccgacgtctgacctcctcctcgtggcgtctgttttgggtgcagcgatggcgaccaagaggagcgtgggcaccctcggggaggcggatctcaaggggaagaaggtgttcgtgcgcgccgacctcaacgtgccgctcgacgacgcccagaagatcaccgacgacacccgcatccgcgcatccatccccaccatcaagtacctcctcgagaagggtgccaaggtcatcctggccagccatctgggccgcccaaaaggtgtcacccccaagttcagcttgaagcctcttgttccacgcctgtctgagctccttggacttgaagttgtgatggcccctgactgcattggtgaagaagttgagaaattggctgctgctttgccagatggcggtgttctactcctggagaatgtgagattctacaaggaggaagagaagaatgatcctgagtttgctaagaagcttgcatcggttgctgacctttacgtaaatgatgctttcggcactgcacatagggctcatgcttcaaccgagggtgtaaccaagtttttgaggccttctgttgctggcttcctcatgcagaaggaacttgactatcttgtcggagctgttgccaacccaaagaagccatttgctgccattgttggtggatccaaggtctcatctaagattggtgtgatcgagtctctgctggccaaggttgatatcctcatccttggtggtggtatgatcttcacattctacaaggcccagggattacctgttgggaagtcccttgtggaggaagacaaacttgaactggcaacttcactgattgaaacggcaaagtccaagggtgttaagctcttgctaccgacagatgttgttgtggctgacaagtttgcagcagatgctgaaagcaagattgttcctgccactgctatccctgatggttggatgggtctggatgttggtccagattccatcaagactttcgcagaagccttggacaccaccaagactgttatctggaacggtcctatgggagtctttgagtttgagaagtttgccgcaggcactgatgcaatcgcgaagcagttggctgagcttactgggaagggtgtgacgaccatcatcggtggaggtgactctgttgctgctgttgagaaggctgggctggccgacaagatgagccacatttcgaccggcggtggcgcgagcttggagctgctggaaggcaagcccctcccaggtgttcttgcccttgacgaggcgtaggttgattcggtttcacctatcagcttgctgcgtgccctttgtttgggatctcatcttggtctaacgctggaacgttatatgtcccaaggaaactttgagataggcttgtcgccaatttttgctagtaaatgagtcgtgaataattatcaacttgctctgtgcgagtgaagtgatgtgactggaatttaacgtacccccgtggatgtgtatggttttaagatctgcatctttgtgtgctgcttccttctgtgttttttgctttgcttattttggaataaatttttgtcatataacgccatgattatcaagaatgttcaccatgatactcc

SEQ ID NO: 21996 - DNA, 1616 bp, Triticum aestivum
  Clone ID: PAT_TA_21996
cccacgcgtccgagcccatcgccactccaatccagcgaccgcctcgcccagatcgccgccgattcgatccggttcctcgacgggatggcgaccaagaggagcgtgggcaccctcggggaggcggatctcaaggggaagaaggtgttcgtgcgcgccgacctcaacgtgccgctcgacgacgcccagaagatcaccgacgacacccgcatccgcgcatccatccccaccatcaagtacctcctcgagaagggcgccaaggtcatcctggccagccatctgggccgcccaaaaggtgtcacccccaagttcagcttgaagcctcttgttccacgcttgtctgagctccttggacttgaagttgtgatggcccctgactgcatcggtgaagaagttgagaaattggctgctgctttgccagatggtggtgttctactcctagagaatgttagattctacaaggaggaagagaagaacgatcctgagtttgctaagaagcttgcatcagttgctgacctttatgtaaatgatgctttcggcactgcacatagggctcatgcttcaaccgagggtgtaaccaagtttttgatgccttctgttgctggcttcctcatgcagaaggaacttgactatcttgtcggagctgttgccaacccaaagaagccatttgctgccattgttggtggatccaaggtctcatctaagattggtgtgatcgagtctctgctggccaaggttgatatcctcatccttggtggtggtatgatcttcacattctacaaggcccagggattagctgttggaaagtctcttgtggaggaagacaaacttgaactggcaacttcactgatcgaaacggcaaagtccaagggtgttaagctcttgcttccgactgatgtcgttgtggctgacaagtttgcagcagatgccgaaagcaagattgttcctgccactgctatccctgatggttggatgggtctggatgttggcccagattccatcaagactttcgcagaagccctggacaccaccaagactgttatctggaacggtcctatgggagtctttgagtttgagaagtttgccgcaggcactgatgcaatcgcgaagcagttggctgagcttactgggaagggtgtcacgaccatcattggtggaggtgactccgttgctgctgttgagaaggctgggctggccgacaagatgagccacatttcgaccggcggtggcgcgagcttggagctgctggaaggcaagcccctcccaggtgttcttgcccttgacgaggcgtaggttgattcggtttcacctatcagcttgctgcgtgcccttttgtttgggatctcatctcggtgtaacgctgcaacgttatatgtcccaagtaaactttgagataggcttgtcgccaatttttgctattaggtgagtcgtgaataattatgaacttcctctgtgcgagtgaagtgaggtgactggaatttaacgtacccctgtggatgtgtatggttttaagctctgcgtctgtgtccggtttccttctgtgttgtttgctctgttttagtttgaaatgaaaccttgtcatgtacggccatgatttttacaagaatcatcatgatgat

SEQ ID NO: 21997 - DNA, 1644 bp, Triticum aestivum
  Clone ID: PAT_TA_21997
gccggagagctcaaacttgcccagcaggttgttgtcgcgggtcttggtcctctcaccctcataaacttggataaggacaccaggttggttgtcagagtaggtggagaagacctgctccttcttggtggggatggtggtgttccttggaatcaaaacggtcatgacacctccagcagtctccagaccaagagaaagaggtgtgacatcaagcagcaggaggtcctggaccttctcgttaccctctccactcaagatggcagcctggactgcagcaccataggcaacagcctcatcagggttgatgttcttgcacagctccttgccattgaagaagtcctgaagcagctgctgcaccctctgggatcctggtggagccaccaacaaggacaacatcatggacagtgctcttgtccatcttagcatccctcaggcacttctcaacaggctccatgcacttcctgaagaggtccatgttcaactcctcaaacctggcacgggtgatggtcgtgtagaagtcgatgccctcatacaacgagtcgatctcaatggtggtctgcgcagtggaggagagggtcctcttcgcccgctcacaagctgtcctcagcctacggagagccctgggattgccgctgatatccttcttgttcttcctcttaaactcctggacaaagtggttgaccatcctgttgtcaaagtcctcaccaccaagatgagtgtcaccagcagtggctttgacctcaaagatgccctcctcaatggtgagaagagagacatcaaaggtgccaccaccaagatcaaagatgaggacattcttctcaccaacactggaagccttcttgtcaagaccataagcaatggcagcagctgttggctcattgatgatacggaggacattgatgccagcaatgacaccagcatccttggtagcctgcctctgcgagtcattgaagtatgcaggtacagtgacaacagcattcttcacagtgctgccaaggaaagcttctgcaatctcacgcatcttgatgaggaccatagaggatatctcctcagctgcaaactgcttctcctcacccttgtactggacattaatcataggcttgtcaccaggtccagcaacaaccttgaagggccacagcttaatgtcactctggacagtagaatcagtgaacctacggccaatgagacgcttggcatcgaagacggtgttgatggggttcatggccacctggttcttggcggcgtcgccgatgaggcgctccgagtcggtgaaggcgacgtacgacggcgtggtgcggttgccctggtcattggcgatgatctcgaccctgtcgtgctgccacacgccgacgcacgagtacgtcgtgccgaggtcgatgccgatcgccggcccatcgcccttcgccgccatctctcgcgctccggagaacttgaagctctctagctagggttttcttccggaggaggagaagcggcggcgggttgaggaggagcctcgtgccgaattcggcacgagggagttccccaggctggttgtccgagtaggtggagaagacctgctccttcttggtggggatggtggtgttccttggaatcaaaactgtcatcacacccccctctttctctctctctctttctccctcgtgc

SEQ ID NO: 21998 - DNA, 607 bp, Triticum aestivum
  unsure (1)..(607): unsure at all n locations
  Clone ID: PAT_TA_21998
ctcacaccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctgatcgacgcggaggagctcacccagtggtcactgtaccgcgcggtcatcgccgagttcatcgccacgctgctcttcctctacatcaccgtggccaccgtgatcgggtacaagcaccagacggacgcgtcggcgtcgggccccgacgccgcgtgcggcggcgtcggcatcctccgcatcgcttgggccttcggcggcatgatcttcatcctcgtctactgcaacgccggcatctcaagtgggcacatcaaccgggcgtgaccttcggctgttcctggccaagaagtttcctcgtccgcgcgctgctctaatatcgcgcaaggcctgggcgcatctgcgctgggctcggcaagggctcaaaacgccgcttctacgctgcggcccccggcatcactaacgacgggacccaaggaacggctcccccgantatcgacttt

SEQ ID NO: 21999 - DNA, 566 bp, Triticum aestivum
  unsure (1)..(566): unsure at all n locations
  Clone ID: PAT_TA_21999
cgtgnttgcagcgcncttccggngttgtaccgggccacggcaccacgtgcaccgggctctcgctcgcgggggagacgcggctcgacagcgccgtcgcggcgcagctgctgcagcagcgggcggccgggttcgtgccgctcaccgtgcgggcccgcgtgcccatccgcatcaagttcggcgccgtcaggctgtggacgatgacgggcaaggcaaactgcaacctgggtgggtggacaatatcccaggcaggcacgcagcttgagcatccgctccattccctgcacttttaagcttaagttctagatgcgccttccttttgtccggccatgcatggttgttgcctccaatgactacggctacgggggtggtagtggtagaggtgtacagtacattcttttcggcacctgtatccatagcttaattgatggctgtaataaataacatccgatatgcatactattttgctatgagattatttattatataataaatattatttatataataaagcatgattttttaggccaaaaaaaaaaaaaaaaaaaactggagactagcggcacgag

SEQ ID NO: 22000 - DNA, 261 bp, Triticum aestivum
  Clone ID: PAT_TA_22000
cgcaactccaagatctgaacatggcctcgtgtttgcatatgccagtatgccaccgtgtcgagtaatcactcatattactgcttgcagggaggaactgtgtttgatttttattttccatgcgcaatgcttaatttaggtcaggaagtccaaagtctctcccattgttttcctgtaagagctaagcagtaccagatggagaaccttatatttgctggaacatgaataaaagcatttgacatgcttgtgtgtaaaaaaaaaaaa

SEQ ID NO: 22001 - DNA, 345 bp, Triticum aestivum
  Clone ID: PAT_TA_22001
cgcaggcagcagtcaagcggccaacctctgcttcacaccgtacctacctgcgagccacgcccacgccgcagcccccgatgtcgtcgcagcgcccgggccgccaccagcgccgcgcgtcgcagagcgtgttcgtgctcccagagaacctggcctccctcgacgtcgacgcggcggccgacgcgggcgccaaggccggcgggccagaaggcgccggcgccggcgccgagcagcaggcgaggccacccgcggggcgtcaccaccgccgcgccatgtccgtggccgcggccgtggcctccaaggagcttgagctgatcaaggaggacctcggcagtacaactacaggtc

SEQ ID NO: 22002 - DNA, 660 bp, Triticum aestivum
  unsure (1)..(660): unsure at all n locations
  Clone ID: PAT_TA_22002
ttttttttttttaataggacaactgctgtttttttcttttctttggtctagagctcaatcgcttttagaaaacagtgtactaatcaggtctgaaaacatggcataacgctctgaacttgagacgactaaccaaaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccaagcaaccgtccactgccaaattgctcctcaatgtgtgggtcaagggtactccctccttgcgcttctcaagctcctcgtgacatgggtgccctttcgttcctcaactgcgcctcaactcctgtccctcaacaatanccttccttgaacaagggtttcctctcctacaatgtcaactcatatgagtgaggtacacgcntgaatggggaacaacaacttgacaatggaanctcaaaagggttggtcccaaaaccatgnttgtgcatgtaacnctcagggaaaggcctgngtaaanttcntcccanntagttcattcaaggaaagccncaataattnnccaaaaggccc

SEQ ID NO: 22003 - DNA, 489 bp, Triticum aestivum
  unsure (1)..(489): unsure at all n locations
  Clone ID: PAT_TA_22003
cgcaagtagcccagctctgcgctcatcttccctgcaccaaacctcctctcgatcagaccatgaagctcggaggacgacaagggaggctcaacagagccttgagggagaaaagggctaggttctacattttccgccgctgcgtcgtcatgctgcttcgctggagcgactagaccgatctccatcactccatgggtgccgttttgngtagagtttaggcgtagttgctctcttgctgtgtacatacaggatgagcacaccgtgtggctgngttctactggcaatctctctctctctctctctctctctctctctctctctcttgttttcctgcttgcctgttgtttcagtaaaggcaagggtgattgatcgatccgctctgtggtctgaagatcgccgtacatgtactgcccgaagaagatcattcatatgaacagtcntttgttacggcgatgataataaactancaatatcatannnaaaaaaaaaaaa

SEQ ID NO: 22004 - DNA, 411 bp, Triticum aestivum
  Clone ID: PAT_TA_22004
tacaggttgtgttcgcgatcccgtcagcctttgctcgctgtccgcatcttgtgttcgtatcagtgagattctgttctagctccgtcgttttgtcacccgacgagatttccgtgtgttgattatgtgtatatgtgtatttgtgcgtgatgaggagaataatcctaggattatggggaaaggaaagctccagcgcatcagccatcaggtgttctgtgatttgggtgaatccgacggtcgtccgtcgttcttgctaataccaaaccgaactgtgatgttagtaagctgattttgatgagtgaattgggctagatgtattgggctcattgatccccgtcgatgcgctgtgtggtggtgtccagtttcctttggtggtatatatatgatgttcctgtgggcaaaaaaaaggggggg

SEQ ID NO: 22005 - DNA, 316 bp, Triticum aestivum
  Clone ID: PAT_TA_22005
ccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtccgaatacttaagttaactatgcgctgacagtctgggactagcagtgttatgtgcgctgctgggaccttgcgcgcaatgctgtggccgattttgttccgttaatgtcaagaattgtgttacagtgcgtgttaaaaaaaaaaa

SEQ ID NO: 22006 - DNA, 895 bp, Triticum aestivum
  unsure (1)..(895): unsure at all n locations
  Clone ID: PAT_TA_22006
gccttccttcgcacgcttgcgaatgagacatataaggtgtcggtcactggcgcgtgatcgacaggctgggctgataggttgggcaccgactgccaaaagcgtcggggtcactgtgtggctatcttgctcgggaagctttggcctggggtttggttatggtctggtgggttggtttacctaggtttattgacctggctaagatagggttagccaatggtcagcctggctctgataccaagtctgtggcgaccggttttccgggctattaattttccaagaaaagggcccttgtgctcaccagccccaggattactgttagctgatgaggcaccgacttgttacagaaattccaagcaaagtacaaaatatgtagtacaagaccattgtggcctatgagtacaacaattggtttctagtggttgatggcggaagcggtttgtggtccacccgcgtctatgggactccatttcccacaggaacagctgaccaggataactcctatcttcgcgaggctgctaccaccactgcgtaggtcccggggctgtcatcgcaacgctcctctccaagcaagcaatctggccaagacaatagccagggacaagccagggaccacttttgaacgttgtcgcaagcatcatccccacgggtttaatataacaagggataatcatgctctgaaatattctatgatcataacgtcagtcacgaaataaacaaaatccatgatgcacgcatgcangttgttcatataaaatataaatatgcaatacgggagtagaaataaaatgcaccgatcgagtgtctgaagcgacgcctcgaaaggataataaggataaatcatgcctcaatcgggcgtctgagcgacaccacataaagagcttataaaaaaaaaaaa

SEQ ID NO: 22007 - DNA, 363 bp, Triticum aestivum
  unsure (1)..(363): unsure at all n locations
  Clone ID: PAT_TA_22007
gttgaggagggggtatcttattttttaagccttaaaaaaactggccctatccatcaagaggaactactattatggaactagaagctaaccaaaggggtataactgcacaatagttttttagaatctttttacgtagtgcaagaatcttgcgtcttttcctcctcctatcctcatctactaccactagtaaaaggaagataaggcagatccaacttantaagctggaccgtctaatcacatcatcaatggtctaaatacgttcgtttaaatgaaatagcctcccttaacgaaacgctaaatcccccgctttcgttctcaacccgacaaatctccaacgancgctccgcccggcannccacgcgc

SEQ ID NO: 22008 - DNA, 603 bp, Triticum aestivum
  unsure (1)..(603): unsure at all n locations
  Clone ID: PAT_TA_22008
gttttttttttttttttttttttttttttangcaacagcgaacctaaccaactgaagaaaaacctctacaaatccacctacacccgcggggctttctcttcttctttgtttttggtgggtacacattcatcacccatgttttatttccgacaatcaaatcccaacgagcatagcaccgaccgaactgacacatcgcatgcataatgtgttcatccctctctaggagggcaacaccgttctacaactaaaaaacccaaaccaactacaaatccaccgacccagagttgtcagttgacccattattattcctccgcctgatcaacattacacacttgtttccttcattcatctgtccgttctcctttttaggcctcctcctcaagcagcatctgatcgaagtgccacaccccgtgccccttgcccactcctcctcanctgggcgacatacttggagatctgttaaggccctcctgctccccaagggggccggnccaattgccnanatgngtctataccgcgccacnggcgtctttaaacgccnacgggaaacctgngtccaactatcctgagaatcccttnncacngggtanananagcccccgt

SEQ ID NO: 22009 - DNA, 627 bp, Triticum aestivum
  unsure (1)..(627): unsure at all n locations
  Clone ID: PAT_TA_22009
gccttctctctgtttccagacttggtttttgccttgcattgaattggattttggaatcatttcaaatgcacttgtcacttgggcatacccttgactttcacccaagtgacccatctacttctcattcaactttatttctctgttaaatccccaaaataatcaaatgaatatttttcataaaagaaaaatattcattttcctctgtgaaactctatccagaaacttgtgctccaaagcaaccctcatttttattgctcccaaaaatctgagataaatccagaatattctttgggaccttgggcacaccttcccaagcaaaaatattgcatgactttttgcaatagttttgctatagaaaatagtttctcttctgggcccaaaattccagtttgtacaacaagtacatttttccttggatcatttggccctggatctttccggagcttaactaccctcctaagaaaactaaaccccaagagatcagcctaatggcatctagaagctagccaaactggcgacaaggttcgggcagaaactgcaactggtgcgtcaagctggcaaccnggnaatgtccaagtccnancaaaacgggtggcaaagntanaaggtttgaagntggncnccttn

SEQ ID NO: 22010 - DNA, 615 bp, Triticum aestivum
  unsure (1)..(615): unsure at all n locations
  Clone ID: PAT_TA_22010
cctcgatcccctcgcttctcttccgagagctgttttccagtcgttacacaacccagtcattcgctctaaagaaccaccatcacaaaaatgcgttacaccgagctcctcgccctggccatgggcaacttggccgctgcccagttcaccactggccgcttctccaacaccaccacagccatggagactggtactgccaccactggcaccgatgtcactgggtactgagacctccggtgccgctgccagcacatctgctggcggcattggcaaccctgacggcttcaacttcctcggatgcttctcttctgagaacggcttccctgggcttcactcaggcctactcctctgaggagaacgaccctgaccgttgtgcccaatgcttgcttggggctccagcttcttcggtctctaacgacaacagctgctaacggtggtaacgagcttgacctcaagaactctccttctgtcaacactgatcagtgtgacatcacttgccctggcaacgatgctaagaatgtggggncnccttctgcgacgctcatngccganagtcncttnaagtctctcccgtcaatccctcgtgtaaccggtanacganatgtataaacgattgtn

SEQ ID NO: 22011 - DNA, 632 bp, Triticum aestivum
  unsure (1)..(632): unsure at all n locations
  Clone ID: PAT_TA_22011
ccgtcgtgcgcttcgtctgcacccacaaaggcgacggcgacggcagggggaggagatgaagctgaagcagctggagggcctcttgggtggcctgacccagttctccgaccccaagctggagctggagcagtatgcgacgggccctcacatcgcgtcgcggatgctctacatggcagagaatagtttcaatgacataactggcaaagtggtagctgacttcggctgtggctgtggcactctggctgtggcgagtgctttactggatgctgaacatgttcttgggtattgatattgacccacagtcacttgaacttgctcaagaaaatgctgctgatctggagctgggacatcgatttaatttggtccgacataaagaacttaaatctgaaagcctccatgttgatactgttgtcatgaatcctccctttgggtacacgaaaggaatgggagcaaacatggagtccctccccnatggncttgcaagttgcttccaagctgtctattctcacacaagacttcactagagaacatatcaagaaggagccttgctggctnaatgcatcatgcggaggtcatccaactgcttanatctacgcggactacaantcacagaaaaanaatnaatncatcat

SEQ ID NO: 22012 - DNA, 249 bp, Triticum aestivum
  Clone ID: PAT_TA_22012
gttgaatttgagcacaactagtctggttttattttagcctcatttgtcttgagatgaacaaattcacatatatatttccagtgtgatgcgaggcacatgttaattcagttacacgtagtctttgatttatttgtactctgtttagcattcaggtatgtttgtttgtttgaaatatttaaaaatttgtgccaaggtgcccatataagtgcagattattcaagtaagtcaatagacaggaaaaaaaaaaaa

SEQ ID NO: 22013 - DNA, 949 bp, Triticum aestivum
  Clone ID: PAT_TA_22013
acccgaagacgaaagtagcccgcaatgggcattttttttcctgatgcttttgtcgtgaggcaagaaggacgaagccagagacaacagttgaacatagagagcgagaaggcgaaaacaaaagcggctcgggcccggcccgatcccggatcttcgccgccggcgacgccggttggagaggtgatgggggaggtgcgcggtgctctatagcagctagtaggtgtagttctagtttttccttagaggagtttggcctagtgccggagattggcgtcatgccgatgaggattttgctgccggcgcgcccgagccgcgttcggtggttcctggcgatactcttgttggtggtggcggttggctcgctgctgttggaaggaggtgcgctggaatcctcggaaataagctcgatgtcttccctggtatgcaggaatccccttcgcttgctctcgccgacggcagtcaccatggtggtggtcaagtcgacggggactggtatgaagacggctcttgcgaccggttccagagcaaatcatcgatggtgcttgagctttggcgctcccggcggacagccggcttgcagcgccgccgcgccaccgaatcctctggccaaagggcggccaaacctcttcctcctagccttgaagctatatgggaggcagtgctactctagctcgatgttcacggcttgctgcggtgaagaactcgtcggaccaagtggtgatgtccccggcgccggcgagtttggagtcgatcgggagtggcttggacctgattgcgttcctcttcagatctttggggtcctttctgcatatttcagggactgctttgtaattttcagtttgttgtgtgtcctgttgctctggcttgtactaccgtattgtaacatcaaataaagtttggggtccttttggaccctgcccttgttcaaaaaaaaaaaaaaaaaagataccgt

SEQ ID NO: 22014 - DNA, 580 bp, Triticum aestivum
  unsure (1)..(580): unsure at all n locations
  Clone ID: PAT_TA_22014
aaaagcaaccgtttcaagtttcctccctagtgcacccaggaaatcgccagcacctcccctgttccctctctgtctctggctctctctcctctccgcccctttttatcgcccgatctcacacattttggaaagaaggagagagagagggagagattagagggaagcgccctgcccaagcaaagagaaaccgcggcgcgagagagaagggaggaaagggcaagacgggcgagcaggatgagagagatcatcagcatccacatcggccaggccgggatccaaggtcggcaacgcctgctggggagctctactgcctcgagcacggcatcgagcccgatggcaacatgccaagtgatacctcggttggcgtcccacatgatgccttcacacgttcttcancgagacggttctggcaagcatgtgccganggcatcttcgtcgaccttgaaccactgtcattgatangttccactggctcntacgcaactcttcaaccagagnagtnactcgggaaggaagaccantaaaacttgccgtggcatanatgttggaagnnatgtcatnnagcctgacgtttngaact

SEQ ID NO: 22015 - DNA, 210 bp, Triticum aestivum
  Clone ID: PAT_TA_22015
ctttgctgcagtggagcttcatgtcggcgaacaatgcaaacgttgtacttctttcatgcgattgagtagttgatgttttacttctgttgccaccaacagttgaacgctgtacttgcagattgataagatctccgtgctttctagtttgcgttgttactgatgaatttagcaaacgttttattgggtgggtattatttgaaaaaaaaaaaa

SEQ ID NO: 22016 - DNA, 641 bp, Triticum aestivum
  unsure (1)..(641): unsure at all n locations
  Clone ID: PAT_TA_22016
catcactccactacccagtcagctactggcctacagctagccgcctcctctcctctcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctccgcggcagaagtacctgtacggggagttcagcatccaagatgangctgattccgggcaactccgcgggaaccgtgacctccttctactgtcgtccgggcgacggcccgggcacgacagattcncatggattcatgggcaacgccaacgggcaccctggtgctaacaacaacttttggccaacggcgccggaagaagacacattctactgtggttcaaccggcgccgattcaaactanacatatcggaccacagactatctcaagnggacactctcntgcgtgctaacgtaccggactgcgtccggcggaaccagtcgtgcccaacgtggccgattcgggcacn

SEQ ID NO: 22017 - DNA, 342 bp, Triticum aestivum
  unsure (1)..(342): unsure at all n locations
  Clone ID: PAT_TA_22017
gtggtgccgcgtcaggttatgatgatggcagctacaacggatcaacaccttaataatgttcatttgtttgtaccacacacagtcaagcaaccggcacgtactgatagggttttttctgtgcttgtgaaataatttggccttgctgggcgatgcagaagtttgttctactcatgtaagccacggccatttctctgcatacgccatgtttgggctatagttgtcggttagtagatgttcttttgctatcaaccggtgtcatttccatataaagaggctacagatcatctgaatcaaggttccccgattaaaaccctccaaaaaactcaacgtgnccnanaggga

SEQ ID NO: 22018 - DNA, 627 bp, Triticum aestivum
  unsure (1)..(627): unsure at all n locations
  Clone ID: PAT_TA_22018
tcccagcctctcttactctccgccgtcgccctgctcgcccgaagcagccgccggcaaaatggccccgaagagaggcggtagggcgccggtccccgccaagaagaaggcggtggtgacgaacccgctcttcgagaagaggccgaagcagtttgggatctggcggcgcccttccgcccaagaaaggacctccaccgcttcgtcaagtggcccaaggtcctgcgcatccagcgccagcgccgcatcctcaagcagcgcctcaaggtgccccccgcgctcaaccagttcacacgtacctcgacaagaacttngcaacaaacttgttcaagatgcttcttaagtaccgccccgaggacaaagctgccaagaaggagaggtcttgtagaaggccaagctgaaaacgaggggaaaactgttgagtcaaagaaacatttgttgtaagtacggcttaacatgtgacttactcatccagcaaacaaggccaactggtgtcatactcatgatgtgactcttaaactggcctgtggtcccggccttgcaggaaatgaggttcatacgcatgtaaaggaaaagacccttggttatcttaaaaaaatgnacgtcttgtnacactnaaacaggnaattngtt

SEQ ID NO: 22019 - DNA, 623 bp, Triticum aestivum
  unsure (1)..(623): unsure at all n locations
  Clone ID: PAT_TA_22019
gattcgcgcagctgcatcaccggcgacggcggcgatggcacggaggagaaagacggacgccccgccgcggctggacgaggcagatcgcacgctctactccaccttctgcggcgccgccaactccctctcccagctctacgcgcaaggccatggcccagcaagaagtcaacttccatgccggcgagcgccacgccttaagaaaagtctaccagtggttcttgaaggaaacacgatgaagaggctaggtcactgtggctgaaataatgtctcatatccagcatgagatagactatgttaggtacggatgcaatgtctcccccaagagtactcaacatcctccagtttgcaatccattcgcatttaattttcccaacttggactggttttgtatgggaatcaacactggttttgcncccnaaccaatgttcactgacaattccnaagatannattccccaaagccttacaacccatncgcaagactccaaaattcatacaaccaaggngctggnaatggaggccgatcanaacaaactacagggcaaataagaggcaatctncagcccacgcacttcttggttggttanacaatanttcacatatttntaatctttcacaaananc

SEQ ID NO: 22020 - DNA, 583 bp, Triticum aestivum
  unsure (1)..(583): unsure at all n locations
  Clone ID: PAT_TA_22020
tgaagatgtctacagcactggttgctttcgagcggccgcccgggcaggtacctctttcgatatacgttctgtcacttcctcttccatacatgcctggaggaacaagtttaagcacatcctttttggttggcgctgctgtcttggtgcttgggttgctcctatacaaccttcctcagaactcagctgatcaagtgaagacagagtgatctaaaccaaaatcactcacaaggatggcagcaagcttttgatgcaccttgatacaatacaagaccgtgcattttcaattgcggtcagcagcacatgtttgtacctcggccgcgaccacgctaacctggagagaatctttttccgggctgggaagtcctaataagtcccaacctataacactccccngtgccccantcctcctttaacgaccccaanaantacttcanccttcccggtcaaaanangcttgngaatatcnganccccggttcaagttgttgcaatcatacccttcccacttaaacaaagcatgacnactaatatggacggangggtattattnaagatcanaccacattantgtaaggtgttcactt

SEQ ID NO: 22021 - DNA, 573 bp, Triticum aestivum
  unsure (1)..(573): unsure at all n locations
  Clone ID: PAT_TA_22021
cgcggacgtgcctgggcaaggacctggcgtacttgcagatgaagtctatcgcttccgctgtgctactgcgccactcggtggagctcgtccctggacacaaggtggagcagaagatgtcgctcactctgttcatgaagaacggcctccgagtgcacgtcaagccgcgggacctcgccggctacgtcgtggcaccggaggaagccccgcagctgggggcctttgtgatctccgaccacaactgcagcagctgcataagcctgcatgtgcccgcgcacattggnacccgtttcttccgtgctgaattccttccatatgcctccgcctgtcaaatcatatcgttcctccgttccccctccttcattaaactgttagttgtgggggctcccgcatctggtgtgcggggtcctgggtgttgtgggcggtggaggcgttcggctggccgcggtgttcagtccagacggttcccggantaaggcctccttcttttatgtccccccctcctttccatcacttctcccaggagaacggattatcacagttagacaacgggaggtacgggtattcaaactattt

SEQ ID NO: 22022 - DNA, 479 bp, Triticum aestivum
  unsure (1)..(479): unsure at all n locations
  Clone ID: PAT_TA_22022
ggaaaatgctgagcgtgatgagcgtgccaagaagtcggtgagcatcaacgagttcctgaaacctgctgaaggagaaaggtactacggcggccgtggccgtggaaggggccgtggggatcgtggtgggttttaagaggcggatacggaggggggatacagtccgtggcccagctgctgctgctccatccattgaagatcaagctcagttcccaagccttgggtgggaaagttgaaagggcgcccagctgctgctgtcaaccgagcgttgtgttgtcctgctgttgtcatatttaattttggtccgacgttaaattcctgtgccacggttttaaacggaacaaataatggtgttgcatgtggctatctttaggtatgtgggacttgaccttgtataccggagttgttgtttatccaaaatttaaccccaatttttggtaggccaccttttaccttttggttggccctnaaanaaaaaaacc

SEQ ID NO: 22023 - DNA, 566 bp, Triticum aestivum
  unsure (1)..(566): unsure at all n locations
  Clone ID: PAT_TA_22023
gcctgaacctgcaggagctgtgcgtgagggcagccctggccgggctctgcttccatggctaccagaaggtgagagccacgtgacaactcacacggttctggcttcagtcagctccaaacaaacagaatgcatgatctgtaacactgtaactgacgatggtcctgggcaatgggtaatggcagctgtcctacatgatcctggcccgggtgtcgccccgttgacccactcccgtggccaactgcgtcaagcgtgtggtgggtcatcctctcctccctcctccttcctccccggacgcccatctcgcctgtcnaatgcactgggggactgggaccggcactggcaagagtttacctgtaccccagactccaagaaagcaaagccaaagattcatgaaagatgtttttcccttccctgttttgggtacaggttttgagatanangattagtcnatatagtatccacgagaaaatgtattgagatataggttgncaaaactnccacggcaatatacactgtacnacagntacagaactctttaataatacaggacaaactccggnctgaaa

SEQ ID NO: 22024 - DNA, 1004 bp, Triticum aestivum
  Clone ID: PAT_TA_22024
caggtcaaggcgactgagaatgctctggttgatgagcccgagatgcataagaatgccggttcccctcggacataggcagagaagctgaggggccagggtgcggagccgacatcatcgaaaataaagatttggctgaacaacagaaaagctaagcttgctcgtatcgcgaaagaaagaggagtgccatacgagggcgagggtgctgacaagtcatctacaccagctacttctcagttgggtgactcctcagagagtgccggcgaggagagctatctgccgccttcaagggtgctgaatgctctaggcttatccaactccaagggcagcagcaggctcgttaccccagactccagcgagccaagtacacaagacatgatgacgagccgcccgttcacaagatcattgtcattcgagcctggccgccccgttctgctgattgacaacgaagggaatgaaatcggcaggggcgagatcttccaggttgatggcagggcccaagggaagagcctggcagagagccacatctgcatcatcgacgtcaccgagctcaaggttgagaagtggagggaactcccccacccttccgaggcgtcgggaagaacattccaggaggcggagtcgaggcatggcggcgtgatgagggttgcctgggatgttgtcaggctcactccggtggcgacgtagggtggtttgttcccttttgtggtgtcgggaatgtagaaagaagctgacgtcggccccgtctggctgggcatcgagaaggtacaaacagcaagtagagagaagcttcctgtcaatctaggatctgaagccaggaatgaatggtggctcttattgtaactagtgtttggtgaaagccagcctccctccctgtcatctgtcaatgactctgtgtatccttccttatgttgcagcctcttcttagggtttactaattactgctatatccgtcgcaacgctggtatgttgccatgtgacatacaaacaaatgtatctttcgtttc

SEQ ID NO: 22025 - DNA, 610 bp, Triticum aestivum
  unsure (1)..(610): unsure at all n locations
  Clone ID: PAT_TA_22025
tgccagtagagctctcagaactcgggaaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcatcgtccaagtacatcgacgaggtctggtcctccggcgcgccggcttcctccccgtcgacgctcacgcccgcgccgtccagcggttctggggcgcagtacgtcgaacgacaaggtgaagcaaaaactaactaactactagtcctaatccgaccgagactccttaccataccatacgcataccatgcatgcaactgccttgggcgattcccatacggaaggaacggacnacggggcatggacaagcggcgggcactttccgcggcctgcaaccctaaagaaggttcgcgcaataacaagggaaacctactcggngggaaactcggtactgaaaccncgggtccattcgcnggtaagggggggaaaattc

SEQ ID NO: 22026 - DNA, 654 bp, Triticum aestivum
  unsure (1)..(654): unsure at all n locations
  Clone ID: PAT_TA_22026
gagccttccctcccaaacttgcacgctgcccccgcgctcgcctccgcccccgatccagatccagggtggaatagggaacggccatacaccatggcggatttctccaaggaatcttgcccttctgtgaagaacattttacttctggattctgaaggaaagcgtgttgctgtaaagtatttctcaagatgattgggctgactaatgcatcaaagttagcctacgaaaagctgtttttactaaaaactcctaaagacaaatgcacggacaagaagctgagataacattgtttggatggttatattgccgtttacaagttttgtacatgaccttcactttttttgtcaaccgctggagatgatgagaaatgactcaaccttacaagtgtacncaaggttttcccgatccggttggcctcctacccaggggtgatgtttaaaagccgccgcncttganaacttggttttgatactccccgctccatgaattgttatggggaacatcctggaacagtgcaacacaatgccggnaagggcaaccaagcgtgatggtcgggcccttccgagaaacattccagggccaccacagcacgctgccgnccgcgtcacgactcatttcactattattgatttttgggcccaantaggcttncctnan

SEQ ID NO: 22027 - DNA, 624 bp, Triticum aestivum
  unsure (1)..(624): unsure at all n locations
  Clone ID: PAT_TA_22027
tcagctcagctagcatatttgagtttctctcgtgctctagctactagcaacctcgacatcaatggcttctggtgccgccgccccggttaagatgtccactgcagtgactgcctgcatcctgctggcggtcctgctgcccatggcgcccaagctaagtaatgggtgacgtttgttccggccgttgtgggtaccctttgcgacacctttgctgatgggttctgcacgggcaacgccaacgaccccgcgttttgtccaccggcatgtgcaggagcaatgcaanccacgcttgtcacagggtgtaccgctggaatgcatcacactctgccgctacaagcngttccctccctttgcgctgctttgctgggtgatttgcttgcgcccccttcatataggtgtattctttgcgcaccccgccgcctctgcccccaggcccttccctccctccacgcatctttggctgcaaccctcttcctttccacngcgccttggctacctacaatcccgattacccgtnaaatgacctcggcttaggcatgcctttcgttccttatgagactcatcgtcgggcccgctggccttctgcacatgtcacaaatcatagcggcacccccccgctactatcan

SEQ ID NO: 22028 - DNA, 1127 bp, Triticum aestivum
  Clone ID: PAT_TA_22028
aaagaatgttgggtggggttgagagttgttcaacagaaatcagaaatatggtatatttgttctcaactggtgataaggttgcctcggagcatgaagcagctgaattaaaattgatgatgattgagatgggaccctctatgcttagcgctggtaatggaactctagaagtggaagaagagaaggaagaagttgcaggaatccattgtgagaaattagcaattattgttgggatttctaattctcctcacttcagaagcatacggataatcaaaactgcaaggatgtgtaaccattgtcacaccttcgctaagttagtttcggagaagtatgggcgtcagatactgatcaaggatccgaagtatttgcacaagtttgagaatggtaattgctcttgtgaagattattggtaaactcaacgggtataagtcagctgggcaaatgaggctgccaggtggctagactgaaatgttccagatataggaatacagccagctaactgtatgaacagggtggttcatcatatttttacatcacatacctcagcaagaggttgcattgtatttgaattttattgacgctgaatatggcctcaacattagtataaagttgacacttggcacttgggggttagcctttccaggaattctatctccggataaaacattattgctctggtatcattaaaacaaagccattcagatgatacatgctcccagcattagtgaattcattgtaaacgaattggtagcacagatcactgcaagtggcacaacatacaagattatgcttataattcaaccacgtattgaatgggtgcatgcctctatgcatatgattaatgggattcgtcgatgatctccagctcagaagcaatatgaccttgaataatgattggcctcactagagaagctttcattaagcaccagggcactgctgctgcaaatggaaacaacctacaaagttttttgccataccataaaccttactgatactgaattagtaaggtactgcagctattggctatatttgttggtctatcaaatatagaatctatacttggtgcttcccctcatttccccctcttttgatcacccaattcagctgaaattatttatgggtgtatcctg

SEQ ID NO: 22029 - DNA, 784 bp, Triticum aestivum
  Clone ID: PAT_TA_22029
cgagattgccgaaggaatgttatccgtgaattcaaggagctgaaggaactgaaacgcattcgaagggaacctcgctgcaccagttggttctgtgttgcggactatgcatttcaatgcgaggtatttgaggattccgtcatagttgattggcgccaatctatatcagagacagatgggtcttatcatcactttgaatgggctattgggacagatgaaggacaatcagatgtttttggctttgaaaatgttgggatgaagacccaagtccaaagaagtgggattgatcttgatcaatttgaagattatttcataactctgagagcctggaagctcgatggccgctatacggagatgtgtgtaaaagcacatgcactgaagggccaatcttgtgttcatcacaggctggtgctgggagatggctttgtgacaattacaaagggtgaaagtatcagaagtttgtttgagcatgctgaagaggctgaggaagaggatgaggatgatgccatggaaagggatgaaaatgatcttgacggtgatggctctcatccgcagaagcatgccaagagtcctgaattggcaagagaatttctcttggatgctgctgcagtgatattcaaagaacaggttgagaaggcttttagagaaggcgcagcccagcaaaatgcacaaagtgtctttgtgtctttggcactcaaacttctggaggagcgagtgcatgtagcatgcaaagaaatcattacattggaaaaacagaacaagcttctcgaggggggcccgtacccaa

SEQ ID NO: 22030 - DNA, 482 bp, Triticum aestivum
  unsure (1)..(482): unsure at all n locations
  Clone ID: PAT_TA_22030
agagttnntggttntntntgacccnccntacanttccngagtgaangagatttctttcccgaaangagctgnttctnacangggagggatcccatggagagacaaactggcctgatttcaggtggccaaaagtaggttccgcatggctttctccatcatcctcatcctcatcctcagagggagcttcctgagacggctggctcctcataggaagatccagtcggttcggcattttgagggtacagagaaacatggcattatgcttncctgggaacatggctggtatattgagctgtcatgtgatgtgatacaagagacaaaacttagggtgccaaacaagcgacgcggttatagatatgttgggcgagacctttttcgcgggtttctctncatttgttcatttggatgaaaccattttggtattgccttgatgctaagagaacaaaataaagttgatgccattgtatcctaaaaaaaaaaaa

SEQ ID NO: 22031 - DNA, 716 bp, Triticum aestivum
  unsure (1)..(716): unsure at all n locations
  Clone ID: PAT_TA_22031
ttttnnttttctttcttttaaagaaacaagagacgcagcttctttggcatgagcaattgatcggactgttaagcaggatgttcaaatgaggaggtgcgaaacatcaagggaactgttttattttaattattctctaaaggcatgagaaagatgtgtgccacagcagtacaatcatgacctaatagagcgactgatacaaagccttgtgtaaagtagacatagttttcacccgataaaacacaatacaatcagaagagcaggctggcccaagcagcaatgaatgcaaagccaccgatcggtgctggtgaagagaacttcctgtcttcaaggtaagccacagtgtagcacgttccagagaagagcacaattccagttgtcagaagccctccgaagatgttggggcgcttcgtcatgggagccccgagcagcgccgcggtgtggacgagatggtacagggaggcggtctgccaaatctctttgtatctagggttctgcgggcggaacatgtgcgctccgtaggtgcccagtccaagagcagcgaccccggagacggcggccaccttgtgccatagcatcgggtccgtcggcatcaccatcttcttctccctcttcgggtcgtcgtctccgttcgctcggttgcttctgcttgcgctttccttccctctccgctggtccgtgcccggttcgctcgccgttactaggggaatccttgtaaa

SEQ ID NO: 22032 - DNA, 623 bp, Triticum aestivum
  unsure (1)..(623): unsure at all n locations
  Clone ID: PAT_TA_22032
ctccaatctcgtcgcgccggtaaaagcccccacgcgcgcctcccgtccggctcctcccctctccgcgtcccggctccatgggcggcctgtcggtgatcgcgccccccgcgcgggacacggcgtcgccgcagcaccgccgcgcgcgccgggcgttcctcgtctccaactacctcatcctgggttgcgcgtccgggtgcggcttcctcacgctgtcgctccgcctgggtcccctccgtgggacggcttcctcctcatcctgctccacgcgctcaccgttggccgccgccgtggcgggtgccgcccgtcatccgcggcgcccgaccgccgcgcgggccgctgctacaccgcccacatgtnccgccaacgccgttcgtgtcaatcctgcaagggcgccgccgccgtgctcgccttctcccgcaactccggattcctcnncccggcgggtccggtctaacttcgcgaggaagaacgggcctcacctcccanggccgggggtcgggttccatctccgctccaatggtcccgctcgcgctcgcttcgtgtaaggaatagcctactcacaggaatcgggggancgnacgcgaaccaagtcgngcaagacggcggactgncctcagttaaga

SEQ ID NO: 22033 - DNA, 420 bp, Triticum aestivum
  unsure (1)..(420): unsure at all n locations
  Clone ID: PAT_TA_22033
acgccataaacaaccgcgtccaaacctggacgtcattaagaaccacacccatgtctggacgctattgccaacaacatccagttgtgtggttcggtcactgctctaattaaactgaattgagtcattttcaagttgatatatggagttgcatgagctgtaaaacctactcccttccgtcccataatataagaacgtttttgacactaagtgtaatgtcaaaaacgttcttatattatgggacggtggtagtagtttgttggcaatcattgctccgcctttgccctgcggtaagcaacgtccgccgatgttacaaaccaagccactactcccatcaaacacatggttttactgctccctccgtgttgagttcacccaagtatcaaggctganttacaaggaggggaaacactagagagttgg

SEQ ID NO: 22034 - DNA, 611 bp, Triticum aestivum
  unsure (1)..(611): unsure at all n locations
  Clone ID: PAT_TA_22034
gttcgaggtcaagtccggctcctgtggcaccgtcgtcaggaacgcggagctgaagatcgtcgacccagacaccagcgcgtcgctgggacggaaccagccaggcgagatatgcatccgcggcgaacaaatcatgaaaggttatctgaatgatccaagaggcgacaaagaacaccattgataaggacggatggctgcacaccggggacattggttatgtnggacgatgacgacgagatcttcatccgttgacaggctgaaggagataatccaatacaagggttccaagtacctccctgcggagcttgaacccttctcatcacacaatcctgaaatccaaggatcccgctgtttgtcctccaatgaaagatgaatcccccgcgaatccccgggggccttcaacccttcgcgacngatgatcctgaataattggagttcgtgctcagcgccttctttccaagggagncctgccccacgggcggtccgcaatccccccaccggntaagaggctaaaaccgnttcccggatccaacatgcacaccatcaaantgtactacttcncatccttnaacgncaaacagcggcccatcngaagnaggataaaanccacggcn

SEQ ID NO: 22035 - DNA, 733 bp, Triticum aestivum
  unsure (1)..(733): unsure at all n locations
  Clone ID: PAT_TA_22035
gccaaccaccgcgctccggctctccccaattctaagcgccccggggctcagggagacgagcagcctaaaaaccctagccccccgaatcggatcccaccgcccgccggagcgcggaaccccgcccccggccgccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaggtccgaaccggccccgacagcctcaagcttcttgaagatgcggaagccaaactggaggaggcacttcaaattgattccaacaagtccgatgcactctggtgcttggggaaatgctcaagactctcatggatcctcactccaagacaatgcaatagctaatgattccttccaaaagcaaccggattttccaagaaggctgttgatgtggaacctgcaaatgactgtacaggaatctctaaacttgtccgatgaaccgcctgcaccgcagttcgtagcccatggcccctggcgctccaaacggctcgctcnatcctccacctcggagcccaagnaaccaaggaagaanaaggcatgattctgggacaatttgtggaggtgtccttggccccggatntnccnggttggatggaaaacaacatccccccgancacaacagtaaaatgntaatacatgcaa

SEQ ID NO: 22036 - DNA, 628 bp, Triticum aestivum
  unsure (1)..(628): unsure at all n locations
  Clone ID: PAT_TA_22036
ctcttccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaaagacggacctccgcttcaagtccacgccgtgctgggcctccaagaggcggccaagggtactcgtcgggctgttcaaggacacaacctgtgcgccatccaagccaagggcgtcacatcatgccaaaggcatcaactcgccgccgcatcctggccaaaaggctaacttctctccgtgaacacggtatggttcggataattgatcggttgaattgtccaatgcgtcaaggctaactttgtgaaaaaatatgtgtaggttattaacaacactnatagtangtccttggttcataacaactttcatttaaactanacatgtgttntcaaaa

SEQ ID NO: 22037 - DNA, 651 bp, Triticum aestivum
  unsure (1)..(651): unsure at all n locations
  Clone ID: PAT_TA_22037
tcgagtttttttttttttttttttgtaactgttgacacatcttgctctcaacattgcacggcagaatgtccatccggcaaaataatgtaatattgtcgaattggtatggcctcaaatttcagccacacaaagataggacaatcataaaccgaacctcagctgcattaacatgacacgaaaaaaaacaagaaatacacgaccaaaacagagcaggcagcgcaaaggaccaattgggtttgcgcttaggccttccgccggaccaacttngcgcaacgaatccagctttggattggtgcaacggaccgtggagatccacactgttccgcaagcgaaagggaagaacagacgatttcctttgggacaaaatagtatcagggcccttgcatccattgcagatgacatcctcattgatgtaccccctcaagattgcttcaagtttttaggagcaatcttcccttggatcaccaacctttgctgccaacaagtgacccacttgttccaattcggcaagttaacacatccttgccacgcgccaagcacgttaaaaatcatnaattacaaaacgtctcttgtcctcctanaactnagtgcccanacgntcccgcaacacagnagatngggtgtccnaaaagttacacncgtcaancccct

SEQ ID NO: 22038 - DNA, 858 bp, Triticum aestivum
  unsure (1)..(858): unsure at all n locations
  Clone ID: PAT_TA_22038
cccgtacggtcggggaggtctccgacggcgaaggccgggaccgccaggagcggctgagctacaaggcgttctcgttgagcgggagtgggttcgcggcggacgttgccgcggcgcggaggagcggcagcgtctgcgcaccggagaccgggcgcggcaggaccgcttcgatggcagcggtagggaggccgccgccacagccgcatcacgggttctcgttgaagccggatcgtcggcggcggtgggaaggagccagcggcggagaaggcagcgatgccagcgtctggacgaggtgggcgaggatctgaagagggaactggagccgcgccgggagatgaaagctgccgaaagctacgccgcagatctcactcctggttgctgcagtgctgatttttcgattttggattggaataagaacagtgcaattcagtagcattggcgagctagaaatctggagctatgtacagtagtaccccgccgtggtggagccgcccaccgggttccggcgcggctgggccccgtccgtggcagcggtagggaggccgccgccagagctgcatcacgggttctcggtgaagccggatcgtcggggcggtgggaaggagccagcggcggagaacgcagcgatgccagcgccggacgaggtgggcgaggagttgaagagggcactggaggcgcgccggagatgaaagctgccaaagctacgcagcagagctcactcttggttgctgcagtgctgatttttggattttggattggaataagaacagagcaaattcagtagcattagcgagctagaaatctggagctatgtacagtagtagtctgccttcttttatatacttaaaactaannaaaaaa

SEQ ID NO: 22039 - DNA, 598 bp, Triticum aestivum
  unsure (1)..(598): unsure at all n locations
  Clone ID: PAT_TA_22039
gaaataagcaagcgccacatgattatactcgaacggctcaaataaacaataagttgtctcgcttggcctacatagtgaaaggcctaatgcgcaacgcggagcactgacgctcgaatatggccgggaaaacagggaaacagacatgttggggcacaccccttccggacgacgttgcgcagactagtcccaatggagggagcttggcccacgacctcctncgccaccgacaaccgttcatgtggggccccggggccggccacacggcccggctccagctccgcctccgcccacggcggccgccgggaccgccgcgctcgcgtcctcgccagacccggcccgttcctggccgccgtcggtggcgcccctgctggcgctcgaccttcgtggtgctcggcgttgtgcccttggttcccccggctgcccattcggtcgccaggtttccgttgtggttttggatgcccacccctgggccggcaaattggnaaaaaaatgatttnattagntaaattnnttccatnccaaaaaatggnacctcaaacaaaaacaancttgggtnanacaaaatttggttaggaatgttccaaattgnnaatttgaa

SEQ ID NO: 22040 - DNA, 585 bp, Triticum aestivum
  unsure (1)..(585): unsure at all n locations
  Clone ID: PAT_TA_22040
ggtggacggaggacatctccgacctggacatcgaggtcttccgctccgtcatctccaccgtgcgcgcgtcgcggctgctcccaccgccgctcatcggcgaggcgctgcacgtctacgcgtgcaagcacctcgtcgacccgctccacgttgccagcgacgcaggactgaccgccaacggcgtcctccaccaagccgccgcagagctcaagacgacggcgaggagaagctggtggccatgcagcgccgcgtgctcgagtccatcgtcaccatggtcccgggcgagccggggtccggtcaccggccgcttcctactaaggctgctgcgggtnggcaactacgttcagcgcgtcctcgtccacgcgcgcgcaactgatccggcaggccggccccaactcgacgaggcaaggcggcggacctgctcatcccgctgcatcggacccgcacgcgtacaacttcggacgnggagccttctncacanttctggccattcaaacggccccgcgaacaacaacgggtcggntacccncatggaaagtccaagatttcacaatactggggcanccntggccgaanttccntggaaat

SEQ ID NO: 22041 - DNA, 524 bp, Triticum aestivum
  unsure (1)..(524): unsure at all n locations
  Clone ID: PAT_TA_22041
ctcgtgccctcctgtgctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctccgtcgccacagagctggggaccaccaaggtggcggaggcgaggcactgcctgtcgcagagccaccggttcaagggcctgtgcatgagcagcaacaactgccccaacgtgccccaccaccgtgtcccgccccggcggcgaggggaaggcgccggccccctcgcgctgctgcttctgccagaagatccccgggttgtagcctcgccggtgccggcccaaccttgtcgtcggctcgcccccccagtccggcatcctaccggtcctcctcccgccctgctcccttccccgcccccctgctcttcgcccgggttcgttggttcctgtnctcncttct

SEQ ID NO: 22042 - DNA, 476 bp, Triticum aestivum
  unsure (1)..(476): unsure at all n locations
  Clone ID: PAT_TA_22042
catggccagggactgccccagcggtggcggcggtggcggagggaggttcggcggcggcggcgggggtggcggcgaccgctcctgctacaactgcggcgaggccggccacatcgcccgcgactgccccacgtgaggtgtgtccgcgtccgtccgtccagccagatcagatcggatcgctccaccacctgctggtctgatggcgccgcccccttctagatctcgcttaaaaaacacccccctctcgctgtgtgtcggagtaccgctttagttttgccgatccgggcacgagtgcccgctgcctctttcctctcatgcgtaagaggatcccgtccgccgttttcaaattccgtccggtccgtaagaagaaccccaaattaattaattttcaatggtgtgtgcttggccctgttcctcatcctccttaaggtttaaaganatatttggcctgtgttncccaagggaatccaatcttcttt

SEQ ID NO: 22043 - DNA, 2556 bp, Triticum aestivum
  Clone ID: PAT_TA_22043
gccggccggtttcggcggcctggtgttgacggggcgatgaagtggtcggaggcgctggatcggcagccaatatgtctgcaacgacggcaagacggcggagatcgggcacgaccggtgctaaaggaattggcatcgtcagttgataattaagtttgcctcgttatttaatctgctgggcatattgactcggtggctaagactgcagcggcctccactagcagcaggaccagccgggacgcgggcggggatggcgaacgcgtcgtccatctcgcgtagcctccggcgatccctcgcccctgacgacctccaccgcctcctcctccagcgctcgcgggcgttcgtgacggctgagtgccaccgccccgtcgtccttcacaagcgcggccccgacatcctccacgacccatggttcaaccggggaacggcgttctcgatgacggagagggaccggctcggcctccgcggcctgctcccgcccagtgtcgtttcctcgcagcagcagatcgaccgattcatgggtgaccttaaacggctggagcaaaatgcaagagatgggccatctgatacttaccaactggcgaaatggcgtattcttaacagactgcatgacagaaatgaaacgatgtactacaaggtcttaatagataatattgaggagtatgcacctattgtttacacaccgactgttggcgctgtttgccaaaattacagtggcttgtttagacggcctcggggaatgtattttagtgcagaggatcgtggtgaaatgatgtccatggtgtacaactggccagctgatcaggtcgacatgatagtggtgactgcattggttcttgtccattcattgatttggtattctgtagttcaactcttcaagtgtgtcttaaagggcgtcgttcttgccttcgagctgtctgtcacgccgtcgccatcacctattccctcgccacgcgggacacagagatgggtgaggacgccaataggaagcttcgttgccgtcgttctcgccatcgagccgccattgccatcacctagcccctcgccgcgcgggacgcagagatgggcgaggacaccggtactaacatgaccaacgaggaggtcgttattaagcttgtgagttgatgtgaccattctcttgcatttcagcatagttgtcaggatctttgacagaatctttgacataatagaattttactggagttcgaggctatattattgatgaggtatcctggagagctgcaagctgcctttcttgttttgattcatgttcctgttgttttctccttggtgagtgtattatgtgggtagtgtaaccatcatgatctgcgttgcaatagctggtcttcttggagctgtaagagcacaaggaaggccaatgatagacttcccaaacaaaagatgttgtcgcaggtgctggcagtgctgggattggtgttgtgaatgctgcaagcaggaccatggcaaggatgctgggaaacaacgaggttgcttttgagagtgctaggagccaattctggatagtcgatgctcatggtttaataacagaggaacgtgtagacatagacccagatgcacgtccttttgctaggagaaagagtgagctaactcatcaaggcctaaatgagggtgcaagcttgattgaagtggttaaaaaggtgaagcctgatgtcatacttggactatctgctgttggtggtttgttctcaaaggaggttttagaagcactaaaagattcgtcctcttccagaccagcaatttttgcgatgtcaaatcctactaagaatgctgaatgtacacctgaagaagccttctcaattattggtgagaaggtcgtattttccagtggaagcccatttgacgatgtggatcttggtgatggaaagatcggccactctaatcaagggaataacatgtatctctttcctggaataggacttggaaccctgttgtctggtgcacggattgtctctgatggaatgcttcaggcggcggcagagcgcttggcttcatacatgaaagaggaggaggttctccaagggataatttaccctccaacctccagaatacgtgacatcactaaggaggtggcggcagcagttgtgagggaagctgttgcagacgacctagctgagggataccgtgacatggatgcacgcgagcttgcaagactgagcgaggaagaaacagttgattatgtcaagaacaacatgtggaatccagtttatccaacagtagtgtacaagaaagactagaattctactcatgctgtaaaatacatgctcattcatcatgtgcaatttaccttaggctattctttcgatctttggaaatatagccacctccactacgagcattgagtctcacgattgttttaatgcgatcgatcacgtgatagaacacaagaccggtcccagtttttagttgtctaatgctgtcagaggtacactaggtagtgcgggataggctcgcagctccctgtctgtcacatttgaagttgatgaggtacttgcaataataactggaacttgcattccaaaataaacccccggtcccatt

SEQ ID NO: 22044 - DNA, 620 bp, Triticum aestivum
  unsure (1)..(620): unsure at all n locations
  Clone ID: PAT_TA_22044
gtggcaggcagcggtgtcgccggcaaaaaatttcgaaacgagaggtgtctgcctatcacttgcgaagaaatcgcgaggggaagcgtgacacctgacgagctgagcaggcaggcggtagtggccgagcgaaagcatcctcgatctcgtcgtatcgtagctgccgccgctcaagagcaatggagagagcggtgccagttcggaagccgcacaccaacacggccgaccttctctcctgggtccggccacgggccctgacgcatctgcctcgcccggccgcgtcctcccgccccagcctcaagccggccgcggggatttacccggcgatttccgccgccccggccaccgagcaaggagccgaggttctgagcaagagtgaaaggaattttgctcctggtcaaatttaaagaatggttggattgggatttttgcctaagaagatgaaatggngatgccaaggttcaaatcctgctaacaagattcctttaggatgttcaacaaactgtgacgggttacccagcttcatcctcgcgatggtccctcagaacactcatacnagggcaacacaaactatggacctgaaatcgatcnaacatanactttagcaacagggctatgatann

SEQ ID NO: 22045 - DNA, 660 bp, Triticum aestivum
  unsure (1)..(660): unsure at all n locations
  Clone ID: PAT_TA_22045
cgaccgctagctactccgatcggatcctgaccacgcccgcctaccaggccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccaagctgaacagcccgttacgccagcagcggcggcgggtacacggtgttccgcgcccaaccgacaaccccttcaacaacctccaagcccggcacgctcaactccctgacgcagcagcagcaagtggcgctggtgcaagggcactcctccccagttctacagcatggactccttccaaccgccagcaacccgtccgcacccaagcctccggccgcgacgggccctacacgctcaacataacgcaacggcaacaacaagccacgtccccgggcgccccgggcacatcaccagcgccaaaagcgttaacccngcgtcnancttcanaagngccctccctgacnttcgggaagggcccccngccnccgttcaaggaacaaaaaggg

SEQ ID NO: 22046 - DNA, 820 bp, Triticum aestivum
  unsure (1)..(820): unsure at all n locations
  Clone ID: PAT_TA_22046
gcgaccgaggcgaccgagccgccgatgccggagccaccgcccgcgccgccgaccacggtgaacgaggagtctgctgaggagctgcgggagcgggcgccgccgccggaatcatctccgctaatcacgcaggcacgtgagggggatggagagagggtggtggtcgtgccgccgccgccggcatcgcctccgctgatcaagccggcgcttgggggcgtggttccggctgccttctcgtcgtctccggcgctgccacggccgccaggctatgctgcctccgagtctgactcggatctggatcacgatccgttcgccaatccgtccgatgaagtgcgttggagaattcgtttcaagatgaccggaggatggagatctggcgggatggtttcgtgtagatgcatccgtgctcaagttggacgacggtgagggatgaagaacacgacattttggccgggcggtacctgaatgctggtgagatgattcaagcaggttattttcagagccacggcgttgatccgtacgtggtcgttactcactccgacggaggccatggagcgtttggttactggatctatccgctaggagatggtagctcggaatatcttcaatcagttggctagtttacctatcttctttttgccagccggttgtggcgtcctttatttggctagtttgtcttctagccctttttgactctgtgtgagctanttcttacttttcgtttggagactttgagaccttattggaacctatttatttgctttaataagatggccgtattgcatcgtctgatgcaaaaggccggagagtccctccctttttg

SEQ ID NO: 22047 - DNA, 2107 bp, Triticum aestivum
  Clone ID: PAT_TA_22047
gatggttggggttttagacatatgttatttctttagagcatatccagtgtttggaggctctcttgcctctaaactacccatggatctgcctcttaaccatagaggaaaactctgcagcgtgcagcctctagctttacaagacacagccgggcccacaattaaataaaatatgatgcattagttaatcaactcatcggtccctccagcacctaactggctgacagtggggacatcagaatatttcattcagcacaaagcattggaggccagtgcttagcatagaggcgtctccaagaatttttggcttagaggccgacgatagtgtatagaggcagtggtcataggcctagaggcagccttagaggcgccaaatactcacattggattgtcttcagttagtttcaggtaagataaccaaatgcgtgttcagctgtatgttacttacgatggttggtgttttagaccgtggttgccctcgagctacatcttgaaatactcctaggtcctaaccataatggtgaagagttacagtctgtagtggagttggtcaaatgggagtgatgcctagaaatgtgcatgagtgtgtaggaagttattggccctttggtttgtgcagtttcagacacaactcagattgccaatcggttttccagcaaattcttatggatacggtaatgtgctctcatctgctgttttgctaggccttttttattctctttcttaatgcagttatttgtaagataatttcagtaatgttgtaagaccatagagaacattatgtttcactatcactaagcatatcgtcaagatcaaattgtcagtgtttggttgctacaatcaactacgtttttttccatttggataaaacagcacctgcaaagcattgttcacattttctactccgaaggcactgatcattcctattcttggtatcttcagctaaggaatcttgtgtgggccacatccaagcatgatgtttacatggcacagaacaattcagtaatgcactggtcttctcttcttcaaagagggacagaagtgctccacgttgcaggccaagttgttccaaagcagaaggcgcatggagctcggacattgtccagagtccagatcagctcaatggccctaaaagacaatctcatggtagcgggcggtttccgcggtgaactgattttcaagtatgttgacaagcccggggtggcattctgtacgaatgctgctgataataaaaactccgtcactaatgctgtagatgtgtatgagtctactagcggcgctactagagtgacggcggccaacaatgactgcactgtcaaatttcttgatgctgagaggtgcagcctgcttagtcgctttactttcccgtggtcggtcaataacacatcggtgagtcctgatggcaagctcctcgcggtcctcggcgacagctccgactgcgtgatcaccgacgctcaatcgggcgaagagatagcgactctcaaagggcacctggactactcgttctcatcggcctggcaccccggcgggcacgtcctggcgacggggaaccaggacaagacgtgccggctgtgggacacgcgcaacctgtcggcgccgttcgcggtgctgggagggaggatcggtgcggtccggggcctccggttctcgtcggacgggcggttcctggcggcggcggaggcggcggacttcgtccacgtgtacgacgcgcgggccggctacggcgccgcgcaggagatcgggctgttcggggagatcgcgggcgtggcgttcagcccggacgcggacgcgctgttcgtcggggtcgcggaccgggcctacggcagcctgctcgagttcggccggcggggccggcacgcctacctggactcgtacctgtgactgagtggaacagtcatgtcggccgcgcgtcgagtagatgcctagatgtgtgtatagtgctccatatggcaagtggtggtttctgtttatatgcggagtggtacaagtgaaaagatgctacggtgcaactgggtacagatggtacatgatctggactgaccctgattcagaagtcagcaggtactacagaatttggttcgcgtgagaagagttaatcttttgatgaaaa

SEQ ID NO: 22048 - DNA, 1400 bp, Triticum aestivum
  unsure (1)..(1400): unsure at all n locations
  Clone ID: PAT_TA_22048
tcgacccacgcgtccgcccatttctcctcctctgctcccctcgccgttctccctcagcccggccagatcgaccaaccggcaagcgcttctcggagcgggagcagcagacggcgcgattgcccgttgtttagtcgacggccacctgcctccggtttgaatactccgcacggcggaccacgctggtgccagcccaagagcagcgcagcgcagggcagagccaggacgggcgtgtaaacacgcagacaggtgaggaggctctggtttcgtggtttgacgagagagggaaggcacaggacaaggaagagagagagagatggccgggggcttcgccggcgtcgaggccggcggcgggagggcggagcaatacgaggggaggatcacgccctacttcatcctcgcctgcatcgtcggctccttcggcggctccctcttcggctacgacctcggggtctccagtggcgtgacctccatggacgacttcttgatcaagttcttcccggacgtgtacgaccggaagcacgcgcacctgcacgagacggactactgcaagtacgacaaccaggtgctgaccctcttcacgtcgatccgcntcccgcgccgccggccgcgtgtccaccttcggggcctcctacgtgaccaagcgccacggccggcgcggcagcatcatggtgggcgccgtcagcttcttcctgggcggcgccgtgaacgccgcggccgtgaacgtggccatgctcatcgtcgggccgcgtcctcctcggcgtcggcatcggcttcggcaaccaggccgtgccgctctacctgtccgagatcgcgcccttcaagatccgcggcgccgtgaaccagctcttccagctcaccacctgcctcggcatcctcgtcgcccacgtcatcaactacttcaccgaccggatccacccgtgggggtggcgcctctcgctgggcctcgccgtgctccccgccaccgccatcttcgtcggcgcgctgttcctgccggagacgcccaacagcctggtggagcgcgggcggctggaggaggcccggcgcgtgctggagaaggtgcgcgggacgcacaaggtggacgccgagttcgaggacctcaaggtggcgagcgaggcggcgcgggcggtgcgcggcacgttccggaacctgctggccgtgcggaaccggccgcagctcatcatcggcgcgctgggcatcccggcgttccancagctgtcggggatgaactccatcctcttctactcnccggtcatcttccanaacctcgggttcggctcctcgggggggctctactccgtccatcaacanggggtccatnctngtngggggcgccgctngtgtccaanggtggtggtggaccggnttggggcggcgggttgtcctcaatggngggccggggg

SEQ ID NO: 22049 - DNA, 351 bp, Triticum aestivum
  Clone ID: PAT_TA_22049
tgaatgcaccccgtgctgggtgcaggaggtggacctgagggtgctcaagcgcctgagcagcggcctccggcactggggcgaggatgagctcgcggtggcgctcctccgccgcgccggtcccgaggctatgggcacagccgcggagatgatcttgggcagggagttgtgacgccgatgcgcgcgcgcgccgcgcggcgtatgctgttcgtcagcgatgatgcagtttttgtatataatcggttaaaatctggccatgtgtatgctcacgggtaatatttgaatgattttatctgtaaaactgttaagacgttttgatctctctaatactaaccttcatctaaaaaaaaaaaa

SEQ ID NO: 22050 - DNA, 517 bp, Triticum aestivum
  Clone ID: PAT_TA_22050
gagagaagaagttttcatcagaagaaaggaagaaaaagagaaagaataaagccgatgggcacacacatcatcatgagatcacagtatctatcggtacagggatccaccaatggatccatccgccaacgcaactcgatcacgcacggagcaagaaagatggcaccaccacaccaccatgtgttgttcctctcggatcggatcagaacatggcgccgacgacggcggcaccgaggacggcggcccacctggcgacgccggagagggacgcggcggcggacttctcggtgtcgtcgtcggcggtggcgtcgtcggcctcgggcgcctcggcgatcccggcggacttcttcttcttcttgggcttggacttggtgggggccggggccggggcgggcgccggggtgggcggctgcggcccgaacagctcgtaggggagcggcatcttgtccacggagtagacggccagcgggaagtccttgctcaccacgctgccgaggagcatgttcgggacgcgtgggtc

SEQ ID NO: 22051 - DNA, 660 bp, Triticum aestivum
  Clone ID: PAT_TA_22051
gaatgaattcgagaagcactagtatatcacataaattacagcatacagaccaacaagaaaaccagagaagaagaagaagaattgagtgttcatcaatcaagaagaaaacaaggaaaaaggaagaagaaagaataaagccgatggacatacacatcatcagatcacagtatcggtacaggggatgcgtgctgagtgctgagcgcaccgcaccgcaccaactcgatcacgcacagtgcaagaaagatggcaccaccaccaccttgtgtcgttcctctcggatcggatcggatcggatcagatcagaacatggcgccgaggacggcggcaccgagtacagcggcccacctggcgacgccggagagggacgcggcggcggacttctcggtgtcgtcgtcggcggtggcgtcgtcggcctcgggcgcctcggcgatcccggccgacttcttcttcttcttgggcttggacttggtgggggccggggccggggcgggcgccggggtgggcggctgcgggccgaacagctcgtaggggagcggcatcttgtccacggagtagcaggccagcgggaagtccttgctgacgacgctgccgaggagcatgttgttgcccttgacgccggtggagccgtcgacgttgttgccggagggcttgatcaaacga

SEQ ID NO: 22052 - DNA, 1335 bp, Triticum aestivum
  unsure (1)..(1335): unsure at all n locations
  Clone ID: PAT_TA_22052
cccacgcgtccggaagaggtgtggtggcatcatcgtcttcctcctctcttcttatccggaagtacaccatgctcccgatgtccgtccaccccgctactacgccggccctcgcgtcgcggccccgcgtctccctgcccagaccttccacatccccttcctcctcctcctcctcctcctcttccagcctcgtccacatcaagagcaggaggctaccccttcgctcgctttctttttttttttttttttttttttttaaattcgagagacactattatctcacataatttacagcatacaactcaacaagaagtgagaagaagaagtcttcaccacgaatgcaaaggaaccaaaaaagaagaaacaatagccccaagcaccacacacagaataaaccctctagcgactcacggtacacccattgaagccaggtgcacgtctccactcccgaagcgccgcgcgcacccgcacggcatgcccgcaacatgcaccgccccacgccatcgcagcatccactcccgggtcaggagattgggcgaagggcggcgacggcggggacggagggccgcggggcgacgccggcgaaagccaggacagcaggctgctcgggctcgtcgacgaggatcgcgtcgtgggactccggggcgtcggcgatgccggcggaccgcgtcctcgcggccgccccgggatccggcgccgtcgtagcgggcgtgcccttcatgggtttgggggacgaggaggccgtcgggggagaaggaggtgcggaagccgtggcggaaagcgagggagtacaaggtggacggtgccatgaaaagcaggacccgatgctggtactcaagttcatatgggctggagaagaacatcggcagcggctcttgaccaagatggttgggtggtggtagcaggcttccccttaagcccgttgctacttctggccggcgggaaagatgcatgggaggaactgaagagcgaagctgggaggagaaagagtggatctcgcagaagcagatgatcatccttcattcaacctggcccccccgacatcatcaacgctctggcagcaaggcggcggcagcttgtccacatgaggggctgtttcagtgtctttcttcttgctttgcttgttcattaatgttaaagccacgatgccacatggtacatgatcctgtagatcgtctcaatctgttctcgtatgatcctgtttgtggaaaatgaacgcaagggtggagtatttgggttgtgttattggcaaggacggtgtttaagatgattgaccgtgagtggttcccttcaaaaaaaaaagaaaaaaaaaaaanaaaaaagggggggccgtaccaa

SEQ ID NO: 22053 - DNA, 613 bp, Triticum aestivum
  Clone ID: PAT_TA_22053
cctgtgcggcgctcgagccggccgtgtgctgactttgcttccctcagaacccaatccaacctcaacttcgaacaaaaatcccaagagattccccaagaggtttcattttgcgtcagatcaaacccagaatccgccactacccgcggagcagtgaagtagagcggtgagcagcgaggagggaccatggcgtcgttgccagaggaggaggaggccttcgagcacacgctgctggtggtgcgcgaggtgtcggtgttcaagatcccgccgcgcaccaccagcggcggctacaagtgcggcgagtggctgcagacggacaagatctggacgggccgcctccgcgtggtgtcgtgcggcgaccgctgcgagatccggctcgaggacccgggctccggggacctcttcgccgcctgcttcgtgctgcccggccagagggacagcgccgtcgagaccgtgctcgactcgtcgcgctacttcgtgctccgcatcgaggacggcagggggaagcatgccttcgtcggcctgtgcttcggcgagcgcaatgaggccttcgacttcaacgtggccctgtcggatcacgagacgtatgtcaagagggagcaagatcaggagaccg

SEQ ID NO: 22054 - DNA, 1490 bp, Triticum aestivum
  Clone ID: PAT_TA_22054
cgccgcccccccggggcggcggcccccccccccccccgcaccttccacccttcgataccacgtcttctccttctctacctcttcttcccatcaagaacccaatccaaacctcaacttcgaacaaaaatcccaagagattccccaagaggtttcattttgcgtcaagatcaaacccagaatccgccactacccgcggggtttgaagtacgagcggtggccttcgaggagggggtcgccctgtcggatcaggagaagtatgtcaagagggagcaagataaggagaccggcggtgaggaggcagacgacagccagatcgatatccacccggcggtgaatcgccggctcaaggaaggtgaaacgattaggataaacgtgaaaaacaagccatcaactggaagtggcatgctttcctctgctggtttatctggtggggccactgaaaaacctaaagcaagcatgctccttgcaccaccgccaggtgcaaccgggaagcttcggtctccgctcccacctccccctaacgactctgcatctgcaagaatgagttctggacccaatgctggaaccagggcctcaaaagaacctaacaagaaaagcagacaccccttttcagctatttctgcaatagagcgaagcctagcctcatcaaccgaagtgggacaaacaaaaagcactggatgacggatgggcagaattttgacaacagaatgccatctgctgtgtcaagagacaaagaaaactgtgtgactgaaaaagtacacaaaatttctactcacgcgtggcctgtaccctatgaaatcacatggggaaaaatgacaatctgcaaccaattattacttgaaaaataaagcctggtggaacgggctgagatctattctcggctcccactgccccctaatgactctgcatctgcaagaatgagttctggtacccaatgctggaaccagggcctcaaaagaacctaccaagaaaagcatcgaccctttttcagatatttctgctctcgggcgaagcctaccctcgtctactgaactgggacaaacaaaaagcaccggtgccggatgggcagcattttgacaacagaatgccatctgctgtgtcacagacaaagaaaattgtgtgactgaaaaagtacacaaaatttctactcactggagcttgtaccctatgaaatcacatggtgaaaaatgacgatctgcatccacttggtacttgaaaaataaacctttggggaggtgctgttatctatcaaggcatcaacccgcatggattcagggagcttcgaaagtctgaatattttcctgaatagaagtgtgggtttccttgtttgtcatatttgtgtttgccagatctcatatactgatacaagaatcatactgacctccacatgtatttctgtcctgaaagattcgagagtactgtttatgcgaaaaaaaaaatttattcaaataaaaaaaatataattattatatattaattattttttttaa

SEQ ID NO: 22055 - DNA, 398 bp, Triticum aestivum
  unsure (1)..(398): unsure at all n locations
  Clone ID: PAT_TA_22055
gagtttttttcctctctctttactgcacgatgatcaggcgcctgatgccgatgaagcttccttgctcatcgccattatcgaagattagctccatgttccgaaggctctctaggtcgtcctcaacgccaggatcaaatcatcagctgagccggagactgaaaacaataaagaaaagcaagcagctgggtcatagtaaacatcatgtagcgaggcttagcagattgcttttttttcccgttagaatcatccacatgtcctccgacacgggctaatttggttctangttatttttccagttagtaaccatgtatccatgggacanccacagcgcgacgtctaatgttacatcatcaaggtcttttggactatcccataagaaacattcctttaagacaaan

SEQ ID NO: 22056 - DNA, 883 bp, Triticum aestivum
  unsure (1)..(883): unsure at all n locations
  Clone ID: PAT_TA_22056
gggaaacaactccatttcccaaccaccaaccaacagccgcccaaggccgatccatggcgtcggcgtcgcggctgctgccgccctttccccctccagctgccccaacatctcgccacacaactctccgcgccgtccctcgcagctgcagcctcgccatcccgagcctccggtgccgcgcctccgctccagcggccgttgacgctggctcgccgctgctgctcgaggaccgcgccggcgcggtgtccatccgagagtttgtcacgctcgatgagctccacgccgccgtgcgcctccgcgttcgcaccttctacgagtacgcccgcgacactgtcggcgccgaggatcacaggaaaggtctggcagagagggaatatgaagcattacaaaatcggatttctgggaatatgattaattttcggagagtctcttgtataaatgggacagtgccactgttgccatcgttgatgtcagcagaggagctttgttcaacatgcaagtttattgaagatggggaagagagaatagtagttggtagtttagacctgaatcagtgcctctggctaccagatgaactgactggaaaagagccaagggtaactgaatcaagccatacacgggcatatctgagcaatgtatgtgttgccaaggagctccaaagatgcggactgggctatgcattggttgacaagtctaagaagcttgctcctcaatggggcataacggattgtggtcatgttgccacaacaacgggcgngccaaactcttaacaagatgntttgttcaaagtagganctgcacaggtagatcttggcgcccaaggttctcttgcttaataaaacaaacttgatntacgtaagctccttaagtanatntncaaaaattt

SEQ ID NO: 22057 - DNA, 588 bp, Triticum aestivum
  unsure (1)..(588): unsure at all n locations
  Clone ID: PAT_TA_22057
atttggaacacttgtgagcatattggagcctttcctctccctctctctcactcatattggttgggattgcattctagtgagattgagagccatctagtgcattgcatcaagttgttgatctttgaggcactagggagatcatcaagtgaggtcgttggcttgttactcttggaggttgccgcctcctagacggctgggtggtgggttcccccgtngagctcttcaaaggagattgtgaaagaggccgcggtggtgattgtgaagaggcgtttgtgcttgcctcccccggagcggtgaaaagcaaccctagtgggatcaaggtttgagggtccattgaccaatccggctcaagagatcaagtggggacttgatagaggaccggttgggagctttgaacctacctcaacgtggactaagggtgaccggcaactcccgacacacnggaaaatcatttgcacgttcacactcccttggttgcacttcccacaactggattactgtcaaatactatcatgataatgtgcncngtaccnctgtaaacaacatacatataaanatgccactttntaaaaaaagggggcgtncaat

SEQ ID NO: 22058 - DNA, 376 bp, Triticum aestivum
  unsure (1)..(376): unsure at all n locations
  Clone ID: PAT_TA_22058
cccccacctcctctcttcccggcctcttcgtctcccggccccccgctccttctcccgcgcgccaggctccatcccccccgccctggcacccacccagcgcgcccccccgccccctgatatcgccgtccgcggcgctcagcagcctggcgctgagccccgccctggtctctccgcccgcggtggggggggcgccggcgctgacagccgctcggggcgcggcccctgcggtgtgggctgctccggagcggactgtcgctcgcagtgtgttcggggctgagcagcccccgccggggtgggttgtgcctgcggtgcttttcgcgactttcgaacccccgtctggatggtttatccantnggagcaataaactacattcaa

SEQ ID NO: 22059 - DNA, 643 bp, Triticum aestivum
  unsure (1)..(643): unsure at all n locations
  Clone ID: PAT_TA_22059
cttctttcttgagttgtttttcgtatacgtgtgcgcttggcagacaatgtcttctccccatcacacgcaggcgtatctcgacgctgataagggcccgactattcttgggctagtcatcactgtctctattctgagtacaatctttgtggctggccgtgtgtatacgcgaaagaggatcataggcgcactgcaccttgatgactggttcacaatagttgcagtgatcttcgagtgggtgccaagtcggtgttacagttgtggctgttaagaacggcaatggcagacactttgatcttctaaacgtgacgcagcaagcagaatgtcattctatacactatcttggggcttcccgtttggcgtcatggcctttggggtttcccaagctcgctgtcgtcgcgctcatcacacgcctcatgaatcccggacgattacacaaagatattccttggggtgctggctggatgttgcatgatgggtttgataggggtatcatcaatccaattgcccaagctccccggccgtccgatggacgttccnaatactgataanantgctgngtcctaagtctgtaacttncaatttgggggcctgtcgaattaanactgncctgcgggtaccgcctgggttgtcactcaaaaaaang

SEQ ID NO: 22060 - DNA, 343 bp, Triticum aestivum
  Clone ID: PAT_TA_22060
caggggccttttttttttttttttttatcagttacgcccagttttattttgagctcagtgaactctgtcacaatgtgccaggcaaaagaattcaattgcatggaataatctgttacattgtttggactaatatacattcaaagttttggttcagcgccaaatttccggattttgttgtgatgctctgctgaagtgccatctgaagcgatactaaactgtccctacaggcttgtactccatggagcccatcttaagggaaactaacctgtcccacaggcttgaacttcacagagctcatctgaaaggacacaaaactctttcaacagcttgcacttcatggagc

SEQ ID NO: 22061 - DNA, 1084 bp, Triticum aestivum
  unsure (1)..(1084): unsure at all n locations
  Clone ID: PAT_TA_22061
gagaaaaaagggaacatcttatgcattactttgctggtataaagaattattcattcacagccactcctcttaagagctcagtcagctgtccctatatgccatgtaaaacaattgaattacatggaataatctgttagattgtctggactaatatcatggcattcaaagttttgctccggccccaaatctccagatttggttgcatcgctttgcttaagtactgtcctcaagggagcccgtcggaagggaaactagacggtccaccagattcacctgcatggaacccgtttgaaggttacaaaaccgccctggcacagttctctctacagagcgctatcaaacgggcgcgggtcgttgtggcacatatctcacaccatctcatctacagcttctgcatccttttttttacagtgcgggctgttctttacagaaagcagcgcacgtatttcgacacattccgtttcatgcccctttatctttcacgacgccattcatctaattcatttttgtaatggaaattgcctacgccagttgataagatcagatctactcagaaagcctagtgagcgcagtttgcgcagtcgtacgttcttgataatacagacaacataagtcattactaaacatcaactaatatgtcatgatttatctcatcttatccttcgcttccgtttactgcaaacatatacccccacgcccccggccgtagttcccgctggccgtgcagatggccgcccggcagagcgtcgaccagacggtccacccggccttctcgctctgctccctcactggaacaccaccttcggatctttgagagccaattgcacgccggcgacgcactcctcccacggcatggcattgcgggtcacgtgcgggcgagaagcgggaggcgcctccgctatcggggtcttcggcgggacgctgccgccgtcgcctgcggcggccgccactgttattgttcctctgcccgcggctcggccgcgagccccccagcccggggggtccgcggggcccgggccggccgccgccccggtggagctccagcttttgttccctttagtagggtnaaggtcgagaaagnanc

SEQ ID NO: 22062 - DNA, 436 bp, Triticum aestivum
  unsure (1)..(436): unsure at all n locations
  Clone ID: PAT_TA_22062
gctgatcgggattcctcgtctctggtctgtctgtgctccaccacctgctgctggtgccatggccatgggtagtctcgccttcgccacggcgctcgtcttcgtcttcgtcttcgccatcgccgtgccggccgtcgccgccgccgcgcaggcccccgccccggcgcccaccagcgacgggacgtcgattgaccagggcatcgcgtacctgctgatgatcatggcgctggtgctcacctacctcatccaccctctgggacgcctccgccccgttacaagctcttctgagcgagcagattttctcctccatttttgggtaggcttttgtagtggatcactagagtaactgggggtggtgggnttggttgtgggtnaaaaaattccggtacctaatcaattgccaatgaattacattcggtttcgcgtgtgtaaaaaaaaa

SEQ ID NO: 22063 - DNA, 563 bp, Triticum aestivum
  unsure (1)..(563): unsure at all n locations
  Clone ID: PAT_TA_22063
gttggatgttttgacaagtcgattctagcttccttatgatctatgttagatttgatcaatgaataaaaggattattcatatcaatgtccatgcaccttctcagaaaatccttttgtgatgttggtgttggtttcctgggacctgtactgatgattgcaataagatatcatgaggcgcgccgaggagaacaggggcctcctctccgcctcctcccttccgacaggcagctgctgcggaaggaggtggtgaggaagggtcaaaggccgccggtggcgggacgtgaagtgaagttgacctttgtccgagcctatatgtnggaggtcagtccatgaagctggggactaaggacaagggcgagcttgaaggctaaaactgttaatgcaccttcnaagatcctcattaggcaagcccctacgtagtgtttgacaaaaaggattcccgacggcaatgcgttaaatnagatgtcaatatcgaaacaagaatacattgggganacgtatcgatttggtcccntcctgggtatacgaaaanagctcatgttaagttcaattaaaaaaaaaaaa

SEQ ID NO: 22064 - DNA, 258 bp, Triticum aestivum
  Clone ID: PAT_TA_22064
aaaatgttcaatataaatttggagaaaaaaatataaacttgagcacttggactagcccaaaacaaataaaactctagctatataatctctttctactataaaagtccacatactctcgtactcctgttcatcctgatcgcaatctcgtccaatcaaatgtgtaagtatagtttccgagcagtttttatattttttgcgcaactatgtaattagacattatttatacatatatgagcaatcttagctaaaaaaaaaaaa

SEQ ID NO: 22065 - DNA, 343 bp, Triticum aestivum
  unsure (1)..(343): unsure at all n locations
  Clone ID: PAT_TA_22065
ctcgtttgaacagaagtgtgatgaattgatggactcttacgcaaccctcctgtttgccaagatcacggagatcaaaccanaagcgttctgcaaacagtatggcctgtgcaggggcacggctcttttctctggtgtgacaagtgacagcacatgtgtgttctgccaccacctgcttgatgaagttatgtccaaactgaaagatccggacgcggagtttgagataattcagattcttatcaaggagtgcaataagattgaaggccacgtccagcagtgcaagcgactggtcctgcaatacattcccctcatcctggtgaacggcgagaattccccaagggggggg

SEQ ID NO: 22066 - DNA, 448 bp, Triticum aestivum
  unsure (1)..(448): unsure at all n locations
  Clone ID: PAT_TA_22066
ggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgttacaacaagaagcccaccatcacctcccgggagatccagacctccgtccgcctcgttctacccggcgagctcgccaagcacgccgtctcggagggcaccaaggccgtcaccaagttcactcgtcctaagctcctttcgagtagtccttaagcgccgtggcgccttttgactgtatggnatgtttgtcatctgaaagttgatctgagcagtgcaatatataattctggcatactantct

SEQ ID NO: 22067 - DNA, 1375 bp, Triticum aestivum
  Clone ID: PAT_TA_22067
cccacgcgtccggctactagcgcctaccactgaggagtgaggctgccacgcccattcgctagctagctacagacccatagtacaaacaataatagagcaactgagcacaccaggacacagtcggtgaagtactgtgacagggagctaggttcagttcaccacaaacgcctcatctccaagccgagcaccctcgccatgagcacggacgcggacgccgtgccggtggccgtggcgccggcgaagcgccctcccatcaacaagtacgccttcgcctgcgccctcctcgcctccatgaactccgtcctcctcggatacgacatctcggtgatgagcggcgcgcagctgttcatgaaggaggacctgaagatcacggacacgcagatcgagatcctggccggcatcatcagcatctactcgctgctgggctcgctcatggcggggctcacgtccgactggctgggccggcgctacaccatggtactggcggccgccatcttcttcacgggcgccctcctcatgggcctcgcccccaactacgccttcctcatggccggccgcttcgtcgccggcatcggcgtcggctacgcgctcatgatcgcccccgtctacaccgccgaggtggcgcccacctccgcccgcggcttcctcaccaccttcccggaggtgttcaacaacttcggcatcctcctgggctacgtctccaacttcgccttcgcgcgcctccccgtgcacctcagctggcgcgccatgttcctcgtcggcgccgtgccgccggtgttcctcggcttcgccgtcctcgccatgccggagtcaccccggtggctggtcatgcggggccggatcgaggacgcgcggcgtgtcctgctgaggacctccgattcgcccgaggaggccgaggaacggctcctcgacatcaagaaggtcgtcggcatccccgcggacgccacggacgccgatgatgtcgtcgccatcgtgcgcgcgaacgaggccgcgcgcgggcagggggtgtggaaggagctgctgatcaacccgagccggcccgtgcgccgcatgctcgtggccggcctcgggctcatgttcatccagcaggccacgggcgtggactgcgtggtgatgtacagcccgcgggtgttcgagaaggcagggatgaagaacaggaccaactcgctgggggcgtccatggcggtggggcgcgtgcaagaccttcttcatcccgatcgcgacgctcctcctcgaccgggtcggtaggaggccgctgctgctggccagcggcggcggggatggccatcttcctgttcacgctcgccacgtccctgctcatgctcgaccggcggccggagtcggagggcgaaggcgctggggcgcggtgagcatc

SEQ ID NO: 22068 - DNA, 941 bp, Triticum aestivum
  Clone ID: PAT_TA_22068
agaggagaaaggggtagcagtcagccatggcgacggccaagcccatcctgtacggcgcctggatcagctcttgctctcaccgtgtccggatcgctctcaatctcaaaggtgtggactacgagtataaggcagtcaatcctcggacagatccagactatgaaaaaataaacccgatcaaatacataccagcattggtagatggggactttgttctatctgattctctcgctatcatgttgtatctggaagataagtatcctcagcatcctctagtacctaaagatatcaaaacgaaaggtctcgatcttcagattgcgaacatagtttgctcaagcatccaacctctccaaggctacggcgtaattggtttacacgagggtaggttgagccccgatgagagccttgaggtggttcaacgttatattgacaagggcttcagagcaatagaaaagctcttggatggatgtgacagcaaatattgcgttggagatgaaatccatttgggagatgtgtttctagccccacagatccatgccgccatcaatcgcttccagattgatatgacgaagtacccaatcttgtcgcgacttcacgacgcgtacatggaaatcccggcatttcaagccgcactgccccagaatcagccagatgcaccttcagcaaaataatcaagaaatcaagccagttacaactatatgcgtgtaatttccacaataatgaggaatgtagtctgcaatgcatggaagaacctctcataagtcataacttatcaggttgtctgagtgtatacactttggcgtccatctcgccgaggcgcgcgtacatgccatggcgagctgccggccgggccccggcgccatgtaaattaatattgatcgattcaccaccagtgagatttggcaagaaaaaagaaaggtgatttgacgaattgacctgtattt

SEQ ID NO: 22069 - DNA, 1355 bp, Triticum aestivum
  Clone ID: PAT_TA_22069
cggccgctcgaggcggcgggcgcgtggggcagagcaaccatggcttcttatgacaaacaattcaaggttctcgaggtacctccgatcgtgcaagagctggtgggcgccggcgtgcaggagccaccgagccagtacgtgcttcctgagcaagaccgtcccgccgcggcggtctccgagatgcccgagcccatccccatcatcgacctcagccggctgtctgccggcagcgccgaagagttcgacaagctgcggtccgccttggagaactgggacctcttcctggctgttggacatggaatggagcctagctttcttgccgaggcgatgaaggccacgagagagttcttcaacctcccactggaagagaaacagaagtactcaaacattgtcgacggcgagaagctgggcatggatggatacggtaacgacatggtcgtgaaagagaatcaggtccttgactggaacgaccggctcaatctcctagtggaacccgaggccctaagaacctacagactgtggccaacacaacccccttctttcagagacatcctgtctgagtacacggtcaggtgcaaagcggcggctaaccttgtctttcgaaacatggccaagatactcaatttacaagaggaacacctggtaaacatgatcggggagaactccatcacccaagctatattcaactattaccctcagtgtccaaggccggaccacgtcttgggcctcaaggcccataccgatggctccataatcacagtcaacttcgccgatgctgaggggctccagcttcagagaaacggcgtctggtacaacgtgcccatcgttccaaatgcattgattatgaacgtcaagggatataatggagattttgagcaatgggttcttcaagagcctggtgcatagggttgtgaccaacgcggagaaagagcgcttgtcgttggtgctggtctatacattggagctagagacagagcttgagccggtgtcagacctggtggatgacaagagacctgcacgatacatgaagatcaagctccacgactacatggaaaaatatcatgacacttatgccacagggacactagccatcgacggcgtgaagatctgaatatgattctgatgtgtacaagtccgctaatgaagaactatgcatggtgaagtatcttccgtcgaccagtttgtaacgagtttatatttttcatgtacccttttccccaatttttgtgtgtgtactccttcatgtaaaatgttcggcagcttgtgtggctgcatgaaacattaaaataaaatgtatctgctgtgtgcaacatgcagatgcaaaggatggaataaaacttatcggtcgtgtgcaaaaa

SEQ ID NO: 22070 - DNA, 1469 bp, Triticum aestivum
  unsure (1)..(1469): unsure at all n locations
  Clone ID: PAT_TA_22070
gcaacgactacatgaacaatcccttctccggctctccataccgggaaatatgccaaacaattcaaggttctccaggtacctccgatcgtggaagaggagaaaggcgtagcagtcagccagtggcggcggccaagcccatcctgtaaggcgcatggatcagctcttgctctcaccgtgtccggatagctctcaacctcaaacgtgtggactatgagtacagggcggtcagtcctcgaactgatccagactatgtaaaaataaaccggattgaatacataccagcattggtagatggagactttgttctatatgatttcctcaccaatcgttttgattctcggaggatgagtattctcagctcccctctccatccttaaagatatcaaaatctaaatgtcttgatccagggtatgatgaacatagatggcacaagcaacgaacttcacctttggcttgagagtaattttagatcaatacaaaaactctacgtgagggtaggctgaaaccagatcagagccttgaaggtgtacaacgtaatattgacaagagcttcagagcaatcgaaaaggcttttggatggatgtgacagcaaatattgcgttggagatgaagtccatttgggacgatgtgtgtctagccccacagatacatgccgccatcaatcgctaccagcatgatatgacgaagttagcccaatattgtagcgacttcacgaacgtcatacatgaaaattccggcatttacaagctgcactgccccagaatcagccagatgcaccttcagcaaaataatcaagaaatcaagccaagttacaactatatgcgtgtaatttatgcattaatgaggaatgtagtagtattgcaattgaagaacctctcataagtcataactagctcccgtccgttcaaggtgcatagggcttctgaagtaaaaaatcgtggtccaaatatataacttagcaggcggtgaaggggctcctcaacaggccatgccgagctgccgcccgggccgggggtcagtatatggtggtttgtcaagagaccgtgcacgatacatgaagatcaagctccaggactacatggaaaaatatcatgacacttatgccacagggacactagccatcgacggcgtgaagatctgaatatgattctgatgtgtacaagtccgctaatgaagaactatgcatggtgaagtatcttccgtcgaccagtttgtaacgagtttatatttttcatgtacccttttccccaatttttgtgtgtgtactccttcatgtaaaatgttcggcagcttgtgtggctgcatgaaacattaaaataaaatgtatctgctgtgtgcaacatgcagatgcaaaggatggaataaaacttatcggtcgtgtgcaaaaaaaaaaaaaaaaaaggcccctaccgcgaccacgctaatcactaaggaaatccaaataaaaaaanaantgaacnaaaaaaaaa

SEQ ID NO: 22071 - DNA, 1102 bp, Triticum aestivum
  unsure (1)..(1102): unsure at all n locations
  Clone ID: PAT_TA_22071
gcttcgatggtcattgttcacgtggggcaaactaagtgaggctatacgaggaatcagcttacaaatttgaggtgtctcatcgctacatggttgacctttgccactttaagaatggcaacacgctacacatattacttgcaattatatatgcaatacttctttgcgttgttacctttcatttgcaatatttcttttctcagtgttgttgcctttcatttgcagtatttctcggtcaggtttaccaagaaatatctccgccgctgtattgacccaaagctttatggcttgccaataaaatctggagatggttaatacctgcatcaaagcccgtcttaccaaaggtagtcagataacagggcaacaattacgaaagggatggcagccttcttccccgcagctaatatgaaggaaataaaaaatatatgcctttgcctacaaagcacaaccacaagcgcctgcatcttacattgcatgcccttcttatcatcgtgtgcagtccaactaaactacataattaggctataaatgtttgttgtgatatcgcttcgccctgacaaccggtttgcgtttggcacttgcatctatggtcatcccttttatagtagttgtacaaacgaaaataacaattacgcgaggcgggtaaagcttcctcctatcagccaattcaaaggtaaaaaaaagatatgtcccaacctttaaatgtaactaccagtgtatgacgctcacttttcactaactatggatatcgtattcagtctactaaactgcttaattagcctatgaagttctgtgtgtatagcttcaccctaagaacctgtttacttttggcactggactctctggtcatcatgttcagtctactaaactacctaaatagcctatgaagctctgtgtgtatagcttcaccctaagaacctgtttgcttttggcaccactctctgctcataacgcaactctcactgatgcataagttgcgagacccgcctcatatgtctctgccaactcaggcctctcgggttcttccaccggcgtctagccaatcctcaaatttctcnctttgggctcattaanntccttcatttcgtgttgangaaagttgtng

SEQ ID NO: 22072 - DNA, 681 bp, Triticum aestivum
  unsure (1)..(681): unsure at all n locations
  Clone ID: PAT_TA_22072
tttttttttttttttttttagtgtagacaaccatccataacgacgttcttaataacccagtggcacagcggggcggacataaccagaaagtcttacaacatcaggtgttgcaaaccacaacggggacaagagcagcacacaagcctgacgatgaccgcatcaggatacttctagtactcatcaccatcatcaccttcctcaccctcatcaaactcagcaccaacctcctcgtagtccttctcgagcgctgccagatcctcacgggcctcagagaactcgccctcctccataccctcaccgacataccaagtgcaccaaggcacgcttggcgtacatgaggtcgaacttgtggtccgatgcgggagaacacctccacaacactgggtggagttggagatcatgcacacaagcgcgctgcaacttgggccaagtcaccacaggcaacaaacttgggagggctggtagttatgccgcacttaaagccnttgggcacaatccaaaaacgggtgggccctggnctnatggnggcaaanancattcaaacctttgggacanacacacgnanatanggacaggcaagttnttcaagggggggttcccttggcacaaggggaggncaaggccnttgngnttcgcaaaaaatgcccggagctccanaaatacgggcaagggaanataatt

SEQ ID NO: 22073 - DNA, 998 bp, Triticum aestivum
  Clone ID: PAT_TA_22073
ctcttcggcacgaggtggacttctgcctgtccctgctcgttgctgggtacgagaccacctccgtcctcatgacggtggccgtcaagttcctcaccgagacgccggcggcgctggcacagctcaaggaagagcatgaaaatatgacaaagatgaaaggtgaaaatcaacccctagagtgggtcgattacaagtcaatgaccttcacccaatgtgtgataaatgagacacttcgtgtggctaacataatcggtggggtatttaggcgagcaaacactgatattcattttaaaggttacactatcccgaagggctgcaaaatatttgcttcgttccgagctgtgcacctcaacaatgaacactatgagaatgcccggacgtttgacccatggagatggcagagcaacaacaaacttcagaacgaggtaggggccaacttatttactccctttggcggtggacctcggttgtgccctggctacgagctcgctcgggttgtcatctctgttttcctccatcatcttgtaatgcgctttagctgggaagcggccgaggaagataggctcgtcttctttcccaccactcgaaccctcaaaggatatccgatcaatctcaggcggcgatcggagtctgtttgacgacctcacattggtcttcggctgctcttatcttgaaagcgaaattaaacatagatgaaggaagagaaaggaaatcgggtaaaatagctactagtagtctacttttgttcctttgggtgtatcatttgtaacctggtatttacacaacagcaaagttgtgctgtttttaacatgtggttataggtgtggcctgaactgttggtgtctaccggttactagtgacgttttggcgcgttccctatttggatatatcccaaacttacgaaaaggagacccgatcaatctcaggcggcgatcggagtctgtttgacggttcgagtggtggggaagaagacgagcctatcttcctcagccgcttcccag

SEQ ID NO: 22074 - DNA, 591 bp, Triticum aestivum
  unsure (1)..(591): unsure at all n locations
  Clone ID: PAT_TA_22074
ggggatcgaagcggagagcaagggagcggtcgagcgggtgacatcatcgtcatccagggtttctcaatcggcagcgatggcgaccagggcggcggcgaggttcctgcagcgcaggtttctgtcttccggcggcaaggtcctcagcgaaggaggaagaaaggccgccgagaacgtgtacatcaagaaagtggaacaagagaagctggagaagctcgcacgcaagggccccagctcaggagagcaaccctcgtcaaccacaggctctgcaccaagtgatgtgaangccgatgctgggccaacggagtcagcatctgcaagtgtgtcgacggacaagaacaagaactatgctgttctggcaagcgcanttgctgccctgggtggcttgggttggtatctaatgttaaagcctaagaaatccgaggaagttgtggactgaagaaggagntntgaatgccgatgtccgcctatatctcacatggtttacttctgccatanactcaacttctgaaaataattgtgaaattacccgcacactggtctaagctgttcatananacctgaatatcaccnagtnttaatantccncctcct

SEQ ID NO: 22075 - DNA, 533 bp, Triticum aestivum
  Clone ID: PAT_TA_22075
gtgggcacggtcgaccccgtcgacgtcgtccgcaagctgcgcaagcgcttctgcatggtgcagatggtctccgtcggcctggcccaaggaggagaggaggaatggggacaagaagcaggaaggcgataagacggatggcaacaaggagaagaggaagaacagcgacaccaaggacgtcccgccgtggtgcccgccgcactgttacccgctgcctcacccgtgctacttcctccacaccgaggagaaccccaacgcgtgcgtcatctgctgatcggtccgacgtacatttcttgtaaccctcctgcatgccagccgattgatcggtccggactccggactcgggactcaccagcccacctgcaccggcgatcgacggcgtgcgttatatttttttatatatggccatgtgtgagctaaatactgcacaggtgatctggcagctgcgcgtctgctgagttcgccagatacggatttgccgtgtggctaagaacttaaataaataaaactgctgcatttggatgaaaaaaaaaaaa

SEQ ID NO: 22076 - DNA, 1061 bp, Triticum aestivum
  unsure (1)..(1061): unsure at all n locations
  Clone ID: PAT_TA_22076
attcaaatcaaagctctgtgacctggatgccagctctgtttactcagtacttcctccagacatgaagctatgcacgaactgaggttgaagctattaaaaagtttaaaaaagctcttggacttgatgatgtggatgctgcaaatatgcacatggcgattggtagacgcttatacagagagagactcgatgcattccaaaagttaatttttgtgtcaaatcttgtcttcggagatgcatcagacttcatacttccatggaaacatcttttcgggatcacagactatcagatcgatattgctatgcgggagaatgccaaaattctatacgcgttagagctcaagtctattggaagaggtcttgacataggcacgctcattgaagtgaggagagtacaacttgcatataaactttttgatgaggttgctgctgacatgttcaaggagcatgccaagaagttggttcaagaaaacatttcatctgctttatccatattgaagtccaataccagtgcagggaacattcccacagaggtcattagtgaggtgaatagtatccttgcattcaataagttgctaacagttctaagcaagtttcctcaaggcgaccgatttgcacgtgggctaggacctatctcgttagctggagattttgatcatgataaaatggttggtgatctaaagatactctatgcggcctatacaacagaagtactttcagatggacgtcttgatgatgagaagcttggtcccttgaatgagctgaggaatatatttgggcttgggaagcgtgaggcagaagcaatcatagaaggagtaatgtcagatgttaaatctcaagtaccagcatgatgatgctcgtgcgtgtgcatcgctacacagtaaaaggttgtgctactatttgttcaggaatactgttttctttgttgcatggaaataaccagagagaaaacaatgtcattcggaattgttgcctttcaggtagcattttgtatttctgccagttaccaggtaaaagaattacttgcgtggtgccgcgnnnnnnnnnnnnnnnnnnnnnnnnnn

SEQ ID NO: 22077 - DNA, 1231 bp, Triticum aestivum
  unsure (1)..(1231): unsure at all n locations
  Clone ID: PAT_TA_22077
gtccgggattcccggactcgtctgaatccccaaattcgaatcagacgatacatgtagctcgctgcttcttctcaatccatcccccccgcgcgcctcttcctaccccgcgcgtgctctggcgaatctgtagccccgtatctcggcgggcggcggaaatggcgaaccccctagccgggctgcaggaccacctcaagcacgcgcgcgactacgcgctcgagggcctctacgacacctccatcatcttcttcgacggcgccatcgcgcagatcaacaagcatctagctaatttagacgacacctttatccgcacaaaatggatgaactgtaagaaagctataagtgaagaggtagagattgtgaggcagctcgatgcccaattgaagtcatttaaagaagcccctgggacaatgcggtcctcgtcgcctcctattcgctctaataataaatcatttctgttccaaccattggacgagtatccaacatcatcgccatcaacctttgacgaccctgatgtatgggcacctccaagagatacaaatacaccaaaccgaaggtcagcaagaggccaatctagtgcaagaaaatcctcacaagatggagcttgggcacggggtccatcaaagactggaacacctagccgtggtgcaaaacccagcggaagtaaagcaagctctgcggtaagatcatcaactgcttcaagcactggcgggaggaaaggaaaatcaagttcgagcaaggctgattcagcgagcagcgatgctgaagaaggtaagtccaagaaggcacagtatgaaggaccggatggggacttagctgccatgcttgaaagagatgttctagactctaccccaggagtgagatgggatgatgttgcaggacttagtgaggccaaaagactccttgaggaagcagttgtgcttcctctctggatgcctgaatatttccggggtattcgtcgaccttggaaaggggttcttatgtttggcccaccaggtaccgggaagacccttctagctaaggcagtagctacagaatgtggaacaacattctttaatgtttcgtctgcaacattggcttcgaaatggcggggggagagtgagcgcatggtccgttgtttatttgaacttgcaagggcctatgctccaagtacaatcttcattgatgaaatngnctccctatgcacatctcgtggagcttctnntgagcatgaatcatcgnnnnngntaaagtc

SEQ ID NO: 22078 - DNA, 723 bp, Triticum aestivum
  Clone ID: PAT_TA_22078
ctcaccccgacttccgccatgatcagcttatcgaaaacttcactgcaaaaggttttacggccgaggagctggtgacactgtccggagcccactccatcggcacctcacactgctcatcgttcacggaccgtttgtacaagtactacaacaacggtgcatacggcacggacccggctattccggcggcgtatgctgcgcgtctcaagaagaagtgtccgccgtcgacggcggcgcacaacgacaccacaatggtgcagctcgacgacgtgacaccattcgtgatggacaaccagtactacaagaacttgctggccggcacggtggcgttcgactcggacatggcgctcatggacgaccctgagacggccgccctcgtcgacctctacgcccgggagccctcggactactggaccaagcgattcgccgccgcgatggtgaaggtcagcgagatggacgtgctcactggcagcaagggggagatcaggctgaactgctccaaggtgaactagtaattgattgagctattggttggaatgctgcgtttgtctctgtatgtatgcttggggaaattcacgatatatattgttctattgtgttacttatttttctttggttcgtttttatatggtggtgtgaaatatggaagcacatttccaagaaagcatattattcgatttgagttgtgaatttgacaagaaacaataatgtactactagtcctact

SEQ ID NO: 22079 - DNA, 1371 bp, Triticum aestivum
  Clone ID: PAT_TA_22079
cggacgcgtgggcggacgcgtgggctactctcattccttcattcctcctccccggccggcgggtaaattggtcggtcaggcctcgatcaccatgggcggttcgtcgacgttcatgctggcgcctgccatggcgacgacggcgctgatactcctcctggtgttgtcgtcttcgccagcggtggtggcgtggaaagattccgggctgtccgtcgggttctacagggagttgtgtcccaaggcggagaaggtcgtccggcgagtcgtcaccaaggcattcaagaaggagcctggcacccctggcgacatcatccgactctttttccacgactgctttgtccgcggttgtgacgcctcggtgctactcgagtcaacaccagggaacaccgcggagagggactcgaagccaaacaaccccagcttggatggtttcgaagtcataagtgacgccaaggagattctcgagaaactttgcccacaaaccgtctcttgtgccgacattctagccctctctgctcgtgatggtgccttcctcgctagcgggctcgactatgccattccgacgggtcggcgtgatggactcgtctccaaggcagacgaggttctccctagtgtccctcaccccgacttccaccatgatcagcttatcggaaacttcactgcaaaaggttttacggcggaggagctggtgacactgtctggagcccactccatcggcacctcacactgctcgtcattcacggaccgtttgtacaagtactacaacgacggcgcatacggcactgacccggcgatgccggcggcatacgcggagcgcctcaagaagaagtgccctccggagacggcggcgcacaacgacaccacaatggtgcagctcgacgacgtgacaccgttcgtgatggacaaccagtactacaagaacttgctggccggcacggtggcctttgactcggatatggcgctcatggacgaccctgagacggcggccctcgtcgagctctacgcccgggagccctccgactactgcgaccgagcgattcgccgccgcgatggtgaagatcatgcaagatggacgtgctcaccggcaacgagggggagatcaaggctgaactgctccaaggtgaactagtaattggttgatgcttttctctccgcatgttgatcctgtgagggaatggacgatatgtgttcttcctgcgtttgtcttggcttgtatgcgtgggtatatgcacgatggaactcgttctacacgcttacttcattgtgtttcgctcgttttgtgttgggggtgcgtcatgtggcacccctgttccaggactgctttgtcttcgttgcgcgttgccctttcgttaagaaaaaaaaaaaaaaaaaaaa

SEQ ID NO: 22080 - DNA, 1052 bp, Triticum aestivum
  Clone ID: PAT_TA_22080
cccacgcgtccgcccacgcgtccgaacacgcgcacgcatgcacatagagagatctagagaaagacacacagagagagagagagagagagagagagatggcggccggtggcatgagcagggaggagaggtggagcctggccggcgcgacggcgctcgtcaccggcggcagcaaagggatcggccacgcgatcgtggaggagctggcggggcacggggcgcgggtgcacacgtgcgcccggagcgcggcggagctggaggagtgccgccgccggtgggaggccaaggggctcccggtcaccgtctccgtctgcgacgtctccctgcgcgcccacagggagcagctcgtggagacggccaagcaagtcttcgacggcaagctcgacatactggtgaacaacgcggcgcagattctagccaaggcgggcgtggagtggacatcggaggagtactcgcacctcatggcgaccaacctagagtcgtgcttccacctgagccagctcgcgcaccccttgctcctcggggcctccatcgctggaggaggtagcatcgtcaacatatcctcccttgggggcacacttgggttcccgggcctcacaatttacagcatgacaaaaggatgaattaaccagcttacaaggagccttgctaccgaatgggcccataacaagatccgggtgaattgcgtcgccccgggcgcgaccaagagtgacatgttaaacagtgttccaccggaaattaaagagaacgagttggcaaagaatccgatgcggcgggcaggcgagccagaggaggtggctgcagtggtgtcgttcctctgcatgccagcggcatccttcgtcaccggccaagtcatcaccgttgatggtggtcgaacaattagtgcgtagttaattattaagagggtcttatcgattaaactcttctgcatgcagattcaataataaagtggcaagtatttagcatgcacctgagtgttgtcccctagtacaattattttgctacattgttgctagtttttaatgtatttctaaagtagatttgtctattttact

SEQ ID NO: 22081 - DNA, 545 bp, Triticum aestivum
  unsure (1)..(545): unsure at all n locations
  Clone ID: PAT_TA_22081
ccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgacacgggcgcggcagcgggggccgcggcgtcggtcctggccgtggcttgctctgccgtcttcttcatcctcgtcgccggtggcctcgtgcagtaggcgctgccgtcgacgtggtggctagctgctgggttcggggtcaaggcggagccctgttcgatcgttttcgccttagttaagtagtagaagtagcaatcatggggctgtgttgattgtgtccctgtctccccctgggtgggcgttgtgatcttgtgctaatgcttaatccttttgtacctactgcattgttcgactatacttgtgttgagcngtgtttatgaataaagacatggtccgttctcaaaaataan

SEQ ID NO: 22082 - DNA, 883 bp, Triticum aestivum
  unsure (1)..(883): unsure at all n locations
  Clone ID: PAT_TA_22082
acgtccatacgactccgcgcatctccctcgacggtttcctccccttcaacctctgcgatctccagcccgccgcccccgccgtctgcgaggcattcccgcaaacacctggcgggcagaggcgacgccccggcgaggccctcaaagggccgggtgttcttcctcgacgtcaacccgatatgcttccgcggatcccagcgtagcctcagcgccttcgcgcgctggctcgcgctcttcttcacgcacgtcagcctccgcgaccccgttgtcgctgtctttgatggggcaggcgggaacgagtaccggaggcggctgctgccgtcctacaaagcgcaccggactcgcggcgtaggcaccggtgccgattcacgcgtggttgacgtgctccgcgagtgcaatgttccggttgtgcaagtcgatggatacgaggcagatgatgtagtggctaccttgacagagcaagtattacagaaaggttatagagttgtcattgcctcaccagacaaggacttcaagcagttgatatctgaagatgttcagttagttatgcccattcctgagattggccgatggtccttttatacgctgaagcattatgttgcacaatacaatgtgattcaactgtanattttagcctcaaatgcttaanggtgatgaagcaatngtgttcccggaatcaacatctggccctggtttggtcccaagacncggtgaaactactgaacaaacatggtcatnnaaaactactaatannctgcantanaacgtagcaaggatatccaagatgtttatcaacatcaaatactncaaaaacataaatccaattaggaggattaatgtnactnatanaatgtaccaaaggaactttatgacattgtacgantaa

SEQ ID NO: 22083 - DNA, 631 bp, Triticum aestivum
  unsure (1)..(631): unsure at all n locations
  Clone ID: PAT_TA_22083
cctcgacgctggcaccccgcggcgcacctcgtcggagaaccgcccgtcaccggagccgccccctcgatgctccgcccgcgcccgaggaccgcttcctctgccccgcagctcctccaacgctgccgcaacgagcccctctgccccggccaccaccaccgctgccccgacatcgtcgagctgcccctgagctctggggtgagcgcctccccgacgctgcgacgccaccccgccgtcttcgtctcctcctcaccagcgctccccgttcccgtcctcctcctcaacggactccgtcaagcctcgccgcccccgttcctcaacgcgcccaccccgaagaccgctgccgctgtgatcgactacgtcgacgacgaccctccttgccagagcaaccagatgacggatcccaggagccagacgacacactgatgactactactatcggaggatgcctactactacgtgaagacgcagatactaggagtagttaggagctccaagcaggaggcctgcctttcgatcaagttgttttgggcaaccttctaaggaaactgtctaactaagtcatacaaatttgtgctccgtgatccgngtttcagctangtatcaacctcaggcctgctgtaaaaaaaaaaaa

SEQ ID NO: 22084 - DNA, 173 bp, Triticum aestivum
  Clone ID: PAT_TA_22084
taaagattgatggaagcgtctcaacccccgaatagggagcccgcaggtgtatatattgatgtatgcgtgagatacaagacatccggttagagatataactgaacaggagtgttacagagagggagatcgagattacagagagagagatcgagatagagtccaagggggggggc

SEQ ID NO: 22085 - DNA, 623 bp, Triticum aestivum
  unsure (1)..(623): unsure at all n locations
  Clone ID: PAT_TA_22085
actccaccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaagtgcctcaagagcctcgccaccaagcatcaagtccatcaacatgggcaaggtctccggcgtgcccggcaagtgcggcgtcagcgtgcccttcccatcaacatgtcaacaaactgcaacaatgtcaactagttcaatatataatccttcctacgtgcatgcatggacccccttgcgtggagctaaaattcctacggttggtggagcagccgactactctaaaaaataaataaagggcgggttctcattggtgtcagtcactcgctctcacgggcgtacctgctcanaactggctcccctt

SEQ ID NO: 22086 - DNA, 1069 bp, Triticum aestivum
  Clone ID: PAT_TA_22086
gcacagcctcacgggcacaggaaaaaaaacctgaagtgagaaatggcagggttcttcagcacctgtgctgcttctgatcactattgtttgcagctcagatctggatcagctcaccatgaactgattagaccaaacaagtacagaaggaccatgatcaggtgctgcagcacagcaaaggggaagacaagaagggactactaccaggttcttggagtagcaactcattccacacctcaggagatcaaggaagcttacaggaaactccagaagcaacaccatcctgatattgctggcgacaagggccatgaccatgcgctgttgctgaatgaggcgtatgaggtgttgatgaggagttcatccaggaaagctgatggatttggcaagagcagaggcggctttgggagcggttacaccggggacgggtacagttcttggaatgggcctatcaggagccaggctctcttcgtggatgagaacaaatgcataggatgtagggagtgtgttcaccatgctggggagacatttgccatggacgatgttcttggaagcgcgcacgtcgaagtccagtttggcgacgtggagcagcagatccaggtggctgtggagtcttgccctgtgaactgcatccactgggttgggagcgaagagctcccggtgctggagttcatggcacgtccacagcccaaggaagggcacggcgtgttcggcggcgggtgggagaggcctaaggacgtgttcgcggcggccaggaacttctccaggaaactcgagaagcaggagcggcaggaaagttccaggggcgcaaacgggggtgaagatatggaggctgaaacggcagctcaggccgaagcgagacgccacgcggggcaggagctccggtggaagagtttgttcgatgtttggaatgggttgggagactggaggaaatctggaacagacaggtagatgtgcagttgctagtcgttggttagtgatggtgtgaagactgcaaccacacactggatgttgtacgacgtgctgtaataactgggatataagatggaggatgacacagaactttttttttttt

SEQ ID NO: 22087 - DNA, 366 bp, Triticum aestivum
  Clone ID: PAT_TA_22087
cggcacgagcggcacgagttagcatcgataaagacaatgcccctaagtggaatcccactacccttgaggaggtgaagtacgaggacatcgaccgtctgttccagccgttcagtccggagctggaacttcaggtcccatctgatgattccaacaggtggagcggcaaatacgagaacacggtctatggcagagcttcccagttgactgtatacaaagatcccccagccttttggtatttccatcccgaaccactgcatttacggaatattcagtttgccgcacctgtgtatttcgagtgtttgggttgcgcgacgttcaatgtttgaactgttgccaaaggttccccggtggctggggggggccggg

SEQ ID NO: 22088 - DNA, 283 bp, Triticum aestivum
  Clone ID: PAT_TA_22088
tctcggcggagcgatgtgcgcgtgcacgtggcatttcttctacaattcagagtctctcgaggtacttgtggcgcttcaaggtgcgcttacagtgatcggtaacataacaatgtgcatagctgcgtaccgcatctacaaagggtcccaagaaagcactaacagcaacagtccataacctgtgtatgcactctttctccgaacatctgtctgtccgggtgggaagcttcagcttctttttccttccttactaaagagtatttcttcctgtaagaaaaaaaaaaaa

SEQ ID NO: 22089 - DNA, 784 bp, Triticum aestivum
  unsure (1)..(784): unsure at all n locations
  Clone ID: PAT_TA_22089
ctcaccctcccctcacacatacaacagagagcgcgtccgagcgaattcaagccaatggcgaccaagagccttcttctcgccgctctccttgtcctcgccatcagcctggcgccacacgggtgcggaaggcgggcaagcagcctccactggggactcgtcaccggcgtggtgccatgcagcgccggggaactccatcatcgcccggctgcggttccgcccttcccggaacgccgccgtccagatggggtgccgcccggatgtgatggcgagtaccagcggctgaccgcagcggaacgtacaccatcaacatgtggcccggccacctcgtccgctgctcgcccatctgctgcgggagccagtgcacgctggtgggtggcgcacccacctggtcggcggtccaacgcctcccgggccaccgtcacgcggacgctgaaccgtactgtgcaaactcccaagtgttgacagtggcagcggtagcggcagcagcggccccgggggccttggcgggcctaattggcctcatcggccagatcgtgggcggcctcctcgggggcatccttaacatcttccattgcccctcccccctcgtctagatgctcgactacaaccggcgtgtcgatcgacaatacgatgaacctaacttatactcctatactagtgtactcgccaacctaccaatgtttccaatggatcacagctcccatttttattagttaatttactaaaggcatgaatacgcttccagcaccaaaatagcctacccctgccttcgcgtanaaccccg

SEQ ID NO: 22090 - DNA, 549 bp, Triticum aestivum
  unsure (1)..(549): unsure at all n locations
  Clone ID: PAT_TA_22090
ggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaaggaaggcctgaggggctgaagttgaaccatgagtgccgtcgcggtttccgtccgtccgctgaacccgaaacgccgccgctcttcatccccggcggcgctgctgcaaggtggaggactctcgccgcantngtgggactcataacacaacgnctggttccgcaacaatggtcccgccaanaagccactggacaaannaccaacaatccantttgncncccccttgctacaatangatnagacctttacgnanaaagcccgccgcgccgccttaaanaattcgggtcaanggctnatnggttccnaaaaanggaaaccccgggggttccgganaacaagaancagaaccacaatnnccggaaccaaaaaa

SEQ ID NO: 22091 - DNA, 1793 bp, Triticum aestivum
  Clone ID: PAT_TA_22091
aactcagaagcacgcgcgacaccaccctgtccgctcccctcctcttcctcggccctcgcttcgttctccgcgggagccggcgagccgccgccccactctctctctccccccgtccaccgcacgcctccgccacgccaatcccatatgcccttctccggcgaaggcaacagagcatgattttgtgggaaggttgaatggcggtgagttgagggatgtacgagccggggttaataataaattgttcaagaggcgtgccatggccgagctggatgccgttgagaatgttgccgatgctatggccgcggtgacgccacagagggggtcgagcccggagttgccttcaggtgcaagaggcgcgcaggggaccagcgtgaagagcatgccatcagaggccagccgagcacatgaggggtgagagacaggcacgaaggaggcacgaagagaagagaggacacaccagcaagggtcgacaaccgagcaagatcaggaaaccgaagggaacggcaagaaaggcccatagccaagcagagctaagggtgcccaagaagggcaagcaatggacgagcaggcatcggtcctcctaccaccatgctccccaagtcctacgatcctgtgctggctcatgcacaggctctctggccttgtggcatcctgggctctattaggatagatcaggaaagattccggttcgtcggaaaccaacggtcgtatcattgttcgttgaggctaaacatagtgagttgcgtaaagttcataatcgttcacaagggcccagtgcccgtgtgcaacatcaaaaaggtttaaccagttttagatcgctaccgctaaggtccggcagcacccctgcctacggattcagtttcaagtgtgatgagagagctgaaaaaagaagagagttctactcaaagcttgaggagaagattcacgcaggtagaagatggaaataagcaatatgcaagcgaaatcgaaggagactgaagaagctgaactcaaaatgctgagaaaaagcttaaagttcaaggctacaccgatgccaagcttgcccccaccccccccgcctccactggttgagctgcctcccactagagctaaatcaccaaagctcggccgttccaagaacaaatctgggctagaggctgaagaaagtaccaccccaggccatcctatccgtatgagccttgatgagaaggctattcaaaatggtgcgaagaaagtaaccccatcaaactcggtgaagaagccccagaggaagtcactccccaagcactcccgaaagtcccatcagccacaagaggccccacagccacaaagcacggaggacctcaacgcaggtaataaacaggagtcagggtctccggcaaagcagcttcaggaaaccgagccgaaggaaagcaacgcccaggagccgatccgacctgaggttaccccggacgacgttgaactcgacgaacaggcatccgtgtagcaacgaccatggtggcaacggccttggattttgtgatggcgggtgtgcatgcctctggctttgtcgcgtattgcgccatatttcgatagggcatctagcggccgtgtgttctgtaaaccaacgcttgtactcgtctagcatctgtgttgcttctgttcataatcgtaagcgaggcttcagtattgtgtgcaatcgtaagcgaggctccagtgtcgtgcgcctccgcctattggttcgccctgttttctactgctgctgctattggtccagatgaactttgtctccccgctttgatttatagtgctgcgatggcgacggtgtaaacact

SEQ ID NO: 22092 - DNA, 616 bp, Triticum aestivum
  unsure (1)..(616): unsure at all n locations
  Clone ID: PAT_TA_22092
aggaacacaatggttctcttggattcatttggacgacctggtggatctcatctacgagtccctgcggaacccggcctacacgggcatcatcaacggcacggcgcccaacccggtgcggctgtcggagctgtgcgaccggctggggcaggtggtggggcgcccgtcctggctgccggtgccggggctggccatcaaggctctgctggggagaaggcgcgacggtggtgctgggatggtcagaaggtgctcccggccaaggccacccaagctcggcttctcctaccgctacccctacgtccgagatgcgctcaaggccatcgccaaacaactctagctacctctatatataactgcatgcatgctcctattaatatttcctttctttctatctactagtccttttccttaatttccttcccatattatacatgtaatatactacccctccgttcaattttataagacttgnaaacaaggggggcccgtaccaattcgccctatatgagcctaataccgcgctcactggcgtcgtttacaactctnacgggaaaacctgggttaccaactaatcccttcagaatccccttncaactgggtatacaanagcccacgtncc

SEQ ID NO: 22093 - DNA, 741 bp, Triticum aestivum
  unsure (1)..(741): unsure at all n locations
  Clone ID: PAT_TA_22093
cccacgcgtccgcccacgcgtccgcccgagcgcgcgcggcaaagaggatgcagctgcgctccctcccgttcgccgcgagcgccgtggccggaaggagcttccttgccgctattcctcggccggtgacggagagaaggaagcagatatgttgcaacgcgggcaactcctcgtcggagaaggagggcagcgagcttagcacggcggaagaggcgctgcggcggctggcggagctcgacgcccagctggaggggctgaaggagcccaagatgaggccgccgccgccccctcctcccccggatcctttcatggaccgcgatatgataatacagcgaggacgcccaagtgatgagctcccagaaatgaccccggcctacgtgacgttctcgactctggcaatttttatcttgaccatcttcaccaacgtggtgttcaacgtgtacatcaagccttccgtggacggcgccgatcggccggtaagaatccagagagtgcctctggctgatcctagcttccagcagcccggcaattctagtggtagctcgtagacatatatgcacgacacgataatacagtttgatagatacagtggggaagggctgtgctttgcaagttaactcaatcatgtgcctcatatttgcatcatgatgatgtatttaacacaataacacccacatgctccaaacgactatgttttgccnggctcccacattgagggttcattaagggaacaaggtgctgcac

SEQ ID NO: 22094 - DNA, 501 bp, Triticum aestivum
  unsure (1)..(501): unsure at all n locations
  Clone ID: PAT_TA_22094
tccattcgcattggtctgaatactgtacctactagcgcgagtgccactgtgccgcagctgcctgctcgccattactgcaagctgtgttcaatcaaagcttaattaggctccctctacatctgatccagctaagtagctagccagcactacaagaagggcgtggcaagaatcaggagagagatagcaggggggctagctagctgagctcgtgcgacgaagaatggccggaattggcaggaacatgggtggcgccgctcctgggtgctcaacctcatcatgtacatcatccgtcatcggcttcgccgagctgggaacctgaaccacttcatcaacgggcaagaccaaactaccccggcgtgggccggcaacggcgccgacgttctacttcctgggtgttccgccaatcctggccggcggggtggggcgccggcgtccaagctggcgggcgtgcaccacttccccgcctggcgccacgacagcctgnncaccaacgccgcgtct

SEQ ID NO: 22095 - DNA, 587 bp, Triticum aestivum
  unsure (1)..(587): unsure at all n locations
  Clone ID: PAT_TA_22095
caacgacatcttctccgcgcccacggccatggcgtctctctaccactcctccctcccgctctccccgccgtcctccagctgccatggtgtcctctccttggcccctcgaaccgcggcgcccttcgtctgcctctgcagagcgccaccgcaagacgaccacgacgcggagctcctcggcgcgctccagtccaacggcaacggcagcctcctcagagaacaacatcccgcgtcagccaaagttctagagtcggcctctgcggaattgggtgacggcggcggcgggaggaggagctctcaggctcagctccgggcgcgtgactgcgcgaggcggtcatgacctccccatggaggagcggtgaaggtgctcgactcctgcagcgcgacgaacggcgtcacatctctgactacaacgacattatctccgcgctggcgaagggcggggattacgatcgcggtcgcgctctcanggcgctcgagccaacgctcgttcgccgganccatcttcgcatcgcgtgagtgctctgangaaggccgccgacaggaaagagacctgacanatgtggtccggtactccacttgcgcctctc

SEQ ID NO: 22096 - DNA, 560 bp, Triticum aestivum
  unsure (1)..(560): unsure at all n locations
  Clone ID: PAT_TA_22096
gaaacaacagcattttacaaattttgtccaggttgtgtctttcaaagacgcaacctggacaaaatttgtaaaatgctgttgtttcaacactgagataatcacagcaaaagacaggcattacatgcacgataatacagcattatcaatactaaaaaagtaagtagcacgcaacaaatactaaaaaaataatactcttaaaagtaagtagcacgcaacaaatactaaaaaaaataacagaaaactcagctagtaagagcctgggaaagaatctgcaatgggtgtcatggggatagttggtcttctccggcgaggttatacccctctgccgtaggcttggttctagggtagcagccctaaggcgcttgagagggtcattgcaagagagagaaattggtttgataatgatcttgcctggatttatcccctggctgcaatgcggctttataaatagcctatggctaaccaacttctcctacaaactctcaactaactcccactttcttggactactgatgctaccaatctcaacattctctcattcaatctatcncnacctanca

SEQ ID NO: 22097 - DNA, 468 bp, Triticum aestivum
  unsure (1)..(468): unsure at all n locations
  Clone ID: PAT_TA_22097
tgatactgacccttttggttgtagcataagctgctatttatcttgatctgttttatttgattaagatcagcgagcaagctgcggccttcttttgcttcgatccatctccacttgtttttttgctggctggagtttcttttaattgtttgcttagctctgcagcttcgatttgttccgaaactttgttgatctatctgtgctgttgttgctcaagatcaagctcgcaaggaactaacacactttattttttagatcttaagaattctgactccatatcttggatctccgatggcttgcacgcccgtactacaacacctgcacagcccgccacgccacgaaagaacgccccgtcattcccgcgacccccggcgccaccccaggctccgcgcgccaaggagccacagccacacaagatggccgtcgctcctgaacctcccgaagaaggtggcgccggggantggactgang

SEQ ID NO: 22098 - DNA, 639 bp, Triticum aestivum
  unsure (1)..(639): unsure at all n locations
  Clone ID: PAT_TA_22098
ctcgtgccgtggcggccgacctcggggtggagccggaggcgctgcaggacgccttcacggggaagcggcagagcatggcggtccaccactacccgccctgccgccagcgggagaaggtgatgggcatcacgccgcacacggacgggctgggcctcacgctgctgctgcacgtggacgacacgcccggcctgcagatccgcaggggcggcaggtggttccccgtgcgcccgctgccgggcgccttcgtcgtcaacgtcgccgacatcctggacgtgctcaccaacggcgcctacaccagcgtccgagcaccgggtgctcccggacgccgagagggcccggaccaccgtcgtccgtgttccaaggaggctccgtccgggggcctggtggcgccgctgccggggctcctcgaccaccaaggcgcgcgcgcgcgctacaagtccattgaaatcgaggatacatcaagggcaacttaaaacccctgggacaaaggacacggttcatcaaagtcctcaaggatatagcatctagtgctccnttcatccaaaaatattgccccccatcgattaatcatcatctaatctcacaatatatcatatctcgtactatataaagagatgtacttctctcaaaaaaaaaaaa

SEQ ID NO: 22099 - DNA, 502 bp, Triticum aestivum
  unsure (1)..(502): unsure at all n locations
  Clone ID: PAT_TA_22099
acaccgccgacactcatctgatcacccactagctagctagcagcttaaggaacttccagctagcgatcgatggctcgtctcaacagcaaggctgtggtgtccgccgtggtcctggcggcggtggtgctaatgatggcgccaaagggaaggcgacggcactgtcgtgcgggcaggtggactccaagctccgcgccgtgcgtgtcctactgaccngggggaaaggcgccctccgatttagcaaggagtgctgctccggtgtgcaaggggctgaaacggcctggcccgcagcagccccggaccgcaaagatagcgtgcaagtgcctcaaagacctccgccaacaagcatcaattccatcaacatggccaagtctcccggcgttcccggcaattcngcgtcaagcctgcccttccccatcaacaatttccacaaactgcaacaatgtcaactaattcaatatataaccttcccgaacttcatccaaggaccccgtttgttggacta

SEQ ID NO: 22100 - DNA, 654 bp, Triticum aestivum
  unsure (1)..(654): unsure at all n locations
  Clone ID: PAT_TA_22100
ccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctccgacctgacctgtcagactgttgctgacatgattcaagggcagacacaccagaagaatttcgcaagacttcaacatcaagaatgacttcacccttgangaggaagaggaaattccgcanggagaaccantggccttccaataaggaagtctggntntat

SEQ ID NO: 22101 - DNA, 534 bp, Triticum aestivum
  unsure (1)..(534): unsure at all n locations
  Clone ID: PAT_TA_22101
caactgtgctactgtaggagctgctgcaatcggggagagaaacgcgaccagtttgccggcaccaacacggcctgctgccacatctccggcatcttcttccgttgttctttcaggtgcgccaaataacccctcctcttttctgactgctagtcagggttggggactgaaaactgtcgctgttagttggggttggggactctttcaggctgcagcaagcaactgggacgatggtggcttccaaggcagtcagagaacaatgcacaagaagaagcatcaccattgacgacccctaacgnccaacatacccaggttcatcccttcgctgccccccgagaccaggtggccaccgttccctctccgaacggtacgccaatttttggctgcccgaggtaacattgaagggaaggcgtccccggcgttcatcccggcttccagccgagaccaacgacgtgttcctcgcaagcttcccaagtctggcacacctggctcaanggcctcgccttcgcgacctgaagcgttcangcatccgccgtn

SEQ ID NO: 22102 - DNA, 333 bp, Triticum aestivum
  unsure (1)..(333): unsure at all n locations
  Clone ID: PAT_TA_22102
ttcctctgccactccctcgccatctgcttcctcaaccaggccagcttcctcatcaacacctcggcctgcctcttctcctcctccgccgactccgacgccgccgtcctcggcctcccgctgccgcccaccagggactacatcggcgacgtcctgggagcgcggcttcaccctcaacctcgtcggcaacaggctcttctacgcccggggtgccctcctggtnctggttcttcggccggttctncgctttcctgntctccaagggncnatggcccccaaantccaaaagctccaangttcntcaaactncattgggcaaaaanngatncgttctcc

SEQ ID NO: 22103 - DNA, 569 bp, Triticum aestivum
  unsure (1)..(569): unsure at all n locations
  Clone ID: PAT_TA_22103
gttaaacacaagtgcctgctcacaattagcagtgtacgtagttgacaccacacagctgcgccattaacatatagcaggcctagcagtgccgttctggaaagggcgggagaggggatgaggaccgagaggtggcagcggattcgccggcctgcaggtggcgtgcgtcgtcgccgccctgtgcctgctcctgccgacggggagccgcgcccaactgcaggtggggttctacaacacctcctgccccaacgccgaggcgctcgtgcgtcaggtcgtcacggctgctttcgccaacaactccggcgtcgcacccgggctcatccgcctccatttccatgactgcttcgtcaggggttgcgatgcctcccgtgctcctgtccgtgaaccccgccgggcggcaaaacggagcgtgagcccccggcaacgacccgagctgcgccgcttccacgtgatngacgccgccagcgccgccggcggactgccangcacgtgtctncgccnantctcgcgttcgcggccgcgaaacgtcaccttacggnaactctctcnantgcaacggnngggggaggcgc

SEQ ID NO: 22104 - DNA, 598 bp, Triticum aestivum
  unsure (1)..(598): unsure at all n locations
  Clone ID: PAT_TA_22104
gctggacggagtcttcgcgttcgtgctctacgacacgcgagacaggacctacgtggcggcacgcgacgccatcggcgtcaacccgctctacatcggctggggcagcgacggttccgtctggatgtcgtccgagatgaaggcgctgaacgaggactgcgtgcgcttcgagatcttcccgccggggcacctctactccagcgccgccggcgggttccgccggtggtacaccccgcactgggttccaaggagcaggtgccccggaacgccgttaccaagccgctccgtccttaagagaggcttccgagaaggcgggttatcaaagaggtcatgaccgactcccgtttcggggcctcctctcccggcggctcgatcctcccttcgtcgcctccgttaacaaagcgccacttcgtccaagaccgacgccgccggaaanttcgggacagactccatccttcgtcgtccgctccagaggtcccctgactgaaggccgcacgagagtccctgatactcgggacaccaccagattcctttnaacgtnnaagacggacnagcattaagagtgattacacacagactagactgacacatcggcagaccc

SEQ ID NO: 22105 - DNA, 517 bp, Triticum aestivum
  unsure (1)..(517): unsure at all n locations
  Clone ID: PAT_TA_22105
gtgctgtgcacgccaaccacaactgaaagggagagccgaagagggaagggggagaagcgaccgcgccgccaaaccctagccccgcgcaagcgaccgtgggggagctccactccgccgcgccgccccccgtccccgtttcgcgacatggccgattccccgcgcaggaggtactcaaggtccccttcatacagcagggggcacccaaaagggaggtcaagatcacaatctccaagctcggtctcagtctaggtcacctgtccctgatcctagatctcaggcgaggtcaanatctagacaananccaatgganggaaggatgctgttaaccgtnggaatactctgtatgtgactgggctctcttccagggttactgaaanggatgttcnngattatttttctaagcatggcagggtggttggttgccatgttgttcttgaacccatacacgtgtttccgtggtttgccttngtcaacatggcactgttnaanaagcggccnttgcataaatatcttattg

SEQ ID NO: 22106 - DNA, 690 bp, Triticum aestivum
  unsure (1)..(690): unsure at all n locations
  Clone ID: PAT_TA_22106
gccggccgggtctcgacgccgaatcccgatatttatttttcttgcgttcctgtccccaggcttggagttatttcctggtctggtgctcgctcgtctcgcgcggcggcggcggagggtttgtgtcggcgctcttgcgagctagggtttcgggtcgaggaagagcgagatggaggaggtgacggagggggtcaagaacctggccgtgacggagccgcacaagaagaaccggatccaggtctccaacacgaagaagccgctcttcttctatgtcaacctcgccaagaggtacatgcagatgcataacgaggtggaactctccgccctcggcatggctatcgccactgtggtgacagttgccgaaattcttaaaaataacggccttgctgttgaaaagaagatcatgacatccactgttgatgtcaatgatgaatcaaggggccgccccatgcagaaggccaagattgagatagtgctgggcaagactgagaacttcgacgagctgatggctgctgccgcggagngagagggaagtcgcagctgccgaggacggcgaggagcagggctaataaactaattttgagtcggttgttgtagcttttatttagacttgctgnctaggttgtgtgttatcttctcttggccagcaagagatagctacttgtgtaaccaaagttcttcgtattggattcg

SEQ ID NO: 22107 - DNA, 1169 bp, Triticum aestivum
  unsure (1)..(1169): unsure at all n locations
  Clone ID: PAT_TA_22107
cccacgcgtccgcccacacttccgcccacgatttatttttcttgcgatatttatttttcttttgttcttgtctccaggtctcgagctctttcgttggtctggtgctcgggcggcggcggtgtcgcggggcggttgcggtcggcgctctcgggagctagggtttcgggacggggagggggacgagggagatcgagaaggtgacggagggggtcaggaacatggccgtcacggagccgcacaagaagaaccggatccaggtctccaacacgaagaagccgctcttcttctatgtcaacctcgccaagaggtacatgcagatgcataacgaggtggaactctccgctctcggcatggctatcgccactgtggtgacagttgccgaaattctgaaaaataatggccttgctgttgaaaagaaaatcatgacatccactgttgatgtcaatgatgaatcaaggggccgcccgatgcagaaggctaagattgaaatagtgctgggcaagacggagaacttcgacgagctgatggccgccgccgcggaggagagggaagtcgcagccgccgaggagggcgaggagcagggctaataaactgtcttgagccggctgttgtagcttttatttagtacttgctgctaggttgtgtgttatcttctcttggccagcaagagataggtacttgtgtaaccaaagagttctttgtatttgtttcgtctccgtggtagtttaatgtcgatggtattctggttcactcaaatgatatgccttgtgttttattcgttttattatgtggtatatgctcgttgttaaccttgttttgnnnnnnnnnnnnnnnnnnnnnnnnnnnnnnnaaaaaacttnngggggggcccggnncccaattncccttanggggnnnnttacaattnntnggccnnnttttaancnnnnnantgggaaaaccttggggttcccaanttaanncctttgnnaaaaacccctttttcccanntggggnannnncnaaaaggncccnccnnnngncnttttcaaaantnnnnnnnccnaannggnaaagggnaanttnnnnnnnnaaaatttnnnnaaaannnnnnaaaantttnnnaaaanncncctttttttnnccnaaggnnnnaannngnnaaaccctttnnnnnnnnnaaanncccc

SEQ ID NO: 22108 - DNA, 611 bp, Triticum aestivum
  unsure (1)..(611): unsure at all n locations
  Clone ID: PAT_TA_22108
gttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggatgttctccctgggatcattaaccaagcttggccctgacaacatggagcacctgaagaggattgccgaggagatgcagaagcaagtggctgctgccgggtgcggcacacaagtcaaggaagacaacgatgacgatgtccaagagcttgttcctggagagactttgaagaataactcaaggggccaaagcctgatatagctcnaaatagtaaatgtactgcacaatgctgtaggcatggtttnttgatgg

SEQ ID NO: 22109 - DNA, 346 bp, Triticum aestivum
  unsure (1)..(346): unsure at all n locations
  Clone ID: PAT_TA_22109
tacaaatctaccccaaagccttctcaaggaatataagaataagatcagatggcgaaaacatgcgaggattgtaaaggttcgggacgcaagggaacccttatttgtgcaacatgcaatggaaaaggttaacaacattaacttccaggaagatcgcagcgtcctcctgggaacgtcattttctgtggttactactgtctccgcaacgcgatgaccccgggtctttcagctaaattcaaggggtctatcaaatacttgtgttatagcgatcgaatcacgggacttatatatatgtcgccacttgttcacgattgaatatcaaactccgttactacctagaaaaaaaaan

SEQ ID NO: 22110 - DNA, 2081 bp, Triticum aestivum
  Clone ID: PAT_TA_22110
ctcgtcactagtgattcgcgcgggcgcggccaaccagcgacagccgcccctggacaaccagcggcagccgccacttcgtccagctccggccccgggaggatcgcttcgctgccaaatcgctcgtcgacggcgggatgggggaggcgtcatctccggcgatcgccaaggatgtcaccgagctgatcgggaacacgccgctggtgtacctcaacaaggtgaccgacgggtgcgtggggcgcgtcgccgccaagctcgagtccatggagccctgctccagcgtcaaggacaggattgggtacagcatgatcaccgacgcggaggagaaggggttcatcgtcccaggcaagagtgtcctgattgagccaaccagtggcaacacaggcattgggctggccttcatggctgctgccaagggttacagacttgtactcacaatgcccgcatccatgagtatggagaggagaatcatcttgaaggcttttggtgctgagctggtcctcaccgacccactcttgggaatgaaaggagctgtccaaaaggcggaagagctggcagcaaagacacctaactcatacatccttcagcagttcgagaatgctgccaacccaaagattcactacgagacaactgggcctgaaatctggaaaggcacaggaggaaagatcgatggccttgtttctggcatcgggacaggtggtaccattactggatctggaaaatacctcaaagagcaaaatcctaacatcaagctctacggtgtggagcctaccgagagtgctgtcttaaatggtggaaagcctggaccacacaagatccaaggaattggagctggttttatccctggtgtcttggatgttgacatcattgatgaaaccatacaggtttcaagtgatgagtccattgagatggcaaagtctctggcattgaaagaaggattgctggttgggatctcttctggtgctgctgcagcagctgcaatcaaggttgctcagaggcctgaaaatgcagggaaactctttgttgttgtattcccaagcttcggagagcgctacctttcgtcggtgctcttccactccatcaagaaggaggccgagagcatggtggtcgagtgaccctcgggactcgtctcctcaagcgcgcgaagctgttctccaaagccaaatccctccattcgtaggagccctcctctacaagaaataaaagctttggcgtccctgctagtgttggtctgacatcaaagccctgtcaagctttaatcccactttgtgtagcaatggggaatacttttgtgttggccttgtggtgtttagcagtttgaattacttcttgcctgccctgtatattgaactattcctctgtggtccatatgtcagccagtgtgaaataaagcatcatggtgcccttacaggagcaaaacgagagtgctatcttaaatggtggaaagcctggaccacacaagatccaaggaattggagctggttttatccctggtgtcttggatgttgacatcattgatgaaaccatacaggtttcaagtgatgagtccattgagatggcaaagtctctggcattgaaagaaggattgctggttggaatctcttctggtgctgctgcagcagctgcaatcaaggttgctcagaggcctgaaaatgcagggaaactctttgttgttgtattcccaagcttcggagagcgctacctttcgtcggtgctcttccactccatcaagaaggaggccgagagcatggtggtcgagtgactctcgggactcctcaagcgcgcgaagctgttctccaaagccaaatccctacattcgtaggagccctcctacagaaataaaagctttggcgtccctgctagtgttggtctgacatcaagtcctgtcaagttttaatcccactttgtttagcaatggggaatacttttgtgttggccttgtggtgtttagcgatttgaattacctcttgcatgccctgtatattgaactcctctgtggtccatatgtcagccagtgtgaaatgaaacatcatggtgccatacaaataaaaaaatatacagataggtttccctcaaaaaaaaaa

SEQ ID NO: 22111 - DNA, 625 bp, Triticum aestivum
  unsure (1)..(625): unsure at all n locations
  Clone ID: PAT_TA_22111
gtccatcgacccacccaacctcctcctccgccccgcgcttcgcctgggtaccggcgtccgccgcgccccgtaccgtctcgtccaggaacaggaagagcagtaacccatccacccatccatcggggatcaccaggggtcaggggagcaagatgtcgactgccaccgccccaagattgcccgctcccagatccggggcaagctatcactatcagacgaccgcggctccggcggccaacaccctctccttcgccggccacgcgaggcaggcggcccgcgcgtccggggccacggctgtccagcaggttcgtggcgtccgcggcggccgtgctgcacaaggtgaagctggtcggcccggacgggacggagcacgattcgaaggccccgacgacacctacatcctcgaaggcggccgagaccgccgggtgggagctgccttctccctgccgcgccgggtcccggctcctccgcccccggaggatgtcngccggcaagtcaacaatccgaggggtcttcctcaanaanggcaaatgccaagggtactcctaactcattctacccangaaanggtatcaaaccacaggggaggctgtcnaagatggttcttacacatgtgtcaaagnggggn

SEQ ID NO: 22112 - DNA, 517 bp, Triticum aestivum
  unsure (1)..(517): unsure at all n locations
  Clone ID: PAT_TA_22112
gagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttgggtggactacttggtgaagttccgatggatcctcgtgatcttcgtggtccttcctatttcaactctgatctacttcaacatcttcctgggcgacatgtggtccgccatgaagtcggagaaagaagcgccagaagcagcacgacgagaacgtgcagaaggtcgttgaagcggctcaagcagaggaacccgaagaaggacggtcttgtttgcacggccaaggaagcctggatcgctgttggcatgcgcaacgtggactacaaagcgtgcgaggatttcgaggtcgactttctcccttcangaaatccttgagatcgacaaaggagaggatggtt

SEQ ID NO: 22113 - DNA, 582 bp, Triticum aestivum
  unsure (1)..(582): unsure at all n locations
  Clone ID: PAT_TA_22113
ggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactgggcaagacaatcacccttgaggtggagtcctcaagacaccattgacaatgtcaaggcaaagattcaaggacaaggagggcatcccacctgaacagcaacgtctcatctttgccggcaagcagttggaggatgggaagaccttgctgactacaacatccaagaaggggagcaacctccacttggtgctgctctaagggtggatgcagtcttgtgaaaacctactggaagacatcaccctgaggnggagtctcag

SEQ ID NO: 22114 - DNA, 464 bp, Triticum aestivum
  Clone ID: PAT_TA_22114
gggccagagaggcatatatctcaccaagatggatcgtaaaacggaccaagaataatccaccttggtcgtacaacctctctcttgttgttggtcaaagtgatggccgtccatgcgaccccggagatgggctagctcgccaataatcacgcaagtagctagtccccgaagacaaccacttcatgcgtgtggcccaaacatatgtatggagaggtgtgtttttgagtaacaatggaacaactttgatgtggcaccatgatttcaaactagaaatccccacacagagtgagggttaggttgacgatgcatatgtatgttacaccacacttcaagccaacgacggggattcatgcatgcatgcgtgcatagtatatgcggtcaaacttaataggtttgaatctcaccatgacctatactacgataacacgaaccaaatgaagaatccgccatggttacctatcttgttg

SEQ ID NO: 22115 - DNA, 743 bp, Triticum aestivum
  Clone ID: PAT_TA_22115
cacaaatcgagttgttggaacatatggatacatggcaccagaatatgctctacgtgggcagtattctataaagtcggacatatatagctttggtgtgttgatgttggagatcctcacaggaaggaaaaatagtgactcctacaattctgaccaatccgttgatttgccgagtctcatatgggaacactggacaatgaaatcagttatggagatgatggacccatacatgagtggcgattcctcgcaggacgagattttgagatgtgttcacattggactatcatgcgttcaggaagaccctgctgacaggccaactatatcaacgatcaatatcatgctggatagcaacacggtcccatctcaacctccattgaagccggcattctacgttagagatgggtggcgacattgtctcaagacatgttattcccaatcatacccaaggaggtgtcaatgatccaacatccaagtccgaatgcgatgtcaccaaatggagatgtccgataacagttccagaaccggggggagtttcgaaataatgaacaagaacaagtttcctattgctgctgtagggaaaccaaaatcttcatcgtctactgagtcagacaatggtatttttgtgtatgcatttggtatggttgaacttacgtatgtacttgtacaagccgtaagatggatcactcttctcgactgcccagaggggcattgtatgggtaataattgagtaacaaacatagaattca

SEQ ID NO: 22116 - DNA, 583 bp, Triticum aestivum
  unsure (1)..(583): unsure at all n locations
  Clone ID: PAT_TA_22116
cccaatcctgccacagctgccctccctcctcccctctgggcgtggccgagttgtaggcatcacggctagcgttgcagccccccggcgcggccccgcagctgcgcaggtggagcccacgggcaccatcgcctccgctgtcgcgtccagccccgctccgcacggcggccgcggggcgctgccctcggccggaggaagcccgtccgatctcctcttcctcgccggcggcggtcgcctctgagccgttcctgtctctcaccttcttcctttcctagcaattagtcccttctgctaacccccccggaccccgacgagttctcaccccgagagtaactgaccgacctaccggcatggagatgaagctgaccatcaggagggtgcccaccgtcgtctccaactaccaggaggacgccgacaagccgcgcgcgggctgcgggaggaactgcctcggcgactgctgcctgcctgcttccaagcttcccctctacgcgttcaagttgactccggcaaagggctcgcaggaggatgctgcttcaaccaagttacttgttgatattctccttaatgagtngggaggagggggggg

SEQ ID NO: 22117 - DNA, 519 bp, Triticum aestivum
  unsure (1)..(519): unsure at all n locations
  Clone ID: PAT_TA_22117
cttcgcaggcttccaaggaagagatcggcgaattccttctcgaaggcggaaatggtggttcgggggatgaggccacgatcgccgcggcagcgggattcatggcgaagaagcacgtgctcttgcttcacgccgggggcgacagcaagagggttccgtgggcgaaccccatggggaaggcgtttctccctctgccttacctggccggggacaatcccgatggacctgttccgctcctgttcgatcacattcttgccatctcctccagtgcaaggcaagctttcaacaaccaaggttgtagcccaagacaaaattgactgatcagtgcacttatacaatgcccaaagaaaaagaagggactgccacatctgtttccgtttcaaattgcccgtagatgacaagtgggatcttcataatgaccggggatgctccccccgtgcgccgctgcctccctcctgtctctccctggcatggccgcgcctactgtcccggtgccgcactctaggatggtntancacaaag

SEQ ID NO: 22118 - DNA, 538 bp, Triticum aestivum
  Clone ID: PAT_TA_22118
gtccacagccaccaagatcgccgcgctctctccaacatctcctgaccaaagcgaatccagcatcaccggggtccaggaggcagcatggctgacgaccagcagccaccggcgcaacggtactggttcccgtactggacctcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccaagaggcgctggcggtggtgtccctgatccacctgcccagccgcagcccacgcggctgtccagcaggccatcgccgtcgccttcccgcgctcagccactgtcgcccattagagagccaacgcttcaacggcaccggttgccaaagagcacaagcagcttctcctcttcatcataccgagcatggtgttcctaagcaaaaagacatcaccgttccgcaaagagaaaacatccatgaacgcttgtacatccaagacacaaacaaagacca

SEQ ID NO: 22119 - DNA, 657 bp, Triticum aestivum
  Clone ID: PAT_TA_22119
cggacgcgtggggctcgattcagaagctagggtttggggagggcagcggaagcgggtaccagccggcggcgatggcttcggaggaggatgtggcggtgaaggagccgctggatctcatacggctcagcctcgacgagcgcatctacgtcaagctccgctccgaccgcgagctccgcggcaagctccatgcgtatgatcaacatctcaatatgatacttggagatgtagaagagatagtgacttccattgaaattgacgatgagacttatgaggagattgttcgtactagcaagcgcaccatcccctacctttttgtccgaggagatggcgtgatactggtttcgccgcccttgcggaccgtctgatggcgtgatactggtttcgccgcccttggagaccgtctgaagtcagggcggaacaactaccattcaatgggcattggcagcagggctatccggatgacttgcatcagcttatacatgattcctggagcattgctggctcgcgagacaccgcgtagcttgagttaatcacccatgtatcctgatacaaagaacaaacaaacacagaactcgacttgtgttatgtagatccatctgaatccggcacctgttcgtccattagaccatatcaccacagtggagggaagcttcagtt

SEQ ID NO: 22120 - DNA, 807 bp, Triticum aestivum
  unsure (1)..(807): unsure at all n locations
  Clone ID: PAT_TA_22120
gcgcgcataaccggcatccagctcgagacggaaggtagggtcgggggcgccggcttggcaaggtcgaatgggtcggcgggaagttcgggttaggttgttggggcggacggggcgccggtagatgccgtggggagtggcgtcggccggcgaggagatagccgtggaggagccgctgggcccggctacgcccagcctcgacaagcgcatctacgtcaagctccggtccgaccgggagctccgcggcaagctccatgcatatgatcaggcatttgaacataagcctagggagatgttagaagagattgcaacaactgttgagattcggcggaagaagcatatgaagaaattgtgcccacacccaggcgttccatcccctgcctttttgtgtcctgaggcgatggtgtcatattggtctcgcccgcctctgcgaacggcgtgagccatgaagtttgacgggggatcctgctgattggtcgactatgagtagtgtgcgtttggttagcagatgacatgggtatgtctgtcatctgctgcagtatcactgttggactgtagggtttttagcctgtgatgatacaattgtgtaacaactccctgtgtttggaactcgtctgactgaggtgcccgtttcttctatgcaatgtcaaactaatatattggtgtgttttttccgggtctcgcgcaattatgttctgctccgaatcctatccccaacaagcgtgtatgcgtaacattattatcggaagaaaatagacttggtgcagaggtttgtaacattattatcggaagaaaatagattngtgcaga

SEQ ID NO: 22121 - DNA, 501 bp, Triticum aestivum
  Clone ID: PAT_TA_22121
tgtggcattcctttacatgaggcagaagcaaactcgtgttgcctccaatgaaccagctgagcaggtggagcaagttgagcaggttgaacgagttgagcaggttgaacaagttgatcaggttgaaactctttctgactcaggaagtagccaggggcatgttgttgccaagggttcactgtttcacagtcctggcgtagaagcctctggcccctcacagtatagcagcagcttgtcatctgggcttggcaggaggaggaataccaagggtgaaggccttgagccagtagtgtcgaggagagactcgacagctcaatccacatcatcttatggtagtttcaccacataccaagaagatccctgccaagaaaggaaacaaggaggacgaagcgatgacccagtccgggcgctccagcaagctgaggaatgtgaaaactcctgaatcctaagattggcgcaagctggcatctgaactgccttttagattattagttaattgctatt

SEQ ID NO: 22122 - DNA, 356 bp, Triticum aestivum
  Clone ID: PAT_TA_22122
tcaccatcggcatcacagggaggatacatatgagagcagacactctcaccacagggatcgccgacgccatggtgaccggcatcgcaccaagagaagcgagagtcgagattacagggactaggcaactctcactcgcaccacagggatccccgacgccatggtgaccggcatcacaccaagagaagtgagggtcgagattacactctccagtttcctaagactacaatgtttcattatgtaaacttgattgtttttccgtactccttgatctagtaaggtttactgttgccctgtagtctcttccatgagaatgtattcctgtaccgaattttatatgtttggtttggggtgtggcc

SEQ ID NO: 22123 - DNA, 536 bp, Triticum aestivum
  unsure (1)..(536): unsure at all n locations
  Clone ID: PAT_TA_22123
ccgcaaagctgcttcccggactagctagggtttcgtctacgccgcttgatctagtcctctctcccggcacgcgaggtagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaagccgtccagcagtgggaggatgattgggatgacgatgacgtgaacgatgatttctcgctgcagcttaaggaagagctgggacggaagcaacggccagaagagctgaagtattatttctctactttatataaatgatttttatatggcagctacttttggaaccgttgatgtgctttgggatgtgaaagttttgggacatcaatccgcaatttgacaacactgtacgtgttagttgtccttaaggaatatgtctccaagccgaaacgctngaaccgccacatgtctacgcccaactgttctcttaaaagatgccgcactgntt

SEQ ID NO: 22124 - DNA, 540 bp, Triticum aestivum
  unsure (1)..(540): unsure at all n locations
  Clone ID: PAT_TA_22124
gtttcttgggcgccctgtgttcacgctgaccagacgttgtgccccctgtgttcgttctgccaagacgtcttggctgtttgatctgagctaccggtacgtcgtatttttcggttctggggtacttgttcccggtcgtgctcggctgtggggtttgcgctgccgatccagcagcgcgggggcgttggcccggggatctcgcctgctcccgccctccgcgccgcagggcgcgcccgccgcctcttctccgcgtggggctggcgccggcggctccggcctgtgttccctggggttgcgtccggcgtgtgccctggagggctccgggttcgcccgacgccccctcgcccctccggcgtgtggctgcgcatggtcgccttggctctgtccgttccttctcctcacctgctantccccctcccgtaaaagaattagggatctaaaaccncttaaattccttaanagngggagtaaaccaaactatctttgcccgaaattcattttttaaacagtaacnncctgtccnaaatacaccttgtggnggtg

SEQ ID NO: 22125 - DNA, 418 bp, Triticum aestivum
  Clone ID: PAT_TA_22125
gatacaagccatgcaaccaagaatggttagcgtggtcgcggccgaggtactttagccacgaagcatccaaggagaccattatcaccatatgcaaattaccctgacatgaacccgccatcatctccgacgccatccaagccagggaggtagaagaagcaatgtatagggcaataggacgccgaagactcaacgaagtcagagtcagccttttgcggaataaccattttgttattatacttaaatccatggatatagaggcgattgattgggatggtgatgcagaagaccgttgctgctaccatgaactatttgatgttatagcatggtgaattcttacattctatgtaaatttcgaacttcttcccagattgctgttcttattgtctgtacctgcccgggcggccgctcgaaaaaaacc

SEQ ID NO: 22126 - DNA, 643 bp, Triticum aestivum
  unsure (1)..(643): unsure at all n locations
  Clone ID: PAT_TA_22126
caccacccagcccatttctcgtccccaaaatttcgagtttcgaaaccaaaccaaacgaagcgacactgcacgtgtacgaacctacgacagctctctacttccctcgcgtcctctccatcgagagctgctcctgctcgtctcctcccacaccgcgcaattcgtcgggattcgggaaccctagcgccggatctccgcggcagcggcggaaatggcgaatcccctagcggggctgcaggaccacctcaagctcgcgcgggactacgcgctcgagggcctctacgacacctccatcatcttcttcgacggcgccatcgcccagatcaacaagcatctaactactttgggacgatgctctgattcgtacgaaatggatgaactgcaagaaagcaatctctgaagaagtggaaattgtgaaacagttggatgctcaattaaagtcccttaaagaagctcctgggacaaggcggtcatcatcaactcctattcggtctaataaatcatttgttttcaaccgttggatgagtatccaacatcttcaacagcacctttggatgattctgatgtggggctcccaccgggggacacacaaacccggaagacaacaagaggcaatctaatgcaaggatcctcccaagatggacng

SEQ ID NO: 22127 - DNA, 553 bp, Triticum aestivum
  unsure (1)..(553): unsure at all n locations
  Clone ID: PAT_TA_22127
cctgattctgctctactctactactctctctgtgctgtagcctaccgccaacagcccagtccagggaaacggttccttattgcttttttctcgtcaccaacttaggcaacgtaccctacagcctcatcgcacatttcgcccaaaaatgtccaccgcagttatctccgccgaggatgcccttgagccctctctacagtctctcctggaccagcgaagccttcgttggatctttgtcggcggcaagggcggtgtcggcaagaccacgacttcttgctccctcgcgattcagctcgccaaggttcgacgctctgttcttctcatctcgaccgatnccgcccataacctttcagatgctttctctcagaagtttgggcaaagaggccgccttgtcaacgggtttgacaacctgagtgccatggagatngacccgaatggcagcattcaggatatgctaacaggcaaggcgaaggcgatgatgtcaacgctgcggctggtggtctccgggagnatgatgcagatctggaatcgaatcctggtatcgacaggtagtctt

SEQ ID NO: 22128 - DNA, 1027 bp, Triticum aestivum
  Clone ID: PAT_TA_22128
ggtgctcttccgcgctctgctccctcggcttcttgagcaccgggtccgctgatctgggtccgccgagctggtggtggttgacccggcagtggtgctgtgcagtggcccaaggcaaagctacttccttttcaaggttcgaaagaagaggaaactccatcagattaccagattgtgccaggattcagggttcgcattatcccagtactgggaactatccctgcaatatttggtcaagttatggcctcctatgtggttactcagcttgcccagttagattttcaaactgaaccaattgttaacctggatttggatcattaccgcgttcttcaccatcgtcttcttgagcacgaggagctgatatatgggtcagccgagcaagttttggttgatgctgaagaggtgatgtacattgtgaaagaattgtggcgtggccgaagtgctagagaccaaaacatgaaggacactggccggaaaatgtggagatctgtcaatgaactgatgcttgttcggtgggacaaatcaaagtccgctggtgtgtcaaacttgatacttctcaagttcagtgaggcggatgcacatgaatccacgacgcttgatcagataaaagatgaagaacctgaattccatgccatggtttcacgtgtcctgaaacgagccgaaacggagtttgctttatgagctggtcagcaatggtattggatttctacaactgctataccgtcataacccgtgcaacgctcatggaccaggcaggtaggttactgttttgcgtcgtctgattttgtgtactagtgacaaggagcaagtagatgatgcacaatttcctgaagtttgttttggccatagaagtcggacttgctggtactgtttcgatttctctggaaagatcctcctgtaatcatctccccgggatttttggtgcgtttgagattatctcatgtagaccaaaacagagattatatcgagcatatgattcccaacaggggcttgcattcaaaaaaaaaaaaaaaaaaaaaaaaaaaaaaaa

SEQ ID NO: 22129 - DNA, 1190 bp, Triticum aestivum
  unsure (1)..(1190): unsure at all n locations
  Clone ID: PAT_TA_22129
ggcgttcctcttcctcttcccgaagctcccataccgccgcgcgctgtcgacctttcttcatcctcctcctcgcgaagctcccgtaccaacccgacctctggactcgacccccgcgggagcaacagctgtccaagaatccattccacccactgcgaagagcgagcgagagagagaggaagcggaagcaagaagatggggcaggcgctgcgcaggctcttcgactccttcttctccaccaaggagatgagggttgtgatgcttggtttggattcagctggcaaaacaacaatcttgtataggctgcacctgggggaggttcttcaaactgtgcctacagtaggttttaatgtcgagaaggttcagtacaagaatgtggcatttactgtgtgggatgttggtggacaagaaaagctcagacaattatggaggatgtacctcagcaattctgatgcactgatctatgttgtggattctttggacagagaaaggatcgaagatgccagacaagaattccagaccattatcagggaccctttgatggcaaacagcataatcttggtattagcaaacaaacaggacttgaaaggttcaatgagcccggaggaggtcattgaagggctgggcctgcatgatctcaagaacaggatatggcacatacaggggacgtgtgcgctccgcggcgagggcctctacgacgggctcgattggctggcgtccaccctgaagcagctgcaggagacgggtcatgctacttcaattgctggaccttctatctagcttcttcacagacagagaaaagtgaccttgcctcggccgcccgacgatccttgcctgacgcaacagccatccatctatccgttgatctgttcatctcacaagagcatgcccccatggtgcgcctgttctacctgtgtgtggcggccgcccatatggggctcgtctggcaggaacttatgcagtgtataacagatgggtgaacgataaacagcacctggcatgggaattgttgtatcttgtatgttgtgtatacctgagaggggccgcttggggcacacgattgctttgctcgattgcatactgatgaaaggaagaggagacgtttgggtatagtgtgctgaatgcttgtctgcagctcgcaacttcaatgattgcatttgtnagcttgagaatactaannnaaaaaaaaaaaa

SEQ ID NO: 22130 - DNA, 761 bp, Triticum aestivum
  Clone ID: PAT_TA_22130
ctaatagcccacgtccgcttgggtccttgagcatcgtattgctggttacggaggcgtacgtgtatgtggaggctgaaggtgtcggagggagcagcccatggctgcggtcggtgaacaacctcctcgggcggcaagtgtgggagttcgatcctgaactcggcacgccagaagagcgcgccgaggtggagaaggcacggcgggagttcgcggagcaccgcttcgagcgacagcattctagcgacctcctcatgcggatgcaggcgatggcggcgtcttcggtgtcgtttccttgttgaggcatcgttgttgcagtttgcgtcatcaagctagggatgattgggggaaaccctagatttgggtctcccgaaccagacgatgacgacgccgtcggtgtcgttcaccctcctgggggggctcattttggagcacgtgctggctggaggggactagggagtgcgatattccatctaccgtgaggccgacggcggatcctggtggcatggcgctgcggagcttcggcgacgggtgtgggctgatggatacgtgcagtattcagcttggatattcggcaccacttcataaagggcatatgagtagcgacaagtgttgccaagatgatggtttcaagcttactgatgtattattttgtaaggtctttgtgaataattaatgcaaaccctcagaaagtggaccttccagttgtcaagcttggggagcatgaagatgtcaccgaggaagccacatggagctctttgaaaagg

SEQ ID NO: 22131 - DNA, 1168 bp, Triticum aestivum
  unsure (1)..(1168): unsure at all n locations
  Clone ID: PAT_TA_22131
caagtctcctccctcctcaatcccctccgcctcaacacgcgacgaccccgctcgcgctaggttaccacctcccgtccacccccctcctctcgccatggccgccgccgacgagcaccacgaggaggccagccccctcctggccccgcccgccaacgagaagctccccccggcgcaggatcccgtcaagggctgcgccgacggggtccccgtcgtcatgggcgagccggtcaccgcccctgccggcgccgagccgcgtgaaagctgggactctgggatcctctcctgcctcggccgcaacgacgaattctgcagcagcgacctcgaagtctgccttcttggaagtgtagcgccatgtgttctgtatggtagcaatgttgagaggcttgcagcagcaccaggaacttttgcaaacagctgcttgccttacactggcctctatatgctcgggaactctctctttgggtggaactgcctagccccatggttctctcatcccactcgtacagctattcgtcgaagatacaatcttgagggtagctttgaggctttcactaggcaatgtgggtgctgcggtggccttgctgaggatgaggagaggcgtgagcacctggaggtcgcctgcgaccttgctacccactacttctgccacccttgcgccctctgccaggaggggcgcgagctgcgccgcagggttccccaccctggcttctatgggcgctccgtcgtcgtcatgatgccacccacggagcagactatggggcgcaccatgtgaactggtccagctcgtcccctgccctagctgttcttgtgcgctttgatgttgtgttgccctggatcttttcacctctcggtccgtaaatacagaataatgtcatgtgaacaatttgtaatgtgattatgtgaatctcaactgattctattcgttaccgactgctgctgtgtcttgtataaaaaaaaaaaaaaaaaaggaccctactggctgggccctcgaaccctggccgcgtccacgtgtagcgccaggtgttccctatggtagcaatgttgagaggcttgcagcagcaccaggaacttttgcaaacanctgcttgccttacactggcctctatatgctcgggaattctctctttgggtggaactacctagccccatggttctctcatccnactcg

SEQ ID NO: 22132 - DNA, 596 bp, Triticum aestivum
  unsure (1)..(596): unsure at all n locations
  Clone ID: PAT_TA_22132
cgatatgagttgtgacaagagaacctgggtcaacccttcgcatgaaaaaggggtccaagttgagtggacagcccaagcaagcaacgaactattcccagatctcaagctactggactcagaggcaaaaaaaaaggacccaaacagccaccaattttggacataatctggttattcaggtgggtgatcggctttagaaaactgatagtcaccaatgaaactcattttgatgaattatgggatcaacgcttgatatcgcaagtatgagaacagccgaagctcaaaatcgcctccctgggtgtttacaatcacaccctctttaaactgaaaacgcttacgctgcggcagagacaacgagacagagttccgttccatcacaaaagcccccctgactcgcacgcattccaatcccagcgccaagaagctgggaacacatccgtctcgtctcctcccggcacggggagagcagcaatcggttcagcaacgaatcgcggtggactgcacgctaaaacctagaaaccaagacgcgcggagccgcgtcccgcaggcagacncagagagacgcatcgttccgcaacagaatgagcaacgagcgacna

SEQ ID NO: 22133 - DNA, 508 bp, Triticum aestivum
  unsure (1)..(508): unsure at all n locations
  Clone ID: PAT_TA_22133
gtgacctaggagaagcctgcagatgcatccgtgatcttgggatgcccttcttcaaccatgaggtggtaaagaaggcactggtcatggcgatggagaagcagaatgacaccagcatcttggtcctgctgcaggagtgtttcggcgaggggctcataaccatcaaccagatgaccaaaggctttgcccgtgtcaaggaaggccttgatgatctgatcctcgacatcccaaatgcccaggagaagtttgggagagtatgtgggagctgggcaacagagcgcggctgggctgctgccgaccttcgcctccgttccctgagcatccaccactggcgataccttccttaagtgtacatttgtgcccatgaggccattacctccgttccaaattttcctatcccaanttaacttaggttacccgttccgcgggaggattgtaggatggatgttggttccggttgttnanataatgcccaatgggccaatccgggaanggtacttttgaanttaaa

SEQ ID NO: 22134 - DNA, 524 bp, Triticum aestivum
  unsure (1)..(524): unsure at all n locations
  Clone ID: PAT_TA_22134
naagtgtcgtggctcccgcccgccccgccggcccgggggatttgttttcgagcggcccgccccgggcaggtcccagtacagcagagctgaggaggtgaggattgtgtgtgtgtgccatggtagcttcctgactccggcggagtttgtggcgcatgccggaggcagcgaagtcacccacccaatgaggcacatcgtcgtcaaccccccgtcgctctagaccggcgcgcgcacgcatgcgggtcgcgcaagtgctccgcgtgtggcctcagcagccctaagcttagcttggaactagaaatctcatcgtgagactgcattttatgttttacagactgcacattacagtacttattatcctgaaactgaagacatggtgggagatttgctcctacagacaactaaatagcaaacatatgacagattaaaaaaaaaaaaaaaaaaaactcgagacctcggccgacctcggccgcgaccacgctaatcactagtgaacccggccgccccgccaatggngggccggggan

SEQ ID NO: 22135 - DNA, 509 bp, Triticum aestivum
  Clone ID: PAT_TA_22135
cggcgaccgaggagagctcggcctcgtctcctcctcctccggcggcggcggcggccgtcgtcgtggcgggcggcggggaggaggcgctgcgcgactgcatgtctgggctcgaggcgttcctggggctgcaaaacgccgacgagggtggcggcgtcgaggcgtgggacgccgtggacctcatgttggcgtaggccgtacgccttagcaggggggcccagcgccagcgccagccccagccccagcgcgcgcgtgccgcgtgccgtcgctgtgaacggccgccgcagctgttttggatcgagtaataatattattagtagtataatgtttctccaaagcagctaagataattgcaagccttgctgggtgggtattactagcactgctatctaggagtatgtactagcaagatgggtttatctagcttgttgctaaacagaaaattaatctaagaaaacagagatatggctgttaattgccggctctaactaatggccggcgataaaaaaaac

SEQ ID NO: 22136 - DNA, 598 bp, Triticum aestivum
  unsure (1)..(598): unsure at all n locations
  Clone ID: PAT_TA_22136
ctggatcagaaggtactgttctaaatgaacctattgtactaagaaaagaatactcaaggatcttgttggagttcgagacaggaagttttaagaaatatcagttaccacgaatcaatggttcctatattctccaatgtcccagtcgaagttttacttgcaccatgggaaactgtggatgtttgcaaggtggtaaagtctcgattgatgctcaagatagactttggagcttcgccattaccattggtgggtaatataaacatcaaggggtcaattggggatcaatctattgggagttacttcaatgaagatggatgagatattttcccagaaatatggtcgatgatgagctaagattagttcagccttgggaatgacttcctaccgtaatccttattttcatttgggatttttccttaatgaggcaataaagcaaaaagatgggaagattataacaccgttagtcatgtattgaataagctgtgtgttcccccagtgaagttaagtgtgtcatcagtgttgatatatgatgcctaaagatgctcgtgtcgctgactcaaancaaagaatggtcaangngattatatacagncaggaangt

SEQ ID NO: 22137 - DNA, 444 bp, Triticum aestivum
  Clone ID: PAT_TA_22137
gatcgatgtcgtgggtaatgtgaaggcgagcatgaggctgagggccgcctgtgagaaggcgaagaaggtgttgagcgcgaatgccgaggcggtcgtcaacatagagtgcctcatggaggagaaggatgtgagggggatgatccggagggaagacttcgagaagctctgtgctgagctgctggagagagttgttgagccgtgcaagagggcgatggcagattcaggtattggattggataagctgcagtctgtggagctcgttgggtcagggtctcgggtacctgctatcgctagagttctggccggattctttagaagggagcctagtcgcacaatcaatgtcagtgagtgcgtggctcgtggttgcgcgttgcagtgtgcaatgcttagtcccacattccgtgttcgggagtatgaggtgcaagatgtaatccctgcctcaat

SEQ ID NO: 22138 - DNA, 334 bp, Triticum aestivum
  Clone ID: PAT_TA_22138
cttcaggagacggcgatgacgaatcctttgagctccctagccggtgtagcaatctgccaaccagtacttcgcatgatccaggtatatcacgttctaaatccatcaaggaatcaaggaaggcatgaacagcaggccgatcaaacttgtcaccagtagcctctttcagggaagggagtagcaatgatgagactgcaggtgaagctacagaactagcacgagaggctgactgcccatcaggtaattgccgtaatttgtgacctttctgcgtgtccacatcctcgctttgaacctcttggactatttactccagaagatctatgctcatgtgatccct

SEQ ID NO: 22139 - DNA, 842 bp, Triticum aestivum
  Clone ID: PAT_TA_22139
aggtgctgctttattgtctcccgtggattatcgtcgccgcactgcctggcaaccgccgtcgactgcatcaaggaaggatgcaaaatcactaactcaaatatacacaaccaacacttcgttagtagcaatcctcattacaacaatagcctttgctgccgctttcaccctacctggagcttcaagtgcaagccaaacgacagatgactgatgaatcaaggaagaatgcaaagtcactaactcaaacatacacaagcaacacttcgttagtggcgattcttattgcgacaatcacctttgctgctgccttcacccttccaggaggatacagcaatgatgcaggaagcgagggacttcccatcatgtctaggaattttgcatttcaggcattcttgatctctgatgtcttagcaatgtgctcctcatttgctgtggccttcatatgcattatagcaaggtgggaggactatgagttcttggtttattacacatccttcactaagaagctcatgtggtttgcatatgtgacaacaactacagccttttcaactggtttatacacggtgctcgctccacgtgtccactggttagcgattgcaatttgtgttatggtagctttactgcccattctcacaaagctgctgggcgaatggcctatcttgaagctcagacttaagctgggtaaagatttcaactcggatttccttgatatggtctgacctcatcaatttatctcatttatatgctgggtgaaatctctcaactctatctgtaatgaacattgtttggctaatcatactgtattgttaattcatcgagggaaactattgtacccttaactactg

SEQ ID NO: 22140 - DNA, 1288 bp, Triticum aestivum
  unsure (1)..(1288): unsure at all n locations
  Clone ID: PAT_TA_22140
ggtccactaanagttggccaggcggnattgtgtttgtcaaggtcaattggtgataccgacgttggagaatacatagttcctgtcccccatgtgaagcaagtaaagctatccaatgccggagggcggcttgtcattgctagtgatggtgtgtgggatgcactgcactttcaagaagccctgaactacaccagggggccccacgcgtccgcccacgcgtccggaattgttaaagaagctgtgagctcaaaaggactacgagatgatactacctgcatagtagtcgacatattacctccagaaaagctaagccctccattgaagaggcatgggaaaggaggcatcaaagcattattccgatggaggccctcagatgaattatctgaagaacagacagacaatgggtgttttgaacctgatgttgtagaggaactatatgaagaggggtccgcaatgcttgctcaaaggttgaatgtaaactatccagccggaaatatgttcaagcttcatgattgtgcagtctgccaattggagatgaaacctggtgagggtgtctctgttcatggcaacatgccgaagcatcattcacgggttgccccctggcgcggtccgttccctggttcatcccgcccagtgtccttgggggctgtggaagggacgctgcatttgtgaaattctccatatacagtccaccctgcccaagtagccttcctcagtggttttgtatactttgtcagacaagctaatattactaacagtgttaacttataaagcagacttgtcaagatcatccatcagtcactggtaaacagacttaaggactgttctctaactcatctcaacttggaagatcaaattggacgtcagtgcagatgattaaaatttgtggaatcattcatgtgaagcaccacatttattttgttgaaggtgcactctatttatgcgaagaaacaagaaaggatcccaggttcaaatcaaccagtgtccttaaggtgtgtataagtgcccttgacatcggttagcacttgtcaggaacccaggctcagtccatttgtcaataccagtcatggagtcatttttagctcgagcctaggcttttctcatgtctctctgataaatgacccaatctcttatgtgatggttttcctcttgttcattcttcttacatgtccattttccttgcaccccagttttttattcgtcgctgtgcatagccacgcggcccaaaactgacatattttctgtattgataccacaattccatagttttatcacagtacttatagttttt

SEQ ID NO: 22141 - DNA, 438 bp, Triticum aestivum
  Clone ID: PAT_TA_22141
cgtgaatttgatcatcactgactactgcatgcccggcatgacaggatacgatctcacgcgtccggtcaaggggtcatcttcattgaaggacattccagtggtgatcatgtcgtctgagaatgtgcctgccaggatcagcaggtgcttggaggacggcgcggaggagttcttcctcaagcccgtgaagctggctgacatgaagaagctcaagtcccacctggtccggcggaagcagccccagctccagccgcagccacaagagaagccacaagcaaagtcacagcagcagcagccaaataaaccacaggcagagcagcagctgccgaagaaggcagagcaagcgccagccgagccgacggaggaagtggcggccaaagtgagcagcaccggaatgacgagtgactgcggcggcggcagcaggaagcggaaggcggcgat

SEQ ID NO: 22142 - DNA, 1057 bp, Triticum aestivum
  Clone ID: PAT_TA_22142
gaattcggcacgaggtccgcccggttccaaagccaagaacagaacagagcgctccctcctcaaacccaccaccaccaccgggacagagagagaggccacgaggaggagataaaggggaaatcatggaggcgatttgctgtggagattcgggtgcgtgatctggtcggatcctgctttcccgggaagaggccgtggcggtggtgccggtgatgtggtctgtggtgggtgctgccatggtgtggtgtgagtgaatgatgtcctccgcccccgcctatatcctccccgtagccccccctccctgccccgagatgccgcatctgccctctcccctccacctctccaatccaagcctccctccggcggcggcgacggcggagggaccggcgagatcctactctgtctctgtctgagcgcgaggagaggcagaaagattgggagggcctccgtgcggataggctcggttcctctggttcttgctccttgctccgcctacgagccatgacggtggtcgacgccgaggcccggttccacgtcctggcggtggacgacagcgtcatcgaccggaagctcatcgagatgctgctcaggacctcctcctaccaagtcaccatggtggactccgggagcaaggcgctggaggtcctgggactgagagacgagggcgacgacgactcctcatccccttcctcctccgcccctgaccaccatcaggaggtgggcgtgaatttgatcatcacagactactgcatgcctggcatgacaggatacgatctgctgaggagggtcaaggggtcatcttcattgaaggacattccagtggtgatcatgtcgtctgagaatgtgcctgccaggatcagcaggtatcatgtgacagtcttatcgaccctattataaataaaattaaccaatggaatgcggctggaacctagtgggtggagcaagagattcgatattgtacttcccctaagctggtactgaaggcatataatatattcgtcagatttaggtattcatgtgatggccaggattatcaatgtagatgccttcccaatgtgtc

SEQ ID NO: 22143 - DNA, 558 bp, Triticum aestivum
  unsure (1)..(558): unsure at all n locations
  Clone ID: PAT_TA_22143
tctttattgtgaaagttgacttgtcagatagaaaaaagtcactttggaggacgggtgcatcggagccctatattttgaattctgaaaataaatcaacacatttatatggatgtgtcttacacatgtgcaaattttgatgctgaaataagtaaccatgtgagttacacaaaaaagacaaaatcatgattctggaaagatgaacagtgcatgcattgttcactgtttgggaaatcaccattttgtcatttttgtatagctcacatgtttacttatttcatcaccaaactttacatatgtgtaatatactcccatatatccgtgattcctggaaagatcaaagttgacttggtctgatagcagtgttccttatacatgggataaaaaaaagtcaccttctgcacatgcccggatggcctggatggccgatgcatcctctcttccctgtccatggatctcacttcaccttatttataagctaatataatgcacttgccgcacaagtcccctgacaatcccgcatccgcgccaagatgctgtcccacctccaagggacggcan

SEQ ID NO: 22144 - DNA, 681 bp, Triticum aestivum
  unsure (1)..(681): unsure at all n locations
  Clone ID: PAT_TA_22144
acacgatcggctatagcgagctaacagaagctctatcaagtactgtgtaggccatggccggagccctcgtcttcgtcgctgttctcctcgccgcaagcgtcggcgctacgacggctaccacgctgaccatccacaacctctgcccccacccggtgtggccgctggtgaccccgagctcgggcttcccctccatctccaccaacaccgcgcggctgggccccaacgcgctgctctccctctccttcccgcccaccttctgccccggcncggcgtcgccgcgcgcacgggctgcgacgccgccgcgtccggctgctggacggggaccacgccgcccgccaccgtcgtgcaggtcaccgtccacgacggcgggaacctggaccaaggccacctacagcgtgtctctcgtcgacggcttcaacgtgcccatggtggtcagcccgcaagccgtcggcggcgggcantgcccggcgctcgggtgcccatcaanctcaactgcgatgccctcccagaaccgccgccccgggggcgccgcntncgcggccgccggagtactcaaagaacggtgccgctcacaagacaagccaacgacttaaccctnccgnaaactgcgccccggggaaccaaggcatntcncaagcaacantaatcgnggaaacaaagnactctcccaanctaaaanta

SEQ ID NO: 22145 - DNA, 1231 bp, Triticum aestivum
  Clone ID: PAT_TA_22145
gccggttctcccgaagcctgcgctgtgcggcgttctctgaaaacctgcttcgtgcgccgaggtagctcctctgccgcgtatccctgacgactcgaccaccacggcgtaccacacgggctgggttctccggcgagcgcgcctccgaagcaccgccgaatctttcttccatcggtcaccaatgaactcgctgccatctctaccgatctgaactaaagccaccggccagaacctccctaccaaggccgggcaggtggacgactcaccccctggatcagccgagcggagaggagaggcagcttgcagattgattgggcgggccctgcatcgtcgtccccgctcgcagtttctccttgggcgccgccgtccatccgaccgctccccaagcccgcgcttcagcggagatgcagaggacggtggatttcaagctcccccacttcttcaactacccgccctactttactttgcagcctgtgagagaaacacgtgaaaagcaagtgcacctatggaaagagctgatacttgattactgtagaagtcaaaagatgtatataatctccctggaagaagattttccgttgttctccaatccaaagattgagagatctctaagctatgaagcaaaggaagtgttccttgcagctcttgttagtgaagggcgcgcagagtggattgacaaaagtcacaagaagtgtctcattctttggctgcggattcaagattgggctaactacatattacacttcgtaaaggaaaatgggttggaagtaacaacaattgaagatatacgctctggaattgaaacacatgggaccgaacttgcgggaattgatcgtggggtcctcatgcgagctttgaggctgctcgagcaaaagggaaaggcagttatctttaagggcagttcagcggatgatgaaggcgtccaattttctgtttaaactttgtgtaccagcccccaactaacagatggacaataatctcgatcggtttccttgaacatgatacatcccttcttacccgtacactgatcacatccttctggcgtgtttatcggcatcattcaaaccttggtatttatttgctctatccacatttcctggactgttgtaattagccttctattcctcttcagtcatatatacctataaaactgccctgtcggttgtaattagccttctattcatcttcagcatatatacctataaaactgcatgttgtgtgtcaaaaggggggg

SEQ ID NO: 22146 - DNA, 1076 bp, Triticum aestivum
  Clone ID: PAT_TA_22146
cgtcgaggccgaggcgttcgacttcccggcctgctatggctgggtaattcttgtcttgctataactcttcacgtgcagagaagggaagaagaaggggaaaggggatagccgccgacaccgcctaagcgaagcgggtgctgctcgcctgcaacggcggcggtgacgccgtctcgcggggggtcgccgtcggcctcgccaggcacggctgcaggctggtcctggtgggcgacgagggcgccctggccgcgacggcggaggaggcgcggcgctgtgtggcccaaggggcgtcggccgtcgcggtggttgggctggacttcgcggcctgcgacgaggcggccgtcggcgccgcggtggaggcggcgtggcgctgcttcggcgacggcgggctcgacgccctcgtcaactgctgctcctacgagggggaagtgcaagactgcctcagcgtgactgaagatgagtacaacaagaccatgaaagtcaatgcaatcacaccctggcttctgataaaggcgatcgccaagcggttccgcgatgcgcagtccggcggctctgtggtatgcttgacccagatcatcggcgccgagagaggattgtatccgggggcggcggcatatggcacaagtttaggcgccgttcaccagctcgtcagactatcggcgatggagctcggcaagcacaagatcagggtgaatgccgtctgccgcggcctccacctgggggacaagttccctgtctctgttggggaggagaaggccgagaaggcgaccagggaggtaatgccgctgcggcggtggctggacccagagaaggacctcgcttccacggtgctgtacctggtcggcgacgactcccgcttcatgacaggcaccaccatctacgtcgacggcgcacagtccatagtgcgccctcgcatgcgttccttcctgtaggtatggttgcccatgtctgggtttccacattccatcaggatgactcctgatatgttgtttgtcgaataacagtgggtctctgtgaatgcaataattaatggcagagtaaaaatcaaatttgaaaaaaaaaaaaaaaaaaaaaaaaaa

SEQ ID NO: 22147 - DNA, 508 bp, Triticum aestivum
  unsure (1)..(508): unsure at all n locations
  Clone ID: PAT_TA_22147
gtcttcagctttggtgtcatcttgatggaactgattacagggcgcaaggcacttgatgagactcggccagaggatagcatgcatctagttacatggttccggagaatgcagctgaacaaggaaacattccgcaaagcaatcgaccctgttattgaccttgatgaggagacatatgctagcgttagtactgtctcagagcttgctggtcactgctgcgctagggaagcacaccagaggcctgacatgggccatgctgttaatgtgctctctaccctttcaagaagtttggaaaccaactgatccagactcggacgacagctacggtattgacctgaacatgacctccctcaagctctgaagagatggcaggcttttgaagataacagccactttgacggcgcaacctcttcattccgttgcaagtttgggataacactcaagacgagcatcccctacaangcctcctggattcgcgggtccgtcaactctgctgacggaanaaaacggt

SEQ ID NO: 22148 - DNA, 632 bp, Triticum aestivum
  unsure (1)..(632): unsure at all n locations
  Clone ID: PAT_TA_22148
gccgcacgaggcccatttcctcccctcccccgtccccattcattcattcgttcgttcccggggggccgggcggcgacgactgggagcggcgggcgggggtccgcgctcctcgccggtgtttttggtcgtggtcgtggtggaggtggagggcgggggcgggggcctgcggccgcgggcccccgcccccggccgcggcggccgccgtccgctggctctcgcagccgcggccgcgcccgcccgcggcgggcgccttcgccgccgcccccgcccaccccgtcatcgtcgtccaggcccaggcgctcgccccccccgccccctcccccgtcgcccgccgcggccgccaccgccgccccggcgcccccccccccccccgctcccccctcttcccccacctcccccgctgcgccagcgagcacggcggcgtgaccgcgggggcgatccggggggcgttcggcgcggcggaggtcgacttcctgcacgaagtccgccaggcctggcccaagcgcccgcggatggccgccgtcggctcctgctgcctgctcggggccatcgcgcgggacacgctctacgtcgccaacctcggcgactcccgcgccgtcctcggccgccgcgtcgtcgcnnnnnnnnnngnn

SEQ ID NO: 22149 - DNA, 817 bp, Triticum aestivum
  unsure (1)..(817): unsure at all n locations
  Clone ID: PAT_TA_22149
accccgctcgtcctcgtcgactctcacatcctcccggaagacgcaggcaccgcggtcgcgcgcgccgacgcgcggcgcatcacctccgccgtctcccgcatcctcgccgcgcacccgggtcccttccgctgcgtccacctcaccagctgctacatggaagagttcaatggcctgctcaggcgctggctccagatcctcgccgacaagggcatcgaggaactcatcctcgtcaaccgcccaatgccgctcggctgccttctccactccacgttctttctcccctccacgttcttaggcatgaccaccctcacctgtctctacctcgggctctggaaattccccgacacggccgacgtcaagcgcgccacctttttccctaacctccgtgagctcgggctctgcaccgtcctcatggagagcaaggatttggacttcatcctcgacaggagccccgtgcttgagacgctctgtgtgggaagcaatattttcaagcttggccttcgccttgtcaagccaaagcatccggtgcgtgaagatcatcctgtccttctttgaggaaatcgctgtggtggacgccccatgccttggagcgactcatcctttcaggtggttggaccaaagacggggtctgcaccaaggggaagatcggccatgcccccgagtttgcactcccttgggggtacnttggattcagaaaaatcaatgtcccagaagttcggcaaacactgtcatcaaggctggggcacagacgggcccagcccccagcgtccctggggtccggagccgggctttggaggtgcgttgtggagtccgcagt

SEQ ID NO: 22150 - DNA, 576 bp, Triticum aestivum
  unsure (1)..(576): unsure at all n locations
  Clone ID: PAT_TA_22150
gngnagctganagtcaggcgagctctcaccactcacttccgtctccggccatggcgaccatctccgcagctctctccatctccctcctcccgcccgctgcccgccgcgccgtctccaccgccacctcctccccgccgcgcgtcaagagagccgcgcggttcaggtgctgcgcagaacctccttccccggaacagcaggagacctccgcgccgctgccctccccgccggcgctgccttcgtccctgtggggcgtctccacaagcgcctggacggcgggcgtcgcggggctggggctcctggagaccggctacctcagctacctcaagctcacgggctccgaggccttctgccccgtctccgggggaggctgcggcgacgtgctcgacagcgactactccgtcgtcttcgggatccctcttccattagttggtatggtgacatatggtgtggtgactgcactttctctgcaagaaaacggagaggagttactccctggacttgatgacttggatatccgcctaaccttgcttctgcttgctacttcactggcgactgcgagcgcttattttcttttca

SEQ ID NO: 22151 - DNA, 549 bp, Triticum aestivum
  unsure (1)..(549): unsure at all n locations
  Clone ID: PAT_TA_22151
tttttttttttttttttttttacaaaaatagtactaggagcatttttgccattaatcccgtgtcaccttcaccttcaccttcatcaggttaatataagttgattaaaaccccggtgcgccggccagcggaccaccccaacccatacccttttttcttcgtcacaacaagaaaacacccaacgcgacgccactgcagccacagccacagggcgcgcacggcacgcgtataccacgcacgcacacaccaaaccaaaaaacacataccagccgtattacaccatcgcttgcgcggtccgtccgggcgtagtgcacgtggaagcagcgcttacaggagctgcatgaggcggcgcgcgggcttcttcttgcgcaagccgacgagcgaggcgtcgtcgacgagcgggccgcaaagcgtgccgtcgggcttcaagttggtagaaaggtgctccggaagacgacgcgggtgccgttggcgatggccgtgaatccaacacgggcgcttgtaccccccggccctgacnggtanggcacttactggcncccccncttang

SEQ ID NO: 22152 - DNA, 478 bp, Triticum aestivum
  Clone ID: PAT_TA_22152
ggcatggccagctcgtcagcgttggagttcaccgtgaggaggaagcttgcggtgctggtgccgcccgcggcccctacgccgcgggagctgaagaggctctccgacatcgacgaccaggatgggctccgcttccaggtccccatcatccacttcttccggcagcatgacggctgggacgacgaccctgcgcctgtactacgcggcgccatagcggcggtgctcgtgcactactacccgttcgccgggcggctgagggagctcgagggccgcaagctcgccgtcgactgcaccggtgagggcgtgctgttcgtcgaggctgatgccgacgtccgcctcgaccagtttgatgcggccctggggccgcccttcccgtgcctcgacgagctcctattcgacgtccccggctcctgcggtatcctcgactgcccgctcctccttttccaggtgacacggctcgcttgcggaggcttcgtcatgg

SEQ ID NO: 22153 - DNA, 821 bp, Triticum aestivum
  unsure (1)..(821): unsure at all n locations
  Clone ID: PAT_TA_22153
cccacgcgtccgactgaagctaagcaatcaccagaactcacgcacgcacacgaagaacacagaaaccagaggagcataaacaagatttcgaagatgcaagcattcctcgcctattcgatccttacgaatccatgctcgagatccttcttcccgcgtccagcaacgcgaccgcagttcctcctgtcctcggttccggcagcgaggacgggtgctgctgccaccgcaagaagatgcggtgggccgggccggagcgtggtgaccgcggcgtcatcgtccccggcagtggccaccgcggcgacggacgttcccgggacgatgaaggcttgggcgtacgaagagtacggggacgccagcgtgctcaagctcgacgaggccgtgtcggtgccggcggtgggcgaggaccaggtgctggtccgggtggccgccgcggcgctcaaccccgtcgactccaagcggcgtatgggcaagttcaaggccaccgactccccactcccgactgttccagggtacgacatggccggactggtggtcaaggtcggcagccaggtgaagagcctcaaggaaggcgacgaggtgtacggccacatcagcgagaaggtcctggagggacccaagcagttcggctcgctggcagagtacaccgccgtggagcagaagctggtgacatcgacttcgcgcaagccgcccgcctccgctcgcatcngaaccgcccatgaagcctccaanaagcaggtttcccgccggcaatcatcctttcctccggcgggccngcggatccggaccttgtcaaccaactggcaaacaatttacngggcatcaaa

SEQ ID NO: 22154 - DNA, 595 bp, Triticum aestivum
  unsure (1)..(595): unsure at all n locations
  Clone ID: PAT_TA_22154
gatacttggaccaccggatctgatgctggctgtcgactgccattagaaggacttgttgcaagctgagggcaccaggagacccttgtttgctactgctcaagttcacaggatgcgttgaggattggaccaaggaaatgaggatgcaacacctcaaaagaagtcataaaaagatgcatagaagtccaagactcaagaacaaaagaagcccaaagaaatcagcgaagaaacctgagaagagggctgtcagccagcgactggtgacgcaccggacagtgcatagtacctgtccggtgtgcaccgggactgtccggtgggacaaccggacagtctgcgcagagaggccgaatcaagcgctctcgggctgttacaccgggactgtccggtgtgcggaaccgtcagattcaacggtggactgctacaactgccaacgtccgctgacnttgcgtgcaccggacacccacagtaactgtcccgtggacacggccgtcccggtgaaccgacacanaaaatgctgcttcttcaacggtaatttgggtgggagntaatacaaccaaccggcattcctatgtggagccaacacatacaagaaatatgg

SEQ ID NO: 22155 - DNA, 568 bp, Triticum aestivum
  unsure (1)..(568): unsure at all n locations
  Clone ID: PAT_TA_22155
gcaaaatttagggtttgtttggccctattcgcacacacccacgccgtcggatcctcctgccctccccacgtccacctctctccgccgaagaatcggcggcggcggcggcggcggcgagcgcctgcccttgccgcggccccccccgcggcagagctagagcctcgttgctgaggaggggagatggcgggcatggccgatatgccgatgaggccggcgcggccgggcccgccgatgcagcaccggggcccgcccccgatggcgcgcctccgccccgaaccaatcgaccgcgagaagacctgccctctgctgctcagggttttcacaagggttgctggtcaccaccaaaatgaagagtttgctgtngagagggaaaggaaccaaaggatgaagttcagatttacacatggaaggatgccactctccgtgagcttactgatcttgtgaaagagttgctcttccaacaaggaaaaggaaccgaggcttctttcaattgtataccagacaagaatggtcttttgtttcaaacaggtnggttcacctcgctatggcatggaaaagtatatncaaa

SEQ ID NO: 22156 - DNA, 524 bp, Triticum aestivum
  Clone ID: PAT_TA_22156
gttgaaactcgacgatggctggaacaacatccagctgaaccttgctgatctgacaaaaagggcgtacggcacaaattacgtcgagacgctgcgggtgcaagttcatgcgaactgccggctccgcagaatctacttctctgaccgcctctactcagaggaggagctgccgcctgagttcaagctctaccttccaatccaaaaatcataggatcccgagggcgtggagagactctggtgaccgggagacttgcatcgtaccattgtgaggataacctagctgcacatctgcgccttcctgagatacagaaaaaatgttccagaatgtcccggttagttttccgattgttgtgcgatgaatgattaggctgttccgtttccatagcaagggcgagtagccttagttggggctgttaccagttgaccctttgtgtgaacaagtaagtcaatgttattaatccggacctttggctactggtccttctggtccaaagcaaaacgtaccgttactgctcaaaaaaaaaaaa

SEQ ID NO: 22157 - DNA, 593 bp, Triticum aestivum
  unsure (1)..(593): unsure at all n locations
  Clone ID: PAT_TA_22157
agccggcagtcctcgcctccgcctcctccaccctgaccgtcaacagaggaagacgaggatgtcgggatccaaggtgtacaccctcgaggaggtggctaagcacaacaccaaggacgactgctggctcgtcatcggcggcaaggtgtacaatgtgaccaagtttctggaggatcaccctggaggcgatgatgttctgctgtcttccactgccaaggatgctaccgatgatttcgaagatgtggggcacagcagcactgcccgtgcaatgatggacgagtacttaagtgggtgagattgatgcagccacgatacccaccaaggtgaagtacacgccccccaagcagccgcactacaaccaaggacaagacccaggagttcgtcatcaagattctccagtttttggtccccctccgcaatactgggtctggccgtcgctgttaggatgtacaccaagccggatctgcctagtctcttgtcatcaacgcttcaaacatcattcacaaactgaataagttagtgttgaaatgctgcaaagatcataatcctgaaactgagtccttgctgtcggtnaactactcataatataaacactc

SEQ ID NO: 22158 - DNA, 744 bp, Triticum aestivum
  Clone ID: PAT_TA_22158
ggacttgcctttgcgtgcgaccggccggccggcctcggtgaccgcgctccagaaatattggcgcgccgcccgcgcgcgtccccagcccatgccgccatgcgtggcgcgccgcggctggcgaaggcgcgagtccgctgcccacgcggcggccatgcgcgcccgccccgtccgcccgccccgcgtcaccggataagggagcccggcccacccctcccccgctcccggatcgccgcgagttcccttttgactttgcctcccgcccgcccgcgcgcccatccctccggcgccagcaaaaatgtggacgagggcgtcgtgatccgatcgccctgaactcaacggaaggagggcgtcgtgatccgcgcggccttgctagcctgacaagagcctctccgcggcaaggcctaaagcgaatcagcaagagtgatgctcgccattatttaccatctggaactcaaatggaggactattttgagcgcatcgtaaaccttgcttggcagttacgacaacacttgacacaattcatagaaaatgtgtttgggtgcattgattggattcctcaatgtcatgaagtccaattctctgcttactatggaggatcattgcctgacactgaaagatatgttcatggacagagttctgcgttgtccattagcaatactacagaagagttatccattagtagtactacagaagaacagactgcacataggatatctgagatcacaattttcagaaatggcgtat

SEQ ID NO: 22159 - DNA, 571 bp, Triticum aestivum
  unsure (1)..(571): unsure at all n locations
  Clone ID: PAT_TA_22159
gcgacatctccatcgatcagcactgaagatcaactggccgatatcttcactaagcccttggatgagaagagatttagcgagttgcggtgtgagctaaatatcctagaatctttgaatgttctctgaaatggacacacatcctaacacttatgctgacttgatgacttagatgtgcaacacacgaagtaacctttttcttcaatgaatgaagactaaccctctaagtgtgaagaaattaatgaagaaattgattcttagagccctacgacaattgtacgcggtgtctgaaatcagctttcttatacggtaggttacgccaccacccaaagttgaaaaccttaaatatgagtttttcttcgtttttgaaattcctcagttttccaaattcttcaactttgcagtgtcttcgctctttccggtgttgttctttctttgaatatatatatgagtttaagtcctctacagcatcacttaagtgtatttttcaagttgtttcctctactaagtgaagtgattggncctccccctctatgcnaaccaaccatcaatcacaaatcccatagcgtccatt

SEQ ID NO: 22160 - DNA, 432 bp, Triticum aestivum
  Clone ID: PAT_TA_22160
ccgccctctgcgaccacctgctcgccccgccgccgtcttcagcctcgtcgagcaagcgcgcccagtgcgcccccgcctactagcgcctgatgcacgtaacgtacgtgccatgctagcttttcggttttgcacttgaggattactggctgatgcatgcacgtacgtaacgccacgctggtatcaactgcagatgcccaactgcttgctactgtactatgattgtataattaactgtgagcactgtccatgcgcgtacgcaccacaaatcttctgtccaactgcttgccaccatgatcatattgtagtccatggaacccagggggggccggtcccgttcgcctatggccacctcttcccgcctcactcaaccgctcgaaactaaaacaattcattattgagaggtgccccgctcaacattaaaaaaaggggggg

SEQ ID NO: 22161 - DNA, 743 bp, Triticum aestivum
  Clone ID: PAT_TA_22161
acatagactacaccaccaaacaacatgagttcgcggttttctgtcaagcacttcagaatgatatacaatcgttcagccaacacccacgtccctcgaactgtgaccacaatggcacttgcagcaggtgtcctgaaaatagttgcacctcaacccggtgctatttatcccatccacctacttcttgccatcgttgtactgaccatcaccacaaccatctaccttgcactctgtcgtaaaactgtataccttgttgactacgcttgcttccggccaagtttcaacctaagatgcccaaaggcaaccttcctcgagcatgcacatctctcgtctttgcttgatgattctactgtcaacttcataggaacagttctcaagcgctcagaaatgagcgatgagacatatgtcccgcctgtgcttcactatatagagccatattgtgggctttacgacgcacgtgccgaagcagagtcaattgtcttctcggtgatcgatgatcttttggccaaaacatgcatcaatcgtgacgcgatcggtgttcttatcaccacctcaagtatattttgtccgataccatccattgctgacatgattgtcaatagatacaagttgcgaggtgatcttcgcgtaatgaacctctcagggatggcgtgctctgcttcagtgacccgcagtggggcttgcaagcaatatgttgcaggtcatgccttgggggtcgcatgcattgatagtgtcaacagagacca

SEQ ID NO: 22162 - DNA, 854 bp, Triticum aestivum
  Clone ID: PAT_TA_22162
atcctgccttccaccccagaaagaaaagaacatggcagctgcgactgcaaggcagctgttggtccacaggatcacttcctcctgctcctcagggacgcttcccaagcacagttccagcagccatggccgctctgcttacagctccatgtgcttcaacaaggccgagaagctccccagtttcagagcgagggtgtccgtgaagccgccgcacgccgtgccggggaagggcggcattgtgccggccgacgacgacggggtcagcctcggcaccgtgaagctgcccgccaacatcgacgtcgctcggttcgaggggttgctctttcagtgggggaacagtctctgccaaggcgccatgttgccactgccagtgcctatcaaggtggacaaggtggagggtgggatcaggctagggttcattgggatcgacgacggcgcgacctcgctgctggcctacatcgactgcttggtgtctccggcgaccgatggctctgggtttgtgttccgagcaatcaggaacggtgctatgaaggacatggagccgcctggggagcccaggatcatgaggagcctcctcatggcgcttcagaagtccattcagattgcgcaagtttgacaagcctgttcagattgcgcacatttgacaagtctgttaaattgtgcaagtctgccagtgaagaaggaacatgatgcagcaggagtttcattctctgttgatacaactttgtaatccctagttttcaaaggtctcctttcatgttctcttccaagatgaagatataaattccattagaggaagtaaagcttaacccccccccggtcttctctttattcataatatttcctgaggggcttcc

SEQ ID NO: 22163 - DNA, 270 bp, Triticum aestivum
  Clone ID: PAT_TA_22163
gctgctggaggccaagatggcgctctgcatgatcctccagcggtttgagttcgggctcgcgccatcctatgctcatgcgccgcataccatgataaccttgcatcctatgcacggtgcgcagcttaagctcagagcaatatgatctcgacacgatgggtgtcccatcgttgatgccattgttatgtataaccttacaattcagataggcattcggccctgttaatgtctgaaataagtatcttcgcgttggcattttgtaaaaaaaaaaaa

SEQ ID NO: 22164 - DNA, 705 bp, Triticum aestivum
  Clone ID: PAT_TA_22164
gcgggggaggaagtgaccatctgctctgctcgcctgatctcctcgactcctccgcctcccaaccaaccacgcccggcgcgtctgcccgcctgcagcgattgccgccatgcccgaagatgccgcgccaatagcccccgcccccgcttctgatctcaccgctggttctagtgatgatgagataacagtagaggatgctccttttgcgcgtactgaactcccccaagatggcagtgccccacctgtcgtaacaactgatatggaagttctccatgataaagttaagaagcaagtcattaaagaaggccatgggaagataccctcaaaattttctacgtgctttgtgcattacagagcatgggtacaaagctctatgcataaatttgaggatacctggcaagaacagcatccagttgaaattgtcatcggaaaagagaaaaagcaaatgtctggtttgggtattggtgttggtcacatgaaaagtggggaacgtgcactgttgcatgttagctgggagctaggctatgggaaagaaggaagctcttcattcccgaatgtccctccatcagcagaccttatatatgaagttgaactcattggttttgatgatgctcttgtaggaaatccccggctagctgagtgtatcaaataactatcaaaggcaattgcctgtgtagtaattttgaagtattctgttttcatctacag

SEQ ID NO: 22165 - DNA, 603 bp, Triticum aestivum
  unsure (1)..(603): unsure at all n locations
  Clone ID: PAT_TA_22165
ccgacaagccccccgccatctgcaccgtccacgagctctgcgcgggcgacgcacccccgccatcggcagggtccccgatctgtgcgccgcggacgcagacgtcgtggcgcaggagcgaaccaatcaatccttgtcccatgaagactgcaacaagcactagcattctttgggtggggtttcagaagaaggaactcaaggaagattcagaaaactcaccgtgagcattcttctgtattaccagtggtggcacctggtcgacaagggctagagacgacgcaccgcctgctgcatgcagttacacaccggatgacgcgctgatactgttcacccaccgcctgcttgcttcgcccagcatctagaggtagcagtgctttgaaccaagaagcgaagcagagctttcaatggctgggctccgcccggcggcttgcctactcagcttaacaacggcgttctttaattcgactcccgcctgatgtatcgtaggcgtgggcggggtcaacgtgcaatccgcgcgtcaccacaagctgctcccaattgctgctcacttacgtaccatccgctctgccgcgctcaattaaacggtctcngaccggttcaaagcta

SEQ ID NO: 22166 - DNA, 295 bp, Triticum aestivum
  unsure (1)..(295): unsure at all n locations
  Clone ID: PAT_TA_22166
gcactggcttctcgagtagagatgttcaaggcatgtaatggaccattcaactattgcatgttgcgcggattcaacggtgaatacacctacaatggagagcaatacgacgctttagctccaccacaaggagcagcatatgtcaagtgcagagaggacgtcaccaaagcactaaagttgaatgncaccctgtgaaacaaacaactgcaccttcaacgggcgatggtggagtggcggcnggcgcgtagctggtcctgggtccgacctctacatcaccaccatgcttctactacacggc

SEQ ID NO: 22167 - DNA, 783 bp, Triticum aestivum
  unsure (1)..(783): unsure at all n locations
  Clone ID: PAT_TA_22167
cgactcctccgggggcggaagcgtgctcaccgacacgcagaagaccaccgtcctcaagctgcaggttggcttgctaggcatggcccgatcatttcaaaaggagcttgatcaaatagccgagaaagcagatacatctactcccgtggtcgcggccgaggtactaacagagacaacattggcattacttcggcatccagattgctgtatctcagcttattcaacagtggatgtcaaacgaagcatggatgatggggagaaacgtttcaatcaactgtcaattgaggaacgaggcaagtttgatgaagagacactcgtgaatgtaaacagtatcaagaggcaaaaggcaggcactcaacgatcaagtggttttagcaacgagtacattgtgattaccatattggttgctgctgagggagtgtacaagctacctactataaacagcagcagtgacctgaagacagctctacaaatgcttggtggcgtaccgtcaagcaaaataatggcggtcgaggtcttatggacaccacaaaatgagaacgacacattgtcggagcgggaactcctggaagattacccacttttgaggcccctatagaaggatttaagatgtgtactgccctgccctcccccagtaaggganttcatttttggcagtccagccttgttaaactatagctcagggtttgtggtttgtaaaaatataaattgtaaatgaagccccccgcccctagcagctacttacatgaaagtttgctcaacgcaacagcgcagcattcagaatcc

SEQ ID NO: 22168 - DNA, 593 bp, Triticum aestivum
  unsure (1)..(593): unsure at all n locations
  Clone ID: PAT_TA_22168
ttcttccggcttcgggttccctcactcccatgccgcctcgccacaacgccgccagctttcttgtgctctccccccactcccggtaggatttcccgagagagagagggggagagcaaaagataaagatcgagaggtcaggagagaggtgggtgtatggagatgccggcggccccgcccccattgctgccgctgcgctcctctgttctcttcttgctcctgctgtcctcgtgctcgttggccagcgggagggccgccgtttcttccccggcgccggcgtcggtgggggccgccaatgggaccgcatcttcttcttcttctccggtcgttctggcgtctccccccgtcgggacctccgtggcggccccccaccgctcccgccgcgagccctgcatttctcgttccttcctctgaattcctgtgtgtgtgttcctgcttttttctatccgaacttcggaaatctagcaagttaaganttttccccgggaatttaattggattggactgcaagcaaactcggatcttgtaattaatcnccaaatacaacaattacaanggttggtcgttccaactgggaantttcccgcctcttaatn

SEQ ID NO: 22169 - DNA, 1820 bp, Triticum aestivum
  Clone ID: PAT_TA_22169
gtctgggcagacggttaggaccacgtcttcttggcaggggtgaagatggctccatgaggcttgtaagagatctgtataggatgcttgatgaaataaactcggaggaagttcctgttgatctaaaattgttagaatcttttgatgattttatctgggatacaaagaataatgattatgatttgaagtcatttgctttgaggctgaaggccacgatggagaccatggataaggaactgagatcatccaggttatcagagcagctaaacaaacattatgcagcaatcgcaattcctaaaggcctttactgcctttcattgcgtctaactgacgtatactcctcaaatgcccttgcgaggaaacagctgccaccccctgagttggtcccgcgtctttccgacaacttctatttccactttgttttagcgtcagacaacatccttgcagcttcggttgtggtcagatcaacagttagatcaacattgaaacctgagaggatagtctttcatatcattactgacaagaagacctatcctgccatgcattcatggtttgcattgaatcctgtttatcctgccattattgaggtgaagggtgtccaccaatttgaatggttgacgaaagaaaatggtccagttcttgaggctatagaaattcagcacattgccagaagtcgttaccatggaaatcaccttgcaagaaccactgcaggtgacagcccgagagtttttgcagccaagctgcaggcaggaagtccaacatatacatctgtgctcaatcatattcgtatatacttgcctgagttattcccaagcctcagcaaggttgtatttcttgatgatgatgttgttgtccaacgtgacctgtcatcactttgggatattgatctagctgggaaggtaaatggagctgttgagacttgcaggggtggagatagttgggtgatgtctaagaggttcaggaattattttaacttctctcatccgctcattgccaccaactttgatccattggagtgtgcgtgggcgtatggcatgaacatttttgaccttgctgcatggaggaagacaacaattaaagataaataccaccattgggtcaaggagaatctgaagtcaaacttcacgctttgggaggcttgggaactttgccacctggcctttcggccgttcgcccccatgttcatccgatcgatccatcttggcaccttttaggtttggggtatcaggagaagacggatatctctagtgttcggaaagcagcagttatacattacaatggacaaagtaaaccatggctggacattggttttaaacatctccaaccattttggacgaaacatgtgaactactcgaatgaatttgtaaggaactgtcatataatggagcctcagttgtagattggcgagacaaaagattcaacaaataaaggcgtaaattaagtggaattaaattcgttattttggagaccggcatcgaagggtatccagggaatgaacataattggttacatgtgcagatgcagcatattcgatgaatagaaaggaatgttttgttcccatttacacgaggatccctttccttttgtttattccatttgtatcatagctcatgaaattacactattgtttaggatggttcttttgtacttgatggagtattataaattgcctaatttggcagagttgatgatagtcccatcagtactgtaattgctggagagtgagtatacagttcaccatgtgaagagggtcaaattttgattttgcaaaaaacatccctgtacattttgcacccagtctttctaatatatttatggtgatc

SEQ ID NO: 22170 - DNA, 496 bp, Triticum aestivum
  unsure (1)..(496): unsure at all n locations
  Clone ID: PAT_TA_22170
ccattccctcgagatacctcatatcctcacttcccgatcgatttgagaatctcgactctccacaaccgccaaaatggtcaagacttccgtcctcaacgatgctctcaacgccatgaacaacgccgagaaggccggcaagcgccaggttctgatccggccttcgtccaaggtcatcgtcaagttcctcaccgtcatgcagaagcacggctacattggcgagttcgaggaggtcgatgaccaccgttccggcaagattgtcatccagctgaacggccgcctcaacaagtgcggtgtcatcaacccccgctaccccgtccagctccgtgacctcgagaagtgggctacccagctcctcccctcgcgtcagttcggctacgtcgttctgaccacctctgctggtattatggaccacgaggaggcccgccgcaagcacgttgctggcaagctcctcggcttcttctactagatggagtcgcttgcaaaagcatcgntnaaa

SEQ ID NO: 22171 - DNA, 1248 bp, Triticum aestivum
  Clone ID: PAT_TA_22171
attcggacgaggctctcgcgccctctcctctctttatccccccctccccgcgggcgccgtcgagcgcaagacagacaccggtggctcgcccgtcgctcccccggctcgccgcccgccgtacttttccgcccctccttcttggcgatcgagccggcagaatccgacgctctttctttcccgggttcctcggcgtcgagtccaaaggtgacttgtgaagaaaaatatcaggtcatcacctaacgtggttggagtatgatctgggttggcctcactgactgccaaggagtctaaatagctggtttaggagcactgcaccagcattttgcttaagtgaaagttctcagaggttttccaggctcaaagaaatttgatcctcatataagctccagatcatgggttggttaaacaaaatatttaaaggctcagtaaacagagtttcaaggggtcattatgatggccactggcatgaaggcaaccaatctgagcataccagagatgcatatgatgagagcgacagtgaagatatagctcgtgctattgcattatccttagcagagcaagatccgaataagggaaaggctattgatcctgattatagtttggaggaagatgagcaacttgcacgggctctccaggagagccttaatactgagtctcctcctcatcaaaatgctcctgttgagaatgttccaacagagagtatcccagcaagggagccacatcagcatgtcttgccctcaagtggattcaggacttgtgctggatgcagaaagccaattggtcatgggcgttttcttagttgtatggatgaagtttggcatcctcagtgcttcaaatgttatgcttgcaataagcccatatcagagtatgagttcgccatgcatgaagaccagccataccacaaatcctgctataaagatttttttcatccaaaatgtgatgtctgcaagaactttattccgacaaatcagaatggcctgatcgaataccgagcacatcctttttggatgcaaaagtactgcccttcccatgaagatgatggcactcctaggtgttgcagctgtgaaagaatggagcccacggacatcaaatatattacattagacgatgggaggaaactgtgcttggaatgtctcacttctgcaacaatggactctcctgaatgccaacacctttacatggacattcaagaattttttgaaggtttgaatatgaaagtagaacagcaagttccattacttttggttg

SEQ ID NO: 22172 - DNA, 591 bp, Triticum aestivum
  unsure (1)..(591): unsure at all n locations
  Clone ID: PAT_TA_22172
gccacacaaagctcttgagctccaaatctagcagcagctagagctagagctacaatcaccgaagaagataaagatacacacgactttgtgcaacaatcaccgacacacacatagctagagctagagatggcggcgggaaagctggggcagcagctgatgacgaggctgcacctcgcgaggacccgaccgtcggcgacggcggacgtgccgcggggccacctggcggtgtacgtgggcgaggggcggaagcggctggtcatcccaacggcgtgcctcagccacccagccttcgtcacgctgctgaagcgggtggaggacgagttcggcttcgaccaccgctgcggcggcctcaacatcccctgcgcctccgagaccgagttcgctcanatcgtgggcgccgccgccgcccgggacggcaacaacatcactgacgattgcgtgcgtgccgcgccgattgatcgaattagatccggccgtgtcataataattcccttcanttcaactaactaganaaatattgtcccttgggngggtcatttncaacaanatttggttgctncaaacgtaaaattgtggaattgaaaaaacctc

SEQ ID NO: 22173 - DNA, 339 bp, Triticum aestivum
  Clone ID: PAT_TA_22173
gccagggaggcactacgcgagggtggagagtcgaatttgacgttgactcgactggtgcaggtctggatgcttggcaacattgaagatgacgcgggttccacgagatagcgtgactcatggccatggatatggtaagggccatagagaagcaagaacacatgtgaaattaaatctgctatttgtagttcttattaagttttggatgtggttacatctcagtcgacaaagacttaacgaagtctcagtcaactgacaaaacatataaaggaatattttataaaaacttacacggatatgaatatagtatcaactctcgtgcccaattcggacaaggggggg

SEQ ID NO: 22174 - DNA, 1354 bp, Triticum aestivum
  Clone ID: PAT_TA_22174
aaagtgcggcctttcttgcctaaaattccagcggcggaggcgaatccaaggaggaggaggagggagccgcccctgcccagctaaatcctcgtcgttcgcctccccgatcgccatttccccccttccgcgacagagattcgtcctccgatgcaggccgccgcctcctggggcaagggcctccccggcctgcggagccacctctgcgccgccgcgtcgttccactccacgcccccctcccccgccaagtggaagggcaagttcgattgcaagcatgaacatggagaacggaagctatccaagaaatatgagcgatacgttgttcgtcaaaaacgagcagaaggaaagaaggccctgcaaaattaccttctgtatggaaagtcaacacctcatatacaggatggaagtatgggcagctttgctaattcgcatgatattccacgattcaaaacgttcagaaaaaaacaggatcacatctcaacaaaacctcgacaaggagtacaccatcaaagaaaggacaaaaaggacaaggagaagttcttcaactttttctacgaaacccgttatgtgaaacttgatatttgagccaacagagccaagcgcccaacatgatggaaggtgattatgttcccatgcttcatgggagggttttcacttcagggcttcatcgtttggattcagacgggctggtgaatcacgaagacaaagagttgaaagcgagagcgaagacgaaagcgacgacgacgacacgggtgagacagccggcgttggctcacatgcgcacagggtcacccttggattgccacctcgtggtccactaaccctagatgatgtcaaaacagccttccgcgcgtctgctctgaggtggcaccctgacaagcacccgggctcttcacaggctgtagccgaggagaagttcaagctgtgcgtcaatgcatacaactcgctctgcgccgtcctcaaggccgcgtgataaccctcttcctccacgcgtggtgttctgaagcctgtgaacgctatcagcacctccctcgagcgcgtgaatttggcaagaaaaccgttccgttccatctctggcagggagttggggctcctgaactggaactagagctctcttccccgcatctgttgtttgttcctttcttcagtattcattttctttcactagagatttgagccaacagagccaagctcccaacagcatggaaggagattatgttgtaacatgtagaagcacaatcatatttgcgtaccattgcaagctgtaacaacaatgatggttatttcatttcatctcgtatcttggtttcgacagggggaataaaaggaacttgtctgaaaaaaaaaaaaaaaaaac

SEQ ID NO: 22175 - DNA, 1385 bp, Triticum aestivum
  Clone ID: PAT_TA_22175
gcagaattctatcccccggaagaacaggcggaggggaggagaggaggaggacgagagcgaggaccccgatccccgccgtgccgtctcctccgtgtttccgatcgatcgcccggctccccggctagaaatggcgcaagagagttggaaagaggcagaggatacgggtgtccacgcgcccgaggctccgataatgtgcatcaacaactgtggcttcttcgggaaccggatgacagaaaacatgtgctcaaagtgttaccgagacactgtcaaggccaagacgatggcccttctagttgagtacaaaactgcagctgctgttgcttcgtcacccacaccaatggtggcatgagatcaaaggatgaaccgtctgccttaaaccaaaagaaggaaaacgaggtagccgaggaaaagacgccgaatccacctaacacccgctgcctatcctggcggccagagagtagggctgaagggcattcaacagccgctgcggggagacctggaagcaggaaggacgcgcggggcccacggagcacccctgagatgtcgtctccgaggaaggccgggatgacggggttcaagtgcgcatgcgcagataccttctgctcgatgcagcgctaagccgacgcgcacgattgcaagttcgactacaagcaggccggcagggagcagatcgcccagcagaaccccgtggtcaaggctgacaaggtcacccaagattctagatggaggttctggctgcaggagccctccagctcgtttatttcctctatgatgatgatgatgatgcttggtccgtcaggtttacctgaggaattgtgtgtctacgatcctcctggaaatgtactttgccgatgaacccgccttcgtacaaacaccaccaaccgatgcccgtccgacggccgtcaatggtccattgctccgggttggccgcgccttcaagggctgtataatgttggtgtttgtgtgggaggaacattcattggcacaggtgcacttctgtttatttacatatatcaataatgtgaatgtaaatatttatcctttaacagtatgcagttcaactgattaaactgttatatgctcaaggcttggcaggtttccgtggtcacctgttagtgtaaatcattgtacattccggtgtgttatgtgttcaaatcagcaatacttgtgcattttaggcggtgagttggagagggatgttgtagaaaagatccaccagtagtagtagtttgctgcacagatcactgtcagagaaaaacagagtgtctgatttgtttatttttcgacagattacatagtggtacttgttgatgagtacaatgatataatctccattatcatagtaagtacagtattgatcaaaaaaaaaaaaaaaaaaaaaaaaa

SEQ ID NO: 22176 - DNA, 473 bp, Triticum aestivum
  unsure (1)..(473): unsure at all n locations
  Clone ID: PAT_TA_22176
cccccaaggccgccccgggggcctnggnntccttgccgagttctcccttggagcgcggggntggtgcacccctgccacgccggncggggtcgtgcacttcctcgagggctacgcgcaccacgaggtgggccccatcgacgtcgaccgcatcgacgtcgtcttgggacgcggcgctcaagcccggctcccggcccggctgatcgctcctcctcgatcggccctgcctgcaccttccgtctagctatggcccaaaccgggcccaagaaaaaacctctattgctactcagttttctttttctttttcttgcctaaaaataactcggtattcttttttccttctcgaagtatactacagctcgatcctgtgacgtggggtgttgttcctaacgattcaatttacagctgtactgttttgatttgtacacatatgtaaagtatatgatacattcgaaggcaggacatagaattaaata

SEQ ID NO: 22177 - DNA, 807 bp, Triticum aestivum
  unsure (1)..(807): unsure at all n locations
  Clone ID: PAT_TA_22177
gtcgacccgcccccccgcctccggctacgccttccccggctcacctggagcctgcgttgctcccccctccatctctgcctctccctccgacgctgggctcgggctccgtcgccggtgtcccggccctctccccgggggcccggcgcctgcgcccgccggcgccacccggcagatcatcctccttcctacaataaccagatcattttccttggtacatctataatgccaatttcgagggtttgtatgaaaccgtgagtttatccggctcatcaaacctgaacgagggccagcaaaatcaaaccgacgggatcagcgtcacgctctgcagccaggagaggcatatcattggaggtgttctgggtggagcattggtagctgccagtactgtgcaggtggtactagggacttttgtgcaagcagggtccaaatcaaagtccaagaaagccgcgaaaccgccggcctttggtcccgactcgctcaccggcgctgggccagacgtggcgtcgcccagctcaggacataaccaaaacctaacgtcgccgccctccgttgtatcgacgggagggtggcctagctctgggatatttgacacgagaagttccagcattgatatcaactcttctagaggatagctcatatttgtcgacacttccatctctcgagagatttttctgttcccaaaaagaataccaaatgtatactttgaaatagcccattcggtttttgagatcattcttagagattactctccaggctgtgttttgttgcatcaatatattntgttngtnatttnggggaaaaaaaaaa

SEQ ID NO: 22178 - DNA, 1467 bp, Triticum aestivum
  Clone ID: PAT_TA_22178
cggcacgaggtctcgagttttttttttttttttttattgttgaataatgccaaatcaaatcaaaaaaaatccaaaagtaaaaaggaaatgaattagttaattcaataagagagaaaaggggaccaggacttgatttcgttgcccaagcgaatcccattcaatcgtttactcatggaatgagtccgttggaaagttcaatcaatctttttttcatatacattttgccttttgtggagaccaagcagagcacagaagggaaatggtcgcacgggaagaccatgccggtgaagaacgtccaggcgctggccgcggacgcggcggagctgacggaggaggccatcaagcggtacatcaggccggcgagggccgacgatgtcgtcgttgctgctcacggcgataatagcagccagagcattcctgtgatcgaccttggtaggctccttgatccccggagctatcagctggaggcggccaggctcaggtccgcatgtgaggagtggggcttcttccaggtgaaaaaccatgaaattcctgacacagttcttgaaaacatgaggaacgacctcgagcacttcttcaggcttcccctcgatgagaagaacagatttggccagttgcctggagacctccaaggctatggccaagcatttgttgagtccgaacatcaaacgctcgactggtgtgacaggctttacctagtgacccagccacctcacgatcgtgaaatgagaccatggcctacaactcctgtcagcttcagggaatccattgagtcgtactcctctgagctgatgagggtgactggctcgctcatggcaatcatcgctagaaacctaggcgttgatctccccagtgatacatacgtgagtcaggcattgaggatgacctactaccctgcatgccccgtggctcatgataaggttttggggatttcaccacattccgacatttctatgctaacgctggtatgggagttgaatatggtgggagggctccagatcaagagacaagatgcatgggtgccggtaaaaccccaccccaaggcattggtggtgaatgttggtgactttcttgagataatgacaaacggaaagtaccaaagcattgagcacagggtcaccgttaatcctcacaaggagaggatgtccatttctgcttttcacctcccaaagtttgatatgagcgtgggcccattatctgaaatagttggggccgagctcaagaaatacaagaccctgagggtggacgaggttgctaaggttgttttctcgagcaaacttgacggcaagaaaaccaaggactatgccatgcttagagtctgagtctacaagagcagaaacttggagcagaaatttcgacagccgtatataggcctgaaacatttgcgctgctccaattttggtcatggttaattggccgatgtatatgaagtgaaccataatgtttaaaaaaaaaaaagagatatat

SEQ ID NO: 22179 - DNA, 1142 bp, Triticum aestivum
  Clone ID: PAT_TA_22179
agatggtgcacccgccggtagaacactagatttggcctctagccttgaagctggttcaactacactgcaagcctcaggcggtgcggacgattgtaatctacgatcagtgctgacaattgcctttcaattcccttacgagatgcatctccaagatagtgttgcaactatggcccggcagtatgtccgcagcattgtctccgccgttcagagagtgtcgatggctatctctccctctcgatctggcttgaatgctgaacagaagataatttctggcttccctgaagctgcaacacttgctcgctggatatgccaaagttaccggttccatctgggggtcgagttatttagacaggcagatgaagctggggaatctttattgagaatgctctgggatcatgaagatgctattttgtgctgttctttcaaggaaaagcctgtatttacgtttgcaaacgagatgggaattaacatgttggaaacatctttcgttgcccttcaagatctctcgttggacaagatatttgatgaagctggtagaaaggcactatactccgagatcccaaagttgatggagcagggctttgtttacctgccaggtggtgtgtgcttgtctgggatgggccgccatgtctcatttgagagtgctgtagcatggaaagtagttggtgaggacaacaatgtgcactgcctcgccttctgcttcgtcaactggtctttcgtgtgatcatccatcacccttgcctgtcccatgcagctccatttttgctctctctgtaggggagaaccgccgccactggaaagtagttttacgttatctttaactagtttgtttctagatttgaagagccagcatcgggaagaattctgcctcgtgtaaaatctgctcacgtttccactaatttacccaggcaagaagctggctgatgtctgtctggattgaggtgctagcctttcttgaatctagaaaggttcctacttttattcgtgtgatgatgatggaatgctagtagtagcgaaattgggacacagctgatgtataatcagtgtttgtgtggatttttcgctttacttgtcgatttgtatttggtctgaagatcgtttgtttgacatgaatcatttgccaactgccggcattcgagatt

SEQ ID NO: 22180 - DNA, 648 bp, Triticum aestivum
  unsure (1)..(648): unsure at all n locations
  Clone ID: PAT_TA_22180
gcgttcggcagcagcgccccgggtaacttcctcacgggcttcggcttctacgagcccttctggctcgtcgacatcggcaacgtttgcatcgtcgtgcacctcgttggcgcctaccaggtcttctgccagcccatctaccagttcgtcgagggctgcgcgcgctcccggtggcccgacagcgccttcctccatgccgagcgcgtgctgcgccttcccgccgttctccggggcggagagttcccggttagcccgtttcgcctgggtctggcagaacggcgtacgtggttctcaccgcggtnggtggcatgctgttccctttcttccaacgacttccttggcctcaattggcgccgtctccgttttggcgctcaccgtctactcccccgttgagtgttacatggcacaggcaagttcgccggtcctcgccgacttgacttggttgctctncgttccggctctgccttgtctctctgtcctcnccgcaactggttctgtncaagggtcatcaaggactcgcaaggacaaccttcaagnctcctaacnctatccggacagngtgtanatgatanntacttctaaataaagntaaggtcaggcatcctcttnancttaatcaaaatgtaacaaatgtatacgatagataaacta

SEQ ID NO: 22181 - DNA, 498 bp, Triticum aestivum
  Clone ID: PAT_TA_22181
tcgaggccggccgggccgggctctcggtctctagggttttgggactttagcctcctgcgccgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtacgacaccgtcgccgcggctgttgcttcaaggttccctggccagtcctctggggtgagtgcatcatcggctcctgctgcagctgctcctgccgcttccaaggatgaagatgacgatgatgacatggatctgtttggcgatgagaccgaggaggacaagaaagctgcagctgagcgtgaggctgccaagcctgaaaaaaaaaaaaaaaaaaggc

SEQ ID NO: 22182 - DNA, 1033 bp, Triticum aestivum
  Clone ID: PAT_TA_22182
cccacgcgtccgcccacgcgtccgcccacgcgtccgcccacgcgtccgcccacgcgtccgcccacgcgtccggttttgggattttagcctccagcgccgccgccgccgccccccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtatgacaccgtcgccgcggctgttgcttcaaggttccctggccagtcctctggggtgagtgcatcatcggctcctgctgcagctgctcctgccgcttccaaggatgaagatgacgatgatgacatggatctgtttggcgatgagaccgaggaggacaagaaagctgcagctgagcgtgaggctgccaagcctgcaaagaagaaagaaagtggcaaatcctccgtcctcatggacatcaagccatgggacgatgagactgacatgaagaagttggaggaggctgtccgcagtgttcaaatggagggtctcacctggggtgcatctaagcttatgcctgtgggttatggcatcaagaagctccagatcatgctgacgatcatcgatgaccttgtgtccgtcgacactcttattgaggaagtgctttgcgaggcgcccatcaacgaatatgtccagtcgtgtgacatcgttgccttcaacaagatctagaatctttgttcgcccacctgttgctgctggattcttggtactgggatctgtcgatctggaaaacattatgtcgtcccatttagttacccctcttacagaaatgctaccggttttgtttttgagtgatgccctggtcttgaatgtctgctacctttaaatagttgaactgctgagcggtttgtaatggcgaaacatctatcatgtggagtaaaatcagtctttgata

SEQ ID NO: 22183 - DNA, 1563 bp, Triticum aestivum
  unsure (1)..(1563): unsure at all n locations
  Clone ID: PAT_TA_22183
gtcctcatcccctacccatctcctagggtttttaccccatggcgatggcatcgcgcgccgtcctcctatcccgtctatccccactccccgctgcggcctatcgcttcctcctccgccctctcgccgccggggcagcctcctcccggcggcgctggtcccgtcccccgccgcggcgccctgggcggcggcgaggcgattcgcgacacagcccgcgacgtcgtcgctgcgggactcgtccccgaactggagcaaccgcccgcccaaggagacgatcctcctcgatggctgcgacttcgagcactggctcgtcgtcatggagccgcccccaggcgacggcgccaaccccgatgtcacccgcgacgagatcatcgacgggtacatcaagaccctcgcccaggtcgtcggaagtgaagacgaagcaaggatgaagatctactctgtgtcaactaggcattattttgcttttggtgccctagtatctgaggaactctcctacaaactcaaagagttgcctaaagtccgttgggttcttcctgattcatacctggacgtcagaaataaggactatggaggagaaccatttatagatggacaagctgttccttacgaccccaaataccatgaggagtgggtgagaaacaatgcccgtgccaatgaaagatcccggcgcaatgacaggcctcgcaactttgacaggtcgaggaactttgaaaggagaagggagaacacacaggcctaccagagtgggcctccaaaccaaatgccaccccatgatgctgctcctccaagtcgcggtgcacagggcccgccgccgccttcaggtgctccaccaaattaccagccccatgcaccaaacccacaggcaggctatgctgcaggaggtggaccaaactatccaaatgcaccaccaccccctggataccgaggtgccccagcccctggctaccaagctggcaaccaaggttaccagggtaatcctggtggcaacatgcacaatggaccaggcccagcctaccatagcaacaaccctggataccagggtggagcgccaggaggcaacccgccgccacctttcgcaggtggcaaccagcctcctccctaccatggcggtggtcctagctatggtggtggtgcaccagactaccagggccaaccaggtggtaacccaggctaccaaggtggcggtaactacagcaacgccgcccctcctccctatgagggcagggacgggccagggaggaactaccagtagagaagactggtagaagagcgctgtgtaggaagttagtaagagctatgctcgagtcgccctatgttgttctcgtggacttttatgcatatattctctatccataatggtgttttgagaactagaactactgcaagcttaggtaagaagtgctttgtttttttctctttgtcgaaataaatacaatgctgactatcgtatggaaccagagctttgttatttgttgccgtattgtaatagcaacatgttctgtgtgttctattgaatcacttttatatcctgtctgtgtaaaaaaaaaaaaacccacgcgnccg

SEQ ID NO: 22184 - DNA, 2515 bp, Triticum aestivum
  Clone ID: PAT_TA_22184
gcacgcggccggtctcctctctcaaccgccacaccccccccgggctccttccgcgcgatacaccgcccgcccgccacaccgactccggcgctccccaatccacacctccggggtgagtgcctcctcggctcctggggttttgggactttagccctcctgcgccgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgatccaaggtgttcgcggcggtgcccgtgaagcccagcgccgagttcccgaacgctgcccgctggtacgacaccgtcgccgcggctggtttgcttcaaggttccctggccagtcctctggggtgagtgcatcatcggctcctgctgcagctgctcctgccgcttccaaggatgaagatgacgatgatgacatggatctgtttggcgatgagaccgaggaggacaagaaagctgcagctgagcgtgaggctgccaagcctgcaaagaagaaagaaagtggcaaatcctccgtcctcatggacatcaagccatgggaacgatcgagactgacatgaagaagttggaggaggctggtccgcagtggttcaaatggtcagggtctcacctaggggttgcatctaaggcgtatgcctgctgggttactggcatcaagaagctccagatcatgctgacgatcatcgatgaccttgtgtccgtcgacactcttattgaggaagtgctttgcgaggcgcccatcaacgaatatgtccagtcgtgtgacatcgttgcccttcaccaagatataggatcgttcttccgagcaaccagtcgctgctggcactcttcgtacctcgcatctgtcgatcctagaaccagatctgtcctcggagttctatacccatctcacggacatgtaagcagattttcttcttcgtcaatccctggatatacgaactataccgactgtcagtcttagctatgtggctttgattttttgccgcgttgttcaagcaagttgtactgggagtactgttggacaacagggatataacaaaaaataaccaagaggcaacttgcctggcggccctggaccagcacacccaggcagcagtcctggatatcaaggtgcaatgcaccccctcgtgatgagctaccaagatgctagggttttgggattttagcctccagcgccgccgccgccgccccccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggtggggattttagcctccagcgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcctgaacgctgcccgctggtacgacgccgtcgccgcggccgtttcttcaaggttccctggccaggcctctggggtgagtgcatcctcggctcctgctgcagctgctcctgctgcttccaaggatgaagatgatgacgatgacatggatctgttcggcgatgagaccgaggaggacaagaaagcagcagctgagcgtgaggctgccaagcctgcaaagaagaaagaaagtggcaaatcctccgtcctcatggacatcaagccatgggacgatgagactgacatgaagaagttggaggaggctgtccgcagtgttcaaatggagggtctcacctggggtgcatctaagcttatgcctgtgggttatggcatcaagaagctccagatcatgctgacgatcatcgacgaccttgtgtctgtcgacacccttattgaggaagtgctctgtgaggcgcccatcaacgagtatgtccagtcgtgtgacatcgttgccttcaacaagatctagaatctttgttcgcccacctgttgctgctggattcttggtactgggattggttgatctggaaaacattatgtcgtcccatttagttacccctcttacagaaatgctactggttttgtttttgagtgatgccctggtcttgaatgcctgctacctttaaatagttgaattgctgagcggtttgtaatggcgaaacatctatcatgtggagtaaaatcagtctttgataaataagatagaaaaaaaaaaaagaacttgtttacaattgtttccatatccgagatgtgactcgaaactcaatcttaccaccaagaaataagaagctgtcgtgcctagccc

SEQ ID NO: 22185 - DNA, 877 bp, Triticum aestivum
  unsure (1)..(877): unsure at all n locations
  Clone ID: PAT_TA_22185
ctacagcctcttccatttctctcctctcctcgtattcttctacacgccacagctgcccaccatggcagccgctcgccggagacgtccgtcggacttagatcccaccgccggtccggcggccggctgttcacgcggcgggagcttgcgctatgaagcggcgttcggctgttccctacgcggctctggcccatccgctcgccggagtcttcccctgcaggcgtgagatctcatctggtagccatcttcccgctgcgcacgccagcccggccgttgctggtggcacggtgctgtatcttcgccagcggtcagcaggtcctgcggcagtggctggcgccacccagcggcggccagccgttcctgccggaacccagcggaaaacgtcgatcaagacgcccgggcgccgtccgctgtcccggttgccgttcccctgccgggcgcctctgtccgggttggcccgtcgtcgagcggtttctcgcggctgcgacccggctggggcgcgaaccggtggctccccgcaggtggggcgcggccgccccggggcccgtacccggctcaccgccgggccggcacgcccggtccggtcgcaccgattcggttccggtccgagattctccggtctgggtcccaatggaccggtgccaagatgctcctctctcccggtccngtccggactccnaaccgaccgcccggtccaaccaactcccgccactttggtgcgaccgaccgatttncccgccccggacggacggaccgnaacaagtccaancatccaaccctgcnacggangcaanacaaacgtccntcctccattgggnnggnactcaattgcaagtaggtttccgcccaaaaaanggcatctctctcgtnnccanaattc

SEQ ID NO: 22186 - DNA, 583 bp, Triticum aestivum
  unsure (1)..(583): unsure at all n locations
  Clone ID: PAT_TA_22186
aaacagtcgacggccagggacccgatcctggcgccaagnagctcgccgcccttgcaatggcgaccaccgccaaccccaccaccgacctcttctcgcgcctctcctttcgccgcgccgtctccccctccccactccgcctcccctccctgccgacccctacgccgcgcatctccgtcgccatcgtcgccctccacaagcgcaaccccaagcgcctcaagtacgactcccagcgccagttcacgagaggggatggcgggatgctgcgggtgcaggtggaaccctccggcgaggacttctggaagctggaccccgtcgtcgacctcataaacagcggcgccgtcggcgtcatcccaaccgacaccgtcttactccattgtttgtgatctgagtaacaatcgactctatttgagccgcctccgcagaanttcaaagggcattngtaaattcaaagcccctctccgtcttgtgccgctcgttgcgagatattgatacctacacaacaggatttcctctaggtaccaaccaagggcaagctaacattttccgtgctgtcaagcgtatattaccaggaccttacaccttt

SEQ ID NO: 22187 - DNA, 1761 bp, Triticum aestivum
  unsure (1)..(1761): unsure at all n locations
  Clone ID: PAT_TA_22187
accagctggnagttaccactttcatgtgggaagaaggcccaaggctcaagatgacgctgaagctgttcccaaacaacaccattcttttcaactcgcgtgaagtgcagaggctgagatacatgttcacagggtggctcatcgcggactcggatatatttgggccctatgagcttatcaacttcgacccagggtggtatgagaacgtattgcaacgtggtacaaagaaaagtccccgtacaggtgccattgttggtattgtcatcgcagcctttgctgcagcggcagttctgtcatcactcattactctcatcttattgcgaaggcgttcaagacagttttcaaagaaacgcaccgcgaaaaggattccgatgaaaattgatggcgtgaaagacttcactttcgaagaattatcaaactgtacaaacgatttcagtgagtcggcactaattggtcaaggagggtatggaaaagtatacaggggggtgttggctgacggaaaagtagcagcaataaaacgtgcacaagagggatctcttcagggttcaagggagttcttcacagagatagagttgctgtccaggctgcatcaccgaaacctcgtctctttgcttggctattgcgacgatgtggatgagcagatgctggtgtacgagtacatgccaaacggtactctacgtgatcatctttcagctaaagctagagagtctccaagttttcccatgaggctacgaatcgcactgggatcatcacggggcatcctgtatctgcacacggaagccgaccctccgatattccatcgcgacatcaaggccagcaacatcttactggactccaagtttgtagccaaggttgctgatttcggcctgtcgcggctggctccgctgccagacacagaggggagcgcccctggccacgtgtccaccgtcgtcaagggcactccaggttatcttgacccggagtatttcctgacacacaagctgacggacaagagcgacgtgtacagcctgggcgtggtgttcctggagttgcttacagggatgcagccaatttctcatggaaagaaccttgtgagggaggttgtggcggcgaaccagtcggggatgatcctgtcggtggtggatctgcggatgggggccgtgccgggggagtgcgtggagcggttcgccgcgctggggctgcggtgctgccgggacgagacggacgcgcggccgtccatggcggaggtggtcagggagctggagaccatctggcagatgacgcccgacacggacggcgtgccctcggagtcggtggccatggatcccacccacacgccagcatcgtcgtcgacagcaaccgggtctcggatgggccacgagcagtacgacatgtcgacgtcggacgtgtccggcagcaacctgctgagcggcgtggtgcccagcatcaaccctcgctgagaaagatgaattgtttgtttgtgtggagcctgcatatgtatataggagtatatggttgctggtgtatggatgtgtgtattatgtgtcgtttgtgccttttttaggaattgtgctctgctgctggtagaagtctgcgttagaaatttgcgattgttcaaattttccatttctgttttcgctgctagctaggcaggagctagtattaggaatctgtgagctattagaaatgttgcttgaaatttgtgattgttgatgtttctattccccttgtgtgtaatttgcttcatttggtggaaacaaaaaaaaaaaaaaaaaaaaaaaaaaa

SEQ ID NO: 22188 - DNA, 934 bp, Triticum aestivum
  Clone ID: PAT_TA_22188
cggacgcgtgggtgagtcacatggactttggccataaaatgcttggcgctgggccctacatgtttgcttgatatgctgctcggtggttcttgcttggttgagaggtggcttttggtcgcgctgtgtgttgatgctccatcatgctggttgtgctcatgcgagatacgtgggttatgtgggattggacgggcataccatgttgttgttcctgtggtaccgggaaggaaacggtgaactaaactttgcttgaaaaattcatcgcaagaaaagggggagatgacaatcatcggtccgtaaaaggaaaagcaaaccggtaatctctttcaatgctctgtttttgagattgagttgacctatcaatcttaaatgatcttctgttttggcaggcccccttttgggttgcttattttgttctggatcggtttcgttggggtctaataatgactgttgtcaaataatgactgaggtcatgttggttgattccaatctgtgccagtataccatagccattggaggtcccctacttctctgcagcctgcctaaaaatgttggtctgtgcctttgccgctgttgctcggctttgctacctggtcactggagtttgtcccagttggtcggccttgctacctggtcgctggagtttgctagctgttgtttccttgtttcgttgagctgtgccgttcgtcgctagagatgcatcactgggccgtgttcgtcgcgagagatgcgcatgagaataatgctgagctccctggctattcttctttggcaatgcaccaccggagtagcaggttccgttagtatgtagtgtattatagtgtgccattgcaagtttacatggccatcagataggtcatctaaagagtttttccttgtttaaatttagttacatggcattgcagttttacatgttttaatcgtctaaagaatgttt

SEQ ID NO: 22189 - DNA, 534 bp, Triticum aestivum
  Clone ID: PAT_TA_22189
ggaaagtcaccggcactattatgctactgtttttgatctgtagttgtaggtttcataatttagtgtatatgcttcagcagaattaatttgcatcttgtcatcaggaagatagcaagacagtggttgatcaaccccaccatcctctctgagcacctcaagtgcacgggtcggttcagcagtcccaggaagaagaatatcctgccaaactagagttttggagtttggccagcaatcaagaggtagactgagttgaacaagatagtcggtgatggaatatagatcttctgctcgtgctcggatagacattttcatctttttttcttttccattgggtgtcggccaaatggagatgttggtggtcttggttctgggattttgtaaaatttggatcaaatggctggtgatgttggtcttgtcgagtgctacagtaatacaccgttgtaaaatttggatctagattgtattgtgcggcagtagttttcgtcaatgtccaacaaacagattggattggtggcctgttggtgtaaataaatg

SEQ ID NO: 22190 - DNA, 847 bp, Triticum aestivum
  Clone ID: PAT_TA_22190
tttttttttttttttttcgggtgccgtctcctgttttttttttggcagcaaaaaatccacaccaatatgtacacggattcacaggctttagatgcttttacatgtttgggtacgcccaatctccgccacggctttacatttgtactgtacaattcatactcgtaattctccaaagactttgcccgctaaccagaaacaaaaagaaactttcgggagctgttgaagccccataccccatcatttttcagcttattattcacacatcctcagcatgaagagcaaacagcatagtcttccttatggctcagaactcctaactttgatctcccattagtttctcaacaggctgtctgcatatggggcatttatttgattggagccttagagcttgtgcacattcactgcacatacacaaatgcctgcaaggaaaaacagcagtgtcccttggctctgtcaagcagataacgcattctttccccatgccatcatcgtcagcatcaggaacatcagcttccgtggagttgacaatcccatatatttctttcagctcatagcgcacaccattaatccacaatatttgcttgacaactttgacttgaagatcgtcgttatgtttccccggccccgcccgcgctatttgtgcccgtgtggagtttactgtttgaccaccttcctctggagatggagaagcttccgcataaactaccagtgggtatacttcctctgaaggatttgaaagctcatccagagaaaagaatcccagatcaatgccagatccagagggctggacataattttgagccaatcctttctggaaaggtatctttgttggtgtctgccctcgtgc

SEQ ID NO: 22191 - DNA, 260 bp, Triticum aestivum
  Clone ID: PAT_TA_22191
tagcgtggtcgcggccgaggtttttttttttcagaattcaaagtaatcatgcacagcctttcatttcattgctccgcctaacgattagagagtttatacaaaagaggttcttggtgatcttaaataggaagtagtagaatacaagctgttcatcacatacccacagcaatctggctgtgtaaatccccagatatatatagtagtagatgccattcgttttttaccccgaagtaccggccccgccgcccgctcggctcggc

SEQ ID NO: 22192 - DNA, 1414 bp, Triticum aestivum
  Clone ID: PAT_TA_22192
ccttcgcccgcggacgcgtgggcggacgcgtgggccggccggcaatttcgatcccccctccctcacaagttctcctatcccggatccatccagaaaagcaggttggtccgcagcctggtcggtcaaaggcgctccgtccctgcccggagttgatgcgcgccgccgtccgaatctctgcgcgaggcaggccggtcaaccgatccatccggccatggcgtgcaggggcttcttcgagtgcgtcctcaagctgctcaacctcgtcctcatggctgtcgggctggccatggcgggctacggcgcctacctgctcgtgctctggctccagctgctgcctccgtcgccgccggcgccgcctccaagcggcgacctagtgcaccttggccggccgatgcttcttcttattgacgtgtctatctcagatgggacctcggagaagctcatcagcgcatggtttatttttgcatttataggtgtcggtgttatacttttcattacctccatcttcggttgtgctggagcgtcagctaggagtggatgctgcttatccacttattcattcctcatcattttgttcatactagtagagcttgctgcaggatgcttcattttcttcgaccatagctggaaagatgtaattccatgttgataaaactggctaacttggacatgagctacaagtttcctgaaacgaaaattggggaaaccgcaaaatgggtcgcacttggagctgttgtgtttgagggatctgctacacgtttcctgcaaagaaaagttggagaaccgcaaaaatgggtcgcagcttggtgatgattagtgacagagggacctgatggtccggagtccgtcagcaattggtgaataaacaaacggctaccgatcccggggtgctgaatcttgagtaccgtcgactggagtccgtcagacataggtgaataagcaaactgcaaccgatcccagggtgcccaatcttgactaccgtccaatcaggaacgatgcatggagccaaagaatgagagacaagtatggggtggattcctttgatccaaacaggtttcaacaggccacgatatctcccgcagaacaaagaaacagatgcacaatcctctgatgcttggtcgatgcaattcagtactggtctccgaatttacagccagctgtgcaatagcatcgacttgcatgtagcatgtggctgggtgatctgttgtttccaagttgtgttggatgtggcgagcccttgcattcgcccgtcctagttccttcatttacatagtcagaaatctctgcatccttcagtctttgcaataattgaacttaattttggccatacaggacattctattgtgtacacgttcccatggaaccttatatggaacttcaatctgtgaaccgattagcattgagcaaaaaaaaaaaa

SEQ ID NO: 22193 - DNA, 905 bp, Triticum aestivum
  Clone ID: PAT_TA_22193
gcgggcggcccgaatgcccccggcgcggcgcgcgccgcgacgcggcggcgccctcggccggggccgctcgggcgtcccgtcgtgttgctgcttggcacattctggtcgcgcgccctgaacttgcccggggcgctccctcgcttcgggtgcctcctatcaggctggccggccgctgtggcacggcgcgcccgcccgcaaaatggcccccccccccctaatactttgggcctcacggactcatgagcatatatacgccgcgggacgacgccgcgcggcgcgaattgctccgacgaggcacgcgtaagggagcggcgggcaacactgcctcggccggtggagggtcgggaggagtaaacccaacaaatagatggcaaccaacacttcagcaacagattattcatcagcaggcacacagccacagattgacagacgactcctggaggcagccacatcgggtgatcccaggcgagtcaaggaattagtatcacggaatccaagcattatacttggaaccactccacaaggaaacagctgcctccacatatcctctatgcatggtcacaaggaattctgcgaggatgtgctggaaatagaggagtctctccttttaaatgctaactttgagtctttcctctcaaagttgaatcttcaaggggagacaccgcttgtaaccgccgttacacatggtcatgccttcgtggcttcttttttagttggacgctgccatcgactaggattgagacaggtaatcttgcagcaagacaagactggttgtaatgcactgcaccatgccattcacagtggccataaggaacttgccctcgagttgatagcagcagagcctgctctgtcacgagatgtgaacaaatttaaagagtcacccttgtttctcgctgtcatgagag

SEQ ID NO: 22194 - DNA, 1738 bp, Triticum aestivum
  unsure (1)..(1738): unsure at all n locations
  Clone ID: PAT_TA_22194
ggctcttccctcctcctccctccgcctcatatcaccaccactcacccaaccggcggccaccaccattgccagccacaacgggacagatccccgcataaattcctccacccgtcgcgccgcccccattcgcccacgcccacgcgcgcgcacgcggcctccccctcctcctcccccattcgctccctccctccctccgccggccggggattcgggtttggggggagatggggtacgtcgggagccacggcgtggcgacgctgcgcaagtacaagtacagcggcgtcgaccactccatcgtcgccaaagtacatcctccagcccttctggtcgcgattcgtcaacgtcttcccgctctggttcccaccaaacatgatcacgctgacaggtttcatgtttctgctgacatcggcattccttggctttttgtattcacctcatctcgatacagcgccccctagatgggttcatcttgcacatggaatccttctcttcctttaccagacttttgatgctgtggatggtaaacaagcaaggcgtacgaactcatcaagtcctttaggcgaactttttgatcacggatgcgacgcgcttgcatgtacttttgagtccctggcttttgggagcactgctatgtgtggaaatgctaccttctggttttgggtcatttcggctgtccccttctactttgcaacctgggaacactattttacaaacacacttgttcttcctatagtcaatggaccaactgaaggccttatgctgatttatgtgtgccatatcttcacctttttcacaggagctgaatggtgggcgcaggatttccggaaatcattgcccctccttaattgggtgcctcttgttcctgaaatctcgctatatggcatcgtgctgtttctaatgattgcttttgctgtaatcccaacgattggatctaacactcacaatgtttacaaagtcgttgaagcaagaaaaggaagcatggtgctggcactagcaatgctcttccctttcggtttactcatggctggaactctcgtgtggtcctatctatctccttcagatataatgagaaatcaaccacatctgctaatcattggaactggttttgcgtttggctatcttgtgggaagaatgattctggctcacttatgtgatgaacccaaaggtctgaagacaggaatgtgcatggccctggcatattttccgtttgcgattgcaaatgcgttgactgcccgacttgatgatggaaaccccctttttgatgagcagctcgttctcctgatatactgcttatttacagtggcgttgtacctcggtcgcgcccacccttggcgcacgcccactgccaacgcgcttgggacgcatccccgaggtatcacaaggaaaaaggcgtaactctgacttagttggtaatcaacatggtatctaccaaagaagcaaacatgcctgcttgtcttcattataggggtgatgtccgaatcatatttgcatctgtcattacagggacattctcccctgaaatttacatcagcactaaaatttgtgctgatgagaaaacaatgtatgtgaaatagttggcaaaattttgttgtattgttcatagagcaaatgctcagcaaaaactttctgggggaaatgctgtgctgattggcagaagttgcctttgtaacttgtcacattgtaacatcagcagagatgcggntantgttgtttangcattttantcgtcnctttttcg

SEQ ID NO: 22195 - DNA, 738 bp, Triticum aestivum
  unsure (1)..(738): unsure at all n locations
  Clone ID: PAT_TA_22195
cgacgaaagctgcagcgcgaaattgaatacggcttggcaccacgccgccgccgcgagccatcgtcaaaagatcgagagaagcaaaagccgcccacggaaccatagcccgcccgcccgcccgcgacgaccaagcagagagggagagagatcagccctgccgcgcgcgctctcctcggctcgtcgtcgtccccccttcctcttcttcccgtcagaggcggcggcggcaccgccaccgccgacaagagaaatggggctcctggagctcttcatcacggcatgcatgcccgtcctcaacatgctcctggttactggtgttggatcattcttggcaacggactccgttgggatactggggaaagaagcaaggaaacacctaaactatgtagtattttatgtattcaatccagctcttatcgcaacctatctggccaaaacgatcaccatggaaagcatggccagattgtggttcatgccggtgaatgtgttcttcactttcatcttcgggttgatcttcggttggatcgtcataaaagtcaccggggctcccctgaagttaaggggcctcattttgggttgctgttctgctggcaatctgggcaacattttcctcatcatcataccagctctctgcaaagagaaggggagcccgttcggcgcacctgatgtttgtcagacttatggactagcgtattcgtcactctcattggctatntgttcggtttataattggaggaacac

SEQ ID NO: 22196 - DNA, 532 bp, Triticum aestivum
  unsure (1)..(532): unsure at all n locations
  Clone ID: PAT_TA_22196
atatttccgctggtaaagatgcttgaagagggtgaaggagatgtactggaagctagtttagctgtcttgtataacctaagcttggatccagagaatcacccgccaataattgctgctggagcagtgcctcttttgaagcgaattgtccatgtgggaaagcccacactgggaatccgtgctcttcaagttgcttaagaacgttgccccgttataacatcatggcacccgactgaccacttngatctccaatagatgtttgactccgggttattgcggtgacaggtatgtttgtaaacatccatgacctgtttcctatcaactggttttaatccaaatggctgattcgatgctatgcaaagaatgctgttaagattcttgacctgttcctaccacctggatgccggtcagatgctatgcaagcatgtacctacaactttttcctttttttggataaaataactttattttttgaaaaaggagnnactcattaattttngnaatccttatttanatggcctggaaaaaaaaaaaa

SEQ ID NO: 22197 - DNA, 659 bp, Triticum aestivum
  unsure (1)..(659): unsure at all n locations
  Clone ID: PAT_TA_22197
ctagtctccagttttttttttttttttttgttctcgaaaattttataatagcatagatcttttctcttgtttgttcgttacagcatggtaaggctgcctctttttctttcgagatatgtacatgttctctcaacaaagatgtacagggaaagtattatctccaaaataatcatggctaagccaatagttggatctgaccgatttgataatgctactgtacgggaaacaaatctccctatacatctagcgtatagctaaacagttaaaaggaaaacattgcaggaagctgagattcaaaacctgtacatgtaggctttaacttcaatatgaacatcctccctgatggtccttgcaacagcacgnagataaaacaagattagttaaatccgcaggcaaggaggagaaactgctgttgggacccggggtgaaagcccaggatcgacggaaagaacgggcagaacccggggaaagactcnactcnttnancccagaacatacaaccgngcnacacccttncccccnatgctttangtccaagaccctnnagattcctnccnaggactnactnattaggaaagngnaaggttccaattagggccccctttcatatgnaanggagggaaaggaatttaggtnanaanttaaacttaatggcncaa

SEQ ID NO: 22198 - DNA, 706 bp, Triticum aestivum
  Clone ID: PAT_TA_22198
ccaaggggaacaactggctgctggtggacaccatcttttatgagtgagatgggtgctaatttaagaatgcaagattacactgttgaggatgagcatattaatgtcttcggatactgcaggtgggggacaacgccaagtttgtgttttccagatgggtcgatgcatactgtatctagatatcaagggcaagacattgcgtaaagtgtatgagatgaaagataaggattggtattcggtttattatatttttccttttaagatggtttggcctccgatatttcctgcactgaagccgaaccttcaagaatcgccatctgaagaacaatatcatccagctcagtgacaaggaccataaggttataacaaaagaaattttatctgtgggcgtcgtagattctggcgcccaaaccctgcgaggccccctctatatatgccaccatgattcaaggatatggccacattgggaatatgggttcattttgctggttacatatttcccccgataccaagcatatctagaggggcgcgttgcctagactgtagtattctggcattttgtctttggaaaagtttgtcagtcattgtgaaataggattatgtaagaaaatccaaatgcatgccctccaggatgaaaagaacaagacatttagaaacgcctccggaatgtttcatgtattttatgccctcataatttaaaaaaaaaaaa

SEQ ID NO: 22199 - DNA, 299 bp, Triticum aestivum
  Clone ID: PAT_TA_22199
ccaatggaccatgggcagggtgcatccaccgctatccagtccagatcaagtcccccaaaacaagcaccggcaatacacggatggcaggtcacaacaataagcagttgagagacacttgaaacgggctaacaaaaggatgctttgtttcttttttttttacccgctttgatttctaaaataaatagggagtacaagggaaggcaaagcctcactgttataatgtaccatctccattattgtacctgtacaccgcagaaaatatagtactcaatcttttcttaccttctaaaaaaaaaaaa

SEQ ID NO: 22200 - DNA, 367 bp, Triticum aestivum
  unsure (1)..(367): unsure at all n locations
  Clone ID: PAT_TA_22200
tttttttttttttttcaacagaagggcacttcatatggccagagatacaaagtacactttgcacaaaaaatgttcctcgtataatagtagtgtaatctgagtataaggcaaacggccaactacgagtatttctcatacagatcaattccccattagatacgctactgtacaaccaacaagcgctccggcaaaaacctgaaatggacctgtgtccaatgaggnttcccgaangcgggccggaagggggagatagttggttggtccggtgataaatcagaaactatntgatttaacaacgcagcttggcggcctgtgtgaaacctaactcctgatgcatcatacattacaacggcagcaaaaggggggg

SEQ ID NO: 22201 - DNA, 658 bp, Triticum aestivum
  Clone ID: PAT_TA_22201
tgatgctctggtttgttacaccccgcttgtccgggtcgtgtgtgttcagtgcttccccggcttctagcttttggctcatccgcgcttgggttcggcggtggcctccccgtctccactgatcgcctgccgtttcttcaccaccagctagtccttggcgagccccgtgccgcgagcccccctgcttgctcatgccgccgccagtcccgcggcgccgacggggccgtgcagtgccccggcccgcaaggctgctgcgatccgacggccgcagctgacgccccgcggcgccccggggccggatcggcgcttctgctgccaggccccggcccctcccgcatctggcgccaccgtgcgccctgcaccggctccggctcttctgctgcctgccccccgtccctcgctgttgtggtggtgtggcgcgctgtatgcctgggccccgtgtcgtgcctgtgtgttctcccgcgcccactaattcgtcttttcttttgtttaggggggactactttccaacacatagatttttgtctgtgagaggctcgttatatgggcgggggttgtgtcttttatttcacgagcgatcgttaattcgaaaataaatttttatgttaacagattgtcatgttgtttgtttcaatgttaaaggactcgataaaaaaaaaaa

SEQ ID NO: 22202 - DNA, 924 bp, Triticum aestivum
  unsure (1)..(924): unsure at all n locations
  Clone ID: PAT_TA_22202
ctcgtcgacaagcctcgcctaaagcctccggcagcagctgaaccttatcggcgccgcgaaccttataccggccggaccgggacctgattcggcagcagcaggcggcggcagtaccactccacccgcacgcgcgcgcatggccgatcggggcgggaggtgttaactgggcggcacggagatgagggagctggcgggaaggcccgggacgtggggcgggctctggctgcggctcggccaggccgcgctcgccgccgcctccatcgccgtcatggcctccgccaacggcttcgccggctacaccgccttctgctatctgattgcgtcgatgggattgcaagcgctgtggagcttgggacttgcatgtcttgatggatacgcccttaaagtcaaaagagatctcaacaatgctgttttagtgagcttatttgtcgtcggagactgggttactgcgattctctcgtttgctgcatcgtgctcagctgctggtgtaatagttctttttgagagggacatttctttctgcagaagatattacgaactgccttgtggaagatatcaactcgcgacggcatttgcttttctgtcctgggcgctaagtgctacatcagcggtcatcatgttttggctcctggcatccttctgattttgtgtatagtcctccttgtgtaagttctgtttatagtgaggttccgctcatcataggatttatataggacgattttcagatatgtaagcaacagaaacacactgccaaaacagatgggaaatgttgggacacctgtaaccccgcggcgtagcattcctaggtatataccacgggagcctctcanataatgatgcaaacggttccaaaaaanaaaaaanactcaggggggccgtaccaatcgccanatgatcgataccgcctanggcgtcgttaaannc

SEQ ID NO: 22203 - DNA, 596 bp, Triticum aestivum
  unsure (1)..(596): unsure at all n locations
  Clone ID: PAT_TA_22203
gtgggctgctggatgtggattgtgagtccacggcaagaccgaccttgaaacatcaagccaccttctcaagtggaagatgatcctgctgccgtcaagtctctgtttcttgtcagttgtcagcttcaattaatacatgtacttttggttatgcaaaggtatcggagcagcagcgagccactgaccttttctcgcagaaggtgaagaggtcgcgtttagcactctggacaagctggagctgctctccttcttcctgatcgagccgagcctcgtgactacatcaattatggcagcgacgaccatctacactactcagtgcatgctcaacgggtgctggtcctggaacaagtgtcgtgagctccacacaaagtactcggaagatcagctctgggactacagttcgacgattcgtctaccatgtttcgggggcgacgtactccggcttcccctatgtcccgggcctcangctggacctgctcactgaccaagacangctaagacctccaaccttgtctgatccaagtattacattgaccganctcttccggganaaggcacgtcgcaanccctcngntaanataggatccttcaactcnctt

SEQ ID NO: 22204 - DNA, 535 bp, Triticum aestivum
  unsure (1)..(535): unsure at all n locations
  Clone ID: PAT_TA_22204
cttgaatccctcataagctaacctctctgtctcccatctccaccatctcaactccccacaaagtcatggatgcaagagaatccaacctcctctagggtttacgacgtccgtcccagggcagaatcagtgggtatgatggcgatggcgganacgaccgaatctcaagaagatcgatctagaggctaggtggggcaccaataatctcatcggcatccttcagggcaagccagagccaaatttagcttcaaggattaaatgaggaagacaccagctctgtgacaagtagcatgaatccttcgaggagtgcatccgtgccatggttgaaggtcttgatcatcgtatattcaaagttacattagacacattcatagttcctgatggaataagttttctttctcctgacttttcatttattctattgttatactagtatccattagttcacatctgaaaaatggcattttgtttattttttagagttgcaggtaggtgactgcgacttgcnaattgtaccagatttangtcngtaaacnag

SEQ ID NO: 22205 - DNA, 618 bp, Triticum aestivum
  unsure (1)..(618): unsure at all n locations
  Clone ID: PAT_TA_22205
cccgccccctccgccccccgcccacagatctcctcctcctcgcctgaacccgccacttcggccccgaaccctaaccctgcgcgctcccgtaggatccaaccggccatcaagcggtggcgccatcgtagatgcgtagctctatagcgacctatcgggagagcctctcccggctcgctggcgaggtcgacgacgccacggcagacgagatccccgcgccgtggccatctcggcgcggagacaacgcccctacgcctccgtcgtccgggcggcggaggcggtacacccgcccggaccccgctgagccggacgagatttctaaactcaaggaagatattgaaaaaattcaagcttctgaggctgaaataaaggcattgtccttcaattatgctgccatgttgaaggaaaaggaggaatgtctgatagcagaatgcgcagcaaatcccccttctaacacaggtaggcacaaagataaccttgggcgggcgggtccccatcccccgtgctgttcattcagggcggatgggccgtctcggagcgtcgaacaggaaaaccgggggaccgcttttcgcctgcagcacccctaccagctgggggtccatcgggccatcgttgcttcan

SEQ ID NO: 22206 - DNA, 657 bp, Triticum aestivum
  Clone ID: PAT_TA_22206
gccccctctagctagcacaccacctgccctgccccgcccgccgcgccctggcccccgccccgccgcgccaccgccccccccccgccgcccccccgcgccaccccctccgcctccccccgcccccatctcggccccgccgccgccgtcccccgcggccgccgccgtcggcggctccggccgacggccgggggcccccggtgacaatcgagcacggcggacgactcgcgggtgttgcagatggtaggaggaggagaacatcctggagcgcgcgctgggaggaggggctggacgttccgcacgactgcaagctcggggtgtgcatgacctgcccggcgcggctggctgtccggcacggtggaaccaacagcgacggcatgctcagcgacgacgtcgtggcgcagcggctacgcgctcctctccgccgcctacccgcgctccgacttcaacatccgcgtcatccccgagcaccagctgctctcggcccgcctcgcaaccgccgacgaccgactgcccccgccgccactcccggccggccacctcgcgcgccctcgctcggctgtgtccccgtgctccgaggcgctgtacagcgttgttcaccagcctttacaataagatgccctttttttttgcctaaaaaaaaaaaaaaaaaaactcgag

SEQ ID NO: 22207 - DNA, 610 bp, Triticum aestivum
  unsure (1)..(610): unsure at all n locations
  Clone ID: PAT_TA_22207
gccccaggggcgaatcaccaccgcccctccgtcttcctcctgcgtgctgctgctacagtagcagccgccgcccgcctactaccttctccccgccgcagcatttctcctccttcgcccccctaccccccgccgccacacgtcccccctgagcggcggctctacgccgccttcgtcgtcatccgccgcttcaagactaccacctcctgccatccgaggatcaccaccaccacctggatccgccctgatatttgtggcagagagagctaccacggcttctactgcacaacaccattggggcacggcgagtacctcacagtcacctcgatcgttttcaacggttttggtctgtgtgccccggagctgcaaggcttcatcgatcagctccccgatcttgcgctcttcgaggcaagctccaaccgccttgagcgtcgacatgcctcgccttgagggcctcccgtacaaatacagccttgatattcaagacaatattgaactccacagttctgggcttgaaaacctattcgctggaagacattgtaatataatcatggtcaataagattacgggcaagttattctgcagtgcggagtacagtctaaacgacctgann

SEQ ID NO: 22208 - DNA, 468 bp, Triticum aestivum
  unsure (1)..(468): unsure at all n locations
  Clone ID: PAT_TA_22208
atctctcccccctctccccctcccctctctcctcctctcaccgtcgccgccgccgtccaatctccggcgagatcccctcccccgccggcagccatggcctccaccttcagcggcgacgagaccgcccccttcttcggcttcctcggcgccgccgccgccctcgtcttctcctgcatgggcgcggcgtacgggacggccaagagcggggttggggtggcgtcgatgggggtgatgcggccggagctggtgatgaagtccatcgtgcccgtcgtcatggccggggtgctcgggatctacggtctcatcatcgccgtcatcatctccaccgggatcaaccccaaggccaagccctacttctcttcgacggctacgcgcacctctcctccggctgggccggctgccgcccgcgccgcgccccccgcatcgccggcgcgggcgtcggccacccgggttgggcacgnnaaaacc

SEQ ID NO: 22209 - DNA, 760 bp, Triticum aestivum
  Clone ID: PAT_TA_22209
gccgcccgcgccggccatggccttcgtcgccatccacgcccgcctcgccgtcctcccccctcgcctcacgcgccgccgcgtcgtctctccgctccgcccctccccgcacccgtctcccgccgctcaggacctcaaccggacacctcttccgcagcctgcggtgccggcgccggccgtgtcgcgctcgcgccgcctccatcccccccaccgcatcgctcgacctcaccgaggacaacgtccggcaggccatcgtcgacgcaaaagccgagctggcccagctgttcgacacgtcggtcggcataacagggcaagttgatctgggcggagctggacggcccctccgtgaagctccggctcaagggcaacttctggcacacccgcgccaccgtcgtcgcgcggatcggcaactacctcaagaagccgtataccggaaatcttggaggtggagatcgaagatgaggcccagcttacacgacagccccgcggcgtacgcagttgcttacggcggctaccttctcattaccgcggcttggtagcagcgttgtgtgcgtgcgagccttcgctgtcggcgcctaccgttttccggctcgcgtccgggaggatcatcatcttgtaagtgggaaggatgcatcaatgattatttttgagaaaacaagggtaaccccggcctttgcgtcattgtgatgcacacagccaaaggatacatcaatgatgatcatcagttccattaattaatggaaagaaattgggagcgaggctc

SEQ ID NO: 22210 - DNA, 575 bp, Triticum aestivum
  unsure (1)..(575): unsure at all n locations
  Clone ID: PAT_TA_22210
gccaattctaaggcgacacatattgccgcgtancggttccaagcccggagaaaggaggaggaccagccatgtaataggttaaggaggaagggatgtacttatgcaatgatcaaaccattgtacactatgtggtgtagctgctccacaatttgttcctaactactcgatgagcttgacaatctgtggaatttaaaatttatagtttacttcgatctatgaatgtggccattcattctggcagcataatctccggagggagtaccgaccattgttcaaggcggtgtgtatgcggttggagcgggtagcctcgaaggtttttagtcaacatgagtggcagcataatctccatatcggtccaccacctccttcgacataggcagagtatcggttttatatgtctctacttttgctgatatgtcggtttttcattttattttgtctgttgatgtttttgttgtctgcgtcttagttatacacagaccaggtgttggtcatcatggctttgtatccacttaatgctacatttggagttaataaaaancactctctaanaaanaantgaattgccaaaacca

SEQ ID NO: 22211 - DNA, 516 bp, Triticum aestivum
  unsure (1)..(516): unsure at all n locations
  Clone ID: PAT_TA_22211
cctgcccactagcccgagctccagaagctctcctcaacccccatagccgccacctcagctcggctaaattagcccgaagccgagcctccccctcctcttctccaccaccagcgacctccatcaccacctcggagccaccctaacacctcatcccctcctccggtggcctctagccgcaacccatcaccgcccggagccgccgtccactgcagccgcaaccttgctcgacgccgtcctccccgtggtgtgtagacgctccaggcgggtgcggctcatctccctaagcacgtcgatatgctgcacggctcgggggatggctgaagtcggccaggcaagcgccggtgccggaggcctctctctggaccgcgggcgaggtcggggagaagatgaaggcgatgacctctcccctctagctggctgtggaccctngcgggccccaggcgtgagcgacccagaaggccggccccgccccgccgatgtggatatgtggacacggnttttgcgtctangctttta

SEQ ID NO: 22212 - DNA, 518 bp, Triticum aestivum
  unsure (1)..(518): unsure at all n locations
  Clone ID: PAT_TA_22212
ctgatatgaagcaaggaagtcagtggggggagctctagcctatactcatgacaaaacagaagcaggagcaagctgccacccctagtcccagccccgctctcttctccctccaccctacacttttcttcctattctcgtcgctagattccaacttccagttcacccccgccgcgaacaagaggcaaccggcgacgacgaaggcagaggaggacgaaccttcgcactcgcagggcgatgaccggaggctgccggccatggatcatgtcaggaagcgccaccaggagaagggcttcctctatgactgcttcttcatgttgtgctgctgcttcttcggcnatgaanccgcgagcactgcctcaagcgcttctgctgcggccgcaacaggggcgantgaccacaaccggtccggaatcggngctcatccaagataacttgtggtttgnatggaatttcatttggtgcaattncacatttaggcangggnaaaaatcgtngttaatcggattggctcccngatc

SEQ ID NO: 22213 - DNA, 497 bp, Triticum aestivum
  unsure (1)..(497): unsure at all n locations
  Clone ID: PAT_TA_22213
acctcccgacccatcccacacgcaccgccgcccaacctggccaccaaccatcccacgccgcccgccgccggccaccaccccgcaccaccctccccggccaccgaccaccctgcgccgcccaccccggccaccaccttcaggatctggccggtgaccccgaccaccgcggcgctccaccctcccacctccttccgggatctggccggcgaccacgggacggcctcccgaccaccgcgacaccacaccatgccaccaccttcccctccaaccaacgctgactccccatctctccccgtcgatgccacacaagtcctgccagccgcccccatgctctgccccgatgccccacttcttcttcctcctcccctgtctcccccaacaaaccgtcgccacaccccaagcctgcctcggcggttgccggattccgcanaatacntggtcgcgagctgcccacaatcgnggttcgacagcatggtctgtgcaccgctaagatggtt

SEQ ID NO: 22214 - DNA, 700 bp, Triticum aestivum
  unsure (1)..(700): unsure at all n locations
  Clone ID: PAT_TA_22214
tgcgaacccagaaaggaagatggcagcacggctcctccccctcctcgtcctggccgtctcgctggcgtggccggcgtcgtgcaagcctctcccggtgctcgttccggtgaccaaggaccccgccaccctcctctacaccatccccttccactacggcgctgacctcgtcgtcgacaccgccggcccgctcgtctggtccacgtgccagcgcggccacctgccggccgagttcccgtgcaacagccccacctgccgcctcgccaacgccttccacatcccaggctgccgcgcgcgcggctgcggccacgacacgcgcaaggacaggacctgcaccgcgtatccgtacaaccccgtcaccggcgcgtgcgcgcccggggacctggtgcacacgaggttcgtcgccaacaccaccggacggcgtccacccggggagccaggtgaacctgcgggccctggcggcctccgcgcccagcaggctcctcaagtcgctgccgcggggcccccgccgcgggcccgcgcgcgcccgccccgcccgcgcgctcctggccccccggggcctccgcgctctccctcccccccagggtccccgctgccccccccgcgcgggggcccctcaatccccgccctggcggtcttccgggggggccgcgcagccctccgcgctcccggaaggtcttcagcangagctcgttaacgccgn

SEQ ID NO: 22215 - DNA, 626 bp, Triticum aestivum
  unsure (1)..(626): unsure at all n locations
  Clone ID: PAT_TA_22215
ctcgtgccgaattcggcacgagaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaagtgggtgccttgcctcgagttcagcaaggtcgggttcatcttccgtgagcacaacgcgtcccccgggtactacgacggccgctactggacaatgtggaagctgcctatgttcgggtgcaccgacgccacccagtgatcaacgagtggaggagtcaagaaggagtacctgacgcgtactcgcatcatcggatcacaaatcgcaagtgaatgcgcaactcacgcctcaancacgggctgcaagatccggnaggctaacagtcaccacacggcaatataaggcatgcgtttgtaanncgaatgcttggttcctccttcgctgcgccttaa

SEQ ID NO: 22216 - DNA, 675 bp, Triticum aestivum
  unsure (1)..(675): unsure at all n locations
  Clone ID: PAT_TA_22216
ttcgagcggccgcccgggcaggtactcttgctagcacatttgttttggtttttgttgctgaatggggtgataaatcatttttctcaacaattgcacttgctgcggcttcatcccctccgggtgtcattgcaggatcgcttgctggtcatggtgttgcaacattgattgcagttcttggtggttctttgctggggacattcctatctgaaaagattatagcatacatcggagggagcctttttttagcatttgccgctgtgacactagttgaaatcgcgacttcatgacttgagaggggacccaagattcgccgacatggtacctcggccgcgaccacgcgttgatatgggaacaccgtagcatgcattggatgatttgttgttgctgacgagaatttctgcctccttttccacggcatccctttatcagcatgattggtactgagactcagagcacgtgtaaaactcaagtccaaagagcattttttttacctgtagatgtcatttgggatgggacctgggacaaagagctgtagatggcatgtagccttttttcttacccttaccttttaccaaaacattgttcagggaaagcacactccactgatttgttcaacaaaaaaagggggggcccggtanccaatttggncccaaaagtgagtcggattaangcgcg

SEQ ID NO: 22217 - DNA, 696 bp, Triticum aestivum
  unsure (1)..(696): unsure at all n locations
  Clone ID: PAT_TA_22217
gcttagtgcgaccatcatcttcgtgctcgacgagcaacgtcgtcgaatggaggaggaaggagagtgggctgagtggggggccatggtggggtttggaccgggttttaccatggagacaatggtgcttcaggccaccagcaacctcaagaaaaaataattagcacttcattctgcttcagcacggcgatgcccgcttccacgtggctacccgcatccatccttcccgtttcgtgcggcctttcggtcatgtctgctgtcgcgcgccacaaagtgaagctggtggagacaaaaaaatcctggcaaaaaatgaagaagaagatggagcgcctgtgaccgaagaagaagttccttccttttggcgtatcgctgttcttgctcttgcagctcctgtttacttatcttcagtggttggtctgtagtaatatctatgttgatgtgcccatgctgtcgctggactctctggctgtctgtagtagtataatgaaacatctgaaatgttgctcgccttcctggtacagcagcgatgtggctggagtctccggaccccctaaacacgtcccctanacangattanctgtcgtccaagtncccaaagataccnaatttcggttgttccnggnggaaccctttttnaaaaananggngtttctgaaaangggattttttccnaaaaaaggggggccgtaaccaatttcc

SEQ ID NO: 22218 - DNA, 1062 bp, Triticum aestivum
  Clone ID: PAT_TA_22218
gtcgcgtagcttcctgcagccatatcgtcacaggccggtagcaggaaaatttcagcagctcggtgtcgatagattccctgcgatacacgagcagacaacaacaacaactagtcagtcagtcagtcagtcgcctcaagctttcttcgaagttgcaccggcgctagccctttcttcttctgcggtgtgccgccggccggcgatgaggtggtgggagagcgtcaagagcctgttcggcgacggcggcaacctcggttgcctgtcctgcgtcgggaggaaggcccccgaggatctctactcctaccccatggagcccgcgaagctggaaacgatcgcgccgcgccgctccggcggcggaggaggagccgggcgccatcgaggtgccggcggtggcgctccgggaggtgaacgagctaaccggctccttcgacagggagaagctgatcggggaggggtcgtacgccaaggtgtacaaggtgacgctgcggagcgcgaggctcgccgtggtgaagaagctggagaaggcgtccaagcacgcctccaacgacgtcttccgccggcagctgtctgtggcgtccaggctgcgacacgagagtttcgtccgcctgctcggctacaccataagcggcgacctccgcgtgctcgtctacgagttcgccaccatgggcaccctccacgacgccctgcacgggccgagggagggcgtgggggcgcgggaggaggtggaggagaggccggtgctgagctgggcgcaccgggtgcagatcgcgctggacgcggcgagggggctggagtacctgcacgagaaggcgtcgccgccggtggtccacaaggacgtgcgctccaccaacgtgctgctcttcgacggcatgagggccaagatcgccgactacaacatgttcagccaggccgccgacatggcgcgactcaaccgctccacgcacacgctcggctccttcggctaccaggcgcccgagtacgcgatgagcggtcaaatgacggacaagagcgacgtgtacagcttcggcattgttctcctggagctcttgacgggcaggaagccgc

SEQ ID NO: 22219 - DNA, 1301 bp, Triticum aestivum
  unsure (1)..(1301): unsure at all n locations
  Clone ID: PAT_TA_22219
gcacgcggcacgggccggcgtacggccgccccaaccaagtcagcagcagccaagaaggaccctcgtcggcggcagtcaggcgagcaaggggtcagccagccgagtccggcggcggcggccatggcgctagcggctaacgcccatggaagagtctgcaccctctcctccaggccgccaacacctttcggcagcaggagcatggtcaccatgcctggacaccacgtccaagctcggttcgcggtccgggcgaccgcggagcgcgcgacatggctgccggggctggacccgccggcgtacctcgacggcacgctgcctggtgactacgggtttgatcccctggggctcggggagcagcctgaggacttgaagtggtacgtccaggcggagctcgtgcactgccggttcgccatggcaggggttgccggcatccttggaaccgatttgatccgtgtatcaggactcggcaacctacccgtgtggtttgaagcaggtgccacgaaatttgactttgccaacaccacacctcttttcgttgtccagcttctcttgatgggatttgtcgaaaccaagaggtacatggacttcgttaatccaggatcacaagcaaaggaagggacattccttgggatagaagcttcactcgaaggtttacagccaggataccctggggggccactatttaacccaatgggactcgccaaagatatagagaatgcgaatgaagtgaagctgaaagaaataaagaatgggaggttggcaatggttgctatgcttggatttattgtgcaagcgtctgtgactcatgctgggcccatcgagaatcttttgacacatctttcagacccgttcaacaaaaatatcattcatgcactaaccttgtcttgaaaattcactgtctcgaaatttcgtttatttttccttttttccatctaataaaggtgtagcacatcagatcacaatggtctcttacaggaagcgcaattcttctcagccccctctttgtaaggctctatcggtaacgaaaactgaatatgaaacttctgtgggaggaactgtaaaaaactcagtacccactcgccactacaggtggggtgacaaattgattttcttcaaataaaaacaagatacagtgttagtttttatcgttgcacaaagaggcggcgggcgctcccaccaaaaaaataagaaaaancaaactactctcaactaaatcaagaacaattactatttgggcggcccttttatacaatcacaaccttacggacccctgctaactacatcttaactaatctctagcgtca

SEQ ID NO: 22220 - DNA, 1038 bp, Triticum aestivum
  Clone ID: PAT_TA_22220
caatggcccccaccgccgctctctcctgctcctgctccccgtccccgtcgccttcctccacgctcctcctcaggcgaaccgtctccgccttccaccgccgacctgcccatgccggcgtccgccgcccccgcctcgcccccttgcacgtggtggacgactccaaggaggtggaggcgaggtcggagacggacaggctggtggacggcctgaacttcggggagctgtgcaacgacttcgagtgcataagcagcccgtacgtggagtccacggccaggcagatcgccagggacatcctcgagatccgccaggacaaccgcgccctcagctgctacgccgtcgccgtcaaatacaaggatcctctcaggtcatttgccgggcgtgagaagtacaagaggccattgtggatcactgaggccctggaaaaacctatagtgacagtccaggaaatgtcaatgcaatccacgagcagtctgaccatcaagtggacgctgagggggaaacccaagaacgccttcttcgcggcggcgggaggggagctggttgtccgcatcgactcgcagttcgtcctgaaccagatcagtgggcaggtgctggagcacgtcgagtcgtgggacctctccgcgtcgtcccctctcgcccaggcctacttctggttttccaggagggtttactccaccgtggaggccggcaaggacacgatcgaggctgccaagggcgtggcgtcgcggctgaacaaagacgataatctggaggtctatcctgaccccctgggagatcccacgaagttctttacgaggccggatgatctgaaccaagacgtggttcagattgggctcttcctggccgtcctctacttcattgtacagttcctgaaaacgactctgtgatgatgactgtactagctacgactcgtgactgaattctccggaacaaggttgtgtgtatatacatacccgtgtatcgatgtctaacatacccatataacaggcatgcccacgcaggcttgtgtttttgagactaaaaaaaaaaaaaaaaaaa

SEQ ID NO: 22221 - DNA, 1517 bp, Triticum aestivum
  Clone ID: PAT_TA_22221
gccctggggcgtcgcctcgggccgggcggtcgcgcctgtgcccaggcgggccccccccaccctctccgcccccccttctgcggtcgccgccgaggtactagcgtggtcgcggccgaggtccgagaagagcatctcgatgatccacaatcacgaatacatggggttcctcagcttctgctgagtgaacaaaccaagcagacgaccaccagacccggggagaacccaaaccaggccaatacctaattggacctcacctctcccccagtccagttaagtccaaggatgaaataaaagaagcctgacgcgtgcccgtcgtttgctcctcagctaacctgtcaagcacctgccctgggcggccgcttgaatccgatgctcatccttcttcgcctggctgcttggccttctttcttgtggctgcaaatccttaagaacaactccaaaaacatgcaggcactttctactgggtgatcaatatcctgcaggtcccagctgcagtaaggtgttttcgtgtggaaagcggttcagctgtgcagggagagccgtgctagacgcatgaatggtaacctggagtgtgtctgtgaggccaatattgagtggtcaccgacgcagcctcatcttctgcgccttctgcggcctcctgggcggtacagtcggtggtcttcttgggtctggagggggtttcatcctcggcccactacttcttgagctagggtgcatccctcaggttgcaagtgcaacagcaacatttgtgatgatgttctcctcgtccctgtctgtggtcgagttctactttctgggggccgtcccaattccttatgctctgtacttgatcttcatttccatactggctggattctggggccagtgcttggtccggaagatcgtgcatgtgctcaagagagcgtcgctgatcgtcttcatcctctcctccgtcatcttcgccagtgctcttaccatgggtgttgtcgggaccgagaagagcatctcgatgatcaacaagcacgaatacatggggttcctcagcttgtgctgagtgagcaaaccaagcaggcgaccgccagaccgggggagaacccaggccaatacctaattgacctcacctctccccagtccacttgagtgcaaggatgaaataaaagaagccgtgacgcgtgcccgtcgttagctcctcgctaacctgcccggccaaggaaattcttctagtagcagcagtcggtgattcgcgcgttagctcctggctaacgcgcacatagtgtcatggtcttgtggcgcggcgtcgtgccgtatgctggatgttctttttgttgggtcatgtgctggttagctcctggttaacctgcagtgaagcattcgtcgtagggtttacgccgattcattcatgcgctagctagctcttggctggctaccgtgcaaacgttggttgtattggatgatgtaaatatatcagccggccaattggttgctgatttgtctatatagcttgctttgctcctaaaaaaaaaaaaaaaaggccccta

SEQ ID NO: 22222 - DNA, 443 bp, Triticum aestivum
  unsure (1)..(443): unsure at all n locations
  Clone ID: PAT_TA_22222
caccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcggggcgtacgttacggggganggcgtcctccgatcagcaaggatgtgctgctccggccgtgcaggggctgaacggccctgcccccgcagcccgcccccacccgctaggcttgcggggcatcgtgccctctgagagcctccgtccacctacatccacagggccaagcttaccgggcggcacccggtctccggcggngccccggcaaatnggggcgtcaacgttccccntcccca

SEQ ID NO: 22223 - DNA, 1211 bp, Triticum aestivum
  unsure (1)..(1211): unsure at all n locations
  Clone ID: PAT_TA_22223
cgaagagaaagagagggagctatggctgtggaggaagagggccggaaaggaatcccatctctcctctcctccggggacggggaggagaacatcgcctccaacatcacccagctcatagggtggactccactaatagaaatgaagaacattgctaagaaagacggcgtcgaagcgcggttggttggaaagatggaagcgtaccaacccctttgctcagttaaggacaggagcgctctccggatgattgaagatgcagaggagaagggcttgatttcacctggtgttacgacactaatcgagccaacaagcggaaatcaaggaatgggaatggtgttcatcgctattcagaaaggctaccggtttattgctgttatgcctgcaaaatattcacttgacaaacagatgctactgagatttttgggtgctgaacttatcttaacagatcctgcaaatgggtttaaaggaatgattggcaaggtagaggagctgatgaagactataccaaattctcattgtcttaatcaagtcaccaatccagcaaacccagatgcacacttcaaatggactggacccgagatatggaaggacacagcaggcaaagtggatatgtttgtggccgctgttggctcaggaggcacactgacaggtgtaggaaagtacctgaagatgaaaaatccatccataaagatagtgtgtgtggaaccttcagaaagcgctgtaatttcaggaggctcaccggggtcacacaagattcagggcacggggccagggttcataccggaggttctcgacacgtcggtcatcgacgaggtcgtgacggtgagcacggaggaggccatggtgatggcgaggaggctggcgagggaggagggcctgcttgtcggcatatcctcgggtgcaaacgtcgctgcttgcatcaagattgcggcgagagaagggaacgagggcaagatgattgttaccatattccccagcgctggcgagagatacatgaactctgatctctttgcgcttgttagggaggaatgtgagaatatgactttttgatgtcatgggcagctctcattaagtagaatgggtgctatttttcatgtgttcgtaagtgtcagcagaaggtacagtgaatcctctgttcttgcttttcaaaaaacagagcatgcctttgcttgtttgaatacatgggtcggatacaggctaatnaangaagaaat

SEQ ID NO: 22224 - DNA, 483 bp, Triticum aestivum
  unsure (1)..(483): unsure at all n locations
  Clone ID: PAT_TA_22224
cccccaccaccgcgttcaccagccattgcctgtcggagctcctgaggaccgatcgaggacgtgcaggggtgctagttagttatgatggagctgcgcaagtactggggcgtggggggccggcggtgcggggcgtgcgagggggcggcgccggcggcggtgcactgccgggactgcgccgggtacctgtgcacggggtgcgacgcgcgcccggcgcacgcgcgggcgggccacgagcgcgtctgggtgtgcgaggtctgcgaggtcagccccgcggcggtcacctgcaaggccgacgccgccgtgctctgcgtccgcgtgcgactccgaaatcatcacgccaaccctgctcgcctagtcgccacgtgtcgcgtgcccatncgcggcccatcggctcccccgnaggccgccgcggtggcggccgaggccnatgatgttttgcggcgccgntntaccggtgaggcantgtnggtnaangccacgtgc

SEQ ID NO: 22225 - DNA, 1233 bp, Triticum aestivum
  unsure (1)..(1233): unsure at all n locations
  Clone ID: PAT_TA_22225
ctcgtgccccaggcggcaagagcggacacacaacacacccacccggccccacacaccataccaacgccactcctacgcacagccaaccctacctaagctaagctaaacagcagcgagcaatggcgtccacctcctgcttcctccaccagtccaccgcgcgcctggccgcctcggcgcgccctgcgcccgccgtcgggcgcacccagctgttcgtctgcaaggcgcagaagaacgacgaggctgcacctgacgctgccgtcgtcaccagccggcgcgccgcgctgtccctcctcgccggtgccgccgccgtcgccgtcaaggtctcccccgccgctgccgcctacggagaagcagcgaacgtgttcggcaaggcgaagaagaacacggacttcgtggcgtacagcggggaggggttcaaactgatgatcccggccaagtggaaccccagcaaggagcgtgagttccctgggcaggtgctccgctacgaggacaacttcgacgccaccagcaacctctccgttataatcaaccccaccaccaagaagaccatcaccgactacggttcccctgaggagttcctctcccaggtcggcttcctcctcggccagcagtcctacggtggcaagaccgactccgagggtgggttcgagtcagacgctgtggcgacggcgaacgtgctggagagctcggcgccggtggtggacggtaagcagtactacagcataacggtgctcacgaggaccgcggacggagacgagggagggaagcaccagctcatcaccgccaccgtcgccgacggcaagctctacgtctgcaaggcgcaagccggagacaagaggtggttcaagggcgccaagaagttcgtcgagaacgccgcaggatccttcagcgtcgcataaatatacacgaccgaccggcgaatttaatggaaatttcctcagggatgaaccgtgtagagaccgatcgagggcatgcatgtgtgtttctttgatttgtacatgaggatggatgaactaagaggtcgatttccctcaaggattcatgtgtgcacaatgattaagaaatcttagtaataatgtttcatttttgtacaatgattaagaaatcttagtaataatgtttcatttttgtaaaaaaaaaaaaaaaacgctagaaaaaaagcgcttcaatttagtattgtgaagaatgtgttatcaatgtgggtatataagttgccctatagtgnntcgtatt

SEQ ID NO: 22226 - DNA, 760 bp, Triticum aestivum
  Clone ID: PAT_TA_22226
cactccggcaaggcaaggacgctggggaagcggcgcggcacccacggtgctcctccggcgaacggcggcgatggacgggagcgacgccgaccccgggacgggaagcggcggcggggggttcgagtgggatgcggattcccagctctactaccacgccagtactgggttttaccatgaccctgtcgctggctggtactacagcagcacagatggtcagtactacatctatgagaatggagattacgtgttatggacttcagatgtgggcaaggaacccaatgtacagagtccatgtgatgaagctagccaaagtttcctggaatcctcttcagggccggaaccggatattccacatcaaccgccatcagaatggttcttgcataaataatcactctctcttatctgataaacatcttttttagacacctgattcttttgcgcttgattctgttattcttttacaggctggaggaaacactaattaacatgtatttatcaggatactctaatatagaggtcagcactgaaaatttactacgagaatcacagataagtgaggaaggcaaaagtgatgaagttgagaataaactcagtaacgtggcttcagataatgcgtcagactctctgaatgatgctacattacagcaaatagaagataaaatggaaatcgagaacttcacagctgtgcatgaatctgtaagggaagaagaagagaatggctttctcagtatggtcaagtagagagagtaaatgatgagct

SEQ ID NO: 22227 - DNA, 513 bp, Triticum aestivum
  unsure (1)..(513): unsure at all n locations
  Clone ID: PAT_TA_22227
gtttttttttttttttttttttttaaaacacaagcactttattcatttaggttgatgttttttttttttttttttttttttttttttggaggaattaaaatagaagcactttattcatttaggaagatgataaatatgtaatcataaacacacatttaacaggactgtcaaaatgtaaacatacaaatgctcaagttttatcaataatatatggtcatctatcacctatatcatatccaatgacgtgcaactattgcatctcatgcattcatgcatgtattattcacatcctccgccaccacgcccacctcccccgcctaagccgccaccgcctcccccacctaagccaccaccacctccagcaccatctccagcaccaaatcccggcgccaaaaccaccaccctccccgccgccgacgccccaaaccgcctctccgccccccgtctcgcgcggccgcgtcgctcgcgcccgcgcgagcaatcagacaggagggaggggcncacgngcgngng

SEQ ID NO: 22228 - DNA, 1647 bp, Triticum aestivum
  Clone ID: PAT_TA_22228
cccacgcgtccgcttccttccttccggcgtgcgtatgtcatgttctactaagctagctagcagaagaagatagttcatccatgcatgcatgacacctcaatatatattatttctgtttacgatctacatagctagctagcttccctagctataagcagctaccaaattggttgagagggagtgtgcattgcagtgttgagatcagtcactggtcgatctgatctctaagctgaggtgtgtgcatggggcatcactcttgctgcaaccagcagaaggtgaaggggggcctgtggtctcctgaggaggatgagaagctcgtccggtacatcaccacccatggctatggctgctggagcgaggtccccgagaaagccggattgcagcggtgtgggaagagctgccggctgcggtggatcaactacctgaggcccgacatccggcgagggcggttctcgccggaggaggagaagctcatcatcagcctccacgccattgttggcaacaggtgggcccacattgccagccacttgcctggccggaccgacaacgagatcaagaactactggaactcgtggatcaagaagaagatacgcaaggctccggcggcgccgaacgtaaccaccacctcgtccacgacgtcgacgagcccacctaacaacggcctggcaccgtgcagcggcagcacggccacgtcggacgtccaccaccgccgtctgcagcatccgacgttcagctgcgcgccagcgggggaccacctgcagctcgacgccatcatcggccaccaccagagcaccagcctagccctgccggttgccgccggggccgggcaggactcaccgccaggaatgtcgcatcactgcccgctcttcatgttcgacaccggtgtcgtcagcacgccgttcgcatccgccgcggcgcagcagcacccgttcatcgccagcttcacggcagcgatggcggaagcggacacgcccagttgctaccacctgcctcccttggtggacggcatgggtgccatgggaatgtgcatggaagccatggacgatcactgcggcgccggcgccggcatgggcaatgggtgcttcggggacgagcagaggcagcggcggcggccggagctggaggacgaggagggggagcagctagggcagcatgagcagtgggacgaggagcagctgctgatgtgggatgatcaagaagtactaacaccgtccaacatggaggccatgcaaagtggtgaacactccctcctttttatgggaccaaacgcatgatcgaccagaaagctgctaaatccatgtgcacatatgctttgcttgctccatgcatgcacacatgatcaaggagtatctctccccctctcacatctgatatttctctctctagctcattctgctgatccgatctgtccatagacaaatactgaggttttccaaaggtgcacttaatttattgtgtttgattttttttctcaaattttcctaattttttggttttggagtgaagaatgtttgttaattgggctttgtaaagagataacttgcatgcatgcatgtttgcatggcatggcaactggtgtgtaattgattgatgtatgctgagtgaatctataataaacaggaaggaatgaaagggaactcctccttt

SEQ ID NO: 22229 - DNA, 572 bp, Triticum aestivum
  unsure (1)..(572): unsure at all n locations
  Clone ID: PAT_TA_22229
gtcctcaccgccgtcaagttcgtcgacgacatatgctacaacaacgcctacttcgcgagggtgggggggatcagcctcatggagatgaactacctggaggtggacttcctcttcggcatcgccttcgacctcaacgtcacgcccgccgtcttcgcctcctactgcgccgtgctgcagaccgagatggcctacctcgagcacccgccgccgtccatcgacgccgtctcccccaccagcttgctgcagcactgcttgcccgaccaggaggtcgacaccgccgccgccgccgccgccgctgccaagtccggctgccaccgacaccagcagcagctcaccgtctgatcgatggagctcttcccctctctctcttttttgtccctgcggtgtcaactgtcatggtctcttcttttttccttttcttttccatttaccgttcttggtacataggtgttggttagctaggatggattcgccattgttggaaggatcgtccttgaatggaagaagggtccggattgagattgtgcgcgccattgtttaacgagctgagatgctgctaatctaaaaaaaan

SEQ ID NO: 22230 - DNA, 469 bp, Triticum aestivum
  Clone ID: PAT_TA_22230
cggacgcgtgggcggacgcgtgggtccgctgccgatggaagctttccagagaggtggctcagcaggtgggcgatggcggacgcggatctcacgcggctcctgctcccagccaccatctcctccctagctaagcaagaggttcgacgaccaccgctacctcttccttgccgccaagcaggaggggcactaggaaaattacatatcaggagaggcatttattagaggatcttctagaaagctttttatatttggttcctggaaggctggtacggagctgtgttttttcatgattcataatcattatatctgattcataagaaacagtgagatgctttgttatgagttacgatataggctttgtaaaatttgcatgcaatcaaaagatgaataggcttcgagctccatttcaataaccttagcgctttttcctgatcctctcgaattgtcttatctattacaatgaattact

SEQ ID NO: 22231 - DNA, 2585 bp, Triticum aestivum
  unsure (1)..(2585): unsure at all n locations
  Clone ID: PAT_TA_22231
cccatggtccatgatccacccatcccacagatccccctgctgaactcccgatctcgcggacgcgtgggcggcaatggaggtgctctgcatcgggacggccgacaccaagctggaggagctgctcttcctcgccactcgcctccgctccagcctcgccgcctccgccccaaaggttaaagggagcatagtggatgtctccacaactaaaacagtaccaacacaagattctaaagacattgcagttattgcaagagatacagttctctcatgctatccggattccagccaacaagatcttccagatgacagaggtgaagcgattgcgcttatgtcaaaggcccttcagagctttctgaaaaacagatatgaggccggcaccctggttgctgctgttggcctaggaggaagtggaggaaccgcactaattgctcctgctctaagatccctaccactcggagtgcctaagcttattgtatccactgttgctagtggcaatactgcaccctatgttggaacatctgacctggtattgtttccttcagttgttgacatatgcggaataaacagtgtcagccgtgttatattgtccaatgccgcttcagctgtcgccggattggtatgtgggatattaatggcttccagtgaatcagatgaaacagacacaaagctgactgttggaattacaatgtttggtgttaccacacaatgtgcaaatgcggtcaaagatagactgaacaaagaagggtatgagacgcttgtattccatgccactggtgtcggaggcaaagcaatgggaagaactagttagaggtggtttcatacagggtgtattggacataacaacaacagaagttgcggattacattgttggaggtatcatggcatgtgatgagaccaggtttgatgcggttatagataaaaagattcctctggttctcagtgttggggccttggatatggttaactttggagctcatgatacaatacctgctgctttctcagacagaaagatccacatacataatgaacagatttcgttgatgcggacgaccgtggaggagaacaagaaatttgctcagtttattgctgacaagctgaacaagtctttatctacagttactgtttgccttccacagaagggcatctctgcaattgatgcacctggaatgccgttttatgatcctgaggctacatctgcactattggatgagttaaatgctcgtcttgtcaaaactgagnaacagacagctgaagctgcttccttatcatataaacgatcctgaatttgccaatgccttggtggatgcattcttgagtatggatataaaggcctctagtgccataactcagaaaaacaacatggtcctaccaaagcaagacacaaatgaaaaggaatcttcttcaggacagaagacttcagatagttctatcatatggagacccccagtggatttccctgatgcaagaccagaaactttgcaaaaaacaaagtcaatactacataagttaaagcaacaaatcggtgagggtattcctgtaattggagccggtgctggtacgggcatatccgcgaagttcgaagaagctggtggggttgatctgattgtgctgtacaattccgggcggttccgtatggctggaaggggctcattagcagggctcctaccatttgctgacgcaaatgcaattgtacttgagatggccaatgaagtgttgcctgtcgttaaagaagtccctgttcttgctggggtttgcgctaccgatccatttcgtagaatggattactttcttaaacaactagaagccattggattttgtggtgtccaaaatttccctacggttggtctgtttgatgggaacttcagacagaacttggaagaaactggaatgggctacagcatggaagtggagatgatctcaagggctcacagcatgggtttcctgacgaccccgtatgctttcaacccagaagaaggcgctgccatggccaaggctggagcgcacatcgtagtcgcgcatatgggcctcacaacagctgggtcgatcggcgcaaagacggccgccactttagatgacagcgttgcccgggttcaagccattgccgatgccgcagtcggcgttaaccctgacatcattgttctctgccatggaggtcccatatcagggccccgagaggcggagtttgtcctgaagaacacgaaccgggtccatggattctacggcgcctcgagcatggagaggctgccggttgagcaggccatcacaaacaccatgagggagtacaaacgcatgtctctgaaatgaggttcggtggctttaccaggtgggcggatgaagcgcgcccggcgttcgtcaggctgttgtcacatgtaaattgttactgaaggtgccttgtgcgtttgaacatataataaaagataccgacgaaattatagggtgtgtgatgtggcatgccatctcgctggcccaggcggtcatgcattacaggatgcccatcaatgagatatgatcttatgttaaaaaaaagaatgagatgtttttttccaggcggtcataaaaaaaaaaaaaaaaaaaaaaaaaaaaaa

SEQ ID NO: 22232 - DNA, 497 bp, Triticum aestivum
  unsure (1)..(497): unsure at all n locations
  Clone ID: PAT_TA_22232
gcgacctagccgggagacacagccgccgcccctccttgcccctcccatcgtcgccgccggccctaccatcgtcgctcggggctccagcgctgccctcccctccaggaaaccgccgctcgcccgctcccttcccctagcttcacaccgctcggccagttccctcccaggagccggtcattggcttgtgggaagtggctaccctcccctggctcgccgtccttcgccgtcgccggtctccattcgccatcccctgttggctgccgcccttcagcccctcactgccgctcggttcagtgagggtaactggctttttgtactgggtatagccccagatgtgattggggacatacaaacggccttcggtgattcgaatattttcctaatccagtttgttcccccagagttagctccttctacttaccggtcccaagaacccgttaaagngcctcctcatccgtcatccntccnacaactaanacgcgccgccgtttgcatct

SEQ ID NO: 22233 - DNA, 611 bp, Triticum aestivum
  unsure (1)..(611): unsure at all n locations
  Clone ID: PAT_TA_22233
cggctatggaggagtgggtgtactactccctctccatcaccttgtgcctcaccctgtcccttgtgttctcatccctgcgcaaatgcaaggcggcgggctcttcgttcctcccgcctgggccgacctcgctcacagcttttggcccgctgctgttgctcgcctggacaagcgtgaacatcgagtcggtagtccgcgtggcacgctcatggtacggccccgtcttcacgctctacctcctcccatccttccccgttcgtgttcgtccccgacagggccgtggcgcaccgcgtcctccgtgcccctcggcccccccttcggccaaccgccccgccggccaacctgggccacccgcatcttctctagtgatnaagcacaacatcacgtctgcagcgtacggccgttgtggcgcgcgctccggnaaaactcaccggccgggcgctccnaccgttcganatcccggggtacgccgccgccccgggccgcgccgcctcggggatcgtcnacgnatcgcacgacagatgccaaacggnaanggncgtcgtcatnaaggggtcctggaagangctgtctcaagtnaatgcccgcantgcttcggcaagggctcgacaatc

SEQ ID NO: 22234 - DNA, 518 bp, Triticum aestivum
  Clone ID: PAT_TA_22234
agaacagatcatagtcttgttgtatttgtttctggtacagccgtgcatgtatatatgattgtacaatctctttttgccagtaaagctactgacaattgcaacatatatcagacagaacaactagatacaaccgaaacaaaattacaacacacaagatggccttgtgaattacagctccattgaattaattcgaacaactatgcgccgaagacgactccagtgccatagcagagataactggtcaccggtgtatgtaggcaaaatttatactgttatgtatttcagcatagatgagcgcacatcctccatgaaagccacggcctcctcctggttactggtcttggcgctcgctatgttctcgtcgagaagcgttaatatggacatgttgagctcgttccgttcaaccatgtcgagcagagttttcttcctatctttggattgcaggatgttggtgagccgctccttggccgtgaccaggtcgttttgcagcttgtcgtaggcctcgactccctccccga

SEQ ID NO: 22235 - DNA, 1151 bp, Triticum aestivum
  Clone ID: PAT_TA_22235
ctagtctcgagtttttgttctttgtcttgttgtttttgtttctgctccagcagatcatacattcctaaaccagttaaccgaccaggagaacagatgatagtcttgttgtgtttgttcggcccgggcacgtacatgtatatatgattgtagaatctctctttgccagtaaagctattgacaattggaacatatatgaaacaaaacaactaaatacaaccgaaacaaaattatagcacacaagatagccttctgaattacagctccttcgaatttattcgaacaactatgtgctgaagggagtcgactccaatgccacagataactggtcaccccatatgtaggcaaaatttatactgttatgtatttcagcatagatgagcgcacatcctccatgaaagccacagcctcctcctggttactcgtcttggcactcgctatgttctcagtcgagaagcgtcaatatggacatgttgagctcgttccgttcgaccatgtcgagcagagttttcttcctgtctttggattgcaggatgttggtgagccgctccttggccgtcaccaggtcgttttgctgctcgtcgtacgcctcaactccctccccggtgaccttctgcatcgcctccagctcgatcagcctgtcttcatttgccgctgtcgtggtgaccgcgaacttgatctgcgcgatctcccgctggatgtggtcgaagaagcccttgttgagcctggggcggagcctgccgatctcgatctcgatctcccgcgcgtccgtgtccaggaagaactccaccagcccggcgtccgtctcaggtatcacccgcgcctcgcgctccttgcggcggcgctcctgctcctccttgacctggaggtcgaaggcggcgcgcgcgtcggcgtcgctgtcgaggcggcgccggaactcgaggcgcgagatgtggcccggctgcggcggcgccaggatgccctccgggtcccatccgatgcaggagatcttgttggcgacggcgcggcgggtggtgggcgcgcggcgggaggcggggcggggcgccaggagcgggaagcgctggaggatggcgccgagggaggaggaggtggaagccatggccggagccgcgcgcgcgagggccgcgcgcgcgtggtcccttcggccgtgcgtt

SEQ ID NO: 22236 - DNA, 787 bp, Triticum aestivum
  Clone ID: PAT_TA_22236
cggctctccctcctctcctcgtttcctctcgtcaattgtgatcgcagcgatagcgatgaaggcggggggcggggacaagatcgcccaagagcccatttctgtctttctgatcgccacgtcgccaggcatcatcatcgtcatcatcatcattatttctttgctggccgtgagtacctatctcactacgcttacatctcctcttttgtggttaccgatgctttactactgtctactcagtgcatgcatgcacgcatgatttcgacactgttatggccgcttgatcatgtatttgttttgtttttataattttggctcatgattgctgcgtctgcgtaatggtttctctatatatttttcaagcactctgtagtacacgtatggccgtatggaattgaccatggttggtacggggtgtggaacgatgatggatctctaccgacaaaaaaaaaaaaaaaatgtgcgagcatcaagttggcaacacatggttattgttaggcagcggcagcagacaaggagttagggctcacggatctgggcatgatatggagggctccggcacatggcatgctccgtcctcagatccatccaacatgatcgctctcatcctcgagcacaaggattcttcagaatggggaaaaggaggccgagcttttgctttgcttgggatggacgattgagtgtttagaattagacgtccaagccactcctctctctcatgcctactatccggtgcatttggcactgcccggtctagtttggtgttcattacccgctagctagctgtcgt

SEQ ID NO: 22237 - DNA, 591 bp, Triticum aestivum
  Clone ID: PAT_TA_22237
tccgctggcgcgagggacgggatgatggcggcagcgtgctccctctcccccctccctctcgcgccgcctggggcacccaggccagcgctcttctcgaggtgcgtcgctgctccgcgccgtggtaggaatgccgggggaggcaccgggcgcttgcgcctcgccaggaggctgcgcccgcctgccgccgccatcgaagaggtggagcagaccgaggccatgatgagggtggctgcggacgacgatagcatcaccgccaccgtggtgtcggtgctgctcacggtctcgttcgtcggcctctccctcctcaccatcggggtgatctatctggcggtgcaggacttcttgcagacgagggagagcgagaagtttgagagggaggaagctgagagacagaaagaggaggcgaggcagaagattgccaaagcgaggggaaagaaaagaaatcgacgatgactgcttcttcagtaacctcagtgtgagaactcatggctggttcttctgtaacctggatcattctccggggtatgatttttgtgctggtttcgtgtcattctgacgttctggggcccctttctcatcgtagttcagttc

SEQ ID NO: 22238 - DNA, 1352 bp, Triticum aestivum
  Clone ID: PAT_TA_22238
gcgcgcgggacgcggccaccgccccggtgacggccctcgggccgtgcgacacccgccgccccctctccgcgggccggcccgccccccccgcgaaggcgcccctcacggccgccgtccccgggcgccccggcacctcgggccgggctgcttcccccgggtgccgttccgcgtccccgacgaccttgggcggaaccgcgcccagcacgacgggtccgcagccggcattcctgcacgccttcgccgtgacggcgaattatgcgatattcccggagatacagatcgtgatgaaccccatgggcatggtggtgggcggcggctcgcccgtcggggcggcctcgggcatggtgccatgcctcggggcgatcccctattacacctcccacgagtcgcagatgcggaggttccaggtggccgggttggtcagcgtccactcggtcgtcgggtgggaggcggccgtcggccctcagatcggcgtgatggccaagtacgtcgcggacaactcggacacgctggagcgcaaggagctgatctacgccttcgtggagctggtgcgcatcaacctccgcaccggcaacgtcacccgcacgccgctcgcggcggcgaacctcgacttcggcgtgatcaagccgggcatggaggtgatccacgcctccgacgggctgttcggcgtggacgaccccatgcccaacatcggcggggtgcccaagctcgacttcgaccgcgccggccacggcgactgcaccgtcggcgcgccgggacttcacggctcgggctgcttcgccggggagccgcctttcgctccccgacgagcgtcgaggggaccggagacgaggacgacgggccactggtgtgctacgtgcacgaccagggcaccggcgacaaccggttcgtggggagagccgtttttcgtccctgatgacgtcgaggggaacggcgacgaggacgacggctacgtggtgtgctacgtgcacgacgagggcaccggcgacaacaggttcgtggtgatggacgcgcagtcgcccgacctggaaatcgtctccgaggtgcagcttccctcccgcgtcccctacgggttccacggcattatcgtcactcaggccgagctccggtcacagcaccaatgatcatcagattcagacacgccaacacgttcgatgtttccgcgccatagattgcgcgccacgatgtataatagtagaccaatagagtggtgcatgggtaggtcatgtataggatcccatgacatacacataggagaaataggtcatctcatgtgtagcatttacatgtttacaaggaaagaattgttggtgaaaaacatacctgcagtaaaaaaaaaaaaaaaaaaaaaa

SEQ ID NO: 22239 - DNA, 489 bp, Triticum aestivum
  unsure (1)..(489): unsure at all n locations
  Clone ID: PAT_TA_22239
gccacctcgacaccacacgaccccgctgccatcagagacactgatgagccgccgccgtctcccaagtcgcctgccgacctccgcctcctctccttattctcccatctctcttctctcgtatctgacctttctccccggtgcagcttccacctccctgcagatccacactttgtcgggcggagggagcctccagcatcgctgggagcaatggcccatgcccggcggcactgaggtgggcacatcacaatatgaagcaccgctcccgatccatagtccatgggggggtagggccccggagagtaacccccgggtgcagttccactccctgcagttcaactttgtccnggcggaggganctccaacatcgctgggganaatggccatgcccggcggactgaagtgggacatcacatatgaanacgtccccattcataattcatggnggtaatggcccggagangatttnattgtccctcttttgtcaaaggn

SEQ ID NO: 22240 - DNA, 793 bp, Triticum aestivum
  Clone ID: PAT_TA_22240
gaccagactccgcccaaatcgccgccgcaccggctccggccgctcccctgctcccgcgggcgccatgacggcgaatcagccggcgggcgaggccctcgcgacccacatctccggcatgtcccgccccgagatgtacgacctcatgtcccagatgaaggccatgctcgaccacgaccaggagagggtgcgccgaatgctcgtcgagaaccccgacgtcacccgcgcgctcttccgggcccaagtggttctcggaatggtcaaaacacctaaagctgcacaatcttcggacatgccccagccagcagttgctcagacaactcctcctgcatcagttaaagctacagtacaagatcatgttaacttgccccagcctcccgtgcctaccaatcaacagaatttgcaaccttctggccaatttccatcgggcacttctaatctgacatcatctttggaccttccacccatgccagcaaatccaccacaatcagcacaatcaaaaggataccctatccatcagatgcattctgcatcagcaccgcagtcatctcagtatccaaatgttaccatgcctcctcatgctcctccacagtattcaaatgttccatctcatatgccaacagtgaacagtcaaccacagcaaccattgcaaaatcctggaatgttttacccgcaattacagccacctctgccccagttgcctaggccaccttccatgcaggcatatacacatcagatgcatcagcaaatacccagtacatatggtcagcacatgttgcaacaaccaatgtttcat

SEQ ID NO: 22241 - DNA, 1189 bp, Triticum aestivum
  Clone ID: PAT_TA_22241
gcaggaattcggcacgagtagaagataacaggcgcgagtttttccatgttgctccgcctgaagattaccaccgtccagcctgtggcgctgcttcttgggcatgaccatggcgcgacagcatccccgcggcggctcgccggagcccttccgcagggcggtggagcgtccacgagggcaaagaggctgaggagcgtggcggtggcgatggcgctcaaggaggaggagccggagagcagccgaagccgcttcgccgggggcggcccgagctgggaccccaggatggagatcggagtcccatacgagcaaaggccggttaacgagtactccgctctcaaggagagcaccttgtactcgtgggcagagctgagtccaggctctttcttcatgcgcctaggcagcctgtgcctggtcacatttacagttctggcggccccaatctcagccgcaagtttcagtcccggaaaggatccactcaagttcgtgctagctgctgggattgggaccctgctcctggtgtctcttgtggttctcaggctctacctgggttggagctacgttggtgacaggctattgtcggcagtcgtgccgtatgaagaaaccgggtggtacgatggccaaatgtgggtcaagccagcagaggtgctggctcgcgacaggttattgggatcttacaaggtaaagccggtgatcaacctgctcaaacagacactggtgggcaccggtgcgctgctcgtcggggcggtggcactcttcgccttcgccgcccccgtcgaggaattcgtccactccttcaatggagcccccactgccgcctcctctaagccgatgatgaggagagaggatctgctgaagctgcctgccgaggtgaggcaagacgacgacctcgctgcggctgctgcggaggccgccaatggacgcccggtttactgcagggaccgctactaccgggcgctcgccggcggtcagtactgcacctcagacgacctgctcaactgatgataacaaatagtaatagtagatacgtattctggtatatgcagtttgccacattgatataataataagcacaagttaagcaaatgtatcttatcggaatgaaattttgggaagaacgatgttgttgattctgtaatagattgcttcataataacagctcactggttgccccattgttgtaaacttaaagcaa

SEQ ID NO: 22242 - DNA, 775 bp, Triticum aestivum
  Clone ID: PAT_TA_22242
ctccttctctctccaccctagccccaaatctcacgccgcctccatcgccttcttcctaacgcccgccgcgccctcgcccgccgttaacgccctcgccgtcgtcttcgccgccgcggactccagccacatccgagtccaaatcgacctcgccggtgaaacggccgcccagaccgccccccgcggcatccccaaaaagctgcattcatggatagactacaacgccacatccgccacgctccaggtccgtctctctgcctcgcgcctccccaagccgccgcgcgcgctgctctcccacccgctccatctccactccgccctcctcctccgcagcaccaagcccatgctcgccggattcgcatcctcccacgccaactgcagcctcttcagctgggccttcagggccaaccacgggcctccctacctcatgcactcccagccactcaatcccaccggcttatcgctcaccacgccgctgccacaccgcctcccccgcgctcccccgggcaaccgctacccctgggtttcgctgctgttggcggccgcgtgcgggcgccgtcttcacattcgtcgtgctcttcgtctggtactccatgggggaagcgccgcccggtcgcgccggtggggttcccccctcccgccgctccgcctcccgacagcggtcgtcctggcgagtctgggccccgcgcggtgcgcagggtcctccctcccggtcgctccccgccgggctggctcaacaaagtaagcccgctaatcctcttccttctaagaattctaa

SEQ ID NO: 22243 - DNA, 598 bp, Triticum aestivum
  Clone ID: PAT_TA_22243
agtgtctgtcgggagagcaccccccaccgcccggcggccttggccttctcacctgctactcgctgccccgcctgcccgtcgaccccccaatttacccgtcactctttctaccgattcccgggggcggccctactgcatcaccgggccccagatgccgtcggaaccccccgcggccccgtcactacaaagaactcgatgcccagcatgaagtgatggcacttaaaccgaagacatgggaggagataccaaggctagtccgtgagcggagggaggctgctcgagaagccagggagcgccagcaatccgccatgcaggagtaaacaggaagacatggaaggagatggcaaggctagttcgagaagccaagaaactccggcagcccatgcaggagtaaacagggcagcaagggcatggattttggttgctctgaacaaatgtacaagtcgtgattggcatctacctgtgtgtctgtgagctatctatgtatctatctgtttttgctttgcttagttaactgagaagacactagccttcaacttgttcagtaaagtttttcaactgtggccaaaactgacaaaaaaaaaaaaagactagtctc

SEQ ID NO: 22244 - DNA, 318 bp, Triticum aestivum
  Clone ID: PAT_TA_22244
cggatctgtctgacgcgcgcatgtgaggtgcaaccgacggccggtggttgcgctccggcacaaagggcttaatttcttccggtcattcataaacgtataatcgtggtcctcgatcgcgagcgtactcttttttttttcatttctctcttgtttatttatttactattcttccttcccgttctcccggacctcttctcttttgttaatttcagctctttactgtatctccattgaaggaaaaagagaacaaaaatgtactgctacgagtttgacaataaatcaatgtgccggaaatagtttactaccaaaaaaaaaaaa

SEQ ID NO: 22245 - DNA, 601 bp, Triticum aestivum
  unsure (1)..(601): unsure at all n locations
  Clone ID: PAT_TA_22245
gcagcatccacgctaacggacaccttgctcgactcttccctccccatcgtttccgactccggcgcactcccgtccatcgccaaccgaagccagccgcgcccttcaaccctcctcccggcggcgttgactggacctggcacgagcgcggtatgtgctctccacggcccggacaccaccgtccaagtccaaggttgcatgaagactcggaaccttaattccaccgcttgtcgtcgccgtcacgagtgaccaagccatcgcctattccaggagtttttttacctcgtagacagcccaaagatgcgatcaggagcagctcaacagaaagatgcgattaggaagagtacgggcgggactgatnaaggaagttancctcaacggcgcaagncataaattttggangggnaaccaagatgtgacagataccaatggantgcccggataatcttgcctctcaacttgattcaaagtnagcatccactatancctccagcaatacggcgacagtcgtnncaacaccatcatgcgtgctcattcgcacatatatactgacgcnactttccgtaagangtcaagtaatgaatgatgggtaataannngtcaa

SEQ ID NO: 22246 - DNA, 771 bp, Triticum aestivum
  Clone ID: PAT_TA_22246
cccatgcgtccgcagcgagcgagcgagcgagcgagagagataaggagagagggcgcgcgcggggatctccgtgccttggtcggcggtagagtcgtcggcgcgggggcgatggagagcgggccggcgggcacgatgggggggccgctgagtgacgtgccggcgatgctcgacggcgaccggtacgagctggtccgcagcatcgggtccggcaacttcggtgtcgcccgcctcatgcgcaaccgcgcctccggcgagctcgtcgctgtcaagtacatcgaccgcggcgagaagatcgatgagaacgtgcagagagagatcatcaaccacaggtcgctgcggcatcccaacatcatccgcttcaaggaggttattctgacgccgacgcatctcgccatcgtcatggagtacgcctccggcggggagctcttcgagcgcatctgcactgccggccgattcagcgtcgacgaggctcggttctttttccagcagctgatatctggagtcagctactgccactccatgcaagtgtgccatcgtgacttaaagctcgagaacactctgctggatggaagcaccacccctcgcctcaagatatgcgactttggttattccaagtcatcggtgctacattctcaaccaaagtcaactgttggaactccggcatatattgcccctgaagttctgctcaagaaagaatacgatggcaagattgccgatgtgtggtcctgtggcgtaaccctttacgtgatgttggtcggcgcctaccctttc

SEQ ID NO: 22247 - DNA, 1533 bp, Triticum aestivum
  unsure (1)..(1533): unsure at all n locations
  Clone ID: PAT_TA_22247
gcaggaagggaccggcagcagcgggccggggggcattgctcccggcgcgggagggaggtcgaacgcggggacttcggcgccgcgggcggcgggagcggccggggctgagggtggggccgggccgggacgtgcccatagtgcagggcggcgaccgctacgagctcgtcaaggacatccgctccggcaacttcggcgtcgcgcgccacctgcgcaagcgccccgacggtcagctcgtcgccgtcaagcacctcgagcgaggggagaagatcgaccaggacgtgcagcgggagatcaacaaccaccggtcgctgcgccaccccaacatcatccgcttcaacgaggtcatccccacgcccacgcacctcgccatcgtcatggagtacgcctccggcggggggctcttcgcgcgcatctgcaccgccggcaggttcagcgaggacgaggcgcgtttcttcttccagcagctgctctcaggagtcagttattgccactccatccaagtatgccatcgtgacacgaacactggagaacacgctgctggacgggaagcacggactcgacgcctcaagagatgcgacgttggcctttccaagtacactttcggttcttcatttgcatccaaaatcctctgatgggaacaccgagcctacatagtttaggaaagcttcttctaaaagaaggagtatgatggaaagattgccggatgtgtggtcctgttggagtggacgctttatgttatgctagccttggtgcatatccctttcgaggatccctgatgagcccaagaattttaggaagacaattcagaggatattgagtgtgcagtactcgattcccgattacgtgcacatatcttccgagtgtcgagatcttatcgccaagattttcgttggcaacccagctaccagaatcacaatcccggagataagaaaccatccgtggttcttgaagaacctcccagctgacctggtggacgacagcaccatgagcagccagtatgaggagcctgaacagccgatgcagagcatggacgagatcatgcagatcctggcggaggccaccatcccggccgccggttcccggatcaaccagttcttgaacgacggtctggaccttgacgacgacatggacgaccttgattcagacgccgacctcgacgtcgaaagcagcggggagatagtgtatgctatgtgacggtgcaaaacctctcaactcagaagggatagggtaccgcggtgcttgatagcccgcccacaaatgttactttgttgtactaattggtctctgtacttccaatgttgtagtacaacggtttggccttttggatgtgaccttgtgttgctccaatgctgtgttgactatctctgctgatttgagaactggttggtcttccgccacccctgtcgtcacttcctctgcggacctgggatctgggtggtcggctgttacccgtctcttcacttcatctttgtaccatgtatatgtgttgtaggcaaataagagacactacagctnatcagtttcgtttcgacc

SEQ ID NO: 22248 - DNA, 1130 bp, Triticum aestivum
  Clone ID: PAT_TA_22248
ggttagagaaatcgatgcaaatgactcttcgttgcagaagtcctcagggcttagagaaatcgatgcaaatgactctgcattgcagaagtcctctattgcctcagacaaggataagaaaaggtgtccggcagcttcagtcggtacttacaagtcagcttcaacaagtcttgacagtactgaagattctgattcctcaagcagcatgttagaacaaagtatctcttgcatcaagcctgaattgacatcacccattccggctccggagtgagtaaggatgttgctagacgtggtcaaactagcgcgacgggtaagagacaactaagagtactatcacaaaggccactgataactgaaatacagaaggacaatgctctgctaagggcaaaacaatttaaatccaagaatcctttcggtcttcaaataatgaaggagtcttatgtatatgtgggatttttcttgaatctaccctgtgaatttgtaagggagtgtcttccccgtgcccacaggaagttaaagctctggaatccacaaggaaagtcttgggatgttaactatgtctactacagcgaacgctgtgttggcggtttgagtggtggctggggcaagttttctctagacaataatctggagaagttcgacgtgtgcgtctttgagctcttctcgaaggacaacataaaagtacacatctacagagtcgtcccagaaataaccccattcctccctggtcctggcaagaaataacagtcatgtgcacgtgttgggggagtgttctcttccattggctaaaaaatatatttggagctctagaaggctgcagaggcaggggggttccctctttttcgaagaaaaatggcgcttgaaggcaataagaacacaatattcaattattggtgacatttaaaaaaaattgaatctctaataaacgtagctatgttcttactggattgtggagtaaatcggttagccccagtcgtatctgttcgagaataaccgtgtagtattgctgccatttgtagttctgcattatttgaacagagtgtgttatttctactaggttttattgaggcccttcagcttgcagttataactttaaaacttgttgatgtatgtcgttgcattttgcgtcgatt

SEQ ID NO: 22249 - DNA, 744 bp, Triticum aestivum
  unsure (1)..(744): unsure at all n locations
  Clone ID: PAT_TA_22249
tacattgtaacatcaatcaagtagctagccatgaactcaaagctttgcatctcctcctcccatcaaccatggcatgggttccacatccatgagagtgcgaccgagagagtagcgccaccaagagttcacctcatcaagaagatgtcccatccaaaagtaagcatcgatgagttcatatccacactcccccagagaaaagggtggtcgcaaccactcatccagtacaagaacttctggttcagaggtccgccgctggagcagatcctgctggcccagcacgccttcgaaccccgcgccgacgacatcatcctcgccacgcagcccaagtgcggcacgacttggctcaaggcccttgccttcaccatcgtcaaccgctctcgctacagcttcgacgaccaacccctcctcactagccaacctcaagcgcgtcgtgccattcatcgaaatccctgggtgttggcggcggcggcgccggatcatcatgcacacatccaagacgcttctccccgaaggctctcgccacacacatgccatgtcgctgctccaatggacatacctgcgagtctgtactgtgccggattcaaggtgcctgggccgaggtgccttcagaaaggtacaacgtcggctcagctgtcctgcaanggctccaccctgcccatggagagtgctttcaacatgtttctgcnaanggttctcctcttaaaggcccttctgggacatgctccagggggggcccgtaccaat

SEQ ID NO: 22250 - DNA, 2587 bp, Triticum aestivum
  Clone ID: PAT_TA_22250
gacctggctccgccggcccgcgctgacgggcctgccgggctgccgcggccctcctcccttctcccgcccgatctccacccccccagcgacccgccgccgccgagagcgctcgctcgctcgcagtcggttcgggcgccggtgccggccaggacagccctccgcgcctcgcccccccgtcgcccccgggtggcgcccggcgctggagtttgtggtcgcttgcggtgggtccgggctacgtctttcatgccgcgcccttatccggacctgcccgattcctcgccgggctggtccgttccccctttgtgtcgtcaatgagtgagaccatgagaaaggacctgggcatttcacctatactactgaggtcaaattcccggcccctctccgactccatgttggccgtgcaggcctgccggcgcctgggtgcttgcccccccggcgatgctaccggggctggtgggcagcatgctggcgctggtcctccgggcgcctctgctgctgcgccggtctccccctacccggcgagatctgatgggggtgcagcatgccatggtaacctgaattgtcggaacggtgtgcgcccttcagcgtccgggcgccacgttgaggtcttcaggaccgcaaatcgaggctggggtcttcgctgttgggagcctattcgtgctggtgcatttatttgtgagtatactggggaggtcatcgatgagcttcaagttaacttggatgacagtgaagatgattacatttttcagactgtgtgccctggtgagaagacgctaaaatggaatttcgggcctgagcttataggtgagcaaagcacgtacgtatcagctgaggaatttcagccactgcccatcaagataagtgcaaaaaagatgggaaatgtctcgcgtttcatgaaccacagttgctccccaaacgtcttctggcagccagtgcagtacaaccatggagacgacaagcacccacacataatgttttttcgcacttaatcacatcgctcccatgacagagttaacctatgactatggtgtggttggagaagagaccagtcatagagccaagacctgcctgtgtggatcattaacctgtcgtgggttattttgatgtacattgtggtggatcaacatgcaagccaataagctagatgtttctggtgctacctagattgtacctatgttgtggcattggtttctgcgaagatggcgccgtttctggagtgagaagacagtaaattatcttggagctgagacagaatgcccattgcctcgccatttgttcagatacttctggatgattgcgtgtattgatgtatgtactgctgcaaatctgccttgtcttgcttttttcgccaaccatttgcaaccatctgtgtagtaggctagcgtcagttttaactggattggacctctggctgttagctgcttgcaacatggtcgcactcggtgctggccgtgtgagttcacctatactaatcaggtcaaatacttgagacccgtcagttccatgacacccatgcagggttgtggttgccagagtgtttgcctacctggtgatgccaactgtgcttgtgggcaacataacggaggtgatctaccgtacagctcatcaggagtgttggtgtgccgcaagccaatagtatatgaatgtggtgaagcttgccattgtaccctgaattgtcggaacagagtgagccaaaaagggatcaggttccactttgaggtcttcaggacggcaaatcgaggctggggtcttcgctgttgggagcctattcgtgctggtgcatttatttgtgagtatactggggaggtcatcgatgagcttaaagttaacttggatgacagtgaagatgattacatttttcagactgtgtgccctggtgagaagacgctaaaatggaatttcgggcctgaactgataggcgagcaaagcacgtacgtatcagctgaggaatttcagccactgcccatcaagataagtgcaaaaaagatgggaaatgtctcgcgtttcatgaaccacagttgctccccaaatgtcctctggcagccagtgcagtacaaccatggagacgacaagcacccacacataatgttttttgcacttaatcacatcgctcccatgacagagttaacctatgactatggtgtggttggagaagagaccagtcatagagccaggacctgcctgtgtggatcattaacctgtcgtgggttattttgatgtacattttggtggaccaacatgcaagccaataagctagatgtttctgttgctacctagattgtacctatgtcgtcacattggtttctgcgaagatggcgtcgtttctggagtgagaagacagtaaattatcttggagctgagacagaatgcccattgccgtgttattgcctcgccatttgttcagatacttctggacgattgcgtgtattgatgtatgtactgctgcaaatctgtcttgtcttccttttttcgccaaccatctgtgtagtaggctagcgtcagttttaactggattggacctctggctgttagctgcttgcgacttgtccgactcggtgctcgctgttaaaacatgtcgcttggttgt

SEQ ID NO: 22251 - DNA, 682 bp, Triticum aestivum
  unsure (1)..(682): unsure at all n locations
  Clone ID: PAT_TA_22251
cgacgcctcgcctcttccccttcgacggtcgccgccgccgttgatcgcgcgcctgccgtctccgccccgtccgcggtcttcccccccattgggtctcgagatagggcttgacctgctgctagctgggaaggatgagcaaaggcccggttccgttccccagctttgggaagaaagcaaaagatctcttgtacaaggactacaattttgaccaaaagttttcatggtcaacaactagcgaatctggtttgggcatcacagcctctgggtgtgaagttcgatgagctgttcattggtgacatacgggtacaacataaaagtggtaggaatactgttgatgtcacaatcgattgcgattccaaagtatcaacagcggtcacttttgatgaagtaatccctggnttgaagactctttcggctcaaaggtcctgatcaaaatcaaggaagtcnatttgaatacctcaagatccttccactgaatcaacaatggctnacttcggactgtgatcanctggaacaatattganaaacaactncttcgtgccaagttgnttgaantantaactcgtacaagnnaacaaggtaanttcaagatatttcgcnctaaaatgtgnaaggannctaactcaacacgtaccngaanatgngcngtaccagtaanaaggatntcacgngccncncccng

SEQ ID NO: 22252 - DNA, 604 bp, Triticum aestivum
  unsure (1)..(604): unsure at all n locations
  Clone ID: PAT_TA_22252
gtttttttttttttttttttttttttttttttttttttttttttttttttttttatcgaagtcccttttattgcncactgctgccaaaattaaccttggacacttcaatagttgtctttcatcgttcacccgagcaactaagcattttccatataaaaacacttaatatcncttcaacacaagcaacaaaaccaaaggcgaaccttcaattctgtttgttataaacatttacattagtaaccaaaattctatcctggagcactcaactccaattaagactggaagagacgaaaaagttaccacatagttacctcttctctggttgttcagacgaaaaaggtaccacatagtttaggtgtttgaatttcattaatgatttctctgactgccatctacaagagctgatctacggctaaatagtaggacccaacaagtacaaaagatgcgattccactgcgcgccatccgtagggggggccacnaatagacatccnacacagggagtcccgtaacccccacaaatccggggccccattaaaaaccccccatgcaaaactagtaccatgacgtgacacttggatacaaatagtaacacacncanancc

SEQ ID NO: 22253 - DNA, 696 bp, Triticum aestivum
  Clone ID: PAT_TA_22253
gccgttcgccccaccacctaaaagttccccgggcacctaccttcctcaatcctcatcccaatccacaaaacgaaaatcttccgttcctctattcgaatcttgcttcttcttcttcccgtcatctccacaaaaccaagaaaagaatctctgcgaaattgcagcgcccttcattattcgaggttggtctgcttcatgcttgcttgctatccctatcgatcagcttttctcttgggtgggttgagtgcgttccttgggctggctggatttattctgggatcccgggcatacattgcctcctccttgcaccttgcaccatagcttctttgccggctcctcacgcgctccgctcggttaatccaaagattcgctatttctctctgctcctacgtgtgagatcctttctttccggttcaagcttggcattcgaatccctcatttcttgagcgggtggccgagcaaggggaatgtctttccggagcctaattcaggacatgaaggacgggcgcgccttccgctcgcccccccgcccccgcgccgcccgcccccgccccgcccccgccggcccccggcccccgcccgtggtcgccggcggcctcgccgccgcgctcgcgggggccggcggggcgccgcggcctccggagctcctgcgggaggtgctggtcaggatcgacgactcccagggctgctggccctccc

SEQ ID NO: 22254 - DNA, 460 bp, Triticum aestivum
  Clone ID: PAT_TA_22254
cctgctgtttgctttctcacctgttgtgtccatccaagcattcaaggatggcgcctaagccagcccagaagaagcccatggagaatgtcgtggcggcggaagcaaccaagccagccaaggagaatgccgcggttgcagaagcatccaagtctgccgagaagaaggcctcgtctggggagacacccagtaccgggacatcgtcgcggccagcacttaggaattccttcgtcaacgacgtctttgagagggtcgcctcataacatggagcgcgacgtcgtttccttcccccacatgatcaatcatgtcctccgtgttgatttcttagagtgtatcgactatcaagtaataatgcatggcatctacttatttacaatattccatccgttccaacatgtataaaaacattatgtatttcggttgggttacaaaaaaaaaaaccgtcagaaccaaaaaaaaaaaa

SEQ ID NO: 22255 - DNA, 382 bp, Triticum aestivum
  Clone ID: PAT_TA_22255
cccacgcgtacgcgccacccgtacgatgctatatacctacatagcacagccatggtccccaccgtgatggcctcgtcggacacctacggcgctcatttccaggggctcaagtgcaccgtcggcctctccgtcagacggcgttacaacggcgctagccttggcagcgtgagcaacggtggaaggatcaagtgcatgcaggtgtggcccatggagggcgtcaagaagctcgcgaccgtgtcctacctgccaccgctcaacacggaggaccttctcaagcatgtcgactacctgatccgatgcaagtgggagccttgcctcgagctcagcaaggttgaagtcatcttctcggagcacaacgcatatggctgggactacgatgggc

SEQ ID NO: 22256 - DNA, 359 bp, Triticum aestivum
  Clone ID: PAT_TA_22256
acgctgttattcggaggattttattgcgaagagttttagggagggacttatagggagggactcatgtcaccacaaacagaaactaaggcaggggttgaatttaaagctggcggtaacgattataaatggacttactacacccgagagtatgaaactaaagatgctgatctattggcagcattccgagtcagtcgctaccctggggttccgcccgaagaaacaagggctgcagtctctgccgaatcttgtactggtacatggacaactgtttggactgatggacttaccagccttgatcgctgcaaaggacgatgctatcacatcgagcctgttgctgaggaagacagccaatggatctg

SEQ ID NO: 22257 - DNA, 465 bp, Triticum aestivum
  unsure (1)..(465): unsure at all n locations
  Clone ID: PAT_TA_22257
ggaagaggcgctcggggcagcagagcgattccttgttgttcatgtcgattccgagatcccccaccagtggagcttgatttctctctccttcctcttcgattcccccctcctgctgtttgttggcctctcaatttccctctcgagcgcgtgtttttttgttcatttcggcggtgcgtagcttcttgggtccgtccttgggggggtggggagcccttggcggggtgagctgcctcatttgggctgtgctagatgcaatgcgcatgtcctctatggcctgtgagtgtctgtatgtgcttttaagtcctgggtgattgaactgcangttagtgttactgtataccccctagttcagtgttaagtaccgtagactacgcattttttgcccaaacgactgtaatcctgtagttgggattcatatacaagaatttgcacnatcacgggtaatcaaccatacttcnatgtaat

SEQ ID NO: 22258 - DNA, 656 bp, Triticum aestivum
  unsure (1)..(656): unsure at all n locations
  Clone ID: PAT_TA_22258
cttctccaagctctctctctgagatatttctcttggtttgagatccacatcccggcgtgacgcagggaggtgctacgggaacgtagcatttggtactcagagccgtgtatcgatccgcttcctctgatctgaaatttttcctccaagagctcacgatcaatccttcgatccgcttgtaattcctggcaaaaggtgcggatcccctcgggtgatctccgcgcaaaacacctccggtgtacctgcgctgggttgagtagttccaggacctttcccgacggcgcgctcgaccatgccctctcccgcgtcgcgcgcggccgccgcggagcccaccatcgccgagcggcaacgctcctcctcccccctcccggcacccaggccgggtccgtccgccgcagagcgcggcctctcgtggctgctcccccccaacagtacgtccccctcggccggctcccccgctggcacgctcaccgccgccgccgcacgcgccatcggggcggcgtctcccttccccccccacgccctgcttatcctatccgcacgcacanggttctganaacaaataaccnaaaggtnaagnacaattaacccacaggaacccnctntgatccaganntgccccatgaatantgttgcaaaccnataccngttaatngata

SEQ ID NO: 22259 - DNA, 427 bp, Triticum aestivum
  Clone ID: PAT_TA_22259
acgaaaccaaaccaaaccccagctacatggccacggtggcgatggacatatcgaagccccctgcggccgggtgcggcgaccagtcggacaagggcgcgcgtggcggacgcgaggggttgcgccagtgctacctgcagcacatgcacgacctggagctacagatacgtcagaagactcacaaccttaaccgtctagaggcccaacgcaacgacctaaactaccgagttagaatgcttagggaagagctacagctactgcaagagcctggctattatgtaggtgaggtggctaaagtaatgggcatattaaagggtctaggtaaggtgcatccagaacgcaaatatggagttaatattggtgcgagcatcgggctcacataaatcacaccttgaacaagagttgctcttcagaatgatagctatatgct

SEQ ID NO: 22260 - DNA, 718 bp, Triticum aestivum
  unsure (1)..(718): unsure at all n locations
  Clone ID: PAT_TA_22260
accagcaccacagcgtctgcgtctacgactccagagcaggcatatcgttgccaagatggaccgtgcagcaatcaccacgatgccacggaagctggtggtgctgtacccgtcgccgggcatgggccacctggtctcgatgatcgaactgggtaagatcatcgccgcccgcggcctcgccgtcaccatcgtcgtcatcgatctaccgcacaacaccggggcaagcgcaacagggcccttcctcgccggggtctccgcggccaaccccaccatctccttccaccgtctcccgcaagtcgatctcccgcccgtaaaatccagccacctagagacattgaccttcgaggtcgcccgcgtctcaaaccctcacctgcgtgatttccttgctgccacctcccctgccgttctcgtcgcagacttcttctgtaatgtcgcacgcggctttgcctcggagctcggcattcccatctacttcttcttcacctccggcgctgaggtcctggctctctacttgcatctcccggtcctgcacgctcagattaccgccaacttccaggacatgggtgatgagctcgtgcacgttcccggaatccctcgtttccggcgacagactccatgcggcaatcatggaccgtgatgacatagcatacacgaagtcgtgagtgtgtgaangacctgtgctgtccagggatcctcgtnacacttcgctcgctcgaggggg

SEQ ID NO: 22261 - DNA, 226 bp, Triticum aestivum
  Clone ID: PAT_TA_22261
ggaactaactctgacgcccaagagcccggggtccttggtgagctcgcacgtcagcacctcgcccatccatccgcaccgcttttcggtatgatggaactttgaaaacttagcgccacgcataagcagttccgcttttcggttactggcacgtgaaatacagatgtagataatcctacaaaaaaattacatatgtgctgtctgtcatcttccgtctccggcgtttctc

SEQ ID NO: 22262 - DNA, 465 bp, Triticum aestivum
  unsure (1)..(465): unsure at all n locations
  Clone ID: PAT_TA_22262
atcaggccacgcgtgcacctccaccccattcgtctccaccgctaggatatccctatccattcgtctccaccgagatgcatctgcatccagctccattgtctctcgctcaatctctcgttcccgtgcttccaccgaatgcaggtgcccggatgtgaagtcgctggcgccccgcgttccaccggagtgccgctgctgtctccccccgttccaccggaggagcgagcgccgcgcccgcaccccgtccccgccccccccctcccctcccccccggccccccccgggacggtcccgtcaggcctccggcaccccccgccgcaccaccctccgcccccgtcgacggcccccccccgaacgcggccccccgcgcgccacccgtctcgaacgctcaatgcgttgcggccgtnncgtctaattcatanattcagnatatatatgatgcnatagtntgattgacactcntgcctc

SEQ ID NO: 22263 - DNA, 371 bp, Triticum aestivum
  Clone ID: PAT_TA_22263
acgcggacccgtgtgcgagatttgagctaaactttcatttacgcctaatcaacatttaggataccgcgttattgagagaatgcttaattcaagagttatagggagggacttatgtcaccacaaacagaaactaaagcaggggctgaatttaaagcatgacgttaacgattataaatggacttactacacccgagagtatgaaactaaggatgctgatatataggcagcattccgagtcagtccttactctggggttgcgaccgaagaaacaggggctgcagtctctggcgaatcttctactggtacatgctcaactgtctggactgatggacttaccaacatggaccgctacaaaggacgatgctatcaca

SEQ ID NO: 22264 - DNA, 389 bp, Triticum aestivum
  Clone ID: PAT_TA_22264
ctgcgatgtagcggtcgccggcggctccggtgacgcgaggtcgccggcaccggcgcagggtgattctggtatcatggtatccgatgctccgtaccgtcaccttgactatgccaggttcttcgtgctcgagacgattgctggggtgacgtatttcggtgaggctctcaacttacaccactgcagtagcaccgtaggccactgaaatttggtgctagcatgccaaattttggtgatatatagtattccatcttcgtgtcattttcttctcctctctgtattcagagttgcaggcattacttagaatttcgtgcttgtgaatctagatagtagaaatagtagccacatgagcgcatctcagattcacagtgatagatttgcaccgtggatca

SEQ ID NO: 22265 - DNA, 546 bp, Triticum aestivum
  Clone ID: PAT_TA_22265
ggccggggtggttagggattagactccgccaccggctgaaagggcctgccgtgtcggccgctgctgtgtgccggagggtgccgttggagcgtgtcgcctgccgcatgccgcgcgccgggagacgccacggccgtgcctgaaggcccgctgtcgcgggagtggccgtgtccgctagcggccacgccggagggcgtcgtgcgtcgtgtcgactcttgatgccagacaagagggctctggtgccaggtgccggtgttgtgatgaaggtcctgccaagtctccatgccgtgcgcaggccatcttctggagccgctctattgcggttgaggcctccgtgctgcagcgtccctgaaatcagcctttgcatgcgcagggcacacaacgcttccatggggaaggccaaaggtaattctgatattgtttattatgtgctacgtgaagtattaagtttggaagagggacaccttgttattatagagtagcaattagatcaagacttctgtattcatttgatcgcctacggaaaggggtggccgtggatgttcgttt

SEQ ID NO: 22266 - DNA, 1958 bp, Triticum aestivum
  Clone ID: PAT_TA_22266
gggttcctcattttctcccactaaacgcaaaatttctctaggcgacgacatggccacgaacaagaagcagccccacgccgtgctcgtgccgttcccggcgcaggggcacgtcacgccgatgatgaagctggccaaggtcctgcaccgcaagggcttccacatcaccttcgtcaacaccgagtacaaccagcgccgcctcgtccgctcccgcgtccccggcgccgtggccggcctcccgggcttccgcttcgccaccatcccagacggcatacccacgtctgatgtcgacgccgacgccgatgccccgcaggacccggtgtccctctgttactacacgatgaccacctgcctcccccacttgaagaacctgctccgcgacctcaacggcgcggttggggcgccgcgggtgagctgcgtcgtgggcgatggcgtcatgagcttctgcatggatgccgccgcggacctcggcgtgccgtgcgcgctgttctggactgccagcgcctgcggcttcatgggctaccgcaacttccggttcctcctacacgcgggcctcacccctctcaaagatgaggaccaagtgaagaacgggtacttggacacgccggtggcgcaggcacacgggatgagcaagcacatgcgcctccgagacttctcctccttcgtccgcacgacggaccgcagcgacgtcctgttcaacttcctgctgcacgaggtcgagcagtcggaccgcgcgaccgccatcgtccttaacaccattgacgagctcgagcagacggccctcgacgccatgcgcgccatcctccccctgcccgtctacaccatcggcccgcttaactcactcaccgagcagctggtctcacaggaaggcgatctcgccgggatacgctccagcctctggagagaagaccagtcatgtctcaagtggctccagggcagggagccccgctccgtggtgtatgtcaactacgggagcgtaaccaccatgtccaagcaggagctggtggagttcgcttgggggcttgccaactgtggctacgacttcctgtggatcgtgaggaacgacctggtgaagggcgatgccgcggtgctgcctcccgagttcctcgaggccaccaagggcaggtgcctcctagcgagctggtgcgagcaggaggcggtgatgcaccacgaggcggtgggcgccttcctgacgcactgtgggtggaactcgatgatggaggggctcagcgccggggtgcccatgctatgttggcctttcttcgccgagcagcagaccaactgccgatacgcgtgcatggagtggggcgtcggggtggaggtcggcgacgacgtccgccgggaggcggtcgaggcgaggataagggaggtgatgggaggagaagtagggagggagatgaggaggagggcggcagagtggaaggaggtcgcttctcgctcaaccgcgcaacctggtggcaggtcgttggccaaccttgagagtctgctcaaggatgtactgaagtgaccgccaataacaaataattaaggtgggtatatagtcactccttgcaaaactatagtggatataattttttacaaagtcaaacattgtaaactttgactagtttattgaaaacttaactacatttaccaattagccttctaccatttacccgctgaacctggcttgctggctttcatgggtccatagaaaccgataagcaagtacgcgtgggtcgcgccacagggcaggaaatttgtgtgcggcgggtgcaggcaatatggtagtctatatggatttcttggctagaaaagccaacaaatatatgtattggtgggaatctagagaaagcggacaaagattatatactaattccccgcccgggcgcccgccactatgaatgcaatgcacacaacctgaagatcaaaaaaaaaaaaaactcacctgcccgggcgggccgctcgaatcgaattccccg

SEQ ID NO: 22267 - DNA, 579 bp, Triticum aestivum
  unsure (1)..(579): unsure at all n locations
  Clone ID: PAT_TA_22267
gcgctctccacgctccaccgtctcccgcccctttctcctcgcccccaactctatcctccccaccacccgactgactaaacccccagacgtcccggaggtttcagcagcagcacgagaaccacggtgatgggcgccgtgacaatggcgagcagctccctggtcctccgcccgcgggcgtcgtcgtcgttgccgagcacgagtcctcgtcgtgcgcccacgcgccgggcggcattgcccgccccgcggcgcctccggggccgcggtgctgaaactcctccgcgggagggggctcgcgcggcgggggcggcgacgacgacgacgcggtctactcgctggcgccgtaccgctgctgctggcggcgctgctgcccggggcggagcccatcagcgcggcttcgagccttcggggactggtcaagacttnagcccccgatggtcgtcactggggcacccggcaaatgcgtggtgcttcgcatggtggtacggaatactggggtaagataagttcgacacctgagagaagcaagcaagactgaccaactctcgngatgtctctctcgctggcgcacgngggtacgct

SEQ ID NO: 22268 - DNA, 778 bp, Triticum aestivum
  unsure (1)..(778): unsure at all n locations
  Clone ID: PAT_TA_22268
gcagggtgaagcaatcaaggaggcaggctattgagaagccaatctacaaccacgtcactggcctcctcgacccggcggagctcatccagccccccaagatcttcgtcatcgagggtttgcacccaatgtacgatgaacgtgtgagggagctccttgatttcagcatctacttagacatcagcaatgaggttaccgtcgcactngaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccagtttacctcttcgatgaaggatcaaccatcaactggatcccttgtggaagaaagcttacatgctcttatcctggcatcaaattttcctatggcccagacacttactttggccaagaggtactcatcttggtttatttaccgttttgtgtccaacgagtaatgctaactgctgttacttggaaataaatcgaaagaaacctagcaagtagtccaaagtaggacaaaataagagagctccaaaaccattcttggactagagatcaactattcactgagtagaacaattctagctgtcaaacaggtcctgcctcagacaatgctgtacaatcttagagtttgcttgtttacttca

SEQ ID NO: 22269 - DNA, 2183 bp, Triticum aestivum
  unsure (1)..(2183): unsure at all n locations
  Clone ID: PAT_TA_22269
cccacgcgtccgcaaagccgaccacgcgccacgagcgcacgagcacgattcgtccggtgcgtcgcgcggcggcttccatctccgcggccgtgctgactccgcctccatggcgtccgtctacaccgcgccccgcgcgccgctggccgccacggccgcctccttcccctcctcgtcctcgtcctcgcggcagctggaccccaaccctagccgattcctcgctgcgcactttggcccgtggccctgtcccttccccacgcgtccccttctccccaagtgtcagggagaagttacaaggcttgaaggggagaagagcagctccaagaggtcgggcagcaaacatggcattctgcagcccacacaccaccacatccctgcgctccccatgcaccaccatcccaaactctggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcaccagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgagttaaattgatcatgaaagaaggcattaagttcttcaacccggtttacctcttcgatgaaggatcaaccatcaactggatcccttgtggaagaaagcttacatgctcttaccctggcatcaaattttcctatggcccagacacttactttggccaagaggtatcggtgctggagatggacgggcaatttgacagactagatgaactcatctatgttgagagccacctaagcaacctctcaaccaagttctacggggaggtgacacagcaaatgctaaagcatgcagactttccaggcagcaacaatggaacaggtctcttccagaccattgtaggactgaagattagagatctctatgaacagatcatcgctgagagggccggcgttcctgctgaagcagcaaaagtttgatcagccccaaattcaagttcacaaatcatttcatcaccaactcaatgagaatgagcatcctcccatttcttgtacctagtttgaatatattacagctagaagacggtagaaagttcactgcagaactcatgaaaacctgcattttgaacttctcgaaaatcctctccatgatgagggtctcttatgtctcttcttaacacatttcgatgtacatcttctcccatgtttcaatgcagaaaatacatgtgtttgctagaatcaaaagcggctgcttttcacgaccgtgtcaaaaaaaaaaaaaaaaaactcgagagtncttntagagcggccgcgggcccatcgattttccacccgggtggggtccaggtaagtgtacccaattcgcctatagngagtcgtattacaattcactggcccgtngttttacaaccgtcgtgactgggaaaaccctggggntaccccaacttaatcgccttgcagcacatccccctttcgccagctggngtaatagcgaaaaaggccccgcaccgnatcgccctttcccaacantngcgcanccttgaaatggcgaaangggnnaatcccaatttttnangnggnntannggggnnanacnnncnggannnttaa

SEQ ID NO: 22270 - DNA, 571 bp, Triticum aestivum
  Clone ID: PAT_TA_22270
tgagggtgtacaatttgcgcgcatgtcatcaattccatcatgtgattatacaactttccctaggaactgggtacctcaccatgagcttgtattgcatgagtatatcaaactgcaagatccaaagttcttctgcgaacttcacaagacaatcaaacgacgggagataagttcaccacaggatgacgtatcgaagatggtgtggcattataaggttcatggtgtttatgataataacaaggtctcaaagaaattaaatgaatggaggagtaatgatgaagctgtcaatggggacacacaactattgttggataagtagtcctagattccatatcatttgtagagataatgatgggtgatagatcgattgcacacaagcagatatcctgttttgaacaaaacacagttttggacaaatagacctaattgtgtgtgcagaatactaatggttgatgtatcaacgacctaccagctaaagaccaagaaatgtatcattgggcaaatatttggatgttcaagagtacatgtttgaacatgtactacaatactacacctgatctcaaggtaaactatg

SEQ ID NO: 22271 - DNA, 753 bp, Triticum aestivum
  unsure (1)..(753): unsure at all n locations
  Clone ID: PAT_TA_22271
gttctcttcttgccagtttgtttagttcctagtacaactttaacttgatacgtctttgatcgtccatctaaactaacatatcaaatactcatggttccacaggttgttggaactctaggatacgccgcgccggagtacatgcaaaccgggcgcctcaccgcaaaaagtgacatatggggctacggcgtgctcctctacgagctcatcaccggccggcgtcccatcgaccggaaccgcccaaagggcgagcagaagctcctggactgggtgaaaccgtacatctccgacgtcaagcggttccccatcatcgtcgacccgcggctcgagggacactacaacctcaagtccatgacgaggctggccggcgtggcaaaccgctgcctcctgcggctaccaaagacgcgcccgaagatgagcgaggtgtacgagatggtccagaagatcgtcgacagcgtcgagatcggcccaccggagcctcccctgcactaccacggctcggtgtccggaccgggcgcaaagcggaccaagaaagggtcgctgaagaggaggctccaggagttcaagttcgggtgccgacagatcgtgtggcggggctggaaacctgagatataaagacctgctgaaatgggatgccaccctcctcctgcctgtgactgtaagtatggctgttcatagagatataaagttcgtaaccggtgcgcggtttgcactgcacgtgtaacttttttggncctgtagatttctgtttaaagc

SEQ ID NO: 22272 - DNA, 654 bp, Triticum aestivum
  unsure (1)..(654): unsure at all n locations
  Clone ID: PAT_TA_22272
tggcgaattcggnacgagattcgcacaatagccagataaatttagtagggaagaacatatnatgtgtngttgcggnaagatattcatgtggngcgtaaaagttaatttaccatttggnaaaatacctggagatgaagtttggtctcggtccggggcaattcccgatcggcacgtactcggaaaacgtacaaaacatcaaatcgagctgaacgaagcaaatcctccgtccgtaaaagtcaatatccgtctcctctgaactgccgtcccccattccggtccatcgagctgtgaaattccgatgttggtcgtagcgagtatccatctcccctcgaccgccgccctcctccatcttctctgttggcgttcatcacaggacgagtactgtctagccgtcttgcagccccacttccaccactcctgaatctactattcctatcactgttgtactcactgctgccattgctgttcctagcttcgttcttttttcttgggttccatgtcggctcctccaagtccgaggcaaagccgttaccaaattgatccctttcatcaccattgtgaccccccgtgtatcctcctggcctttcgccactgttggcattaggcctatattccccccctcctcggccgcgtcggtgctcacctggactagac

SEQ ID NO: 22273 - DNA, 545 bp, Triticum aestivum
  unsure (1)..(545): unsure at all n locations
  Clone ID: PAT_TA_22273
acgcctcctccccaagctccccccatcgcaagaaccaacttttgcccccaaatccccccctaaactctccaatcccctccccccattgcgagatcccgcaccagattcgatctcccccctcccaaaacccacgagggacccgtctccgtccccgaatccgccgtttccctcccccgaatctggcggccggagatcgggcgcgggagccggcgtccggcggagctcgatctgtccgtccgagctgaggcggaccgcgaggaggctagctgcggcgcggcattgggcttcggcccgctttttcgacaataagaatggcggccccggggagcagtaatggcggtggccgcagcagttcccagcagcagcagccgcagcaggacangagtatatgggctggntgtttccctggcttgtcatgcttcgggcgcctaagggtggaaaccgtgtacctcctgcagcactatgcccgacgggaacgctncgactaacgtgggaaatgctnatcgggnggaatcccancaatatggggtatgaatctgcccttg

SEQ ID NO: 22274 - DNA, 1000 bp, Triticum aestivum
  Clone ID: PAT_TA_22274
cccacgcgtccggagaaggaggaaattctagcaccacacactcatttctgtgtgatatgtggcaagggtttcaagagggatgctaacctaaggatgcacatgaggggccatggagacgagtacaagactcccgcagctcttgccaaacccatgagagattctggctcagatcctacaccagttacaaggtactcgtgcccatatgtcggttgcaagcggaacaaagagcacaggaagttccagcctctcaagacaatcttgtgtgtgaagaaccactacaagagaagccactgtgacaagaggtatacctgcagccgatgcaacaccaagaagttctcagtcattgctgacttgaagactcatgagaagcactgcgggcgtgacaagtggctctgctcatgtggaacgaccttctcaagaaaagacaagctgttcgggcatgtcgcgcttttccaagggcacacacctgctcttccaatggatgatatcaaagcatcaggagcattggagcagcctcaggggagcgaggcgatggacgacatggtggcgagcacagggtataacttcccaggcagcacgtctgatggtattccgaatctagacatgaaagttgccgatgacacacgtggttatttctcgcccttgaacttcgacccgtgcttcggtgccctcgatgactttgctcgccctggattcgacatctctgagaaccccttctccttcctgccttcaggaccggggtcgtgcagttttgggcagcttagtggcgacagctaatggagctcgtcaccgttgacaaccatgatggtgtcgatcgttatgtatgaatgttatatgtatgaccgtcttagttcttcctctattcagggagccattttggtccatgcctctttcttaagtgtacttttagtttgtggtcatcaataatgatcaagtacttacatatagatttgacaattgttaaatatattatattttctttaaaaaaaaaaaaaaaaaa

SEQ ID NO: 22275 - DNA, 597 bp, Triticum aestivum
  unsure (1)..(597): unsure at all n locations
  Clone ID: PAT_TA_22275
ctaggttccattatttcactgaagtgagctccatgagagaggattccacaaggtgaggtccgccgtgaggggtggccagcgatgtgagggagcagccgcgaccagcgctagcagagtccaacgcgcccaagccccggccaaggctatagcagctgctttcgcgtgccgtcgttcccctccagcagatccctgggagaaggcggggaactgcagggcgtccgaccggctgggtgaagcgccgcttcgccgtgatgtcgcaggaggtcgtataggcgcacatcaagatggcgtacatcaccattacggccaccttttctgctcaggggtgcgcttacttccggcggcgtgcggtgcgccggcaaactgtgtgggggggccacagtgggcgctaccatgcgtctcactttgatctcggcggctattggggcttcttaatgcccctgtttattgggtgagtctgcgcccaatttccaacggggtggtttgtacgtnagtaaaaaaanacctgggttagtgaatgccctttccnaaaaaaaaaaaaaaaaaaaaaaatccangggggggccggnanccaattccccnanaaggagtccttta

SEQ ID NO: 22276 - DNA, 803 bp, Triticum aestivum
  unsure (1)..(803): unsure at all n locations
  Clone ID: PAT_TA_22276
attcacccaggcaatctgagagtgatactggttctctcactggtgctgggttatcaactggtgcgccgctcactgggtccattccaccattatcactcacagatagcgggaatgctgacgagattgttcatgagggatcatactcaaaggagcttgccactcctgaagccaataagaatcgttcttcaccagcttctgtcaacaaaagtgccactacacatatggtggcagcaagtggtgtgcctaagtctgggctgcgtaaacctctgttttccgatggtcgtgctcaggggcctgcaaagatggttggcggctccgctgttctcggtgatgagcttgctgctgcctcaagatcaaccgaaggcctggtggaagatgaagacgaggctcctgcggccaaaagggccaagctgtagatcagccgccctttggcaggaagttcttttggagcatagggcggttgttaggtgtgcgctcgaaatgatggcccagtagatggatgactcgatgtgggttagatggtgaagcttctctttaggtctatcgccccttttgtcgtgctgtgttgtttatgatgtgatgttccggtctaccagtctcaaaaaacttcagtctgctgcttgtgggcgaacattcgctgtcggtattaggatcagcgttggcctttgctattgtgtggtgtttgcttagcttctggttgctggtgaatgtaaagagaagcttggctatcttatttagtatgcccgttgtccnnnnnnnnnnnnnnnnnnnnnnnnnnnnnnnnnnnnnnnnnnnnnnnnnnn

SEQ ID NO: 22277 - DNA, 715 bp, Triticum aestivum
  unsure (1)..(715): unsure at all n locations
  Clone ID: PAT_TA_22277
ctcgcgcgtgacgccgccctctctctgtcgacgcgccctctctccccctctcgccagcatcttgctccgcaccgccgcctggctcaccgctcctcacacgccgccctctcctactctggcaacgcgctgctaggcgaggagtagatgcagaaagctgccatttttgtgcgccggcaacgcgctactgggcgagagggaggcgcgcgctggcgctagatctgagtgcgccggcggccccgctggctaccgcggggaggcctcctcgtcgccgtccctgcagccgccgccgccgcagcagcagcaggggcacgctattcagcccgtgtggctgcggcagccgagtctgccttgggatcttggtgcgggcgcgcctcccatcggcttcgggcttcgtgatcttgaggagatgcgcaagatggtgctcgacgggttcaagcactgcgcgcacgggatcatggagaacacccgggggcagccagcctggtctggatgcctgtactgttctttcctgtagtggagctaattttgtgtctttgttaatcttctcatgaacttctgtagcttctgttagctagtcttggtcatgaatctgcagcttcacctagttaccgtgtgctgcaattatgctgtgttacaaagtgatcntgctgctggtacctgtatactttggattataaaccgttataaagtaacttctcaatacatgatttccaan

SEQ ID NO: 22278 - DNA, 548 bp, Triticum aestivum
  unsure (1)..(548): unsure at all n locations
  Clone ID: PAT_TA_22278
ccggctcgtccggttgccacctacaaaaagagccatgagtgctgctcccaccggcgccgtggccggcgaagaaatcgacgagaccacctttcgggctcaggctgagatgtctgagatcatggtgtcgctgccgcgctgcccggtgtaccttacccgccaataccgcggcttctggatccgcgagttcgttcttgagggcatggccgccgttcaggcgtccttcgagccgatgccaacggacgtcttcctcgccagctgccccaagtccggcaccacctggctcaaggcgctcgccttcgcgacgctcaaccgcgccacgcactcgccgtccgactccgaccacccgctccgccatcacaacccgcacgactgcgtcgccttcctcgagacaggcccgtacccgagacatggcgctcccttcacccggtgctgcaaccactgcctaccctgctgccagaccataacggatgcggtcggtcgtcacgtctccgggagccaangaccanggtctcntcggatnacacancaagtcgcggggnctcacgtnt

SEQ ID NO: 22279 - DNA, 767 bp, Triticum aestivum
  unsure (1)..(767): unsure at all n locations
  Clone ID: PAT_TA_22279
ctcgtgccggctccgggcatagctccatctctctctcccgatccccttctccaccctccggccgccgccgcggccaggccggcgtggcggtgcgccatccatccagccaccactccatcatccactccatctccaccacccgccgctgccagcgccccatcaccacctcgaaccaccgcgccatccatcaccatctccagcaccgccagccacgaccatcaccaccgcgccaccacctcctccgcgcgactccactccttctccatctctctctgctgcctttcttcccttacctccgctgctccctgctgtttcccctcgccttcctcaaccttctgctgctcctcccatcttcaacctgcaattcttctacgcccttcgctccttgctgctgttcctctcctcttccttcacctgctgcgatctctctctctcccacatctttgctgctgcccctgctgaaccctccacgctgctgctgctccttcttcttctccccaaaactgctgctgcccccttcttgcccatgcctctgctgctgcctctcttctcctacaccttttgctgctgccatctctctctctctctctctctctctctctctctctctctctctctctaaatatccgtaatttgagaaagtgagcttctttggtagatcataatgccagtagcggccngtaacctggnanaatgttaantcngancttgtcaaggggttaatagaatccggcacnggtngggnggaatcctangggtttgtcctt

SEQ ID NO: 22280 - DNA, 474 bp, Triticum aestivum
  Clone ID: PAT_TA_22280
ggaagaaggaaccgacgaaggaaggagaagctaaggtccatccccgatcctcgccgcctccgtcgccgggacgccacgcgtggaatcagcgataaagcggacgaatttcgggcggaggagctcagggatctcgtcgtttgctccttcttcttcttgattgatcgaccggtaggtgggcgaggcgaaggcgggcggatccaggagcggcatcagccatgatgatggtggacacggtcagcgccagcacctccttcatcgcgcgccacccctccgaccaccaccggccccgccggccgcggaccctcctccacgtcgtcagctgccggcccctcgccacgcccttcgcgggccgccgcctcgtggcccgggtgcccaggccggagcgccagcggctcgcggactggcccgtcagggcgctggccgccgtcgggttcaccaaggaggccgtcccgtggaaggagttccgggggatcc

SEQ ID NO: 22281 - DNA, 487 bp, Triticum aestivum
  unsure (1)..(487): unsure at all n locations
  Clone ID: PAT_TA_22281
agcagcggacggacgtcgccgtcccttccgtcgcctcaagggcctccggctccgatcccctcctataaacccgccgccccctccccccacctttccccagatcaaaacccctcctcccctctccctcctccctccatccctcgaaccatccgtccgcccgtcggccatggccaccgccgccgcgtcccaggtggccttctccgcgcccgtcggcggctcggaccgagccgtnaggagctccggaatccagngcatcaacagnctcagcttcggnancanatcatggatcggcaccgcagtggcgtgngacagnacggncgcggtgcatggggggatgtctgcngggnngtccagcagtctagcangagcaagggctctgtctnccctcganctgnagagtgcnanngagccgccgctcaanacctanaagccaagggcnttacacggnaccaccgncncgttgancggntgtgggcttancgcccag

SEQ ID NO: 22282 - DNA, 390 bp, Triticum aestivum
  unsure (1)..(390): unsure at all n locations
  Clone ID: PAT_TA_22282
cttgccataagtagttaagagtttatttgatgtggttaaataaatcaagctaattttctgcagttctcgggttagaaaaaggtttcacttaactttgttgaagttcatctagaatcttggaatccggcgtggtcgcggccgaggtacgcacagaatgatatctacctcgatgagtgtaatgtgttttctcacttccaggcctaggaatgttttttcattggacatacttcaaatattttataggtaagtaaaccaatcatgtttttgttgttcggagggaactcataatatgttctagggaaataaatatgcttgccctttttttaaaacaaannnagtatttggannngtaaannngaagtatttcaaagtacctgcccgggcggccgc

SEQ ID NO: 22283 - DNA, 552 bp, Triticum aestivum
  Clone ID: PAT_TA_22283
cccccgcccgccggccgaccccccgccccctacccgccgccgtcctcctcgcccccgcccgcccctccaccctcccccccccccccgtcgccctcgcccccgcccccgccccccccccccgccgccccccccccccccacccccggcccccccccccggccccgccgccccggggccccccccgtgtccgccaaccgccgccccccggcgcgctccccgccgtcccgcccccgtccccccctccctgacgttccccgcctttcgggtctgctccgaccgttggctcgggggggtccccccagcggcagggacgcggtgcgcaccccggaggaggggaaccgccggctgtcgaccggttccgggagctcccgcccgcagggcccccggctgctgcgagctggcacgctaccgatgcggttcgaacgggggcccagcttggacccacctcctggcacgatgcctgtctgcctgcgggggaccgattccgccgtgcaggggaccatgccctttgatgcttcaagcaccattactttgtctcctgtaaactttcaa

SEQ ID NO: 22284 - DNA, 722 bp, Triticum aestivum
  unsure (1)..(722): unsure at all n locations
  Clone ID: PAT_TA_22284
tttttttttttgattagagaattaatccattgttagacgcacgatcaaccccattagccaacaggcttccttatcagcttattcagcattatatatgtcgcggggttttcatgaagctcaatttctcttacagttgcagataaattagaagctcattcatcagtagttcattctactgacttgtgctagttcacttattaggtacaaaacgaactgatggaatgaactataaacaaataaaataaaaatcataaccccttgagcagcacatcctcaacgaacctatcaaggttagcagaggacgagcccccttctttggtagcatcttcagcgagcctcttccactccaacgtcttctccctggcctccatccccttcctcccggccatcatctccctcaccagtgcggctatctcatcgcccctcgcctcctgcggcagctccgctccgatgttccacgccgtgcttacctgccggcagttggtcgtctgctcggataccatcggccaaccgagcaccggcaccccccgattacggtctccaagatggagttcaaccacagtgcgtaacaaaaagccccacggctgggtgggcaaggaccgcctcctgggcacacaaggcacgacgagcccgttcttcccgacctcaagccgggcgccaagtcggaccgcaaaatccacaggtagggagagccgccccgcgcccgcccgcgtgcccttntt

SEQ ID NO: 22285 - DNA, 670 bp, Triticum aestivum
  unsure (1)..(670): unsure at all n locations
  Clone ID: PAT_TA_22285
cccacgaggccacccccgtacctgccccacccacaattcccatcttctcccccgtgctgcctcatctctccatctcccagagcactagcacacctccagccagcgccctcatccctccatctgccctgagcaaccacacgccgccggccaacgccgcccgcccgtccggcgcccgcccatccccgagcatcagcatgccgtagccagcgcccgcgaggccgtccgtccgccgccatgcccagcgcccttctacccatccgtctgccacctcgccagcgccgtgtgaagctccacccctcgggagttcgtcctcaccggccggccatgcgcactccagctcctccggtcgcgccctcgagcctgtcaacacccgagctctcctcaccgtcggtcccgctctctgcctcatgactctgccgctagagcagccgggcgctcaacggtcgagaacgggcatcccgactcctcgcgtgctcccgcngggctggaccaattactctgagcgcggaaggccgattgccgctgacaaggcaagctcgggcacaagagaacggacacggaagggaganaaggacacataggaacagacggacacaggggcgcgtgacgnggggaaacaagntgnaagccatgttgcnnttaggcttgtatnagnacggaatattttggg

SEQ ID NO: 22286 - DNA, 258 bp, Triticum aestivum
  unsure (1)..(258): unsure at all n locations
  Clone ID: PAT_TA_22286
gggagaagaaatcacagaggaagctgcccaagatgagactggagaggctgaggcagacagcacttcctaggtaattataatggtgtttcttgtttgttagtttcggaattgcctctccaatgaagaagcctttttggttttcttttattgtaatttgattatgtatgttacacatcgatgcagtatattagattttcagttcttcttatatatatttcangatacactaagtttttcaatcaccacaaaaaaaaaaaa

SEQ ID NO: 22287 - DNA, 1587 bp, Triticum aestivum
  Clone ID: PAT_TA_22287
cacgcgcgaggtttcgtcttcgcaagaggaactggtcgcgcgttctccaaggttccctgggatggcgtcgtcggaggtggtggaggacgaggcgtcggcggcggcgatgctcgccaacggggccgcggacgtccgccggaggagggaccaggccaaggcgatgctgtcgaagcaggccgtcaagatcgccaccaaggcagaggagcacgagcgcttcatcttcaaggtcacacacctgatgggtgttcttggatttgggacattttgctacctcttgggtgccagaccacaggatgtgccgtatgtgtattgcctgttctatgtcatatttgttcctctcaggtggatttactaccgctacaagaagtggcactactatcttctggatttctgctactatgccaacacttttctccttgttatgattctcttttatccaaaggatgaaaagcttttcatggtttgcttctcatttgcagagggtccccttgcttgggcattaattgtatggcgttgcagcttggtgttcagctcattcgataaacttgttagtgttctgatacacctcttgcctggaatagttttgttcactatccgttggtggaacccacaaacatttgctgccatgcatccagaaggaagagcagcaagagtcacatggccatatgtggaggacaaatcttatctgtggacatggctatttgttgttcctctagctgcttacaccttgtggcaactgatgtatttcctcatagttaatgtgctgcgccggcaaaggctgttaagggatcctgaagtcatgacatcatacagggaactgtcaaagaaagcacagaaagcaaacaacatctggtggagactgagcggattgcttggtgacaagaatcgtccgttgatgtacatactgcttcaggcactgttcacagtggcgacattggctttcactgtacccatattcctttcataccggctgcatgggatcttccaagtactaaaggtgtgtgctgcaacatggaacggtggaagcttcatcctggaggtgatgcccagacaagtcgtccagaaggagaagaagagacttgagatgaagcccattgaacaagcaaacttgaaggagcacatggacgatccctcaggtaaccaccagcatgcatccgaggagccaagtcagtgaggaaactgatttgggccgcaagattagattgtctggttactggtactgtcgtgtgaccttgttccttctgtcagaaaagttgctatcgatgaatgttctgttggcttgggacatttcagggctgtttatggtgggatcgctagttaggatgtgtgggcatgtttgacatagcaaaaggtggtggttcaaatgttatcagcgcattttatgccaactttgtctctagggttttcaacgtgtgttgagtgtgctgagatagtttcttttttccttttaaaaagagccttggcttagggcatgttcaatgcatagccccaaggtgatgcctcgcatgtcatgtaggatcggatatgatgtaaagtagattcggataagaaagcgggatcctctcgaaaaggcgggtgcttttagag

SEQ ID NO: 22288 - DNA, 636 bp, Triticum aestivum
  unsure (1)..(636): unsure at all n locations
  Clone ID: PAT_TA_22288
gcgaccgcgtgtggatgatcggcttcggctccgggttcaagtgcaacagcgcggcgtgggagtgcatcgagcccgcgcgcgacgcccagggcccgtgggccgactgcgtcagccgctacccggtccacatccctgaggtgctcaagcattaaccaaccaacgtctcgcggcctgcaacaggatgtctctctctgtcgcttctctctcgattgtatccgtagacaactactatgccccatgcatttcttctttctactatcagtctggtgtgtatttccctcggtgctaaacctgatcggtccgacggatcggccggagcgctcgtgcccatgacgtccaaggaggacacggctgggccggagccgcagctgggccggccggcgtaatagcagcgcggtggcgattaaatatgccggtctgtctgacccgccatgtgaggtgcaaccgacggcggtgttgcctccagcacaaaggcttaattcctccggcatcataaacgtatagcgtggcctcgatgccactactctttttcccaattccccctgttaattgttacaatcntcctccgttctccggactctcctctttgtaatttagtcttacggaccccatgaggaaaagatcaaagtacgcaca

SEQ ID NO: 22289 - DNA, 633 bp, Triticum aestivum
  unsure (1)..(633): unsure at all n locations
  Clone ID: PAT_TA_22289
cagagtctgtaagctagaccaagatgatcttatgatacttggaggtctgccggcactgatttgcatttataggaagaaagcggaacaaacaattcctccaggtttcccgagcgttgaggttttcagtttcgactcttatgtgccatgggtcacctttgagcagggagctatatatgccgaaactgaaaaacctccacctgaagctctatgcctgcccagctgataaatttccttgaggtatcatcaacctccgcaggcttgagaagattaccatccggtactctccacacaatgcaagcagtggcggtgtcaagaaggtagttgctgccatgaagagaacaggctgccagccatggtaatcagtcnaactttcaagacaatggcgactccgaggttgtgagaatggtcagggggctgaacgcacaccacctggatcaattcctgtggacctggtttggccactaataaaataaaagaacacaanttcggccgaaacatactggcctgaaaccaagacccgctactcctcccactaagatatagcatgctcctcaacggactcccttggacatggggacgtacnaagtgtctgtaacattactactctccttctattaataacaacaatccgtg

SEQ ID NO: 22290 - DNA, 701 bp, Triticum aestivum
  unsure (1)..(701): unsure at all n locations
  Clone ID: PAT_TA_22290
ctcgtgccgaattcggcacgagctcgtgccgaattcggcacgagctgcaatgcatacgcaatgatttaagatctggatagttttgtgcagcaggacaacgtaagagactactctcgtgcttttttcttttttttcttagtgcaaacaacatagaaagcataacagtggaacgccgccattgcggaagacaagaggcagctagcatatcctattgatgctttattttaaatcggtaaaattcacccattgacggaaaaaaaaccatcacagcagagtgaagcctgatcctttgaacttctcctcgaatatcgcatctagacatttagccatctcaggtgtcaaatggttcacccaatctcccaccacccccttccggaaataggagtcatatgggaacttcaagaacaccccctggggagcctttcttgttgggcctctagatttttcaagatgctccaagctacaaagctcaacgatctctgcaacgacaccgggcctcttcctctgtgtcggaaaatggctcccgaaggaattgagctagctcctgactttgtcaaccggtccggatcatctgctcgtaggcaagaaaacacctgttggtctgcattgcttacctcaatatcaaggattgatccagacaggccggnaaaatgtgcctcaacacgtctcnacactctgggtgtattagtcaancggtggga

SEQ ID NO: 22291 - DNA, 563 bp, Triticum aestivum
  unsure (1)..(563): unsure at all n locations
  Clone ID: PAT_TA_22291
gaaaagtataaacaagataaacatcaaaaacatatcctgttagctgtcgctgacaagttccttgtcgatagacaagcaaataaatgtggtgcaagcattctatgctttgacgagatacagcagactattaagcactgggactgtgcttgttgctaccagcaataaagcaccagaagatctgaatcaggatgggatgcaacgcgaaatcttccttgagttattatctaagctagacgagacctgcaataagattcttgttggaactgaaacggattatcgccgccttattcctacggatggctcaactcagattcactattattggctaccaatcctgacacaaggaatatgtttgaggctatgtggcatgacataactaaccagacaggaggaaacattactgcagttacaatcctgtatgttggaagccattgagatcccaaagttgtacggtgtggaaggttgactcgagtattagtggcgccagtatatccacccttgaattaattcccatatcaaatgtatcagatcatgcacgttgctgaagaacattatggtatacn

SEQ ID NO: 22292 - DNA, 1080 bp, Triticum aestivum
  unsure (1)..(1080): unsure at all n locations
  Clone ID: PAT_TA_22292
tccacgcgtccggttgggtaaaggatttgttgatgagttggactacaatattgaagctgataatgctactaaattcctggacactcactccaaatattcatttgtcatggttccgaaggttctcaaacaacttactaggaagagggttttgactatggagtgggtggctggtgaaaaccccagggaattgctttctctggctaaaggaatttctggtagcattgctgagttgtcagagaagcagaagttggatgcaaaagcccgccttcttgacctggtcaataaaggtgttgaggcatcattagtacagctccttgaaacaggcttgctgcatgctgatcctcatcctgggaatttgcgttatacacctgatggtcgtgttgggtttcttgattttggtttgctttgcgagatggagaagaaacatagccgagctatgctttcgagcattgtgcacatagtaaatggagattgggcctcccttgtttacgatttgatagaaatggatgttgttccaccaagaactaatctacgtcgggtgacaatggacttagaggatacattgggcgaggtaacctttgaaggtggaattccagacatcaagtttagtagggtacttggaaaaatttggtctatagcacttaaatatcactttcgtatgccaccatattttacgctcgtcctgcggtcaattgcctctttggaaggacttgccatagcacaggatggaacttttaaaacatttcaggcagcatatcccgtaacctttgaaggtggaatgtctgacatcaagtttagcagggtacttggaaaaatttggtccatagcacttaaatatcactttcgtatgccaccatattttacgctggtcctgcggtcaattgcctctttggaaggacttgccatagcacaagatggaacttttaaaacatttcaggcagcatatccgtatgttgttaggaagcttctgtctgataactcacttgatactaggaaggtcctgcatgaggtgattttcaacagaaggaaagagttccagtggcacaagattgcagtgnttctaaagctagcatcagcaag

SEQ ID NO: 22293 - DNA, 595 bp, Triticum aestivum
  Clone ID: PAT_TA_22293
gccctccgaagcaatcgcctcgcaacaatccatcttccccgcttccgttccgctccgttccgttccagtccacacatccaggtcgtacgccggcgcgtccagccgggtggatctccgagcaagcggcattgctgggacttaagatgcgagacgccgtcctgctccggtgcgacgcctccatggccggccgccggttccacctcttacggcaagcagcgcgagcggcaggaggagcgtttccggctcaggcggcgaccgccaagcaacgacgcgcgccggcgccggcggggaacggcgggaagagcgacggaggaggggggtacttcgggccggaggcggcggtcgtgctgggcgctgatgacggcggcgctgctgggtgctcccgcttctcctgcccccgctgccgccgccgccgccgctgttcctgttcgtgccggtcgccatcctggccgtgctgctcctgctcgtgctcctgccctccgaccccgggcgccctccccgccacgccgtctcctggcagccagctagcctaccttcctctcgccgcgcgcgcgctcgctctctcgctcgccggcgtcctcccctcttcttctta

SEQ ID NO: 22294 - DNA, 564 bp, Triticum aestivum
  unsure (1)..(564): unsure at all n locations
  Clone ID: PAT_TA_22294
ctagcctatacccatgacaaaacagaagcaggagcaagctgccacccccggccccgctctcttctccctccaccctacacttttcttcctattctcgtcgctagataccaacttccagttcacccccgccgcgaccaagaggcagccggcgacgaggaaggcggacgaggacgaaccttcgcactcgcagggcgatgacgggaggccggcggccatggatcatgtcaggaagcgccaccaagagaagggcttcctctatgactgctccgtcatgctctgctgctccggcgcccgcctggtgccctgcgtccaccgccgcttgcgccccgcctgctgccgcgccatggccgccgggccgaccatcggtccggtttcggcgcgcgcccctggggaacccgtggttggcgtctgtatatgtcgggcggctgcctttcgcccatttagtgcactggtatatttcatccgtgtgtgtacatctggatggctccctgcttctgagccctgcattaacacgtcaaaagagaccanatagaaatgtggtantacaagatcaaaaaaaaaaaa

SEQ ID NO: 22295 - DNA, 608 bp, Triticum aestivum
  unsure (1)..(608): unsure at all n locations
  Clone ID: PAT_TA_22295
gccgcaccggccagtgagctctggcgcctcctcccttcgacgcctcgtcactccggcgagcagcacgacgcggactcctccctccgacgcctcctcactcgggcgagcagcgcggtgcggcctcctccctctgactcctcctccttctggagcctcccccactccggcaagcagcgcgggtggcacggaacgggccggtgagcagcgcggcgctgcctcctccctctgatgtctccgccctccggcgcctcctactccggcgagcagcacgggcggcacgacacgggcggtgagcaccgcggtctcatcccttacgcgcctcctcactccggcgagcaacgcgggcggcgccggactgccggtggaggaccgcaccctccctccttcggcgctcctcaactcgggcgagccgccgcgggggcgccctaccccccgcccccgcctccccaccccgccccccggctcccgccccccccgcgctccccctcccacccctcgagcctcctaagacggccccgctgcctgcctcgctcaagtcggcgngcaacantctgtcaacangncactcggtcaacaacccggacaaatcttggnctntaacgctccnc

SEQ ID NO: 22296 - DNA, 729 bp, Triticum aestivum
  Clone ID: PAT_TA_22296
ccacgcgtccggccagagcccaagcccgagccgatgccaaaaccagagccaaagccagagcccaagcccgagccgatgccaaaacccgagccgaagccagagcccaagccttacccaatgcccaaacctgagcctaagcctgagcccaagcccgagccgatgcccaagccagaaccaaagccagagcccaaacctgagcccataaagccagagcctaagccgatgccaaagccggaaccgaagccagagccgatgccaaagccggaacctaagcccgagcccaagcccgagccgatgccgaagccagaaccgaagccagagcccaagcctgagccgatgccaaagccagagcctaagcccgaaccattgcctaaaccagagcctaagccagagcccaagcctgaacctatgcctaagccggagcccaagcctaagcccgaaccgaagccggagccgcctccgaagggcaagccgccaatgactgacaattgatgtgatactcacatatgacagtgggaggaggagatcgaccccgtccggagccacgatgtgttatttctagaataagtggcgtagtatccggctagcgagatagtgatgatgcatctttttgtattgcttccgtattccaccattccttttagtttctgttgttccatgcacccgtgatgagtattactactttgtaattatcatttgcgtgttggtatacgttcatctgtgcacatg

SEQ ID NO: 22297 - DNA, 989 bp, Triticum aestivum
  Clone ID: PAT_TA_22297
cgatgccaaacctgagcctaagcctgagcccaagcccgagcctatgccaaaacctgaaccaaagccagagcccaagcccgagcctatgccaaaacctgaaccaaagcccgagcccaagcctgagcctatgccaaaacctgagcctaagccgatgccaaaacccgaaccgaagccagagcccaagcctgagccgatgcctaagccagaaccgaagccagagcccaagcctgagcctatgccaaaacctgaaccaaagccagagcccaaacccgagccgatgaagcccgagcctaagccggtgccaaaacccgaacctaagccagatcccaagcctgagccgatgccaaaaccggagccgaagccagagcccaagcctgagcctatgccaaaacctgaaccaaagccagagcccaaacccgagccgatgaagcccgagcctaagccggtgccaaaacccgaacctaagccagatcccaagcctgagccgatgccaaaaccggagccaaagccagagcccaagcctgagccgatgccaaaacccgaaccgaagccggagcccaagccttacccaatgcccaaacctgagcctaagcctgagcccaagcctgagccgatgcccaaaccagaaccaaagccagagcccaaacccgagccgatgaagccagagcctaagccaatgccaaagccggaaccgaagccagagcccaagcctgagccgatgccaaagcccgagcccaagcctatgccgaagccagagcccaaaccagagccgatgccaaagccagagcctaagcccgaaccattgcctaaaccagagcctaagcccgaaccaatgcctaaaccagagcccaaacctgaacctatgcctaaagccgggcccaagcctgaaccccgaaacaaagccggggaccccttccgaagggcgagcctgccaattgatggaaaattgatgggatactaaaatttgaaaagttgaaggaagaaaatta

SEQ ID NO: 22298 - DNA, 806 bp, Triticum aestivum
  Clone ID: PAT_TA_22298
gccggccggtccgggaccaccattcagaggaaccacaccgacaccccatccactttatctcagttgagaggtttagaagcggtgaagcacaggtgcagcaagagctgcgagaggaaggagcgagcagcaatggcgaggcacagcctccttgccgtgctcctcgtcgggctggtcgcggcctctggtttcagccaggccgccgccgctggtcggggcctcgccgagaagctccccgagccggagcccaagccgatgccgtacccggagcccaagccggaacccaagccagagccaatgcctaagcctgaacccatgccaaagccagagcctaagcctctgcctaagcctgaacccatgccaaaaccagagcctaagcctctgcccaaacctgaacccatgccaaagccagagcccaaaccggagccgaagccggagccgatgccaaagcccgaaccaaagcctgagcccaagcctgacccgatgcccaaacctgagcctaagcctgagcccaagccagagccgatgcccaaaccggaaccaaagccagagcccaagcccgagcctatgccaaaacctgaaccaaagcccgagcccaaacccgagccgatgaagcctgagcctaagccgatgccaaaacccgaaccgaagccagagcccaagcccgagccgatgcctaaaccagaaccaaagccagagcccaaacccgagccgataaagcctgagcctaagccgatgccgaaacccgaacctaagccagagcccaagcctgagccgatgccaaaaccggagccaaagcctgaggccaa

SEQ ID NO: 22299 - DNA, 1587 bp, Triticum aestivum
  Clone ID: PAT_TA_22299
aatttgtggtgatatacgaaaaaacaccaaccattcagaggaaccacaccgacaccccatccactttatctcagttgagaggtttagaagcgcgcggtgaagcacaaagtgcagcaagagctgcgagaagaaggagcgagcagcaatggcgaggcacagcctccttgccgtgctcctcgtcgggctggtcgcggcctccggcttcagccaggcggccgccgctggccggggccttgctgagaagctccccgagccggagcccaagccgacgccgtacccagagcccaagccgcaacccaagccagagccaatgcctaagcctgaacccatgccaaagccagagcctaagcctctgcctaaacctgaacccatgccaaagccagagcctaagcctatgcccaaacccgaacccatgccaaagccagagcccaaaccggaaccgaagccggagccgatgccaaagcctgaacctaagcctgagcccaagccttacccgatgcccaaacccgagcctaagcctgagcccaagcccgagccgatgccaaaacccgaaccaaagcctgagcccaagcccgagcctatgccaaaacctgaaccaaagcccgagcccaaacccgagccgatgaagcccgagcctaagccaatgccgaaacctgaacctaagccagagcccaagcctgagccgatgccaaaaccggaaccgaagccagagcctatgccaaaaccggaaccaaagccagagcccaaacccgagccgatgaagcccgagcctaagccgatgccaaaacccgaacctaagccagagcccaagcccgagccgatgccaaaaccagagccaaagccagagcccaagcccgagccgatgccaaaaccagagccaaagccagagcccaagcccgagccgatgccaaaacccgagccgaagccagagcccaagccttacccaatgcccaaacctgagcctaagcctgagcccaagcccgagccgatgcccaagccagaaccaaaggcagagcccaaacctgagcccataaagccagagcctaagccgatgccaaagccggaaccgaagccagagccgatgccaaagccggaaccgaagccagagccgatgccaaagccggaaccaaagcccgagcctaagcccgagccgatgccgaagccagaaccgaagccagagcccaagcctgagccgatgccaaagccagagcctaagcccgaaccattgcctaaaccagagcctaagcccgaaccaatgcctaaaccagagcccaagcctgaacctatgcctaagccggagcccaagcctaagcccgaaccgaagccggagccgcctccgaagggcaagccgccaatgactgacaattgatgtgatactcacatatgacagtggaaggaggagatcgaccccgtccggagccacgatgtgttatttctagaataagtggcgtagtatccggctagcgagatagtgatgatgcatctttttgtattgcttccgtattccgccattccttttagtttctgttgttccatgcacccgtgatgagtattactactttgtaattatcatttgcgtgttggtac

SEQ ID NO: 22300 - DNA, 1712 bp, Triticum aestivum
  unsure (1)..(1712): unsure at all n locations
  Clone ID: PAT_TA_22300
ggcaaaggcaccacaccgacaccccatccacctcaccccgacaccccatcctctatatctcagttgagaggtttagaagcggtgaagaacaggtgcagcaagcactgcgagagaaaggaggcagcagcaatggccaggcccagcctccttgccgggctcctcgttcgggctggtcgcggcctctggtttcagccaggccgccgccgctggccggggcctcgccgagaagctccccgagccggagcccaaagccgatgccgaacccggagcccaagccggaacccaagccagagccaatgcctaagcctgaacccatgccaaagccagagcctaagccctctccctaacccagaacccatcccaaaaccagagcctaagcctctgcccaaacctaaacccgtgccaaagccagagcccaaaccggagccgacgccggagcacgatgccacagccccaaccaaagcctcagacccaagccctgacccgaagcccaaacccgagcctaagcctgaagcccaagccagggccgatgcccaaaccggaaccaaagccacagcccaagcccgagcctatgccaacaacctgaaccaaccagccgagaccacaacccgagcagacgcaaccccaacccaacccaagccaccgccaactaacccaagcccaagccccagacccagcccgaaaagccggaaccgaagccaaagccgaaagcccgagccaatccagaacccgaagccgaacccatgccaaaaccgggaacccaagcctgaccccacgcctgagccgatgccaaaaccgcagcccaagccccgaacccaagcccgaagccccatgccaaaacccgaaccaaaaggcctgagcccaagccttacccaaagcccaaacctgagcctaagcctgagcccaaacccgagccgatgcccaaaccagaaccaaagccagagcccaaacccgagccgaatgccaaagccggaaccaaagccagagcccaaacccgagcccaagccagagccgatgccaaagccggaaccaaagcccgagcccaagcccgagccaatgccgaagccagaaccgaagccagagcccaagcctgagccgatgccaaagccagagcctaagcccaaaccattgcctaaaccagagcctaagcctgaacctatgcctaagccagagcccaagcctgagcccgaaccgaagccggagccgcctccgaagggcaagccaccgatgactgacaattgatgtgatactcacatatgacagctgaaggaggagatcgaccccgtccggagccacgatgtgctatttctagaataagtggcatagtatccggttagcgagatagtgatgatgcatctttttgtattccttgtattccaccattccttttagtttctgttgttccatgcacccatgatgagtactactattttgtaattatcatttgcgtgttggtattttttcttgctgttcacataagtcgcttggtctttcgttagcaatatagaaatattaaatctttttgtattcatgctatgttccgccaatccttttagtttctgttgttccatgcacccgtgagagtattactactttgtaattatcatttgcgtgttggtatacgttcatctgtgcacatgactcgttgttctttcgtgtatctacacatgtttttattcgcatggaaaacacatttttgtccnnnanaaaaa

SEQ ID NO: 22301 - DNA, 594 bp, Triticum aestivum
  unsure (1)..(594): unsure at all n locations
  Clone ID: PAT_TA_22301
cccagctctagcgcctcgccgcagcacctccttctccctcgcttccttcccctacatctcagatctttcctttttccttggccatgagagcaggagagcacgtcctcgtcccttgtgaccgcccaggtcgtccctcccctcgctcgcgtgaggtgcctcctccaaccgcacccggtgatggtgccccgagccgcttgaagcaaggccagccagcagccgcccatgttcctcctctcactccggcttttctctctcctcctctctcaatttttgccantgggacaaccctcgcaagcaccccacccgccatcttcggtcacctctccgntcgacctcgtgctcctccgcctcngatccatccaccgcgccaccgggaatcacgccggagcagcggattcgcnagctcctgcctcgtctgtcgtncgggagagccgcctcaccagggaaggaggtggcatggaacacaatccgcagnacacgttctcgctgccgggaaactctactcggctcgactctccgctcgatcgtcgtttcgaccgcagcgctctgctcgcggcgtcggggggggatccggtttgtcccggcctcgccgct

SEQ ID NO: 22302 - DNA, 1090 bp, Triticum aestivum
  Clone ID: PAT_TA_22302
cctccgcccacctctcactcctcaccccgccccctccattcgcccgccgaccagagaggcaggtcgccgccgacgagatctgagagctccggaggccggatcccggccgctcaaaggcacgcggagatgaatctgtttcggctcgccggggacatgacccacctcgtcagcgtggtggtgctgctcctcaagatccacaccatcaagtcgtgcgcaggcatatctctgaagacgcaggagctatacgcactagtttttgcagctcgctacctggatctgtttgtgcattttgtatctttgtataacaccgtcatgaagctggtcttcctggcgagctctttctcaatagtttggtacatgaggaagcataagatcgtgcgtaggacctatgacaaggagcacgacacctttcgccatcatttcatagtgctgccatgtttggttctggctctcctcatcaatgagagatttaccttcagagaggtaatgtgggcattctccatttacttggaagccgtagcaattctgcctcaacttgtgttgcctacagcgcacaaggatattgacaacttgactggccaatatgtctttttcttgggtgcctaccgcgtactttatatcctcaactggatttaccgatacttcactgagccccattttgttcactggataagctggattgcgggtatcgtgcagactatgctgtatgctgacttcttctactattacataataagctggaagaacaacgtgaagctagagctaccagcctgagccgctgttttcttccaagatagactaggtattacggcttgcttaacttaatggatagacaggacagatatggatcatatgatacagatgtgcgttttgggttcctggattttcttgtttccttccaatgttttcggaggtgaaagctaggttcgccttgtatcttgtaaggtaatataaggaggttgtgtacttgtgatactgttttggaactcgatgaaggtgctgctgctgtactccctttggcgagtgtatactgcttatatggttatatttcataacttgaaaaaaaaaaaaaaaaaaggcccctaggggg

SEQ ID NO: 22303 - DNA, 1158 bp, Triticum aestivum
  unsure (1)..(1158): unsure at all n locations
  Clone ID: PAT_TA_22303
cctcccttcttccgcgattccctcgcccccgcttcggttcccccctccccccctccccccctctcgccttcgaaattatttccgttcctcctcccttccgcggaaccaccagggcgggcttgcgcgcgggggcgaaagaagcgcgcaagcttagcacatgcggacaccgtcggggccccgccgccaagcttgaaaggtagaattggaaggggcatggctggcgtggaggggcagccgccgcctcagatcagcagcatgtccaactccaagctgcaggacggtggcaccaagccgaatctggtcaaggagcacgttccggggagcgagctctggaccgatggccttatctgcgcttttgagctcgtcaagggtcacaggaagctggttcatcacaaatcgttgccaaagattgatctcgcgcacatgaagaaccaggcagctaggaatgggcatcgcgttgtgagcccggcacccgaatgagggaggtgtggtggaaatccccagccaggcggagcttggtatcgatccttttgcggtcaaagacaggccatcacatgctggagatgttcatgatcacaagatgggtgcccattggatggtcaaggattgctgagctgagccagagggttcaatcagatgctagctgggagaatgaacatgtgcccgatcagcgacagcgaggatgattacactgtacccgatgttgcgggtccgtactggctgcgtcctgggggacctacatggngggttccatgtcaccgnangccatctttcgttgatgcatggttgggtagngctcactggatgcatccactatcaaaactgcctgagagatgaaaccgtctgataacgaccgatgaagtaccttnnttnaggttcagttaaagttcaggaggactgtatttgacttttggtaatnatggggatccaatatgaaaggaagacttccattgtcttanaatcgggnaggccaaactttttttaactgatgcatggaaaggnctttaccactaaatgtttangagtgatgaangcngagttgttnttttggggaagnaaccccaaacnntataatatagccattggcngcgntttnganggagaaatatccnaaatntttggaacnaanaaatnattaattggangnaaaanaaaccn

SEQ ID NO: 22304 - DNA, 665 bp, Triticum aestivum
  unsure (1)..(665): unsure at all n locations
  Clone ID: PAT_TA_22304
cctaaactcatcagacacccacaaagcaccaaagacacccacacgtaaccgatcgagcagcatgagctcgtcgtctgccgccatgcaccccaaggccgtgtaccggctcatcgtggacaacttccttgccgttgtcaccgccgccatggccactctctctgtcgtcgccctggtgtggctcgggccagaggagctgatcagctggctccgtggccgtgagttccagccagcgcacctgttcttcgccgggttcgttgcggccgcagcaagccaccttgtacctcctgctccgtccgcgtgccgtgtacctggntccaactatgcctgcttcagctcctccttcaaccgcccgctcgccggatcccaatggctcatttaatcgagcacaacaagcacacgccaanacaaagaacgcacgtcggtcanctcgcggtgctggaacctcngggtccgggaagaaactngcttgccgggggggaaaactantcccganganaaattatgganctcaaaaagccgcgccaattcaactcnggcctccgggantgannactgtccaanacgggtaaccggagcattagggnctctaatgaaccgtntgccaagcatcctggggatntatanagtnactggtncactcgtnanactncgaangggaagngnna

SEQ ID NO: 22305 - DNA, 646 bp, Triticum aestivum
  unsure (1)..(646): unsure at all n locations
  Clone ID: PAT_TA_22305
ctaacgcctaaggttaaccagctactacaaccatggctacggccgacgcgagcaaattttggactacgaggaactacatcctggtggccctcggcggaaccctcgccgtcacggccgtggtcattgtagtctccgtcgcccttcaccctgcgcacatcagcttctccatcctggacgcctcgaacagcattgacagtgccggcaacgacagcatcccgtacctcaacctcaccatcgccgccgccaacaccagccggaagcgcgcggcggtgcggtacactaccatcttccgtcgaactgcaagaacagcacatgcagttaggaacactatccagacccaggtctacgtnggggccgccggcccggcaattacctgcggccaggttacaaggccggcgatcatcaaaggcatcgtcaacggtaagcctgctgtccgggagaccgtgtccaagagcatccaggggttaacggtggtggtggtggccgcgggtgcngttccggtttccgggatnatcacgagactgtccgagattaggctcctgccacatgtgtactcccgttaaaagtccacaaacccccgggacgcaatcaccgccgttggtgactaacactatatcagtntgagcctcagtctcgggaaaaaaaa

SEQ ID NO: 22306 - DNA, 187 bp, Triticum aestivum
  unsure (1)..(187): unsure at all n locations
  Clone ID: PAT_TA_22306
cagcgctcancacaccgcagccgccggccggccgccgccccacgggtgaccgtcacgccgccgccgccgtcccaccgtccaccgggcgcacaccagccgcagcccacgaccacccctatcgattcggagacccgctcgcctccccgtcaccatccangctttccccctccnannttcccgccaagcc

SEQ ID NO: 22307 - DNA, 414 bp, Triticum aestivum
  Clone ID: PAT_TA_22307
ctttacatggtgctaagcttcatgtactacacactctacgggatgatgacagtcgcattaacacctaaccttgagatagctgccggattgcccccccccttcttcgtcttttggaacgtcttctccggcttcatcattgggagagagctgatcccgatatggtggaggtgggtgtactgggctaacccagcggcatggacagtgtacgggctcatgttctcacagctgggcgaccggacagagctgatccgtgtgcccgggcaaccggaccagacggtgcgggagttcctggagggctaccttggccttgagggccgctacttcaaccttgtcacctacctacacttggtcgtcatcgccctctttgccttactcttcttcatcttcgtcaagcacctaaagttcgagcgaagg

SEQ ID NO: 22308 - DNA, 656 bp, Triticum aestivum
  Clone ID: PAT_TA_22308
caacttcaacggatttttatcgtgacacctgatttccctgtcctgttggctagctgcccagttgtacagtttgagaggtcatgtctgccgtcaaatgtatctgaccgtgatcaacaaggatcgttcagccttggatgccgagttctccttccacccgagagctttcttaccctgcggcttccattcgtatacggtgccgagacaagggacggaagcacatcccccctcaaacacctcgagcagcaaccagagctcacagcatggctcgtcggaggcacagctttgcagatcgtgtcagccgggcacgtcgccgagaaagaagccaacgtgccgtgatgctcttggggatctaaggttttgatgagtggttcaggcgtaactctactcactttcaggacgtgcatgcagcagccaagcagtatgtgtcccgcactcaaggcatcggattccgggttgcttgccagtgtatgtggttggcgtagcatggtccctgtcagaggtgttctgcttctgctcctgggatttatttatgccgccaagctgttgatgtacctactacaagaatactgcacaagccagagatacagcctttccatggagagaaaaacgtggaagctccaggtcgccgccgctccttctattccaagagatctgcg

SEQ ID NO: 22309 - DNA, 306 bp, Triticum aestivum
  Clone ID: PAT_TA_22309
agactatatatactctcccatctccctctttttagggttagcatttgtttagctcatatgtgagatagagcatttgctcatccatacggatctgctcctcgagagagaccgcggcccctccacggagacgatccacgttggattcaagaccccctcttgggtggccccatcaagacctcctcgcggagaagaaccggttaccctttgtatcgtcctttgttggattcggatcttgtatctccccttgtgtttcgaggatctagcatatgtgtgactatatcttgttggtttgataaaaaaaaaaaa

SEQ ID NO: 22310 - DNA, 606 bp, Triticum aestivum
  unsure (1)..(606): unsure at all n locations
  Clone ID: PAT_TA_22310
ttccttatcccccggcacaatatcatattttcgtaccgtgcgaccctcttcctcagctcccctctgcccccctctccctctctctcgaagctccgtggcgcgatgcacgactgggcgccggcgatcatagcgacggcgctgttcgccctgctgtgcccgggagggatcctccagctgcccggccggcagcggacggtcgacttcatgaacctcaggaccagctgcctgtccatcctcgtccacgccgtcatctaccccgtgctgctcatgctcttcgtcgtcatcttgcaggctcatctctacgtctgatcttaccttatcttactgactaagtgtgcttcatggggcctttgttctctctctctgcttttcttaagtacgccctccgtgcgtcccgtggggtttagtgaagcctgggggcgcgccggaggctgcatccgtttccgccgtgcctccggcccggcgtccgctccggcctcccggctttcgggccctggttcggtgagatgccacggaaacggtgaattaatttttcggtcnggatngggtttcctttccggccggttaagaaagaaattcccaaaggngntaccaccggtaaaaaaa

SEQ ID NO: 22311 - DNA, 451 bp, Triticum aestivum
  Clone ID: PAT_TA_22311
cccggctcagctcccctctctcctctagatctcccggcgcaacaaacgcaaggccaccggcgcctccgcgcatccgcagtcgccgcctctgcgatcttgcccgccgccgccgccgctgccgccccgagagatggcaaaggcattttacgcggtggggttctggatccgggagaccggtcaggccctcgaccgcctcggctgccgcctccaggggaactacttcttccacgagcagatttcagggcatcgcacacttatgaacatctttgacaaagcccctcatgttcacaaagaggcatttgtcgctccaagtgcatcccttattggtgatgttgaaattggacaagggtcttcaatttggtacggctgcgtcttaagaggggatgcaaataacgttcaagttggatctgggacgaatatacaggacaattctgttgtgcatgtggcaaaa

SEQ ID NO: 22312 - DNA, 1405 bp, Triticum aestivum
  Clone ID: PAT_TA_22312
attcgctcccgcggccaccttccctccgtctccctcccttcccccgcctcccctcttccccttgtcctcgccagctccccaccggccgaggccaggtgccacccaacgcccgctctctccctcctggccgcctcggcagaggccccgtctctcctcgagatctcccacggggcaaggccaggagccaacaaacgcaaggccaccgccgcctctgcgcctacgcagtcgccgttctgcgatcttgcccgccgccgcccggagagatggcgaaggcgttttacgcggtgggtttctggatccgggagaccggtcaggccctcgaccgcctcggctgtcgcctccaggggaactacttcttccacgagcagatttcaaggcatcgcacacttatgaacatctttgacaaagcccctcatgttcacaaagaggcatttgtcgctccaagtgcatcccttattggcgatgttgaagttgggcaagggtcttcaatttggtacggatgcgtcttaagaggtgatgcaaataacgttcaagttggatctgggaccaatatacaggataattctgttgtgcatgtggcaaaatctaatctaagtggaaaagtctttccaactatcattggagacaatgtcacagtagggcatagtgctgtattacaaggatgcactgttgaggatgaagcttttgttggtatgggagctaccctgttagatggtgttgttgtggaaaagcatgggatggttgctgctggagcccttgtaagacagaacacgaggatcccttgtggagaggtatggggtggtaaaccctgcaaaatttctgaggaagctcacagacgaggagatcgcttttattgcggaatcagctgccaactattccaacttagccaaggcacatgctgttgagaatgctaaacccttggaaaagattgattttgagaaagtgctgcgcaagaaatttgctcaccaggacgatgaacacgattccatgcttagtgtcactcgagaggtccctccagagctggcgccccccagtcctactcctgcccaataagcttttcttatcaccaccttcagtttggattcttatatctctatctgtccagtgagtttggcagtttacttttacttcagtaattttgggtcgagcaatgttctaaagctgaccatgtacttcagtttctgtattccatatgttcaagatccatggaacaaatagatccatttcgcacaaatttaccagtagcatgcgctgcgtgcatagtttactctggctgaaattgcgagatgcactggaggcagcacatgaactgttggcctgtagttaaatgcttaattgaataaatatttgataacaaaaagtactgaaggataaattttattggaaaaaaaacgagctagtagag

SEQ ID NO: 22313 - DNA, 414 bp, Triticum aestivum
  Clone ID: PAT_TA_22313
cgcctccccatccagggtcgcggctccctcgctctcgtcccacccatgggcggctgcccggtcgtctccggtggcctccgccgccacccccgcagggcgtcgcctcctcgccccttcttcgtgctcccgttcctcgctggcgcctcgctcccgcccttccaggcccgctgttccgcagcccacgccgcagccgcgccttcttggctctaccgtctcgtgctgtggtggtcgccttttgggctaacggccactcccctgtctcttgcactacttacggttccttttgctcccctttctatgctgcatccaggcaaacaggggggggcccggctgccctgtgccgcccgccttgtgggcccgctgctactctcctttcaaatgaaatataaagggtgctttttcaaaaaaaaaaaa

SEQ ID NO: 22314 - DNA, 475 bp, Triticum aestivum
  Clone ID: PAT_TA_22314
cggatccatggatgacggagctgagctgaagcacagcagctgagagattgtactggatggggcctatttgatattcctctctgctccttacccgcaaactagctgatgatggatctccacatgaagtttctcctggcctccctcagctgtgtacttctgatacaaggagctttctgtggggggactggagcgacaagctggacttgtgtgtgcaccgctcatccacttggcgaagcaaactccaatagcagcctgtcatccagttgcgactcctcgtgccattgcatacgagatgaaaacggcggcacagggtcatggaactgctcgtgccgctccgacaaggaccttcaggaagaagaacacgctgtggtgcacagtacgagttgcttcacttcctgtaactgcacatctggaagttctgaacaagggaggaagcatttctctagcaaaacagtcattgcaacactcctggtat

SEQ ID NO: 22315 - DNA, 903 bp, Triticum aestivum
  Clone ID: PAT_TA_22315
acgaccggcctggttgtttctcccagctgctccatcatcttcctctatgtttctctttcatctcttgacctctgcaagaaaacaatgggatcggagcaggagaagaaggccgccgccacggtggaagtggaaggcatcccgttcccgcgggaaatcgccgccgccaagacgctctcgctcgtcggccatggcgtcacggacattgagatccacttccttcagatcaagttcaacgccatcggggtctacctcgacgtcgacggcgccatggagcatctgcagggctggaaggggaagagccagctgatggaggacgaggctttcttcgacgcactggtctccgctccggtggagaaggtgctgagggtggtggtgatcaaggaaatcaaggggtcgcagtacggcgtgcagctcgagagctccgtcagggaccgcctcgtggcggcggacaaatacgaggacgacgaggaggaggcgctcgagaaggtctccgacttcttccagtccaagtacttcaggcccggctccgtcgtcaccttccacttcccggccacgcccaccgccgcgccagagataacgttcgtgacagaaggcaaggaggaggccaaggtggcggtggagaacgcggccgtggcggagatgatccagaggtggtacctcggcggcgagtcggcggtgtcgcagaccaccgtcaggagcatcgctgatagtttcgcggcaatgctctcctcaccatgattcttttttttgagggcaccatgattctttttttacaagtgctgcttacctgcttttgcaataaatcgataagtcacgatgaaatatttcaaaaactttggcaactcgatccaacgctgtacatcaaatcatttccaaatttctggataaagggcactctattat

SEQ ID NO: 22316 - DNA, 1584 bp, Triticum aestivum
  Clone ID: PAT_TA_22316
cccacgcgtccgcggacgcgtgggtcaaaatcttggcttggattgtgcgaatcggacagagccaatatatgctgatttagtgaggaaatctagtggcgacgaggaaaggatgctggtgctgttctttgacaggattggctggcctacatctctgccaactagtgagaaagggtcatttacaaacattgttggcaaatggcgcgcctcgcctcgcgcctccgccgccagcgccgccgccgccgccgcccggccccccgtgcgccgggcctcccccccgacggaccccgggaggccccctcccccctgccacgccgcctcccgcgccacccggctccccctccgcgccgccgcctccccgtcctcacgcccgccgtctccgcccggtagccactcccctccccccccccgccggccgggggcgccgccggccccgggctcgccggcctcctcgtagcgggcggccaacccaccgtcatcgcagccgaccgctttggcatgccgtgcatagttgtccgacgcagcctagccgcgagagcagagtttcactccgcgacggccgtcacggatgggttcggtgacacgggcctgacagtagcgaagatgccgtctatgagctgggcctgataccgctgcgaactaggcatgggatctgagttccctgcgtcctgtccgtaaccggccctctgcgtgaagttgaaagctttggaaaagctctctgcttctgatgacttaccactgcgtccgggagttgagaagttcatccgatgatgcccttagtgagggtgtgcctgtagccatattggcaacatatggcagaaatggagagaagatttcaagatcaatagttgagaagttaggccctgagagaacgtcgaaaataaacattgttggaaaagacgaggtcgaaagaagtctttatgggcagcttgttcttggtgaaggagttgcctccagtttggatgaacaacttaccaaggaagtacaaaaggccgcttctgcagagaaacagaggatagcagaagaggttgcatcacttctaaaactcagcgttgacattaacacagcatctaaaagttccgagaagataatagccacgctgcgagctggggccgaatatgtgggatgcaatgtgcaaaactgcatccttgtagcgggtagccaacccagcgtcatcgcagctgagcgcattggcatgccgtgcatagttgtccgaagcagcctaactgctagagcagaatttcactccgtaaaggccgtcatggatggattcggtgatacggacctaacagtatcaaaactacttagcaagaggtggtcctaatacctttgtaaactaggcattggatgtgagttccctgccgtcagtttgtaaccgaccgacttggtgatgatcgaaacgcggcttgatttaaacccgagctagcaaaacgaggctttatataatgccgagcttgcggcagaaagttacaataagcgccactgtttttggtgtttttaaaggtggttattgtaccccgtgaagtattgaacatttgtactgttactcgaccgaagtttggttctgtgccttcatatatactccta

SEQ ID NO: 22317 - DNA, 976 bp, Triticum aestivum
  Clone ID: PAT_TA_22317
gcaggtttccattcccaaggttcaatacaatcaagccgtagcgtctacggatttcgccatatccccatttccctcttctttgagcccaggttccttgtgtaatttcatccatctcttagttttttttgaatcattgagttcatcactcaacgtagtctagcagttcagttcgactctatttgagagacctcgcttgcttattgcaattcagaattgaattgattctatccttgatgtatttgcaattcaatccgaatcaatatatccaaaagtttttatctcccccacctcccgtcttacttttttatagtattccaaattatactataacgcttgatatttattctttttttctaatcagaattagcaattttatttactctgactctatgttccccttagtgaaatattaatcctcaaattattaacaaataataaagtctataatgatcgaatgaaaataccaataaattctataattttattttttaatatcctatagttaagcatatcaagctaactttatctttaagaagttttagtatttttttatttttataagtataacttcaaatttagaactagttaatagctaagattaataactaatatctgagattttacggatttcctatactatacctatttctatttgttacactatttccgttatgtaagcccacttagctcagaggttagagcatcgcatttgtaatgcgagggtcatcggttcaaatccgatagtcggcttttttttctctatcgatgttctacgaacaagaatctctttttttccgaattaaatggagaatccaggatcttttatgttttttaccttacaattttgacctgcccgggcggccgctcgaaatcactagtgaattccaaataaatattttgatgaaattccattttttggggtactttagttgattttactctgtttatcctgtagtttaattcagttttaatttcg

SEQ ID NO: 22318 - DNA, 822 bp, Triticum aestivum
  unsure (1)..(822): unsure at all n locations
  Clone ID: PAT_TA_22318
cccacgcgtccgcgataataatgttggtaggattgtcaaggcagtagtattggatcggccatccctcgatgagtccaagagagagcatcctgattctgaacctgtggcctcaacctcttcttctgatcatgtgatgggattcttacctactcgctcatttccagctgatcgctttgcacccttggatgaagatgttgcttatgttagcccacttttggcgttcaacctgggagtgcatatttcctgtctcaagcttcttatccagaaaggggaggagcctttcaagttctgctctaaagtttatgaggatggttctgctgtcagtgggattggtatttctcttcacctagaacttctcccatgcccacaagtgcctaaacatgctttgcacttacgggtttctattgtgaggattcctgattgtggtgtgcttgcttccctaaagataaattcagccattggaggaagtgactaccaagatatgatagatcaagctttaaatgaacacttcaagtttgataggttcctancaagcggggatgtgttttgcatacataatgactggaactgtggcatgatctcttgcctagcgtgcaataaggagaatgatagactgcatcctcctagcatgatatactttaaggtaaccggcatggaaccatcaaatgagccgattcttcgtgttaaccgtgatcaaacagcccttgtccttgggggaagtgcttctgctccaatccctccctgcagcttcttttctgccaatgatgattcagtccctttgcatggcgaagtagtggagcagttagcatccatcatcgcacc

SEQ ID NO: 22319 - DNA, 616 bp, Triticum aestivum
  unsure (1)..(616): unsure at all n locations
  Clone ID: PAT_TA_22319
tctctgtgtacaaatcgacttccatcgatgccactcgtcggtagccctcgccacggcccgccgctgaagctcgccggccgcgcccagcgccggcctccgccccgcaccattgcgcccaaatgcgatatctcctcccctcctgcgcgcctaaccaggagagccgtttccgccgcctcgctgctcctcaccgccctccctttccccgcctcgtcaccgcaactccccgtggcctccgcgtcggaaacggaggaagaagtccgggggaggagaagggaggcgcaccagcgctggagttggagcggtacacggaccaggaccaggggttcaacctcctcaagccacctcaatggcccaaggtggaaaaggcgggcgcgacggcgctgtttcagcaagaaggggaaaggggagtaacaatattgggggtgtcgtcaacctgttcgcctctcctcgctggacggattccggacagcgcagttcgtccacggacaaagctctacaagcaagagaaagaaaaaggaaagtgcaaaatccgcaaaagtgagttcaacggagaaaaattaggcccctggccccggtggcatatcantacncttgtancacagggaaggataancgt

SEQ ID NO: 22320 - DNA, 491 bp, Triticum aestivum
  unsure (1)..(491): unsure at all n locations
  Clone ID: PAT_TA_22320
gttgactcaaaaacattcttccccatcttccttgcgaggtccaaggcgaggcgtcctggggagctgatcgcgctctccctcgagccagccggcagctccgcggctactttttcttcctgatttcctggtcgaggtatggatcatacctaagaatccctccctctagcagccagcagctagctagatagtatttggttgttttgttnggatnctgctctagcacttgaanagaggtccatcctgcgagctccgtccatagcagggtttgntggccaggaattttgtttcctgtgtacccaaggcctgagatatttggttgggttgttggggatcaaagcctggcatttgaaagaaaggttcatcctgcgagctcgtccgtagcagagctcgtagtcgggaattttgtttcctgtgcacaagtcttangctgggtgaaagaggggtgatatatacagtatatttgaagtttcgaacaaaanaaaaaaaaaaaa

SEQ ID NO: 22321 - DNA, 987 bp, Triticum aestivum
  unsure (1)..(987): unsure at all n locations
  Clone ID: PAT_TA_22321
gccgcacccgccacgcgtgcgcggacgcgtgtctacctacggtgaaggagaaccaacaaccagctgatcaaagccatggccatgagggcgctcgcgctgtccccgtcccagagctcctcatttgggctccaccagagcatgccctccttcaagccaagcagcgccagccctgctagaccagtcagggcctatgcgaaagcagatgagcaggaggaggagaagaagaaggtgcccaagcagtccttgtttgggaacatcaccgaggcgctggacttctcgcaggtccggtcggagaaggacgcggagctgctgtatgaggccagggattccatcaaagatgaaggaaggatgacaagggaacagtatgcagcccttcggaggaagattggtggcacctacaaggatttcttcaagtcatatgttgaagttgacggagaatacgtggaggaaggttgggtggacaagacctgcaaagtttgcaagaaagacacaagaggggagccaaggcaagttgacaatctcggaagatatatgcatgtggcgtgcgcagagaactcgaaaccaacaaacttcttttccaagctcttcagcagatgaacttcttttgtaccgccatacccgctgggcggctcgtcggtagtgtgttctgggttgctcaagtgaaacgggttttggtcagcgtttatacacattcccttaaactcgagagtactttttaaaaccgggccgngggccccatcgattttttccccccngggngggggtaccaaggtnaagngnncccccaattnnncccttttannggggnnngnntttacaaanttnacttgggnccggnngtttttaacaaccntnnnggaactggggnaaaaacccctggggggnttaccccaaanttaaatnngncntttggnnnnaaaatncccccnttttnnccnnnttgggggnnaaanaaccnaaaaaagggcccccnccccnntnnnccct

SEQ ID NO: 22322 - DNA, 917 bp, Triticum aestivum
  Clone ID: PAT_TA_22322
cctcgtctccggcgcgagcgcggagggggcgcccaagaggctgaccttcgactccttccccttcaaggccggcaagtacgagatgaagaagttctgcctggagcccacctccttcaccgtcaaggccgagggcatccagaagaacgagccgccggccttccagaaaaccaagctcatgacccgtctcacctacacccttgacgagatggaaggcccgctcgaggtcggcgccgacggcaccctcaagttcgaggagaaggacggcatcgactacgcggccgtcaccgtgcagctccccggaggcgagcgagtgcccttcctcttcaccgtcaagcagctcgtcgctaccggcaagcccgagagcttcagcgggcccttcctcgtgcccagctacaggggttcgtctttcctcgacccaaagggccgtggtggctctactggctacgacaacgccgtggcgctacccgccggaggcagaggagacgaggaggagttggccaaggagaacgtgaagaacgcgtcctcctccacaggcaacatcacgctcagcgtgaccaggggcgggcgggagaccgacggagtgatcggcgtcttcgagagcgtgcagccgtcagacaccgacctcggcgccaaggcgcccaaggatgtcaagatccagggtgtgtggtacgcgcagctcgagtctaactagagcagagcagaagtgaagatgctcatcttgtgtgcatgcgtacgtgggttgatcgttggagaggaaacaatcgaggcaacaatgtgtgtttgtgtgtgtatctagtaatctaaacccagggtgtcggtttatattttagcttctgttatttttcttcctcgccaaaaaaaaaaaaaaaaaaaataaaaaaaaaaaaaaaaaagcccctagggaaatgagcggccgc

SEQ ID NO: 22323 - DNA, 1844 bp, Triticum aestivum
  Clone ID: PAT_TA_22323
cccacgcgtccgccgacggccgcacgcctctgcaaacacgagtgggatcgatcctcccgcgtaccaagccaccgaccaacatggcagcgtctctccaagccgcggccacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccctcaagttcgaggagaaggacggcatcgactacgcggccgtcaccgtgcagctccccggaggcgagcgcgtgcccttcctcttcaccgtcaagcagctcgtcgccaccggcaagcccgagagcttcagcgggcccttccttgtgcccagctacaggggttcgtctttcctcgacccaaagggccgtggtggctctactggctacgacaacgccgtggcgctacccgccggaggcagaggagacgaggaggagttggccaaggagaacgtgaagaacgcgtcctcctccacgggcaacatcacgctcagcgtgaccaagagcaagccggagaccggcgaggtgatcggcgtcttcgagagcgtgcagccgtcagacaccgacctcggcgccaaggcgcccaaggatgtcaagatccagggtgtgtggtacgcgcagctcgagtctaactagagcagagcagaagtgaagatactcatcttgtgtgcatgcgtacgtgggttgatcggtggagaggaaacaatcgaggcaacaatgtgtgtttgtgtgtgtatctagtaatctaaacccagggtgtcggtttatattttagcttctgttattgtttcttcctcgccaactcatgatattgatcccccatgaatgttcacaaaattatttgttgacactttcttcgttttaccttccttttgatttgaattgtctggaaattttacagtatgtattataaattaacaggtaaataatttagaaccatgataagtgccacatgtgtgctacaaacacatgacaacttcgaatgtttttcacggcaaatttagtgatgcaagtatgacaactttaatggtcaaaaaaaaaaaaaaaaaaaaaaaaaaaaaaaaaaaaaaaaaaaaaaaaaacaaaaaaaaaaaaaaaaaaaaaaaaaaaaaaaaaaaacaaaaaaaaaaaaaaaaaaaaaaaaaaaaaaaaaaaaaaaaaaggggggggccgtttaaaaggatcaaagttaacttccccgggcatgcaacgtaaaaatttttttatggggcccccaaaattaaattcacgggccggggtttaaaaacgccggaactggaaaaaccctggggtaaccaaattaaatgcctttgaaaaaaatccccttttggccagttgggaaaaaaacaaaaaggcccgaaccaaccccccttccaaaaatttgccaaccctaaatggcaaatggaacccccc

SEQ ID NO: 22324 - DNA, 627 bp, Triticum aestivum
  unsure (1)..(627): unsure at all n locations
  Clone ID: PAT_TA_22324
tgtttttttttntngnttttttttttttccctcttttcttcttttttgtttgttttttttgccgtcttttcttctttttccactcatccatcaatttctccaactcatagacaaataatgtctgttttgtttcaccatgggccactgccataacaagcaaacaaaactatctaccattacatcctccaaattcaaggcctgcagcttcttcttaacctacactcgctttacaaacacatacaacagcaccaacgtatgtgtataatccctacctgcaaaatacgtactcactacgcgagatctaacaacacattctccaanagagaatcgttctcacaaacatatactccatgtatcctcacattctcatcatgcatggtaagcattagctaacctcgtccccgccgcgccgcgtccattctagaangggntcctcctcctccaacaaangcgtgaaatccgtctcctcatcctaangggggctcacaaangctgggggtcngtccatcaagnttatcctccagcaatgcggttngcaaaaccggtccttgncggcggccgncggcccccccgnncccccaatctccccgcgggaagcaangggaaaatgcaggagtcnccccccng

SEQ ID NO: 22325 - DNA, 618 bp, Triticum aestivum
  unsure (1)..(618): unsure at all n locations
  Clone ID: PAT_TA_22325
ggtgatcctgcggcccagcatcatcaccagcatcctcagggaccccctccccccgcccgggcaggggacccggaccatcgacaccatcatcatcggctacgccaagcagaacctgtcgtgcttcctggcggacctggatctgaccatggacgtgatcccgggggacatggtggccaacgccatgatggtggccatggtggcgcactcggaggagcagggcgcggaggtgatgtaccacgccacgtcgtcgctgcgcaacccggccccctacggcgtgctctacgagtccggccgccggcacttctacgagaaccccaggctgagcaaaggacgggcaggtcatccccaccaaaggagatgcacttcttcaaagaccatccgccaagcttccaacttgttcatgctcatcaagttacaaagcctgccactccgaagattcctgcacctgggtggnaacttgctncccctgcgggcctcnttctcgcaacccctcgccgactcaccccggcccggcgattcgccatgctcctcctcggcgtctccgccccctcgccttaatcaaaggatcctcgacgacatcaacttggagcggctgcnatgacatgacaagacaanccg

SEQ ID NO: 22326 - DNA, 612 bp, Triticum aestivum
  unsure (1)..(612): unsure at all n locations
  Clone ID: PAT_TA_22326
ggatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactggggaagcatggtcacgcaaagtgtcactttgttgccattggacatctttaatgggaaagaagcttggaggatatcgttccttcatcccacaactgtgacgtcccccatgtttgaccgccaaagatatcaactggattgacataactggatggatggatatgtcaaccctcccaactggagagtgggcaacaccaaaggatgacctggaacttcccaaccggatgatttctgcctggggcagtttaagacgggtttgccgatgggaaggactggatcctgtctgtgattccgccatggggtgaaagaacaagtctgcccgtgaaggaaaccgtggtggcaagtaacacctcggcgtggntgcctactgcgatactt

SEQ ID NO: 22327 - DNA, 573 bp, Triticum aestivum
  unsure (1)..(573): unsure at all n locations
  Clone ID: PAT_TA_22327
atttccctccgcctccttcctcgcattcagccgcaaagccttctctcctcctcctttgacttgcttccaagaaagccgatcgccatgcgcgtgcagtgcgacgtgtgcggcctcgagccggccgccgtgctctgctgcgccgacgaggccgcgctctgctccccctgcaaccgccgcgtccaccgcgccaacaagctcgccggcaagcaccgccgcctcaccctcctccagccctccccggccgccaacgacgccgccgcgccgctctgcgacgtctgcaaggagcggagggggctcgtgttctgcgtggaggaccgggcgattctgtgcgccgactgcgacgagcccatccacaagcgccaacgacctcacgggcaaagcacagccgctcctcctcgtccgggccaactgtccgcccgacccgtgggacaagagatccctccccggacggactccgtctaacaggacacgctcgggctcggcgccaaggaanccctgcattcanaagccagcaacccggggagggggggggggaggaggaggaacaacattnagactactcacaacaactnn

SEQ ID NO: 22328 - DNA, 599 bp, Triticum aestivum
  unsure (1)..(599): unsure at all n locations
  Clone ID: PAT_TA_22328
cctagttctttctcactctgttgtcctcaccggaatctcggctcccacgcatctaggtgcggcagcctgtgcctcgccgccgagcgctgctactacgccgagccccctcatctgccggcgctgcgcggcgccagcccccggcgatctggtccacacgaaagagaacaatcaacggaaacagacaagcattgtttcaaaattgccttcgtgattttcatcattggacacgtgctcgcgccgaccgccaaacatgactacatatcagtagatttctgggctgcactcaacgatgtcaagcaagatcaaagattgggaactggggggcccttatgtgcggaagcatctgttccaagcggtcaggaagttcaaaaccgatgtttcgtagcggaacccaactatacacatagtccggatgtcatctgttcctgcangtgtttgttctcgacatcttggagctcggtctactaaacaagccacaaggagtaacaccaagaataggcttgtacgactacgagccgatgaaaaagatgctccgagcaaaccccgctaatcccccagggggggaagcactttcaacagtgggnaaggttacaactggg

SEQ ID NO: 22329 - DNA, 642 bp, Triticum aestivum
  unsure (1)..(642): unsure at all n locations
  Clone ID: PAT_TA_22329
atcgcccattcagctagctagagcctagagctacccatctccaccgtacgtatcaatccatccacatggtgcccaacggtaacaatgacaacaacaacgccgccaaggactaccgtgaccctcccccggcgccgctcatcaacgccggcgagctgggcaagtggtcgctctggcgcgccgtcatcgccgagttcaccgccacgctcctcttcgtctacgtcaccgtcgccaccgtcatcggccacaagcgccagaccgacgccaccgtcggctgcggcggcgcgggaatcctcggcatcgcgtgggccttcggcggcatgatcttcgtcctggtctactgcaccgccggcgtctccggcggccacatcaacccggccgtcaccttcggcctcctcctcgcccggcaaggtctccctcgtccgcgcgctgctctacatggtcgggcagtgcctcggcgccatgttcggggccgggctcgtcaaggccgtgcaaggcgcccaatacgcgcgccaacggcggcggcgccaacgagctcgcgccgggatactccaagggcgccgggctccccgcggcggtctccggcccctcgcgcccctcgcacgtccgcgcggcgggaggatccagtcctctgncccntcantg

SEQ ID NO: 22330 - DNA, 838 bp, Triticum aestivum
  Clone ID: PAT_TA_22330
tattaaataaggtccctgtacaattttgcaatgttatacatcaaaaaacctaaattgctttcattattttcctgtttaagcattgcatgagatacgatccatgaggaggcccccttttgatttgatccatgcgagtgcgctcttgggccacccgtagccgcatggcgagctgaacacgcccgtgctgcagtccaccagctcctgcacggacaggtcaaccagctccccgccctttatcttgttcaagctctccaccgtcgccgctgcagcaaatgcccagcagcatccacatgctccttgttgcttagcaggcgtgacgacaccatgttccctccagtcgaactgccggggagggtcagaggcagtcatcgtcaaattacgatcctcctcgatggcgttcttggatgatgccgccccctcggcaacatctccagctaaagtagtgatgagaccaccaccatcaccggctccaccataagcgccaccgacataccgcgccatgaactcctcgttagtgaggtcggtgaactcgttctcgccgagctcatagccgagcctctcggcgtccctgttggaggcgtcgatgaagtccacgttgcgacggtacacctcaaaccgccgcagcttctcagcggcactatggtacgtccggccatgcgctgacatccaccggtggaacctacccagcatcagcaggtcatggtcggctccatcgccggacgtagcacgggaggagggcaatgtggtgctggacagggtgactaggaggacgaggagagccaacgagcggaagaggggagccatgcccatgtgttgatgcaagaacacttgattttgg

SEQ ID NO: 22331 - DNA, 314 bp, Triticum aestivum
  Clone ID: PAT_TA_22331
gatccattgcggtactcctcctgagaccgatcccggaccagagaagaacctcacccgaggagggccgcgcacgagacaaggagatcaccgatcccagaccgcacacaggacagcactcaccttgatctagctcatgagccgagtttgggctaacattgacaaaactattctgacggctcttctccatgaaggtgatgaggatcctattggttacactctatgcctctggtaggaccaccatactatacaagctatagcttgtaaagatcgtacccaccattcccacaacattgttttaagcgtttactgtgtag

SEQ ID NO: 22332 - DNA, 713 bp, Triticum aestivum
  unsure (1)..(713): unsure at all n locations
  Clone ID: PAT_TA_22332
ccgccgccgcggccgcagccgcagccgactggacgccgcaagccgcgcgcagcgccgggtgaagagccggacctgtcacctcctccgctcccgtcagttccggccacttcaccgcgagccccactgaccctcaaaggcctcaacatggcaggtctgctgctgcgtagattcatcgggatccagccccgggcgccgatgaccgccgccggtggagccgcgctcttctacgcctcgtgtccctcgtcgccccgcaccgtcgcgcacctggaggtgaggggggaacaggccgctgctgaagctgaattatcaaagaagagttgtatcccatgcaattcaaaggatctgcacgccatgtcagaagattctgctaaaaatcccttgaacaggtgactggttgggaactgaaaaatgaaggtgacattttgaaattacacagagcatggaaggtgaagaattttgtaaaaggacttgagttctttcagcttgttgctgctgttgctgaggaagaagtcacaaccaggtttcatctcgtcagttggaacaatgtgaaatccatgtcgggccattcattcaggggtttaacagataatgacttcatccttgctgcaaagttcataacnanctaaaggcttttgnaaaaaaaggtattccangattanttggaaataacaaatcccttttttcagccccgnttaaactncccaaaaaaaang

SEQ ID NO: 22333 - DNA, 611 bp, Triticum aestivum
  unsure (1)..(611): unsure at all n locations
  Clone ID: PAT_TA_22333
nttccngaattcggcacgaggcnccggccaccaccgctccagcgccgtcaggatctgccgcctcacaccgtgcccagctccgccgcccccgcgcctcccctactcacccgctcgacgctcgccggagcggcggatctccgacgcatcgctccctcccgcaggcagcaaccggaatctaggcggacccgcccgccattccaccggaattggaaaacctagtagtcccggcgcctcaacctcgcctgaactcaccgtcgatggcggccgccgcggggtcgtacggcaagctcgacaagtcattcaagcttgccgctcgctccgtactcaccgccttctcccgcgaggatcttaacaatgctttcccatcgttcacggacgccgaaagggagcacctgtaccaaatgttcatctatgcgatcaagtctttgcatggcaacatantggaggagttccgaaatttctgcgacgaaatagaaattgctactgcccttgacaaggtagatcagtttgtcgaagaacaaactctggacgtattatcctcagacaaagactagcattgaagacatgaaagaaaggatatcaaaggagaagaaggatgaaattgaacnttt

SEQ ID NO: 22334 - DNA, 659 bp, Triticum aestivum
  unsure (1)..(659): unsure at all n locations
  Clone ID: PAT_TA_22334
ctttctcctctcctgataaatacatcatgaacaaccagtctctctgctcaccaggcaacctagctactctcgttactcttttgattgctcctgtcctgtactgatatgctgctagcttttgttaattatatgccaatatgtgctatgcaaccctcctctgagcaaaagcccacatacacacaccaccttcctcactctctctaattgagtagagctgctgtagccctgcccacacccagtaggcggtggagcaccatagccacagcctgtgcctcttgtgcatcgtcctgttcgatctcttctccttgagatcaaactaaaaccagccatggtgaagaaagcttggcctaacatccctcatcttcagcagcaagcaggtgggacaagtgctgccagtaccagtggcggctgcaccttcctccgtggcctcngtcctcccccccgtcggccgcctcccgccgtgggccgtccggccggccccccagggcccgccccggcgggcagcagcagcaccaccagacggcgtacaagaccatgaaactcgggctacttgccagactccggcgcggactcgtgcttctccaaactccttcgcctcggtcgacgacagcctctcaacggcgtcnaggccgcctccgggctcgttgaggcaacaanca

SEQ ID NO: 22335 - DNA, 421 bp, Triticum aestivum
  Clone ID: PAT_TA_22335
ttcccgagtccacgggcgcttgcacaggataccaagcgagtgtttaggatcccacacagggcatttcttgacatgctcctagcacaccttgggctaatcaccggctcagtatgatcgtgttgtacatgaggacggcaagatctgtgtgaccatctttttcaacacctgtacattggatcttggaggaccaatcagtatgaacgcgtcgtgtcatcattcctcctggtctacattatgcccagacatgcaaagttgtggatcgtctgtaagctaccatttgctttcgtatgtcctatgtctgtgatatttgctactaaacctattgtgctacgtgctttctatgttcgtacattgttaggtggctccttattgtgtgcatacaaacaaaccttacttctgaatgattcttcattagtttttt

SEQ ID NO: 22336 - DNA, 644 bp, Triticum aestivum
  Clone ID: PAT_TA_22336
aaggatttacactctctcgtcgacgttttcttttcttgttgcaccggtgtggcatcgcctttggacaagccctttgtctcgattctccctttgcagctcagctccaccgaccagatgatgatggctgacaaagagctcgatgtccatggctcgccgggttccgctggctccactaacagctgtgtgcgggggcttgcacaggatacccagcaagtgtttaggattccacacagggcagttcttgacatgctcctagcacaccttggcctatcaccggctcagtatgaacatgttgttcatgaggacgacaagatccatgtgaccgtctttttcaacacctctacgttgggtcctggaggaccaatcagtatgaaagtgtcatgtcgtcattcctactggtctattttatgcctaagacatgcaaagttgtggatcgtctgtaagctaccatgtgctatcgtatctcctatgcctatgatatttgctagtaaacctatcgtgcaacgtgctttctatgtccgtacattgttaggtggcttcttattgtgtgcatacaaatgaaccttatttctgaatgattcttcattagtttttttatttttatcatggttgacataagaatgagtgcaaaaataactttgttt

SEQ ID NO: 22337 - DNA, 1687 bp, Triticum aestivum
  Clone ID: PAT_TA_22337
cccacgcgtccgcttggaatcatagttcagtttaattctagatagttgctattggttgatttatttacatcaccttgatcactacaatctcgcatgaatcatagttcagtttaattctagatagttgctattgggaatacaacactgtttaacattcagttttgttttctcagtgctttggagaagatggacatgaggccccagcctgcactggcatagctaggcacgggagtatccttccacttgacatttccttcttagttttgtatgtttaatttttagagccgtggttactatgaaaaccgagatgtggatattgcagtattgatcttagttcaattcattctattacgtagcctcactttgttatccatgatttccctcatttgattgatttgacacatgttcattcactagattatagtctacttcattttttctggttactaggatgtccgggatggccctcgcgtccgttcctcaatcctcatcatgagattaacttgtagaagaatctattcataaccttatgatgtgtgtgatgttgggttatgttgaaaggctttattttttacttgattccattttcttccttgttcattgtctagacatatgtttgaaactgtggcatggtcaaacatttttttgccttgcttccatcttcttccatgctgatcaatagcgctttttcttgggccttgctttgagagggccgctggtcgaggccatttcggtcatttttccgtctgatacataggtcaaacctagaaggatttacactctctcgtcgacgttttcttttcttgttgcaccggtgtggcatcgcctttggacaagccctttgtctcgattctccctttgcagctcagctccaccgaccagatgatgatggctgacaaagagctcgatgtccatggctcgccgggttccgctggctccactaacagctgtgtgcgggggcttgcacaggatacccagcaagtgtttaggattccacacagggcagttcttgacatgctcctagcacaccttggcctatcaccgggtcagtatgaacatgttgttcatgaggacgacaagatccatgtgaccgtctttttcaacacctctacgttgcgtcctggaggaccaatcctgatgaaagtgtcatgtcttcaatcctactggtctattttatgcctacgacctgcattgtcccttcgcagccggctgctccgatgtgctggcgattgctgacgaagagctcgatgtccatgctcgtcaggttccgctggctccactaacagccgtctacgggcgcttgcacaggataccaagtgagtgtttaggatcccacacagggcatttcttgacatgctcctagcacaccttgggctaatcaccggctcagtatgatcgtgttgtacatgaggacggcaagatctgtgtgacatctttttcaacacctctacattggatcttggaggacaatcagtatgaaccgtcgtgtcatcattcctccggtctacatttgccagacatgcaaagttgtggatcgtctgtaagaaggaaagaaggccctgaccactctcatcatttactcaagtaataacaccatcggcgacaggaacgacaagctgacgcagatcgtttcttggtggctgctaatgaatcatgtaatgattgcgcagaactcaccagaggaaaa

SEQ ID NO: 22338 - DNA, 607 bp, Triticum aestivum
  unsure (1)..(607): unsure at all n locations
  Clone ID: PAT_TA_22338
aagtgcataaagcagtcattgcatctggagccagatactcaggaccaactgtgcactttgtggatgagcggtgtccgcactcccaggaccctggcccaaagagttgtgccagtgttagccaatgatactccggagcaattggctgcaagggttcttcacgaggagcaccaagtttacgttgaggcagttgctgccttgtgtgaggatcggaattgtgtggcggagacggatggtgtccccacttatcaggaagtcagacaaaccccaatgcgtatacctaattccgtgatctctgtcctgagatctcctggaaaactaatgagtttgtagtgtccccaccaagtgcccagtttccgccacggcatgttagtcagcacacaccgtttgtccgattggagtgaaataacatgtctaataatcctgggtcccaagaaacataatgtgttaccttgccactgtgttcaactcattgtatggcttgggctttgatgatatccgggcccggtgtgcccgttcccggtttccctggccctctggctgtcccccctccctctgtgtcaacccaatgtaanggctggctttgatgaaaatgtgttccggnttgctg

SEQ ID NO: 22339 - DNA, 625 bp, Triticum aestivum
  unsure (1)..(625): unsure at all n locations
  Clone ID: PAT_TA_22339
tttgcctccatcgattcccttctcctctctcctctcgcttgcaagaaccccgtcgccgtcggccaagctctcccttccccggcgccccctctctctagtctctacacccgcaagcgtgctccgcctccccgctcgctgggatctctcccctccccagctcgaccgcgcctccaagccgagtgcctccagctgcagctcgtcggccacgctctccgactgttgcgccttccctcccggccagcatccgggtctccatctcaggccgtgatgcacaccgccacgcgcgagctgggagtagtagggaggttgcgccgtgatatctgaatcccgccgcattcctgcctcacctgccgtcgggaggacgacggagaggagcgccagttcgtccaccgcgtggggccacgcaagctgcctcagcccagctcagccgcgaagccgtcgttcgccatctctctgccctgctcgagtgaaggtctgcaagtcnttggtgagcgtgggccggcgaagtttaaagatcctgaattcaanttctctcttttgtttcttcgtcgcacggcctcgctggcgcgcgccttgcccaagagacacgnggncgcctgaacgcgggcctcggccgcaaggcact

SEQ ID NO: 22340 - DNA, 631 bp, Triticum aestivum
  unsure (1)..(631): unsure at all n locations
  Clone ID: PAT_TA_22340
aaacccccggcgcagccagaccggtggaggaagccgccagcccaccacagcagccatgttgcgccgcgcctcccagctcctccgcaccgtccccgccgccgccgtgttcccccgccgcctcccgcaaccgcaccggcacccgcttccaagccccacccgcctatctcccccccgcccccaggcaaccgtcgtacttctacgccaccgagtcagcggcggcgccggcggcgccggccaccaaaggtgccgcggccactgaggacggtggggagcctgctgaggctgaacgacatccgccgacaaccccggcgcgacgcagcagaagacgcgcaaaggccgcgggatcggctccgggaaagggcaagacggcggggcgcgggcacaagggccagaaggcgcgcggcaccgctcgcttcggttccaagggcggccaaacccgctgcgccgccgtctcccccgccgcggcttcaaatcccgcttctcggctcacgttcaagccctgtggactgggaaaaatngcgaagctcatcaaatgctgggaaaattgatcctctgaattgatnacaatnaaagaactgaaggatacaantccaattgnaaaanaantaaggatnggattcggtatgggcct

SEQ ID NO: 22341 - DNA, 677 bp, Triticum aestivum
  Clone ID: PAT_TA_22341
ccgtggttttttgatctgtgccaactagtttcggttttttttttatagaaaagatacaatttctttatttgacaggacgaatttatagaactttatgacaatcatagcttatgatattccataggtatatgatacgggccattaccaagatgatagatcccaaaccatttgcctttctacttgatattcttcacacacaggtggcggcgcacttgctggtgcagtcattcgtgttgtccttaccagttagcctcatgcagtccggggcctgatgaattgccgaagcaagagcctgtgcatgagtgggtagagggtccggatcaataccagcccccggagccgcatcttgcgcctttctgtttggaatccctcacacgcaggtggcggcgcatttgctgttgcagtcgttcgtgctccgcttaccgggtaccctcattctgcccgcacccgtgcagtggcggccacatgcgctgccccgcgtcgccggcgcggggcccgctactagttcttcttggcccaccgaccgacagcgccccaaggaaggcaggaccagcgtgccgacgacagcggcaatggtggccgctttgagggcatgagcgagagtggatgaaccagcacgagccatgttggagaagaatgtatcaagaccgcaccgcttcgccggtgccggacctcgg

SEQ ID NO: 22342 - DNA, 285 bp, Triticum aestivum
  Clone ID: PAT_TA_22342
agccgtaccgatacagactatacggatggacctaaggctcagtgacgcatacgataccctcaccactcacgcgcagtgctgtctaagttctgctaaacagaacagagcaacgggcgcctggtcgtgtttgctcgacctgcgcaccgcgcgcgtggcagcctggttgcgccctgcgccgggcataagacgcacccagctgtatgtgaggctggcgcagaaaaaagacgaggctgcatgtgacgcttccgtggtgacgaggcggcgctccgcgctgtggtttctcgc

SEQ ID NO: 22343 - DNA, 696 bp, Triticum aestivum
  unsure (1)..(696): unsure at all n locations
  Clone ID: PAT_TA_22343
tcgggatagactttggaacttccggcgccagatacgcacttatcgacaagcaaggggccatccattccgaaggcaaaagaacttacccagctgcaggttggacaaaccaccaactgggcaagctcctggagagaagcactcttccagcttcttggcgacattccgtccgttcaccagccatcagtctcatccatctccattggatgggacttcatcaaccactctcatcattggataagaaacaatggagagttcttggccggcctttcctctacaatggagagttccctggatgcgctgcccatgatcaagtccgattgctccccccaaatcacacagtgtgctccgggtccgtccaccctatgcaantccgtctcnatggggggaacaagcattgttttgaatgggcggcgatgatcccggcgatactggatgcaccaatcaagactggctgnctgtgggttttgcatgggagaatacgggtttggtgattacaacaatactctcaaggtaggtatgatccaagagacggggtcatanccaaactggtcaagtcacaagcatactcacacatgttgccttcttcgtcaaagcaaccggaggttccatgggccaacaaagaaattgcgccacaatatggnttcgaatgacgttggncgtacgggaaacganacatgtgccttctcacagaacang

SEQ ID NO: 22344 - DNA, 313 bp, Triticum aestivum
  Clone ID: PAT_TA_22344
cagccgaatcacggcagcagcaacaactcctccttccccactgcttccgcctccgatcgaccccaccggagcaccaccacccgccgccggcggcggcgggcggatcgtagcggagcggcgatggaggcactgaagagcctcctgaagccgaagccgacgccgcagcaacagctgcgcgaatggcagcgccgccttcgcaacgagggccgcaacatcgagcgccagatccgagacgtgcagaaggaggagaagaaggtggagaacgccatccgggacgccgccaagcgcggcgacatgggatccgccaaggcgc

SEQ ID NO: 22345 - DNA, 677 bp, Triticum aestivum
  Clone ID: PAT_TA_22345
aggtcggtaggacatttgttcaagagcccccaagttatctagcttgtgaccaatcttatgaaggcccaagagatagctgtcaccatgcaggaattcagcaaagagatgacaaaggctggcgtgatggaggaaatggttaatgatgccatggattcagcactggatgatgaggacatggaggaggagatagaggaggaggttgataaggtcctctctgcaattgccggggagactgcgtctcagcttcctgacgctgttcgtaaacaaaaggagaaggttacacaaccttcgacaagtgaacctgcacagagaactgctgtagcggaatccgttgacgaagacgatgatgatctagaaaagataagagaaaggctcgccaaagtgaggtcgtaaaagagaatcgatgtgctgacatgtgtataatagtccatttggtaatgtacgatacacaacttggcagatgtcgcccttgtcactcacagactgatctattattacccaaaccaccgggttgttggatctctgctgtaacctgaatgtgacgatcatcacgtgtgatcaaacgtgccctgtattttgttttgttttcgacttgttgcgactacataaatattgtaagtatatgcagatatcatgtcagtaaagctggatgcacatctgtgcagagctaccaactg

SEQ ID NO: 22346 - DNA, 1462 bp, Triticum aestivum
  unsure (1)..(1462): unsure at all n locations
  Clone ID: PAT_TA_22346
cccccgccgcatcggttggttccccactccctgcctctccttccggtctgtctcgatcgatcgagggaccaccggagcaccaccagccgccggcggcgatggaggcggtgaagagcctcctgaagccgaagccgacgccgcagcagcagctgcgcgagtggcagcgccgcctccgcaacgagggccgcaacatcgagcgccagatccgagacgtgcagaaggaggagaagaaggtggagaaggccatcagggagtccgccaggcgcggcgacatgggatccgccaaggcgctggccaaggagctggtgcagtccaggaaggcggtcaaccgcctgtacgagaacaaggcccagctcaactccatctccatgcacctcggaggagatcgtcgctactactcagaacggtaggacatttgtccaagagcactgaatggtaatgaaacttgtcaataatcttgatgaaggccccagaaatagcagtcaccatgcaggaattcagtaaagagatgacaaaggccggcgtgatggaagaaatggtcaatgatgccatggattcagcactggacgatgagggcatggaggaggagatcgaggaggaggttgataaggtcctttctgcaatcgccggggagactgcgtcccagcttcctgacgctgtccgcaaacaaaaagagaaggtcacacaaccttcgacaagcgaatctgcacagagaactgctgtagcggaatccgttgacgacgacgacgatgatctagagaagataagagaaaggctcgccaaagtgaggtcgtaaaagagaatcgatgtgctgacatgtgtataatagtccatttggtaatgtacgatacacaacttggcagatgtcgcccttctcactcacaaactgcccagagtcaccaacgtacaagttgttcgatctctgttgtaatctgtatgtgaggatcgtcacgtgtgatcaaggtgtcctgtattttgtttatttctacctgttgcgaacacataaatattcctggttatatacagatatcatgtcagtaaagctggatgcacacagctagctatctatgcagaactacaaactgaaaggctgaaagcctgaacttgaatgttgttccagctcagattgctgaccttaagaactctcttgccatccaggagaaccagtcgtctaatttgcaagtctcagctggagtctgctaccgagatatatttgattcttgagcgagagatccacatctgnnggaagatcatcacaagaccattgnggttggcgaaacacttcttnttaccgaataagccccgnttgcantgtttggnaccccttgggcaggtcaaaaatgncccccccaaatngggggccatggccttaaatggggcttaaccncccaaataaaccaanccggtncggggggganccccttggggcctggcaantttttatttggggnaattngggggg

SEQ ID NO: 22347 - DNA, 612 bp, Triticum aestivum
  unsure (1)..(612): unsure at all n locations
  Clone ID: PAT_TA_22347
aaaccgcactgcctagccagtgctgcacacgtcgagcaatatggctttgaaaaactctgccgtcctcctcatcgggcttcttctctcttgtgttgccacgagcagtgcggcgagaatcctggaagagaccgttccgtccaaggaggagcaccagcctgaggtgccaccgcttcctaaggtagaactgccaccgtttccggaagtgcacctaccgcctaagcctgagcttcccaaggtggagttgccgccggtcccggaggtgcacttgccacctaagcctaagttgcccaaggtgggagtttcctccggtcccggaaagtgcacatgccacccaaacccggagctgcccaaagtggaactgccgtcggtccctgaggtacacctgccacccagccgggattgcccaaggtagactgccaaatcccgggggtcacagccaccaacccggagttcccaagtgggactgcccccaacccgagatccactgtcccgtgtccattcccggatccggccaacctgagaatgggtaacaatgtgcctgcctgctctccgccccnacctccaattccgctttcgtatcgntgtnattgggtttaaaagttgangtctaaa

SEQ ID NO: 22348 - DNA, 411 bp, Triticum aestivum
  Clone ID: PAT_TA_22348
ggcacgagccgttttgtgttgctcttgtcattacttgacatttttgtcgtcactttaatgctctgttggctgtgatgttaattttattattattatactctcacctgtattattgatgtttcccccccccccccccccctcgatttggtaagcactggtggtcttcttcgattggataccggctccctcgattttctgccccctttgtggttggtataataataatgtatgaaatgtatgtttgccttctgatgaagggcgcgagctttcccaccttacgtctttgcctaagttgtttggcagtttgctcctgatagcttggcacaggcagacagagttagtactttgattaacaggtattgttgagctgctgcacttgttcactgtgggatatactaattttcgatatgg

SEQ ID NO: 22349 - DNA, 806 bp, Triticum aestivum
  unsure (1)..(806): unsure at all n locations
  Clone ID: PAT_TA_22349
caaatcctacaacaaattttgcaacaacaactgattccatgcagggatgttgtattgcaacaacacaacatagcgcatggaagctcacgagttttgcaagaaagtacttaccagctggtgcaacaattgtgttgtcagcagctgtggcagatccccgagcagtcgcggtgcaagatagcctgccagccatgggaagcaagggcctcaagggtgtgatggtgtgtttactcatactggggttggttctggaacaggtgcaagtagaaggcaagagttgctgcaagagcaccctaggaagaaactgctacaacctttgccgcgcccgtggtgctcagaagttatgcgcaaacgtttgcaggtgtaaactcacaagtggcctaagctgccctaaggacttccctaaattggtccttgagtccaactcagatgaaccagacaccatggagtactgcaacttgcacatcccttcttgcgtaatgatgcgtatccatggtctgagatttcacagggcaaggtcgtgtctcacctttgcgttcaataaaattggatcccatcgagagtatccaaaccagtgtgtcaccctgtgttatgtgtgtgtatttccattccttgttcgaataaaagtcatcatgttggatgccatgttgcattgttgcaaaaaaaaaaaaaaaaaaaaaaaaagacaaacaaatataaaaaatacaaaattacaaacncntacattcaaaagaaataaatcttctataangnaccataaaaccaacttacttggccgatgccttacaactaaattgactggaaagacc

SEQ ID NO: 22350 - DNA, 666 bp, Triticum aestivum
  unsure (1)..(666): unsure at all n locations
  Clone ID: PAT_TA_22350
gggcaacaaggtcagcagctaggacaagggcaacaaggtcagcagccaggacaagggcagcaaccagcacaagggcaacaaggtcagcagccaggacaagggcaacaaggtcagcagccaggacaagggcaacaaggtcagcaactagcacaagggcaacaagggcagcaaccagcacaagtgcaacaagggcagcagccagcacaagggcaacaaggtcagcagctaggacaagggcaacaaggtcagcagccaggacaagggcagcaaccagcacaagggcaacaaggtcagcagccaggacaagggcaacaaggtcagcagccaggacaagggcagcaaccgggacaagggcagccattgtcctggctgttgcccttgtcctgactcctgcggtcaggacaaggaatggaaatacacacacataaaccagtgtgtcaccctgtgttatgtgtgtgtatttccattccttgttcgaataaaagtcatcatgttggatgccatgttgcattgttgctgccctgatgtactaccattccttgttcgaataaaagtcatcatgttggatgccatgttgcattgttgctgccctgatgtactaccatgactgagatataatggtatatgttgtatcnnnnnnnnnnnnnnnnnnnnnnnnnnnnnnnn

SEQ ID NO: 22351 - DNA, 1204 bp, Triticum aestivum
  Clone ID: PAT_TA_22351
cggacgcgtggggtggtggaggtgccggcggagctggtggcggccgggagccggacgccgtcgcccaagacgcgggcgtcggagctggtgaagcgcttcctcgccgctgaacacccgtccaactatccaaggactgaggaaggccacaatcagcaactgaccctgtaataccttacctagctagctaggtgtagtttgcttgagccaagatgttgggggtgtgatggtgtgtttactcatactggggttggttctggaacaggtgcaagtagaaggcaagagttgctgcaagagcaccctaggaagaaactgctacaacctttgccgcgcccgtggtgctcagaagttatgcgcaaacgtttgcaggtgtaaactcacaagtggcctaagctgccctaaggacttccctaaattggtccttgagtccaactcagatgaaccagacaccatggagtactgcaacttgggatgtaggtcttccctatgtgactacatggtcaacgcagctgctgacgatgaagagatgaaactctatgtggaacagtgtggtgatgcttgtgtcaatttctgtaacgctgatgctggcctcacatcccttgatgcgtaatgatgcgtatccatggtctgagatttcacagggcaaggtcgtgtctcacctttgcgttcaataaaattggatcccatcgagagtatccaaaccagtgtgtcaccctgtgttatgtgtgtgtatttccattccttgttcgaataaaagtcatcatgttggatgccatgttgcattgttgctgccctgatgtactaccatgactgagatataatggtatatgttgtatcatttgcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaaaaacccaatttttataccccggggttggaaagaaatttttttttttttgggcccccaaaaataaattccggggccgggtttttaaaacgggggggggggaaaaacctgggggttacccaattatatgcctttggaaaaaaacccctttttcccagggggggtaaaaaaaaaaaggccccc

SEQ ID NO: 22352 - DNA, 742 bp, Triticum aestivum
  unsure (1)..(742): unsure at all n locations
  Clone ID: PAT_TA_22352
ctaccttctccattttattgaacgcaaaggtgagacacgaccttgccctgtgtttactcatactggggttggttctggaacaggtgcaagtagaaggcaagagttgctgcaagagcaccctaggaagaaactgctacaacctttgccgcgcccgtggtgctcagaagttatgcgcaaacgtttgcaggtgtaaactcacaagtggcctaagctgccctaaggacttccctaaattggtccttgagtccaactcagatgaaccagacaccatggagtactgcaacttgggatgtaggtcttccctatgtgactacatggtcaacgcagctgctgacgatgaagagatgaaactctatgtggaacagtgtggtgatgcttgtgtcaatttctgtaacgctgatgctggcctcacatcccttgatgcgtaatgatgcgtatccatggtctgagatttcacagggcaaggtcgtgtctcacctttgcgttcaataaaattggatcccatcgagagtatccaaaccagtgtgtcaccctgtgttatgtgtgtgtatttccattccttgttcgaataaaagtcatcatgttggatgccatgttgcattgttgctgccctgatgtactaccatgactgagatataatggtatatgttgtatcatttgcctatggatataaactccgtctgggaggcgccagtgctgcgttgcggntannnaaaannnnnnnnnnnnnnnnnnnnnnnnn

SEQ ID NO: 22353 - DNA, 1835 bp, Triticum aestivum
  unsure (1)..(1835): unsure at all n locations
  Clone ID: PAT_TA_22353
ggtcagcagccaggacaagggcaacgaccaggacaaggacaacaagggtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaagggtactacccaatttctccgcagcagtcaggacaagggcaacaaccaggacaagggcaacaaggatactacccaacttctccgcagcagtcaggacaagggcaacaatcaggacgagctggtagatccatcaaccaaagccattatacttctttgttctgcaagatagcctgccagccatgggaagcaagggcctcaagggtgtgatggtgtgtttactcatactggggttggttctggaacaggtgcaagtagaaggcaagagttgctgcaggaccaccctgggaagaaactgctacaacctttgccgctcccgtggtgctcagaagttatgctcaaccgtctgtaggtgtaaactcacaagtggcctaagctgccccaaaggtttccctaaattggcccttgagtccaactcagatgaaccagacaccattgagtattgcaacttgggatgtaggtcttccgtgtgtgactacgcggtcaacgcagctgctgacgatgaagagatgaaactctatgtggaaaattgtggcgatgcttgtgtcaatttctgtaacggtgatgctggcctcacttcccttgatgcgtaatgatgcgtatccatggtctgagatttcacagggcaaggtcgtgtctcacctttgcgttcaataaaattggatcccatcgagagtatccaaaccagtgtgtcactctgttttatgtgtgtgtatttccattccttgttcgaaataaaagccatcatgatggatgccaaaaaaaaaaaaaaaaaaaaaaaaaaaaaaaagggcggggacaatggctgcaaccaggacaagggcaacaagggtactatccaacttcttcacagcagtcaggacaagggcatcaatcaggacaagggcaacaagggtactacccaacttctctgtggcaaccaggacaagggcaacaaggctacgccagcccataccatgttagcgcggagtaccaggcggcccgcctaaaggtggcaaaggcgcagcagctcgcggcacagctgccggcaatgtgccggctggagggcagcgacgcattgtcgaccaggcagtgatagaactctctgcagcttgcatggtgcttgggcatgcatgcaccttaaannnnnaaaannnnnaaaanannnaaaaaanaaaaaaaaaaaaaattaaaaaaaaaaaaaaaaggggcggccgttttaaaggatccaagtttacgtacccgtgcatgcaaagtaatagtttttttttaggggcacctaa

SEQ ID NO: 22354 - DNA, 1411 bp, Triticum aestivum
  unsure (1)..(1411): unsure at all n locations
  Clone ID: PAT_TA_22354
tttctgtaacggtgatgctggcctcccatcccttgatgtgggatgatgcgtgtccatggtctgagatttcacagggcaaggtcgtgtctcacctttgcgttcaataaaattggatcccatcgagagtatccaaaccagtgtgtcaccctgttttatgtgtgtgtatgtccattccttgttcgaaataaaagccatcatgatggatgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttttttttttttttttttttttttctgagctctttgttcccaccgcatcgacccactccaccaaccaagatagcctgccagccatgggaagcaagggcttcaagggtgtgatagtgtgtttactcatactggggttggttctggaacagctgcaggtagaaggcaagagcaagtgtgtgagcaccttgtgaaagaaactgcggcaacgtttgcggcacacgtggagctcagaagcaagaggcacgcgtgtaccagcttaggacaagagtgccagcaccctatgggatcccagggcctccagggtgtgatggtgtgtttactcatgctggggttggttctggaacaggtgcaagtagaaggcaagagttgctgcaagagcaccctaggaagaaactgctacaacctttgccgcgcccgtggtgctcagaagttatgcgcaaacgtttgcaggtgtaaaatcacaagtggcctaagctgccctaaggacttccctaaattggtccttgagtccaactcagatgaaccagacaccatggagtactgcaacttgggatgtaggtcttccctatgtgactacatggtcaacgcagctgctgacgatgaagagatgaaactctatgtggaacagtgtggtgatgcttgtgtcaatttctgtaacgctgatgctggcctcacatcccttgatgcgtaatgatgcgtatccatggtctgagatttcacagggcaaggtcgtgtctcacctttgcgttcaataaaattggatcccatcgagagtatccaaaccagtgtgtcaccctgtgttatgtgtgtgtatttccattccttgttcgaataaaagtcatcatgttggatgccatgttgcattgttgctgccctgatgtactaccatgactgagatataatggtatatgttgtatcatttgcctaagaaaaaaaaaaaaaaaaaaaaaaatccagtgctgcgttgtgttccctttagtgagggtnaatttcgagcngggancaanaccnnnnnnnnnnnnnnnnnnnnnnnnnnnnnnnnnnnnnn

SEQ ID NO: 22355 - DNA, 703 bp, Triticum aestivum
  unsure (1)..(703): unsure at all n locations
  Clone ID: PAT_TA_22355
aaatgactcatgtctgaaaaggatgcaggcagatggggcaatgcacccatgagctcgacactatgcttataactagcttgttcaatttctccttaggaagtcgctaatgatgagcaacattccttgggacacccctgaaatccagaggatacgagtggtgtcccttcaaataagtttgaaggagtcagggtagctttcatatctgcagttaggtctggcgattgtggttttgagcctgtgctgaccaattttgggagcggctcggcaattacaagccaggaggactgcacgtgatgagttaagggctaaaggcaaaagaattactaccgtctttttagctccaacactagagaacctttggaatatgataaagctttacatcacactggctcccttactcgaacgcgaatttactccttcaagaaatttgtgcaccaagttgaggaagctggggcatccaatcatatcagaataaactagtatgtttcactaaaagggagtgtatataatcctttatatcatggtccttgtcatattgttagcgaccttccccccgtgatcctctacacacgtcattctttccatgtattagagcatggatctttatatggacgcccacatgttggttacttgaattgtgtgccgcaacgagcacacaattaaaaaaaaaagaccttatgggctgtctataanatcacacaca

SEQ ID NO: 22356 - DNA, 573 bp, Triticum aestivum
  Clone ID: PAT_TA_22356
ggaacgtcgatgaggcggcgctgatccgcgcactcaaggcaggggggatagcaggcgcgggcctcgatgtctttgagaaggagcctgaggtgccggcagagctactctccatggaaaatgtggtgctcacagcgcatgaggccgtcttcactgtggagtcggcctctgatctttcagacctcatgatcggaaaccttgaggcgttcttccaaggtaagccattgctcacgccggtgcttccggagcaaatgctgtagatgatacaaccacagttcagaccccgtcaggtttcatatgacatttgtgattgatgttacatgcgacaagtaggtactccctccgtcccataatgtaagacgtttttttgcccctgagggagtagtatatattgctcctcctctgagtaagcaagggccccgccagcattattagtgtcggtccttaaaatgcagcaagggacatttataagaaatgtgcatggtccgttatttgaaaaggatgatgggagaaatccaaattcccattctgggccaaaaatatttaaatacttgacggccgtcgtcgccgccgcga

SEQ ID NO: 22357 - DNA, 559 bp, Triticum aestivum
  unsure (1)..(559): unsure at all n locations
  Clone ID: PAT_TA_22357
tgtagtaccgagcaagacaaagctctcggcacaaaacccccaaaccccaggcgccccacccccacacgcatcgcacaccacccatccaacccatccccatcgcagcccacgcgcccgggacccgagcagccatggccaaaggagcagccggaggagggggagggggcgccgtgaagacggccctggtcgtcaccggcggcctcgtcctcgcctggctcaccgtcgagtccgccttcaagcccttcctcgaccgcctccgcggcgccgtctcccgctccatcgaccccgcccgcgaccccgacgaggacaccgccgcccccgcccccgaggaggacaagtcgccggccaccgcggccgtcgccgccgctgtcgcctccgccgtcgccgaaggagaanggacccgacgtcgcccgttcgccgaggagaagaaacccgacgtcccccgccccccgccggagccgccggccccccgcccccgccccccgcgccgaagggcgtggacgggcgaaggacaaggggtcaaggcaaaggaggggaagnngccttgccgcaaggncat

SEQ ID NO: 22358 - DNA, 629 bp, Triticum aestivum
  unsure (1)..(629): unsure at all n locations
  Clone ID: PAT_TA_22358
gcccgtctctcccatctcacctcacctcctcccccacgccgcggtttcccgaccaccgcgcagagaacaggtcttccgtcctccctctccgactcgcggtcgccgctggcttcctccttcccggaacgcgcgggccacgctagctccggcgggcttggtttcatagccgcgagcgatccatccaccccccgcctagaggctgcaggcggaggaccgagaagagaaaattgttgttcgtaatggcgggcgacaggtgcgagggcgcgatcgcggggtgcgagctgtgcgggggcgtcgcggcggtgcactgcgcggcggactcggcgttcctctgcgtgccctgcgacgccaaggtgcacggcgccaacttcctcgcctccaggcacctgcgccgccgcctcgtccacgcggccgcggacgaggacgccggatccgcgggctcgggctcgggctcggagtcgtcctccagctcctcctgcgtgtccaccgccgactcgtgcgcggccgcctccgcggcgacgcgggcggcggggaggaggagggccgggtgcaagcaccggcgagcgcgggcggnnntcgtcctcgnnnggtgggccaagcggatgggcctcgcggcgggaacggcacgn

SEQ ID NO: 22359 - DNA, 572 bp, Triticum aestivum
  unsure (1)..(572): unsure at all n locations
  Clone ID: PAT_TA_22359
atatctttaagaaccctagaaagaatttcacttgngagcaacaggggtcaggtcacactatatcaatatcataattctcttttttttaattgatactgattagccgtaaatcaatttgattttgttatgccattaaggaaacactatttgggatacaatacccattttagaaccgttcactactaacaaatagaatttataaaaatancaantaataacaaataatataagttaatggttccaatttttcctcaatttgctgtgactgggaaatcctttctcttttcaatagaaagagaaggtatttangcaatgtgtgttttgagatacaatcaatcgaagagaataaaactgggtccaataaaaaacaggaatgaatttattaaaagggattgggaagggataagtnacaaagggattcaacgatctaaaaccaagccaaatgggcctaatcatcccctcccacggggggggcccgggtacccaatgtccgcccttatgagtgggctccgttttggccccgcgtctcaactggggccgtcggttttacaaccggccgtggaccggggaaa

SEQ ID NO: 22360 - DNA, 620 bp, Triticum aestivum
  unsure (1)..(620): unsure at all n locations
  Clone ID: PAT_TA_22360
gcatcttctacctcatcctctgcctttctcctcctccatggcctcgcttctgcttctccctcgaaggcttctgctttcttcgcttcccccatcagcccctccttcccactctcgacctccacctccatcaacgcgtcctctccgcggcggcccttgccccctgctcctcgcgccaccggccgcggcggtgacaaggacaaccgcgtgcaggagctgagggtgcctgattcctgggctcacgcccggaggagcagcgcaggaatccgaatggctgaggggaacgctacacaagtggctgggacgacgagtactgccccgagccggccaacgtggacatcaagcaacacggccgcaaggtccgtaccacgagtccctcacggcgaagcatctgatgtgggggaagatcctgatgaaagatgggtcggagactgcaagactgtcctaccaaggagagctccaacgggcccctcgccccccgccaacccgcngtgcgcctgataaccagaggatggatcntcagccggtgagtgatgttgacagacagantagccgaaccggcaatgggtgctcagtttctggctgcccnaacatcaatgggttagtgtcaacggaagnaatct

SEQ ID NO: 22361 - DNA, 641 bp, Triticum aestivum
  unsure (1)..(641): unsure at all n locations
  Clone ID: PAT_TA_22361
cctgcgtataatgcccacatgccgacataattttcatctttcctgtatagatatatggttagagaagcaaacgacctgcccaatatgccgaatctcgttggacttaccgggtggaaaagccagtgcttcccctgcccgtagcctccctcaattatttggccaccctgagagctctgccagtcgttcaccgcattggatacttcccatgcatcgtgatcgtaccgggggtagaggtaacagaccggcctcacaagaatcactaagaagtggtcataacatgaaatgcactggagacaaaagcaagacacgttgggtcaggctatgttgttccttggcggtgcatcggaggacgtctgccatttgcaagaaatcctgtgcatccctcctccatcacaatccaccacacttggggcgtaagagttggaggcaatttgtttggtaggcccggcctttaggcatgctttctatgtcacgggttgttagattagccagttccccatttccgccacttccgtgggcccttgtatgttccgttttgatgtgcattggttgtatattcctcaaaggaaatattgtacagatnaagacgcggagctccgaaaaattggtggctctccgctcgtcaagacaaaaaaaaaaaa

SEQ ID NO: 22362 - DNA, 1276 bp, Triticum aestivum
  Clone ID: PAT_TA_22362
gacacgcagacaaccggtggccaccggggggagacggagcgcgcggcggatatggccgcactcgcccaccaccaccgagtcctttccttcacctccttcgcaactccaagaactcacctaccctgcgcgtcctcctcgtcgcctcccacgcatgcccgcctcagaggcgcccgtgttctccggcacgcctccggcggcagcagcagcgcggcccccgcctccagctcgtcgctggaggagctgtcccggagctgcaccacctggtcatggcgagggatgcgcgtgaactacctggtcaggggggagggcccgcccgtgctgctcgtccacggcttcggcgcctccgtcgcgcactggcgcaggaacattggcgtgttatctgaatccaacaccgtctatgccatcgatttgctcgggtttggggcgtcagacaagcctgctggattctcttacaccatggaaacttgggccgagttgatcctggagttcttggacgaggtcctcaagaggcccaccgtgcttgttggcaactccgtgggcagccttgcttgtgtcattgccgcctcagattctaccagggaccttgtccgggggccggtgctgctgaactgctcaggtgggatgaacaacaaggcgatcgtcgatgactggaggatcaagctgctcttgcctctgctctggttaatcgactttctgctcaaacaaaagagcatcgcatcggcactcttcggccgcgttaaagaaagggagaatctgaagaacatcttgatgtctgtctacggaaacaaggacgccgtggatgatgaactggtcgagatcataagagggccggctgacaccgaaggtgctctggacgcgttcgtgtcgacggtgacgggcccgccggggcctagcccgatagccctgatgccgaggatcaagattccggtgttggttctgtggggagacgaggatcccttcaccccgatcgacgggcccgtggggaagtacttctccggcctcccgtcggagcttcccaacgtgaggctctacatgctggagggggttggccactgcccgcacgacgatcggccggacctcgtgcacgagaagctgctgccatggctggccagtctcccgtccgcggccgagcctgaggtggcggtagcttaactggtgagcagtgagctaacgaggagccaaagagatgtgcatatatatgtgtcttttttatgaaccttcaataatctgtctttacacgattagagcatctacaacaagtaccaaaaaaaaaaaa

SEQ ID NO: 22363 - DNA, 1706 bp, Triticum aestivum
  Clone ID: PAT_TA_22363
gaattcggcacgagggaaactgaggttgcgggaactcagataattttggcaagagaatatctgaaggatgttgctatcagcacagaacagctcaaatatcttgtcatggaagctttgcctcgtggttgtcaggggcaccgggctgagttgtatgctgctcgagtggcaaaatgtcttgctgccatggaaggacgtgaaaaagtttttgcagaggaccttaagaaagctgtagagctagttattctacctcgttcgatcatatctgataacccacaagagcagcaaaaccaaccgcctccacccccacctccaccacctccacaaaatcaagataacgcagaagatcaagatgagaaggaggaagatgaggagaaggatgaggaggaaaaggaggatgatgacgaagaaaacgaaaaacaagatgaccagatacccgaggagtttatttttgatgccgaaggtggactagtagatgggtaactccttttctttgctcagcatgcacaaagaaaaaaaggaaaggctgcacgagcaaataatgtcattttctcagaagacaggggccgatacataaagcctatgcttccaaagggtccagtcaggaggttagctgttgacgcgacacttcgggcagctgcaccataccaaaaactgcggagagaaaaaagtcttgacaagacaagaaaagtttttgttgagaagactgatatgagagccaagagaatggctcgaaaagccggtgctctggtcatatttgttgtggacgctagtggcagcatggctctgaaccgcatgcagaatgccaaaggtgcagcattgaagttgcttgcagaaagttacacaagcagagatcaggttgcaattattcccttccgtggagactatgctgaggttctgcttccaccatcaagatccattgcaatggctcgcaaacgtcttgaaaagctaccatgcggtggcggttctcctttagctcatggcctgagtacagctgtcagagtgggattgaacgctgaaaagagtggcgacgttgggcgtatcatgatcgttgcaatcaccgatggaagagctaatgtatcactgaagaaatccaatgacccagaagctgcagctgcttcagacgcaccaagaccatctactcaagaattgaaggatgagatacttgatgtgtctgcaaaaatattcaaagcaggaatgtcgcttctcgtcatcgataccgagaacaagtttgtatctacgggattcgccaaggaaatcgcaagggttgcccaagggaaatactactacctgccaaacgcttcggacgccgtgatttcggccgccaccaagaccgcgctggcggacttgaagagctagagagcgatctcggagcgtcgatcagcacccgcccaactattgtttgtaccgtctgatgataaaagttgtttcgtgcagtaatttgtgcagctgtccttagttctttctgtaacttttttgggacgtgcgtttcagctcttatgacccaattttggtgtaggttttcttttcttctttctttctcttttaccagcaccagcagggctaaagtccgagcataacttcgtgtaaatgtcggaattctcccactgcctctctgataattggccttgtaaatctactgctgttaattttcgaggcagaaatgcgctgctgtcgggtgtcactaaataatattccttcatttttgt

SEQ ID NO: 22364 - DNA, 683 bp, Triticum aestivum
  unsure (1)..(683): unsure at all n locations
  Clone ID: PAT_TA_22364
cagactggtacttcgatagcaatttccctccactaccacacactggtactctctccctctccccctacccctctcgccctccgtctgaaccacccacccccaggcttcaatggccatggcaaccaattattcaatctccaacgcaccatttacctttaaaccatctgccccgcataaacaagttccaaattggagatttcctacaattagcagtggtgatggtggtgggagcattttcactatatcaaggaggaatttaagaacttggttccatgtctgcgctgtcactggggaccagagcacccgtgacgtcttcagtgcaaatttcccaagcgattacacagaactcatagtgcaggctaaagaagctacagaatcagcttttaaggatggaaaacagctattgggaatagagtttcctacagcaggactacaatctgttaccaagcggatggcgaaaggtggatccgagatgacaaggaagcatgcttctcatttgagagttttgcgatcgcttcgtacctgcaaagaaagttaccaaggaccaagaatttcctccccggaggaaaagggggtttctttnccaananagtcaacttttgaagggggtcattgaaatnngttacctaacaaaccaaccttatcgangattgggtttacnacaaaggcaaatggaaaccttg

SEQ ID NO: 22365 - DNA, 779 bp, Triticum aestivum
  Clone ID: PAT_TA_22365
aggaattcggacgagggactgcgccgcccgatcccccctccaccttacctcctcctcttcttcctctccatccccctccgccctcaccaactcctcccgtctcgattcgcgacacgaattcctccgaggccaagccaagagctgggggcgaggcgagggacggacggggattgcctcgtgaagtgatccgacatacccacgctccgcggcttgggatccgaaccccaatcccgagcgggagaaaaggctgaaatttaaggcgttccttgggcgtggagttggaattcctgaggacagaacggtctacccggtgctgcggtacctgttcttgttgggcaattgatcggtttatgactgagctggtatgagatgaagtgattggagccacaacttgtctgtagagcagcattttggtatcagagaggtgatgtcttttgcttcactctagaactgtacatgcgtgacatattgagcacctgcaatggcacgaagaaatgctggggcaatgcagcgagaggggtcggttaaggactggtcggaattcgacccctcaccgtctcccaagatggcctactcgcagtcctatgttgcaatgagaggggtgctgacttcgctggcctcgctggaccgtgtcctggcctcaaccaccctcttgtcggcgtgcgcggctacgtcggcccgcaaccacgcgtggtccggggtgaggcccctgtccggggggatgggctggaaaaaggccatgatcaatctatttgtgtgtcttatgattggcattttca

SEQ ID NO: 22366 - DNA, 635 bp, Triticum aestivum
  Clone ID: PAT_TA_22366
aggtgcttcttattttactggtgcatgtgatgtcctcttcaatcttctcaagctgatatattaggtgttagtttcttcatctttaaaaacaatcatggctaatgatcaacatctcaaatatttgcaggtggaattagtgctgtcacaacacccaggggtagctaaagctgtggttttcggtgtaccggatagttgcccacgcgtccgaattgttgcttgtcttagcatcagagatgactggagatgggttgatgcaacagctgagcaccaaggagaaggcaatgaagtgtctgctcatatccttcaagagtattgcaggataaaaaatctgagcagattcaaggtgccaagattatatcatcactggagtaggccgttcccagtgaccaccacaggcaaaattaaaagagaggagctgaaggccaaggtcttggcttgcatgcaaccgcgtagcagtttgtagcttcaggccgtggactgacaatcacgtgggattcttctctccaccgaccatttccaatggagtttcagttttgtacgagtttacatgtacggacatgcatggcctagttttggatattcgggtgtagtggtcatcagtgaagaaatagtctgtgagaaaaatatccaaccct

SEQ ID NO: 22367 - DNA, 627 bp, Triticum aestivum
  Clone ID: PAT_TA_22367
tcccagataagaatttcagtgtgaaacatacacatccaagtgttgttgccatggcaaattctggaactgattccaacggattcccagttttacataacccacaatcaagacaggctggttggacggggagcatgtagtctttggcagggtgattcagggaatggattatgtctacgccattgaagggggcgcaggcacttacaacggcaagccgaggaagaaggtgctgatcactgactctggtgagatacccagggagaaatggggcgaggaagcagactgagtcatagcctagtggtggaaaggggttgatgccttcccacccacccaggttcaaggcatagtaattgcaattttggttcgttgcaccaatcatactgtaggggtctcccttatagtctttctgtcaaaaagatggattttgacaccgcgcgcttccgtgaccggttttcttcgcacaccagccgtgcttcgagcagagttctgaatgttgtacattgtagccagcgtatcacatgccaaaacctacttgtatttgcatgaatcttagcgtaaaatcaatgacatatgactttttcttgaaatagatgtgcaatacttagagcacatttagatgtgctttagcaa

SEQ ID NO: 22368 - DNA, 1092 bp, Triticum aestivum
  Clone ID: PAT_TA_22368
cccacgcgtccgaacggaggagggcgtctctctgctccgtcgccgatctcgcctccgccgcgaatcccccgaaaccgcgagcagattcgcgccggactcgcgacgatttttgatgagataagcccccggccacctcggggttcgcgatgctgcggaaggcggccgtcgggttcctcgcctgcctcgtgctctacctcgccttctcctcctacccccgtagccagagggctgcatatgttcagttaccagcagttactcacagggtatacctggacgtggaaattgatggccaaaatataggtagaattgtcattggtctttatggggaagttgtgccaaagacagttgaaaattttagagccctttgtacaggtgaaaagggtgatgggcccaagggtaaacctcttcactataaaggaacaccatttcatcgaatcatcccaggtttcatgattcagggtggtgacatagttagaggtgatgggaaagcacgcgaatctatatatggaggcaccttcccagatgagaatttcagtgtgaaacatacacatccaggtgttgttgctatggcaaattctggaactgattccaacggatcccagttctacataaccacaatcaagacaggctggttggatggggagcatgtggtctttggcagggtgattcagggaatggattatgtctacgccattgaagggggcgcaggcacttacaacggcaagccgaggaagaaggtgctgatcactgactctggtgagatacccaaggagaaatggggcgaggaagcagactgagtcatagcctagtgctagaaaggggttgatgcctttccacccacccaggttcaaggcatagtgattgcaatttgggttcgttgtaccaattataccgtaggggcctcccttatagtctttctgtcaaaatgaaaacggggcgactgaaattcagtaggctgcttggcctactctgttgcctacggattttgacaccgcgcgctttcgcgaccggttttcttcgcacaccagctgtgcttcgggcagagttctgaatattgtacattgagccagcgtatcgcatgccaaaacctac

SEQ ID NO: 22369 - DNA, 810 bp, Triticum aestivum
  unsure (1)..(810): unsure at all n locations
  Clone ID: PAT_TA_22369
gcaaagtactaaacaccgcagacaaatacagcgacagtcgccacacataagagctatccgaagcgaaaattactactataatttgatgaggaggccttagagcccccgcaatcaaagaataaggaaaacacccggtcgggtaaacaaccctacggccaacatatagcagcaatgggcatcgtactcaagccggcacgcgatccgcacaaggactcgcatcaaaaagacagcccagccagatctatctacgggccacgcaagcaagctctagcatgcaatgcaacacaacaaatatccgaacatcacggcacacccaaatacaggggtgccgcacaccccctatgtttcaccgatgaggtgctggaccatgaatttccagcgggattcaaacccgtaaacatagaggcatacgacggaacaacagaccctggggtctggattgaggactatatcctccacatccatatggctcgaggagacgatctccatgccatcaagtacttacccctcaagttcaaagggccagctcggcactgcctattggtcaaaancttccccgaaacaccatagagtttgggaagactccnaagggggggccnggtacccattcgccctanatgancntattaccgcntcactgncnccntttanactcctgacngggaaacctggcntacccaattnacnccttgcacaatcccctttcncaactgggttataccaanagcccacgttgccttccaanattcccacctnatggnatggacccctgtacggctaaccngngttgtgtacccactgcgntaatca

SEQ ID NO: 22370 - DNA, 640 bp, Triticum aestivum
  unsure (1)..(640): unsure at all n locations
  Clone ID: PAT_TA_22370
gaaaggtcacgggatcgattccgctctcccggttcttgtgtgttcagccggtcaacgtttccccacatcctgccattcttccccattccaactacttccccgttcttccccaagctctcgttgcgccatggagtcggctgtttatgaagagcttttcggggactacttatccagatctgcacacaactcaagcttattgactccagacaatacgccagctgagtgtgttggatctgctgctcggaaacatgtgacaagttacttcaagcgtttcactggttacacgccagcttttggcggccaagtggaagaagaatcagctccttcaaggacaagatgcttggggcatttctccatgcataccataaccttatcaatgcccagcatccagatgtcgtaccgttccctgggctactgctaccaaaccacgaaatagttacgttacaccgctctgtggaaacttgttacgggctacaggtattggggcgcgtgctccgcctggctttggtgaanggtggaggcctgataaacatatcaaaatgaattatgtgattgtgtctgggcaacagttcaaaattattaanggaantgtagggntaaatcacctcacggganagagnaattcgcaagagttcggaan

SEQ ID NO: 22371 - DNA, 523 bp, Triticum aestivum
  unsure (1)..(523): unsure at all n locations
  Clone ID: PAT_TA_22371
ctgtcctactgtcacatacacacacacaagtgctagctagctaatcgatcagccagccatggcggaggagaagcaccaccaccacctgttccaccacaagaaggagggcgaggacttccagcccgccgctgacggcggcgtcgacatgtacgggtactcgaccgagacggtggtgaccgccaccggcaacgagggcgagtacgagcggatcaccaaggaggagaagcaccacaagcacaaggagcacctcggcgagatgggcgccgccgccgccggagccttcgccctcgtacgctctctctcatcataactagtggagtcgtaattaccatacgcatatatagctcttgtcgggcttggctaatggactgcgtgtctacgtgcagtacgagaagcacgaggcgaagaaggacccggagcacgcgcacaagcacaagatcgaggaggagggtgggccgnctgcggagncgtcggcgccggcgggttcgtcttccacgagcaccacgagaagaagcaggaccac

SEQ ID NO: 22372 - DNA, 1208 bp, Triticum aestivum
  unsure (1)..(1208): unsure at all n locations
  Clone ID: PAT_TA_22372
gcacggctagcccgacaagacggaagcactccggccgttatccataacggccgtggcggcgcttctccgtgctccccccgtgccgatttctaccttcgttggtactggtagggaagtgggcggtaggcgagggaagagtgtgagagctggcgcaggctggctgtggggcctgctgggccggaagggcggcggcggtgcgcccacggcgatgacggtgacaccagggaccgtgaaggccggcgatcccgtgcttcacgagccggcacaggaggtgtcccctggggacgtgccttccgagaagatccagggcgtcatcgatcagatgatcgctgtgatgcgcaaagcccctggcgttggcctcgccgccccacagatcggcgtgcctttgaagattattgttctcgaggacacccaagaatacatcagctatgcttccaaggaggacatcgatgcacaggatcgccgttcctttgatcttcttgttgttatcaatcccaagcttaggaagacgagtaaaagaactgcacgtttctatgaaggatgtcttagtgtcgatggatatagagcggttgttgagcgtcatttggatgttgaggtttcgggtttcgaccgaaatggacatcccatgaaggtggaggcatcaggatggcaggcacgccggctgcggcccgagtgtgatcaccccggaggctcgtcgcatctggacggcaggctcccgtgctcctgcatgggcgggtgctccctggaggctccctcttgcctctcgagtggcctccgcggacattcaggacagttgataacttgaatctgccacttgccactggatgtcctcctctaggtgcatgatagcattgatgacatgcttagtttttctattcaagtatatgtaatctcttgtagtatttgcaacttttttgctccagtgcaatatcataatatgttttacacatttattgtcatggatgtacatcacgtcgatgggacacacgcttagaaatgcggcgttcggaatctaattgtaaaatatcaaccgccggccgcacctttcgccgtaaggtgctcggccccgccccggcgtcgctggaagctgccgttttcccggtaacactaacactaagaaancccttccacnggtatacaaaggcnacattcctccaatnccaccaaggaaggaccccgncgctaaccngggtngnaccatnccactn

SEQ ID NO: 22373 - DNA, 763 bp, Triticum aestivum
  Clone ID: PAT_TA_22373
acatgaatctctctgctgattggtgaaggaattcctgagtccccccgctctgctttgcttccacgaactctgattcccagcgagggccaagccaaaagcactagtcggcggccgacgagggaaccgttctgcggtgagctgctgggtacggatccggacccgaggagagaacgggagccggcaccttggggtcggggatcgggctagtgccttggcgccgctcgtggcggtccgaggtcgccggagtggacgcgcccacgctcgctggagtcaccgcgccgcccgtggtccttcccttatccctctggatgaactgaactgaactagttgcggcgcggcggcgtgcagcacggacgcatcaccggagcaagcagcgaccaacgacggtgagctcctccgctgcctgtgcgtggcgtggacagcagggcatgagcgcgaggccatggccgagcaaccgcccggctccaaccgcgcggcggcgcacgggcccgacccggccggcaccgtcgaggagctctccgcagggacctcctccactgcgcagacgtctgcgccgacgaggtcggcctcgccggcaccgaggacggcgagcaccaagtcgctcctggcagtgcaaaagaggggtcgattgctttttctttttagatgtaagggtgtgtacgtaaatgttatgtcaagtcagctccttacaatctggtcccatttgttagaaagtgatcaaatgagccaaatcacctgatcagtgcgatttgcaaaatgttta

SEQ ID NO: 22374 - DNA, 916 bp, Triticum aestivum
  Clone ID: PAT_TA_22374
tcgagcggccgcccggtgctgtacattcaaaagtggaattgatacagtaagcgctcatagcccacaaatttacaagatccgtgttaatttccatacattccaatgccttcaccattcacatttgactcttttttttatagtagatataacatcagtctggactaagttccatgctctaaatacttcgctaacaagtgtttgtgtatttgtgcaaactcttactggcattgccgttttcttcaaactcgccctgctactcaatcaccttcagaggggagcgtcgttgtcgtccccgaggattgacagagagaatggtgcgatagcgatattgaatgtcgaggatccaaccttgtcaatgtgcttcatctcaaaatcaccttccattctcccatttggagtgtttagtgggcatgcggatgagtactcaaaacccgtctttgggaatatcacaggttgctctcccactacaccaacaccccaaacattctctgtccttccattcgcatcagtgacaatccagtgtcgtctgagaagctgtacagcacgctgagaattatttgtaattctgattctgtaggcaaaaaagaacttcccctttaagggttggctccggctttcaatatagacactcctgacttgaacccttatccccagagttgtagcatcactagaacatttgaggagggagtgcggagccaaaatcatcagttcatctctgtacttggcagcatccgcaaacctctcctcctcgaccgccttcttcagcgagcggcggaggcggaggacgggctcttcttcctcgaacaacctcaacgagtccctcagcctcgccgcctccttgtaatcctcgagttgggcggctacggcgagctgctgcttgagcatagcgtacttctggctcctcaacaagaaggcc

SEQ ID NO: 22375 - DNA, 542 bp, Triticum aestivum
  unsure (1)..(542): unsure at all n locations
  Clone ID: PAT_TA_22375
gggacgtcgtcgcggtagcgacgacggacgccgagacgagcacgtgacaccactgcctccctgtcttagcgtaacgcgagtcgaggcggacgtcgtcgaggtagcgacgacggacgccgagacgagcacgtgacaccactgccaccctgtcctagcgtaacgcgagtcgaggaggacgtcgtcgcggtagcgagaacggacgccgagacgagcacgtgacaccactgccaccctgtcttagtgtaacgcgagtcgaggcgacatcgtcgcggtagcgacgacggacgccgagacgagcacgtgacaccactgccaccctgtcttagtgtaacgcgagtcgaggcggacgtcctcgcggtagccacacggacgccgagatangatgtacacactccaccctgtctacataacgcagtcaggaaacactcccgtacgacacgacgcgagacacactgaacacagctcctgtctaggtaccaattagccgctctccggtacaagacgnccanacacagtgcacatcaccntctacgtaccatcag

SEQ ID NO: 22376 - DNA, 915 bp, Triticum aestivum
  Clone ID: PAT_TA_22376
gcttactccgctccagctccaccccagccgtccccgaagagtcggcgcccggcgccggcccgcccgccgtccccgccgtcactccggcccccccccagccagtccccccactgtcctgcgcggcgtcggcgcggcggccggcccccccctccgccccaccccccccctagccaggccctcccattttcctccaagggtacggggggatagccagggcatcggctcggctccacgccaacagtagcaaaggtctctgatttggtttgagagtggcaaggatcgagtaagcccacaggtggccgcctcggtgaccacgcacccgcggccctgagtggcatgaagggtggctgccaatacaacaacatcttggatcccaaggaagacaaggaccagaaggtgctcctcttcgcctgcaagaactgcgaccaccaggaggtcgcagacaacaactgtgtctaccggaacgtggtgcaccacagcgctggagagttcacccaggtgctccaggacgtcgccggcgaccccacccttccccgcaccaaggaagtccggtgcgccgtctgtggccacggcgaagctgtcttcttccaggccaccgcgagaggtgaggaggggatgacgctcttcttcgtctgctgcaacccgagctgcggtcatcggtggagagaatgatgtgccgatcacccaaccgatgacggattccacccatgcaacagtctgagagagttgttttttctttcttcccaagagatattttccccagtagcatgaattggctgtatgtttcagatgtattgaggcggcatatcattttcataactccgtgaggaaaaaacaaccgagtccaccggggtaaaattatccctgtggtccattgcattaatcaaaggatgctatgaggacattttttacctt

SEQ ID NO: 22377 - DNA, 666 bp, Triticum aestivum
  unsure (1)..(666): unsure at all n locations
  Clone ID: PAT_TA_22377
tctccatctccctcaccctccttctccacctccggccgccgccacggccaggccggcgtggtggtgcgcccctcaccatcacaccatcaccatcgcctctagccacgaccatctccaccatgcaccaccagcaccacttcccacgagccgcacctcacaccaccaccagcaccacgccatctccatcttcgccgccgcgccaccgctcgcacaatctcttcttcccctgctgctccttccttctcctcaccacgctgctgcttcccctctcacgcccctgggtactgctccttctcacgttcctgctgctgttgctccgtcttgtgcccctggtgctgctcctccttccctcgtccttgctgctgctctctccctctctgttgctcttctctgaatcccctactgctactactccacttcctctgctcccttcttcttctctgaatctcgctgctgctgctcctcctcttaaaactgctgctctccctctccactttctcgctgctgttccntcnctcttctacaaaatgctgctgtcctctcccattgcttgctgcacaccttctgaactctccaacttatttgtcggttgaacggttgctcggctgnatttngtataataaatactggatctggtanggattataattgatgaatgcattagca

SEQ ID NO: 22378 - DNA, 2183 bp, Triticum aestivum
  Clone ID: PAT_TA_22378
ccggggtggagcagcgcaatcgccacgggagacctgcgggctgctgccagacctcgattggatgaggaccgccccgccggtgaggactctgcacccagagcccgcccgtggaccacacctcgagcaccaggggagcgcgcggctgtggcatcacgacgaggcgcatccaggcctcgggccaggccaggcgggtgggctgctcgcccatctcgagggcctgctcgcccccgggccgctcggcgtgcaggggggccagcccatcgtggagggtgatcctcagggcaccagccagggcgtgggggtggagggcctcctgtcgtccatggtgcgcggcggcgaggcgcctgaccccgtgctctgcatcgcgcacgcccgttccgacgaggacgtgtacgagggcatcgtgtgcccggccaacggcagcgtgaggctccggcatcagcgccaggtgcttccagcgactcggcagacccggctgcgcctggatcgtgatgatctgccgcccggtgtcggcgcgcgagaaggcggcctactgcgcgcgcgcccgccgccgcgggggcggcgctgtccgcggcgggctcagcccgctttcgtacatggacacggggtgtcggcaggagcgaacgtcgctggatgtcgatcaccagatgaaaaaaagcgggacgacgacgatgatgtctaataaccgatgaaaaaaggaggacgacgacgatgatgatgatgattcaggaagtcagttggtgtggttttaggattagctgcagttacaggataaacaggtttctttcttctttcttctttcttttctggtttatgtttccaacctcttcctctcgcgcacgcatatacatatgcccgcccgccccatacattgagcgtgagaagaagaggtttgttccttccgggtcacattgtatatgtagttgacgatgacgatgaaatcactcagaggaggaagaaaaattgtgccgtcgttcaggaagacggagaaccggctgattctcctggactacgatggcaccgtgatgccggagagctccatcgacaaggcgccgagcagtgaggtcatctctgtcttgaatcgtctgtgcgaagacccgaagaacagggtgttcatcgtgagcggtcgggggaaggatgagctgagcaagtggttcgcgccatgtgagaagctggggattgctgcagagcacggctacttcactaggtggagcaaggaatcgccatgggagacctgcgggctggtggcggacttcgactggaagaagaccgccgagccggtgatgagactgtacacggaggccaccgacggatcgtacatcgagcacaaggagagcgcgctggtgtggcaccacgacgaggccgatccggacttcggttcgtgccaggcgaaggagctgctcgaccatctcgagagcgtgctcgccaacgagccggtcgtggtgaagaggggccagcacatcgtggaggttaacccccagggcatcagcaagggcgtggtggtggagagcctcctgtcgtccatggtgcgcggcggcaaggcccccgacttcgtgctctgcatcggggacgaccggtccgacgaggacatgttcgagagcatcgtgtgcccggccaacggcagcgtgaagctcccggcgacgagcgaggtgtttgcgtgcaccgtggggaagaagccgagcatggccaagtactacctggacgacacggtggacgtgatcaagatgctgcaggggctggcgagcgcgccgtcgcagcaccggccgtggcccgtgcagctccgggtcaccttcgaggaaggaaacggggtatgaataagccgccgacgatgatgtcaataacccgtgaaaaaaagaaggatgatgacgacgatgatgatgatgattcggtcaatcagttggtgtggttttaggattagctgcagttagaggataaacaggtttctttcttctttcttcttcttcttattcttcttctggtttacgtttaaaacctcttcctctcgcgcacgcttatacatatgcccgccccatacattgagcgtgagaggaagaggtttgttccttccggtcacattgtatatgtagttgacgatgacgatgaaatcaatccgagcaagaaaaatgattctaacaaaaaaaaaaaaaacgaggggcccggtacccaattcgccctatagtggg

SEQ ID NO: 22379 - DNA, 597 bp, Triticum aestivum
  unsure (1)..(597): unsure at all n locations
  Clone ID: PAT_TA_22379
cttccctccctcgcttgccttccttccttccttcctagcgtagcattccctatagaaaccctcgattctgatcgccgggatgaggttctgacccccgattcggtccggcgattgtgatttcccctcgatttcgtgcgggattagtggccggaattaatcgccatgacggcgtcgtcgccgatggtgctgtccctcctgctcttcgcctcgctcacggcgctgctcgtcctggcccctcgcacggcgtcgccgccgctgccgctggccgtggtggttggggacgaggaggcgccgccggccgccgctggtggtgctgcggggatcagcggcggaggggcgggagttgaggagggaccggaggacctcgcgctataccggcgcgtgacgctcgacgccggcgagggcgcggcggtggcgtccaaggtggcgttcatgttcctgaccaactccgacctcaccttcgcgcccgctttgggaagcgcttcttcgcggggcacgctgaacattttcaaacgttctaacgtgcccccggtccccgcgggccccnagnctccttcgggccgttctcgggcaagcnancgggngggaccagctatc

SEQ ID NO: 22380 - DNA, 531 bp, Triticum aestivum
  unsure (1)..(531): unsure at all n locations
  Clone ID: PAT_TA_22380
aagatcaccacaccttcagactttcagaaccaaagtgaaatttagctagccaggagcacaccagactcaaacatgatccatccaaagaagcttgctcagctggccaaaaagtggcagaggaaggtcgcggccagggccggtggccagcaagctgacgagtgctgcagcccagtcgctgacaagggccattgcgtggtgtacaccgccgacggggcgcggttcgaggtcccgctggcgtacctcggcacgacagtcttcgccgaactcctgaggatcgccggggaggagtttggcttcgccagcaacgcaggggagcagggtcacgctgccctgcaatgccgcggttatgggactatgtcttgtgcctggttaggagagttgcccccgggggggccnaaaagancnttccttagccccaattgntgggccatgncaaggggcaaagatnncattgatggggaacccaacaacaatttnccncctttanacgnttncctaaactaaggaaaaatctggggaantttttggggc

SEQ ID NO: 22381 - DNA, 612 bp, Triticum aestivum
  Clone ID: PAT_TA_22381
gaaacccgggcgtttcctcctctactcgccttctgaactagtcccagaagcaatcgactcttcatcttcttcttcttcttcttcttcttcttgttcacgagcaggccggagcaagcaatcgagctcgcaccaactctgccggccggacggacggaccgggcaggggataggatctgaagaagcttctgaaggttagtagcagaccagacaagtcgatcgatccatcttggggttgtccggtccagtcgccgtgatcgatcgagctccatgatgaatgtgctctccagcggccacccccagaacctgcgcatgatccatcaccaccatcaacacgacattttattattatgtccacggcggagcaccatcaacgcacatcctcctagccgcacgaggaggccatcttcaggctccttccgccgcggcgccgtcgtcccggtcagggccgtcgccgacgacggcggcgaatccagcagcggcaaagacgacgacgacgaggcggcgccaagagcagcggacgacgagggcacgtcgtcggcgtcggcgtcgagacgcaaccaaaagacgctgaggaggctggtgggggcgcctcggcgcgacggcttcagcggg

SEQ ID NO: 22382 - DNA, 1385 bp, Triticum aestivum
  Clone ID: PAT_TA_22382
cggcaccccgccttgcttcccttcccgttctacaactgatgacaacagcggaaaccgaaatgtgcttatccatgctggattcattaaatgagtgtaggccgctttctggatggcttcttgttgagaatctagtcagagctatttcggatgagtttcagaatgtttttgtagccgaagcaacctggaaaagagtcagatcagagagagcatgatcagtagactgaagtgatgttgagcaagacatagtcacctgatttacttgaccccgcagtttccatgtttgaacaggtcggggagctcctgcgaccagtccttaatacccttcatgcttcttcttttctgttctgtggcgagctatcggtggagcttgcttctctttccagaattcgccaattttttgtggttgaatcgtttgctgggggaattcatgttgtgcatgcattggtcgctccaaaggcggctctggagtattatgatacctatgttcctttcttgttggaggcatctaacgatgataactctaatattcggcaggctgctgtttatggcctgggcagatgtgctgagtatggtggccgtagtttccgtcctttagttggagaggccctgtcaaagctgaacaatgttatcagacatccagaagcacaacatgcagataatattatggcatatgataatgctgtttcagcacttggaaaaatatgtcaatttcatcgcgatgggattgatgcggctcaggtcattccagcatggcttggttgcttgcctataaaagatgacaagattgaagcaaaagttgtacatgatcagctttgttcgatggtggagagatcggactcacaggttcttggacctcatagtcagtatcttcctaaaatagtctctatttttgctgaggttctgtgcaatggaaaggagcttgcaacagatgaaacaaccacccggatgatcagtgttctgaagcgatttcagcagacattgccacctgattttcttgcctcaacattttccaccttgcaaccacagcagcagcttatgctccagtccatcctatccacatagttccactcttctgtcttgtggctgtaaggttggggcttgcttttctttccataattcgtcattggtactgtcaaccaattttttgagttgaatctttttctgggggagttcatttgtgcatgcattggtcgcttcaagggattggtggtcgccataccatatggttttgatgtagagtgtatattatcttgtattcaaatatgattttggggcgtgctgcgtcaaaggtgtaaggccaatggcgaaaattgttgttggttgagtgtgcacaagggggcaccagttttggtaatgagattgttatggatttgtgggtcggtccc

SEQ ID NO: 22383 - DNA, 362 bp, Triticum aestivum
  Clone ID: PAT_TA_22383
ttgcaaagttgcatgttggtgcattcaagataatgagtttgatcggccgacgatgggtgaagtggtccgggttctcgagggtctgcaggaaattgatgtgcccccgatgccaagactgcttgctgctataacggcgcaacctggtgctgcatattcagtgtaattataactcacagtcgatgctaataatctttgttaatttcagcaaattttaaagttgtagtaatgtcgagtggaagaaataaaggcaagcattgtagcataatatggcaagaactaccaatatgtgtttgttttgttgattggatagttcgatatatatccttaaacccttacgtcgtaggaagctgcccatggggggg

SEQ ID NO: 22384 - DNA, 992 bp, Triticum aestivum
  unsure (1)..(992): unsure at all n locations
  Clone ID: PAT_TA_22384
gccggccgggtactgcaaacccccccctcacactctcgtgctcctccctctttcctacctcccatctttcccaccgcgcgcgcgcgctcagccaaaccaatcgaccggagccagtcgccggcactgcggcccatggccaaggcgcgcaagcccacggcgttctccgccgccgagcgcttcctcggcttccaccaccgccccggctccgccaccgtcgccccgtccccctacgacgacctgccggacctggccgagtcggacgtctggtattcgccatcgtcggacgcgccaaccaccaccgcggatcaggacggggttcagcgcaccgacagggcgcccaggggcgagccgccgcggcgcgtgggcgggctgagccaggcgttcgcggacgggcggcaggtggcgtcgtcggcgcccgtcgaggtgcccgcgtggccgagccggttcgccgacctggagcccgagcccgagcccgacgagcagcagcaagaggacgccgacggctgggtgccgccgcacgtgtacctggcgcggcgtcaggccagggcgtcggtggtcgaggggcgtcggacgcacgctcaagggccgggacgcgtcgcgggtgcgtgacgccgtctggagccgaaccggattccccggatgaactcaaccggatcggccgggctgctcggaatcagaaaaaaaatcccccttttttcttcctttgggtcgcaaattttgtaatatggtttgtttgatttttgtttcaagcgagttcatgagaagcgagagaattcgccagaaagaccaaaagatggtgtgctttgttgttgtagaatcattgtacatttggtttgttgaattggtggttgattgtgttagttaggtaggactcaaaccgaaagatggtnggngtactattatcctttcnaagttggttgnggcctaaaaaacaaaaacngaccatcttttttgacgggagcaataataatggatgcatgcatttcaaaann

SEQ ID NO: 22385 - DNA, 415 bp, Triticum aestivum
  Clone ID: PAT_TA_22385
gaattcgggcacatcagccatgcaacaaccgcagctgcagccccgcgtccgcgcgcgcgctttcctccacgccgccgttaagctcagcccgaggaggaacccgttcctcctgcgccgtcccgccgcgtccgccggcggcgccgtcgcgggcgtccagctgacggtgtcggactcggagctgtcgtcccggggcttcgcggtgcggcgcaccgcggagggcctggacgtggcggcgctgaacgaggtgttcgcgcgcgtggggttccctcggcggcaggaggagcgtctccggcgcgcgctggagcacagcgaggtggcatggctggcgtcggaggcgacggggcgccccgtggcgttcgcgcgcgcggacggagacggggtgttcaacgcggtggtgtgggacgtggtggtggag

SEQ ID NO: 22386 - DNA, 605 bp, Triticum aestivum
  unsure (1)..(605): unsure at all n locations
  Clone ID: PAT_TA_22386
gccactcgcaccacagtcatccactcacaagctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtgcagcagggcggttcgccggcccggggctgctgcaccggcatccaaaacctgctggcggaggccaaacaacaagccccgaccgccgcaccatctgcggctgcctcaaagaacgtcgccaacggcgcctccgggcggggccctaatatcaacccgcggcgggcgcgcttcccctccaaagtgcaacgtccgcccctccccctacaaggattaacccccagccgtccgtactggaaacctccgattcaattggcccctgcctctaggccccctctggccccttgtcggggaataatnctgtacanacgaacttactagcctggggnaatcttcgtcactatcncggttgntaaggcatgnttttgatnancatggtctgctgtncgaggtcnanaacaa

SEQ ID NO: 22387 - DNA, 1728 bp, Triticum aestivum
  unsure (1)..(1728): unsure at all n locations
  Clone ID: PAT_TA_22387
gcacgaggactcgtgctcggtcggtcttgacctacccgaagctccaacccgacccaataaaatctctcctacaccctgccgcccccggcgcgcggcgcccgctcacgcctctcgtctctcgcctctcgcctctcgaacgcgtcgaggcagccgccgccgctcccgttctgccccatcgcgcgccgctcccctgccccagccgtttacaccccgtccgcaaccttgggcagcggctctcgaggtgaataaggagctttgaagtctgtgtatgaactagatacaacagatatcatgggtgatagttcaaattcaaatgtgcagaaggctgaggaactcaaacttagggcaaacgatgccttcaaggcaaacaagttttctcaggctgtagagctctatgaccaggctattgatctgaatggttcaaatgcggtttattgggcaaatcgtgcatttgcacatacaaagcttgaggaatatggaagtgctgtccaggatgctacaaaggctattgagattgatcctaaatattcgaaaggttattatagacgaggtgcggcatatcttgctatgggaaaattcaaggaagccctgaaagattttcaacaggtgaaaagaatctgtcctaatgatccagatgctacaagaaagttgaaagagtgcgagaaagctgtccaaaaaatccgcttcgaagaagcaatttctgtaggggatacagaaaggcgctcgatagcagattctcttgattatcatataatagaagttgaaccacaatatactggagcaagaattgatggggatacaataacattagatttcgtcaagcagatgctggaggatttcaagacacaaaaatgtatacataaaaggtatgcactacagattgtgttacaagcacgggacttgctgcgagcagtgccttcccttgtcgatgtgaatgttccgaatggttgtcactttacggtctgcggtgatgttcacggccagtactttgatctgctaaatatatttgagctcaatgggcttccctctgaagacaacccttacctcttcaatggagactttgtggacagaggatcgttttcacttgaagtcatacttactctctttgcattcaagtgtctctatccaactggtatgtatctagcaagaggaaaccatgaaagcaagagcatgaacaaaatatacggttttgagggagaagtgaagtccaagttgagtgatacgtttgtcgagctgtttgctgaagtattttgttgcttacctctggctcatgtaatcaacaagaaggtctttgtagttcatgggggtctgtttagtgttgatggagtaaagttatcggacattaaggccattgatcgtttctgtgagcctcctgaagaaggtttgatgtgtgaaattcctatggagtgaccctcagccttagcctggtagaggcccatgctaacgaggtgtagggcttccctttgggtggagatgtgacaaagaggtttttagaagataacaaccttgaccttgttgccccatttcctacgaagttaaggatgaagggtaatgaacccatgcaatgacgggtagcttattcctcctcccatcagcccctacctttgccgcccattngnacaaagngatttatccggtnaaatgcccccaattttaagccaatatgtanttcccaaaatttcaacccnnatttaacccntggcaancaanatttccccgggttcaaaa

SEQ ID NO: 22388 - DNA, 410 bp, Triticum aestivum
  Clone ID: PAT_TA_22388
ttttttttttttttttcgtgttctaataaaatacaataatcaaagacacttacaatttaaaagatatcttctgtttgttttttaagataaaaaacaacacaagttggtttgctcgcctgacttctcaaccttacagaccttgctcctattaatggaagcataaggaacaacttttatttaaccacatcacatttcaacaaagatgcttagttaaaacacaaacacatatctagttgttgttttcatagttccaaccattgtaacatcttggctcttgcacatatccatatcagggatagccaccgccacgagatcctccgttgtaacctccaccatatccgccaccaccaccgtatcctccacctccaccatatccgccgccaccaccatccccccccccgaccacgctt

SEQ ID NO: 22389 - DNA, 873 bp, Triticum aestivum
  unsure (1)..(873): unsure at all n locations
  Clone ID: PAT_TA_22389
cggacgcgtggggcagaacagcagaagcctacgagaaccagcgtccagccgaccagccgccgccgcgcgataaccggagttaatggagacgcccaccccatggagggtcctcgagttctacagcggtatcggcggcatgcggtactcccttgcgtcgtcgggcgttcgagcggaggtggtggaggcctttgacatcaacgacgtcgccaacgacgtctacgagcacaacttcggccaccgcccctgccagggaaacattcaaacactcactgctggtgatctagacaagtacaaggcacatgcatggctcctttctcctccatgtcaaccatatacacggcaaggacttcagaaacattcagctgatgctcgggcattttcatttataaagattttaaaccttatgcaaaacatgagctttcctccacaaatgttatttgtggaaaatgttgtccggattcgaggtgtctgatacacacgaccagttgttagcggtcctttcaactctcaatttcaacacacaagaattcatcctaagccccttgcagtttgggtgtcccatattctaagaccgcgctacttctgtttgggcaaaacaggaatctatgtcttttccaaatccatcagtcaatggacaagctgcttagggcaacctacatgcccaacattgaacactacgagaactcagattagctatgatcaagaatgaagatgttctgggagtagtatgtatnccaattagaacttncctngaacncagagtattggagatnaggatnttcagcatcaaccccgacttttaaggagntgatngagcaccccgattgaacgctnacaagactacacatttcactaacttgatggacgggggga

SEQ ID NO: 22390 - DNA, 480 bp, Triticum aestivum
  unsure (1)..(480): unsure at all n locations
  Clone ID: PAT_TA_22390
gtcatggaaagccgcatcaggacgttcagtccggtggtcatggcgcaccatgatggtccgccgcctacagccgacgcaccggagtgcacagtagcaagcaccagtttgaggtgaggatatcgcattggtctcctgttgctcacatgcgaggcctcggacgagcggccaaatccacgtgaggtggatgttgcaggcacggccatctccccttccttccttccttctttttccctccaactaccatgttatctttaccatgtcttctttccttgttgtattgttttttcacccatgggggatagagatgttacctcaagtcggcaatgaagccagtgatttgtatccaataattttcngttaatacggtaacaacttattccagcccctggacggaacgggcgccatctggatgatgtcaagaacttacaagaaagttcctaaaaaaaattatgacatggnatttcctcaccctggattgtc

SEQ ID NO: 22391 - DNA, 936 bp, Triticum aestivum
  unsure (1)..(936): unsure at all n locations
  Clone ID: PAT_TA_22391
tcaacaaccaccaaagtacacacaccacaccaatcaagtacacatccaggccaccaagccacccagcgagcgatcgccatatcacacatagcgccatgtctggcgtgtgggtgttccgcaacggggtggtgaagctggtggagaaccacccggcgtcggcggccggaccgccgggcggcggggcggtgcggcgcaaggcgctgctccacacgcccacgggggaggtggtcgcctcctacgcctccctggagcgcaagctcgtcgcgcttggctgggagcgctactacgccggcgggggcggcgccgccggcgactgcatgctcaggttccacaagcgctcctccgtcgacctcatctccctccccaaggacttcggccagttcagctccgtccacatgtacgacgtcgttatcaagaaccgcgacgccttccgcgtcatcgacgtctagctgagctagctggctgatccggccattccgatgaagcaagcacagctaggtcgtgcaagcccggcggccgctaccgtcgcatccatgtccgtcatcgatctccgctggttaacttttccaccttgtgtacgtgtgtgtatgtgtgtgtacgtaacctgcacgtatatacgtgtgtatgtatatgtacgttgtgtattgacgtatatgtagatatacatgatgcttgtgcagtgtggttgattaatttgccttctataagtactattaggtcggccgatgtgcggggaccttgtgcaccacctgccacttgctcgtcttcttttggatcaaagcttgtttggtaatacaaactggctgcaaccccgaagagcaaacccatcttggggtggccctggtccgcagcatagggttagcaataatggtgttggtttcgctgggagcgtgatctctccctggggctgcgtcagtcgtcaaaaaaaaaaaaaan

SEQ ID NO: 22392 - DNA, 873 bp, Triticum aestivum
  Clone ID: PAT_TA_22392
ggcgggggaagctctcgcgttctgttcgagccggccggcgcccgccccggcgcttgggattgggaggggtggggtaaatcacgacagagcggagagagtaaaaaactacaagatttcatccatctcaccgaggcgagggtcgatgagtgaatttttttagcggtagcggagatgaaacagagaccaaaaccagggtcgaacgccactgactgggactcctctaggcctcggacttgctctccgatctctcattcactagctccctctcgatcgcctcagtcgacatcaacaagccagggcaaaccagcaaggaaatagatagaagtctcggactcaatatacagcatcgacatgtagagatgagactcgatgaatttatttgatatagataaatgaaccaaattacattgaaaaaaatagcaaaagaagaaagagacgggcggaggccccctagaccgccagaaaagctatcaaaacctatcaaccgtgcgatcgcgtggctcagcagatggcacaaacaattaaaaagtaagtattttgaaagcagtccgcaagaccgtctcggccctaacctatacacaagatgcatggatgcaatgcgccatgaataaagtcaccaatgtccattttcaaaaaaaagttagctataacaaaggtaagtaaaaagggaaacggcggtagtccgcctgaaatcccaacagaacataaataactaccgatcgggtgtctgaagcgacgcctcgaaaggtgaacaattaaatataaggaaaatgatgccacagtcgggcgttttcccaacaccccccattccaatcactagtcgcggccgcctgccaggttcgaccatatgggagagctcccgcaacgcgtctg

SEQ ID NO: 22393 - DNA, 651 bp, Triticum aestivum
  unsure (1)..(651): unsure at all n locations
  Clone ID: PAT_TA_22393
gaattcactagtgatttcgagcggccgcccgggcaggtctcctcctcccaggccggcggggtgctcccgttgatcccttgcctagaatgtcgttgcaaggtggtgaccttcgtttcccgtgcgggagaacagttctacaaatgcgtcacgaaagatgctgggctatgcccgttcatgagaacgacggacacctacctgccggagctcactcgtgtcggtatagctgaacctcaggtgctgcatcactccatggccatgcaccaatccgccccagttcagcgtagatccagtcgggagcaggagttcatcgacggcagccagggggagatccagccggaccatgcagctgcgaggctgcagatgcagcaggcgaaccaccacccccgtgccccaactcactgttgctccttcgcacctccgatgctgctggctgggaagcaactttatccttgtcgtcgccctgttgtatttaatcttcggccaccgcccgttagcgtctcctctcggtgatgtcatgtgtcatcgccgctctccgccggctctgcttcgcacctctatcgcgtctcggatcctcgggttacacggtatcccactgttancacatttanatccaatgtcgtggnttggnagggtcaagtgtgnatttttaaa

SEQ ID NO: 22394 - DNA, 618 bp, Triticum aestivum
  unsure (1)..(618): unsure at all n locations
  Clone ID: PAT_TA_22394
tttttttttttttttgttcaacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggttcaagcagctccctccctgtagtaaggcgaacaccacgccgccatcatcatgcatgctctccgccaacaanagaactgaaggcctttgacttgctaaggaagatacttttgtggcgggctcaacatcctcctggaaagcatctaggcatccccttcaagcttggcaaagaggtccttgatgtaacctcatggtgggagataacgctcctgtcaaaacaggtgccctgaagacggaagggcaacaattcaacacttaaggctggcacaaacctcacacacacacctancanggatgggtcaagccaanacgncctgacacaatgcacgantcaananccttncanc

SEQ ID NO: 22395 - DNA, 456 bp, Triticum aestivum
  unsure (1)..(456): unsure at all n locations
  Clone ID: PAT_TA_22395
gcggccttcgcctccacctccccctcgccggcgatctccgcctcggcctggcgcatggactccctccgcgccgcgctccccgcgccccgcccctccccgtcggcggncgtccggcctcgcaggcaggcggcctccgccgccccgttcctccggagctccttcgtctccacctcccccgcctcgtcctccgtctcccccgcccccatgtcctccgcggcctcggngtccctcgccttctcgtacacctcctcgttctccgtggaatcaagctttgctcaacgactgtttggcattgaatgtccgtngaaaggatattggcgatgaagcacggggaagcgcattcctaggctcaacaagnccgcaaattagcggaaagctccnggtcggcggtgacacanagtngtgaancacnggangataaanactacaancnaaggcaaaggnatnaagaatttg

SEQ ID NO: 22396 - DNA, 584 bp, Triticum aestivum
  unsure (1)..(584): unsure at all n locations
  Clone ID: PAT_TA_22396
ctcctctgctctgccatgccatgatggcctccgccaccatggccacctgcttctgctcctcctcctctttctctccaccaggacctcgccgccgtccattcacccccatcaagctccccttctcgccgtcgccgtcgccggcggtggagctgcagagcgagcagcaccggcggcacgtaacgaccacaacccgctgctgcagccacccccggacccgcacttcccgctgcgcctccccgtccaaggacggcagcagcggcagccgcctccgcatcttctccggcacggcgaacccgacgctggcggagggagatcgcctgctacctggggctggagctgnggcggattaaagttcaagcggcgcgcggacggggaagctgtacgtgcagcttcaaggagagcgttgcgcgggaagcgacgtgttccctggtgcangccaactggcccgccgggcannngagaacctcatgggggctgctcaacaaggnggncgcctgccgccggcgcctcggcanagacatnaacggcgttcgtgncctnanttcgggaaccgcgngcgaacgcaanattgnngggccgccagt

SEQ ID NO: 22397 - DNA, 520 bp, Triticum aestivum
  unsure (1)..(520): unsure at all n locations
  Clone ID: PAT_TA_22397
cggaaccaacaaatcccaagctaatctcgtctccgatcgacccgaggctcgtcgaatcctccttccccaccgcctcaagatgcagatctttgtgaagacactcacgggcaagaccatcacccttgaggtggagtcgtctgacaccatcgacaacgtcaaggccaagatccaggacaaggagggcattcccccggaccagcagcgccttatcttcgccggcaagcagctggaggacggccgcacccttgccgactacaacatccagaaggagtccactctccacctgggtgctgcgcctgcgtggcggcatgcagtcttcgtgaagacctcacaggcaagacatcactctggaggttgagagtctgacaccatcgacaactcaaggcaagttcaggacaaggagggatccccccggacaacacgccttatcttcgctggaacactggagatggccacctcgcgactacaatcagaagcgcaccccactggggccccccgcgggggccgctcgtggnggatg

SEQ ID NO: 22398 - DNA, 601 bp, Triticum aestivum
  unsure (1)..(601): unsure at all n locations
  Clone ID: PAT_TA_22398
gatcggatcagaccagagacacagagcagagcggataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtccgccccctccaaagggcaccccgtccgttccgaggccgccgcccgagaccggagcccgacaacggcgggtgcaagtggcggtccaaactgcacctggcaaccccgtgcacctgcaagtgattcatcaaatcaaggacaaggagattgcatggcatggatggactaatgaaggagactaatagtanttatcatggtgtgtgctttgggtcccctttttaaattgccccccgagataaacgagattatcctacctacctaccctaccagctaatcaatggccttttggttgtacgtgtggtgcaaaggcccctatccgttccgttacccctttccaaggtccaactcgtcctgcctccgtttacaattattgacaananaaattgngntccccaaaaaaaaaaaa

SEQ ID NO: 22399 - DNA, 614 bp, Triticum aestivum
  Clone ID: PAT_TA_22399
gtggaggctacgaggatagcagcagctgcaagcaggagagcgaacacaagaagacccttgctggatgccatgcttggcatccgtgatccgtgcctcttcttcttcttcagtggttgtagtggccactggccagctcgtgccgaattcgatatcaagctgaccgcggccgtcgcgacgcgattccatggcgattctgatcttcccctctcctcgtgcttgatttttcctccgtgttccttcgatcccggctcccgtggaacatctcaatgtcatcttcatcataaatgcatcttcttcatcaagggaggctttgctttcaggtggtcattacgagaggagttgacggctctcacgtacctgttgctttcctctggattgattttgctgtgtagcacaagtgactgcttctgttctacctccaggtgcctgtaggaaaggaggacaactgggagggaccggttcaacctttttgtttgtttttggttgaccagttttcaacccgacccgttttcaacagacaactgtcaacagttcattggatggaaaaattgactgacatctaattacaaatcagtcgaattacaaatagacactcccatccctcgtgtcagggg

SEQ ID NO: 22400 - DNA, 674 bp, Triticum aestivum
  Clone ID: PAT_TA_22400
cgcacccactcactcacctcctccgcagttcttgctcgagcagctgtaaccactaaccaacacagccgcatctgcgacattttctttctcgcagctaggatcatggcctccaagatcttccgccccgccctcgcctcctccgcagttcttgctcgagcaccgcatctgcgacattttctttctcgcagctaggatcatggcctccaactccaagatcttccgcgccgtcgtcatcgcggccgtcgccgcgtcttccttcgccggggctcgctctggccgccgagcgagcccgcgtccgagcccgacgtccggatgccgcagctgtctcctctgtcgctcctccgccgcccgtgctctgcccggccgtggccttcctctgttggtcagcatgcgccactgagctgggccgaggtcgcagctgccgcgcgtgtccacaggctcgctccatgccggatttcagggtgaaagatggccgctttccttgacgtcacctttgcgcgttgttccgtttatactacctccttgatttgataccctcccatgtgtacccgtcgagctgttagtgtttttttttgagaaatccatgctgttaatgtccgtgtgtttcctttcaaggtgctaatagttaagtgtatgattaagcattggcaaaattgtctactaaaaaaaaaaaa

SEQ ID NO: 22401 - DNA, 618 bp, Triticum aestivum
  unsure (1)..(618): unsure at all n locations
  Clone ID: PAT_TA_22401
ctcgctcctcccccactctctccctcgtctccctcgctcagatccgtccgcacccgcagccatcgtcgtcagccaccacgctccaccgcggccaccgacgcccccgcatccatccgcagttcccgccagctccgtcctgctcccctacgtcgcctgcgccaacggtctcgagccgggcgcctctccttcngtgcgggacgaggtccgtcttcaaccccaaggagtcctccgccgccatccgaatttcccggccacactgagcctcccttcgagcacgcttttgcacaactaccggctccgcgaccccccgaggctgccgggtgacccctaagttcgactacggtgttgacgaccctctctctttgccaagagcaaccaagatgctggagtcaaggagccagacgccaccgtttgatgacgactactactactccgggagggcctactactacgtgcaacccgctgacggggacaagagtagttaacaagttccaagcaggaggatgcgctctttgatcggtaccaatttaggttacctcttaagnaaactgntaactagtcgnataaatatgttgctcgcgataacttgtantctgatcagcttaggcctggttgata

SEQ ID NO: 22402 - DNA, 561 bp, Triticum aestivum
  unsure (1)..(561): unsure at all n locations
  Clone ID: PAT_TA_22402
tagcgtggtcgcggccgaggtacccaaaatggctggaggataacaaaagcaagataagcaaagaagaatatgagcgttacagcaatcagcttgaactcatgctgaaacttaatgaggtctatgaacatgagcctgagaatatgtctaaggtttttgagatcatgcaaaacatgcaagaatgtggtcagccccccagtgatcttgttcaagatattgttccggatctggatctgagcaagttgggacaactatctcctgagatgcttgaatcaacagaaaattgctgcataatgtgatgagcaaagcccatcttgggtgcaaattccatgtagtagcgacaatacctgtaaccactccccttttagttgaaagttcttttcgttggattatttgtaaagctctgcagatataaaacggattcagttttcttattcttggatgaatgtcatattggtcctgcccgtgaggacccaagtanccagccggggggggccgcttcctttcgcctgaggatctataccccgccgcgggcgtcgttccacgcgcccgaattaaaaaaaa

SEQ ID NO: 22403 - DNA, 633 bp, Triticum aestivum
  unsure (1)..(633): unsure at all n locations
  Clone ID: PAT_TA_22403
gtcttcttcttcttcagttccgccttcccatccccgcctgatcggagtctcagccgcggcagccatggcgaagacctactccgtcgtcagcgccgagtaccaggaggccgtcgagaaggccaggcaagaagctccgcgccctcatcgccgagaagaatgctccccgctcaatgctcccgcctccgccgtggcactccgggccggggaccttccgacgttccgtccaaagacaaggcggcccgttccgggacgatgaaagaacccggcggggcaaggcgcacgcccgccaacgccgggccttgggcatcgcccgtgccggtgctccgancccatgaaggaggagattncccacatctcctacgccgatttcctacaacttgccggattntcccgttggaggctccnggtgggccgtgatcctncancccaggaaggnaaggananttaaccccactgagncgctccctggatgtacnangttctgacactnaagancttttggaacaaatggttagtattaagaatgntcccccngggggcaaccnggaaagnnaaaaggaaagctggttnaggactganaaggaccttaattgaaanctattagngttcgatgggnnaaaaggatttaantca

SEQ ID NO: 22404 - DNA, 412 bp, Triticum aestivum
  unsure (1)..(412): unsure at all n locations
  Clone ID: PAT_TA_22404
cgacccaaagagattccctcgctctcacacacccagtgatgctggccatctcgccgcgccaatggcatccatcccctccctcgccgtctccggcgccgccactgccgtcccaagccgccgtcgctgccaaagcccctgccaaagctcccgccggcttncgaacaaagggcgggtctcatcagaaggagcacccagccatggggaaaatggcagattggagcgccgaaagagccccctctggccgctaggtgcccaaggaaagcaaggagcatgctgaaaagacggccggacggtgcaatcagcgatgtacgtgcctctngcttaacaantgcgtccaangccaacgaaccgaagggggcttccgnaacggcaanggccttgnacggcaanattgggaaagancggaacgttc

SEQ ID NO: 22405 - DNA, 688 bp, Triticum aestivum
  unsure (1)..(688): unsure at all n locations
  Clone ID: PAT_TA_22405
aantaataaattcaggcctttangatttgattagagctgtcngcagttccgtgcccgcggccctggtacattagctaccgcgtgaaatttattgaaatgtatgatatttctgctggattccatcaaacattcctctctccctaaacttattctgctcatgctttcttgctgttgtttccctcctgccatccaaaacctggatttccagagcaaaagaaacatccatcatggctatcccttggcctggcatcccgaccaccatcctttctccaagccttcnaataaatccaaaaagcataaacttccacccnaggttaaaaccaattatatcctccaagctggtaggtggtagagccccatagcccgatagtcccgtccaagtgaacctggtaatgggcaacggaggctctggggtgcaattggacagcagtgatacgcccagcgtgcccttctagctccccaatacatccgcccaccttcaggtcccagttccgtgcagttccctccatggggccaacgacaagatgttgtccatcagggcgtgtaaagtaatcaacacagaccggcccctccgcctgccctgccagtggcgtgggcccatgggcctccgattgaacccccccgagcctcgctctgcccgcccctcgtgcgctgtcgcaccttccgaccggcccgggcggccgctcga

SEQ ID NO: 22406 - DNA, 449 bp, Triticum aestivum
  Clone ID: PAT_TA_22406
tcggtctcgctgctctgcctcacgcggtcaccggagtctggtcgacggcaagactctgggttgatcgacgctgactagcgcggctcggtgggcgttgtgctcttcaacccagtgaagcccggcggccacgtcgcaagatgatcgtccaggtgatcgtgacggcgaaggtcaccgaggtggaggacctcgacgccaccgtccgagggtagggaggatgtgggtccaccggcgtctgaactacgagccttggtagatacatctagagaagtgctttgtttaggttggtggtgaacactaaggaagttacccatgtttcgatgatggttgtgtgtgtctgatgttacatggattcttgcgatctctttcacttgagatggttctgtgaccttagtttatcttgcactggatgtgtctctgatttccattcatgaaaaaaaaaaaaaaaaaaa

SEQ ID NO: 22407 - DNA, 718 bp, Triticum aestivum
  Clone ID: PAT_TA_22407
ttctgttctgttaaaagtggattcgtaggcattaggtgcagatgctgctcgtgggacgtcatctgttcatttctcgttacatgagaagggacttgaggcgaagaccactaataaaacttctataatagctttgagttgtgggctagagcatagagcaaagattgataataatgttaggctgctggatttcagaaagaggcttgaatctgcatgtgttgaaacagtggaatctgagaaaatgacggaggatcttccgattcttgaccatggcactgaggtaacaagggagcattagctgagcaccaaagaattcactgatgctgtagcccagcaaccgagggaaaaaagccagatatcagcctcattgcaattgcaatcatgtgtatatgttaattctgtggaaggctgtggagttgggtgaactaggttcaaattcataatggctgtgcagattcgtcacgtatttttagtgggaagacgacttggtggatccgttcactttgcgttgtctggatgcaatttttgtaaggcttgaactttgtgttagtaggctgctatatgtgatcagatcccttgaacgtattttgtgtaaagcctgatctataggtaaactgttagacgcagcatatccctctggcgtttgttgggtaaataatggtccataggccaaattagactttgaattgaatggacttcaatatatatgtagattattagc

SEQ ID NO: 22408 - DNA, 817 bp, Triticum aestivum
  Clone ID: PAT_TA_22408
ggtcgaccggccgcggccgggtcgtggggaacctcgccttcgtcgccctcgtggcctacctcgtggtgagcggccagttccggtggctgctcgacgccatcgtctccctctggctcctcacggtacttctgcctattgtgggtctcggtgcgctcatattctttgcacaacgaaatatacttcagagcgattgtcccaactgtggaaaaagcttccggatactgaagacatctgtgaagaatggtccacaattctgtccttattgcactcaacctttttctgttcagggcgataagtttgtcagagaagctgctagcttttcctctggaaggacccctacaaatgcacaacaagccttcaatgagttattcaaccgtggatcaaatggaaaagcaccttctggttctgggacgattgtagatgttgaggctgaagtcacggacatcgagtgatatttcttcaggagcgcatcagggtcagttttgctgctgttttgggggccagtttttatctccaatgttgtactgtataagcctgtagcactctaggaaataggtttgcagcctagttccaagcgacttccgaagcttagaggtgagaccaattggcagatacagatcgaaggcagatgtaacagattaacagggttgtgaatatttacattgcttcttttgtatattcccaggcttgcaaatacacccagggttttgtatatgtaacatatgttgcaaactagggtgacattgacgcctttgaacagccggtacgtacacgggaggctccagtcctcttctagggcttgttcaaaaaaaaaaaa

SEQ ID NO: 22409 - DNA, 563 bp, Triticum aestivum
  Clone ID: PAT_TA_22409
cccacgcgtccgccgctatcgccatcacctcctccccatggtccgcgagctagacgcgctgccgggaagaatccaccatctacggccttgcggcgctcgccggggacaccgccgccgccgcctctatcctttccggatgcctctgtctcctctctacaacggcctcctcatctcttcacggctgctccagaggtcgccccctcgagcatcgcgtcctcttctccaccaccacctcgccgccgcctcctcccttcggttctctccttgaagctccatcaagtggtcactgccgcttgctgcctcttctctcctgcaggacgacgcctccccatccaccatctgccgccgctgaactgggtggcagttgcggccatgggggagtaggggtggcatggtcttcatggtcgttatgtacaagaagacgaggacggcagtggggggaacgagcagcgaggccggagcttcactatggatttgaggatgcaaactcgcttggcaccatcaccgtcgcaatctgggctgccatttgcgtctcgcatctttctttcccaatacttaactta

SEQ ID NO: 22410 - DNA, 615 bp, Triticum aestivum
  unsure (1)..(615): unsure at all n locations
  Clone ID: PAT_TA_22410
cccagtcctatcgcctctcctccctggtgcgccgcctccccctcgtctcccactccctcgatctgcgccgcaaccgccccaccccgccctgcaccgattccttacctcactgccggccaactcctcctctctcgatctgcagcgctgctccaccttcggtccctgatctggcatcccaggctcatccctccgtctcattgttgcgggttgattccctagcttgcgacagatggatttctggtggcgctcctcaagcaagcggcggcttgcggcggatcgattccctgggctgccttccgggcggtggcggacgttgagttagagtagcaaaacctgggcaagaagtggctagtaagcagcggagcaacaacaacaaagagcaacatcgatagagacgagtataacggaagtacaagaattgcttggggcctatgttggattaattaggataccaacaccatctaattttcaagattttgctgatgtgtaggttcattgccgggaatgctttttcccaaatagtgccttgttaaaagaacaagatangatcctgggaataacgtcganactacatcaaatctcatggtanagaatgngtgcggtaanantaaatga

SEQ ID NO: 22411 - DNA, 407 bp, Triticum aestivum
  unsure (1)..(407): unsure at all n locations
  Clone ID: PAT_TA_22411
gccgctcgggtcaggctggtatcccccctaagccagccgccggtctcgccggccttcgcggacccaacgcattgccgccccgctttaaactagccccttaataagctgccgtctgcagcgtctcctgccgtcctccgagcaggggcagcacgaggaagtcctcctcccctctctcccggctgccacttnggacggcgagctgctgggagtttcctacctcccggcctgcggaaggatcnaaataagtgggacggntacangcagtaaaatttttgaaaactggggacactgggatggcgtttgcgtctcccaacgaactgctggganattcctgcccattgcngtgtacnggtcaattccgggctttaatcntaatggaaggtggaattgacnatacggtcacaagg

SEQ ID NO: 22412 - DNA, 711 bp, Triticum aestivum
  Clone ID: PAT_TA_22412
gcccgggcggctcggcccgctcccccccgttcctccgtggctcacgccgctccgctcagccgccgcccctccagcgtgtaccatgccgatggtggccgccgctgcagcagcgccggaccaacccttcttctcccagccccgccgccccccacagccgcctagtctcttctccataagaaaagccgccctcccgccgcggtgctgcagcagtcactcctcgcactgtcgctgccactgctcctggagcagcagcgcgcacgcgcgcaggagcagccattgccgtgccggtgcaacgccggaccacccggacgagccgccgccgtcgggcagaggcggccgttaccatccttgggaggacatcgccgagaagcttcagctcgacgacggagagccggcgcgcctcacggacgctgaatccgcccggacaatcgtcgaggtgaacaacaatgcaacggtgatgatctccacgctcatcgatgatggcgtgcacgagaggatcatctttccggagttcccctacttgaccgacgagaatggagatatttacttcgaggtcgacaatgacgatgcagtcatggaaaacattatgggcgacgataagattgcgcatgttatcattggacttgataacacagacgtctttgctgacttggacctagcggcggcatcatcaactgcatttgcacaagaagaagatgacgatgattctga

SEQ ID NO: 22413 - DNA, 675 bp, Triticum aestivum
  unsure (1)..(675): unsure at all n locations
  Clone ID: PAT_TA_22413
cggcccgctccactacccgagcaccaccttccccgtaggcttcccccaacctttccacgcccgcctcaaattctgccaccgcggctccccagctcctcaacgcgccatcgccgcggatccccaccgcctccacgcgtcgccgccgcagatccccacagcctccacccaccagcccaatccaccgacgccggcctgcccccacagcctagcgaaccgccgccccctctcccggatccgcgagccccattgacgcctgccgccggccaccgccaggatctcgcgccaccacccaccaccaccaaggaggccccccatctacgcgtggattccgtcttgccggaggttccccaagacggaggaacacaaggctgaaccgccggcgtcgggaaggagaaaacggggcggagctagccgacacaaggacaaactcgccgcgcctcccccgcgctcctccgcccgcgccgcgctggagggaagacgctgtcctcctaacgctggcctgggtcccggggtcgggcgccgcatccatcgcccggccgccaccaatcccgcccctttccgacccccctgacccccggcgcgccgctcccgtcttccggncccccgggtgccccctggtccgtgccaagcctccccgccggccccctggcttccctatgaaggcaaatnttntna

SEQ ID NO: 22414 - DNA, 593 bp, Triticum aestivum
  unsure (1)..(593): unsure at all n locations
  Clone ID: PAT_TA_22414
ccgcgtcgtccggcgagaactcccgcggcgatcggccatggcggcgtctctccgagcgtcctcctcccccctccgctcgcgcctcctctcctcccccgccgcctggtctccctggcgcctgctcctctcctcctccgtccactcggacgccgcccaccagaccgaaaccctcgccttccacgagatccagctctcccctgagaagccccccaccgccaccgccttcgtcctccacggcctcctgggctccggccgcaactggcgcaccttctcccgcaccctcgcctcccagctccgtgaccgctcccccgccgacgagtggaagatggttcttgtggatttgaggaaccatgggagctcagccaaggatcaaagggctgagcccgccccnatgatatgtcgagtgccggcaaagatcttgctgatttggttaaagctcnggggctggacatggncanatgtcgtcgtggttacatccangggtggaaangttgcacnganttcgcgganaattctcccgttgcgaatacngagatctgngcncctccaaananctcngggtggttgantcgnccnggaaaantaaaaattna

SEQ ID NO: 22415 - DNA, 913 bp, Triticum aestivum
  unsure (1)..(913): unsure at all n locations
  Clone ID: PAT_TA_22415
ggctcgcgcgctcctccacagcccactgctctgcctgtttctggccttttgccgttccccgttccccactcgctcgtcggcgatacggcgtcttcggtcctctgggggttgtctcgtggagggggaagcgatggggcgtccgtgcgtcggcgctctcctggcgtgcgccgccattgcagcttcttgctgctgctgcttccagctccagttccagggtgctgatgcggcggcgaccccgtcgttcggggacaacttcgacatcaccggcgccgaggaccacgtcaagaccccccccgacggccagacgtggtacctctccctcgacaacaagaccggcgttgggttccagacgaagcagaagtacctgttcgggtggttcagcatgaagctcaagctcgtcgggaacgactccgccggcgtcgtcaccgcctactacatgtgctcggacctggacgcggcgccggagcgcgacgagctggacttcgagttcctgggcaaccgcaccggccagccgtccctccgcctggccagcgggtaccgcagcgccggggccgccccggcgatgcggctctcgccgcggttccacccaccgccgcggtccgcgcctccgccttcctctggaaccccaagctgatcgtgtcgtggacaaggtgcccatcagggagtacggcaactcggacagcccaacaaatcttcccgatcatgaagccatgtacgtctnctccaagcanctggaacgccgangatgggccagcgccgggggncgggaaaaannggcgggacaagggggctntgaactcncnaaannaatncncngnngagcctggcctgnacggcgccccggtngcccnnccggacngtggcncgcngggcncaaananacggacngggacacgaaacanaaacaanccng

SEQ ID NO: 22416 - DNA, 748 bp, Triticum aestivum
  unsure (1)..(748): unsure at all n locations
  Clone ID: PAT_TA_22416
tgtaagatgttttggaactacattagcacgttttttgacactaagtttcaaaaaacgtcttacattatggaacggagcangagtacctaccaggctaccacccacatgaacaatattgacgtcctgccccacttccggtcgtacagtttaaggttctggactaagctattcgggtgcatgcagttcagcacatatatcatcaactccagtactccacagtccacactactcactaaatactaccccctcccaatcccctgtgtttccgcaagatacggggaagatttggtttcaaaatttcactcaagatccatcaagacctaatcaactaacttcaccgcatatcgccttcttggcaagacatcaatcatgttgtnaaattcctcttaaggatccattggattgtacccttccttaatacaggaaacacggcgagcatcaaccggcccccggccgggggtggatcgggcgcacaccttggcttggggccgcttgggacctctcatcgggagaatcagatggtacaaatgggatgcatgcccttcaatgtgttcctccggggacaccaccatataaagtgcnctcaagttcctgatctaacatctgccgctcaagtcaaanacgcgccaattctcgaaacaanaacacagcttagcgtacanatgttcaagcttccgcttatggatcantactcaaacatactgagaaggccannaactcnccaattgttcatgacagaataaaactg

SEQ ID NO: 22417 - DNA, 1126 bp, Triticum aestivum
  Clone ID: PAT_TA_22417
gcagagagaagcaacctaacatccagcccggccgcgagagagagatcccgccgaatccccaaacccaaccaccgctcctcgcccgcctccccggcgacctcagatctcgtctgcggcggcggcggcgacgtcggaggcggagggcggggattggaggcgaagatgttctatggggcgatggtgtgggatccgtggctgatcgtggcgcagatcgtctgcctgcagtgcctctactacctcgggctcggcctcttcatggcgctcctcgtcggcacccgcgtcccgcgcctcacgctcctctacctctttgactttgccactctcaccccgcgcacaaccaccggctggtgcgccatcgcctccttcctcctcgccgccatcgcaggtgctggattcatgttttatgtgattgagagagccaagaagtgcctggacttcgcagccaccctctacatcatccatctgtttatttgcattatttatggtggatggccagcttcaggtacatggtgggtggttaatattgttggtttggcaatcatgtcactcctcggtgaatacctatgcatcaggcgagagctaaaagatattccagtaaggcttcgtgcaagtgtttaatctcagaggctaaaggagtataggtggtttccaactgttgttaccccccaagagatgcttgttaatatctgcccttaggaatacagagacctgcgatgcatgctttgttgtgtgatttacaaccaatactattgaatcctgcaaatatctttgctgttgtaatgcatggtctctctgtagaaccaccataggtaaatgacattgcgagcgaggcttctgaactaccaccattggaatgggatgtcagctcattttttgtggcatgtatcaagtcttcctctcttatggatggtgatagaaaacaggtgtctgcttgacaatttgtatgactagataacaatatcttgaaattgctctttagcgagattgataatgcgaattttctcgcacattttgatttttgcaagctgtacattgcagatatcatacctagtttattatctctcagtaagtgagagctgatttctgtctgaccccacatgactgcttagaaattccatattccttc

SEQ ID NO: 22418 - DNA, 537 bp, Triticum aestivum
  unsure (1)..(537): unsure at all n locations
  Clone ID: PAT_TA_22418
gggtcgacgggggtggagagctcctcctacaatagactgtgtgcctctgatttntcttcagcattccaagttttagcagccatggcacttacgcttgtgttctcctctctcctcgttttctgtctcaatggcgtgagctccgattcaagctacttcacctccttgtttactctcggagattcctactttgacactggcaatttcctgatcatggctgatccggcgatacccgagtataatggcaacccaccctacggcatgaccttctttggccgccccactgggggcctctgtgatgggagagtcaccgtcgatttcatcgccgagcagtttggtctgccacttcttcaagcctccatgttgaatagctcggacgtgtctaaaggcgtaaattttgctgtgggtggcgcgacagcgatcgacatcgacttctatgaaaggagcaaactggttccgtacaagcttttgaacaattctctaaacgttcagctgggctggtttgaggaactcctgccggaaatttgcaccgcagggcgc

SEQ ID NO: 22419 - DNA, 690 bp, Triticum aestivum
  unsure (1)..(690): unsure at all n locations
  Clone ID: PAT_TA_22419
cccaactcctccaacgcccccaattccggccgccggcgtgatccgctccggctgctcgccacatcgccgccggtgtgctcctcgacgctggacccaactcccctgctcgacgtcctccattcccgcgggcacggccgcgttcgttggcggcccaggtcgcggcaccgtcgtaggctcgtagctgctcgtcggcatgctcctcgacgccggcctgctccgtggctctccatccccgccggcacccaccatgttttccggcggccaagctcgcggcgccacgccaaactccagcggccgcccgggcccggtagatttttgtgtgtgatttgagctgtaaaagcctgaacaaaggcaactattctgtattttcctttctgaattttattctcttacaagactggcctatgttgtaaacgaatttctgtgtgaatgaaagcttgtggaatttccaaaaaaaaaaaaggggggccgtaccaatcgcctatatgatctatangcgcgctacgggcgtcgtttaaactctgacgggaaaactggggtaccaactaacgcctgagaaatcccnttccactgggtaaaacaaaggccgaacgttgcttcaaattgcactatgnaatgaccccctncggataancgngggtttggacccagncgaantnaagcaacnncntttttttccctttcgaagng

SEQ ID NO: 22420 - DNA, 535 bp, Triticum aestivum
  Clone ID: PAT_TA_22420
agtgtgaaggagctgttaactcagcggttgatgtaatgcatacaatggcatcgtcgatgtgtaatttgttgtcaaaggtggaggggacaagctccgtggtgtatgagcttgcgaagcttgcaacacaagagcaaatgctgttggaccaatcaagggatctcttgtccacggtggcagcgatacatgtcaaacagtgcagcttgaaaactcacttgctgcagcgaaagcaaaggcagagcctccaaacacggtggtagatcagttatccgcgccacgttggtggtcactactaacatgacacggcctcatctttcctcactgggagactactactacgacaggtaataaagctgtaaccatttgttgggtgtgaagtgtgtcccccctaatcccgctccgaccgatcccgctgagtgtagctgattcttgtaatttttttcgagtgcatatcaccatagaatggccccccccctctttgcctccggtgtgcttccggcgggcgtatacagagagagaacctagtgtttgaccaaag

SEQ ID NO: 22421 - DNA, 496 bp, Triticum aestivum
  Clone ID: PAT_TA_22421
tttccctacttgttgatatggtctggctggaacaagctggttcaatggtgccttcagcaaagtcgccgaggctggtcatgttgccggctcaagaacaacagaaaagttccagatagttgtgtcaaatatatcagccaaaggacctgctgtcgttgcttgagcttgttgagtttgttttgggagctcctcttcctggggaaaatctgttggaaaccttgagcaagcatctaatgttggctgtgtcatcaagctttggcttgtaactgtgtatttctctccttctcatcttcttctttgaggaggtttattttcagggagtcttgacagatttggtagatgatctaaattttctttagaattttagaaccactatcctttttagtgtcggtgttcaattgattatagatgatagtgacattttggaccatggtcctggttcggtgtggtttcatgattgtcatacagtacactaaattttctgagtattgcacaagcc

SEQ ID NO: 22422 - DNA, 1596 bp, Triticum aestivum
  unsure (1)..(1596): unsure at all n locations
  Clone ID: PAT_TA_22422
cctagcacaggcgcgcagcacaggacaggacgcacgcacgccacgccacgccattacaaatcgccccaagcaccaaaccctacccaaccaggcaacaaccaaccgccagccctcccgcggatccccgccctcagctcgcgcctgcctcccgtctcgtctcgcctgtccttttttctctcccgccgccgcgccatggaggaggggaggagggggacgaggacggtgcgggtagcggaacatctcagatctggccggggagcgggaggtgcgcgagttcttctccttctccggcgaaatcgaccacgtcgacatcacccctgacggggcggcggcggggaggacggcctacgtcaccttcaaggacgccaaggccctggagatcgcgctgctgctctcgggagcaacaattgtggatcgagttgtgaacataacctctgctgaagattacatctacatccctgttaatgaacagcaacttgtgatgaatgaggtgacaagtacagctcctactgcagatttggaacaacctactgaggccaactcaagccccactagtgtttatgccagcaaggctcatgatgtcatgacaactgtgatcgcaaggggttcatgcaattcgacaagatgctgtgaataaagctaaatcatgtgacgagaggcatcagttaacgggctaatgcgtcagctaggatcagttccttcgataggcgtgttggcctttcacgagaagttaaatactgggatatctgtcgtaaatgaaaaggtgaaaactgtggaccaaaggttacatgtttctgacaaaacaatggctgctttgctggctgcagagcgcaagctaaacgatacaggctctgctgtgaaaaccaacaggtatgtgtctgctggaacaagctggctgaatggtgccttcagcaaggttgccaaggctggtcatgttgctggctcaagaacaagagaaaagttccagatagctgtgtcaaatatatcagccaaagggccagctgtcgttgcttgagtttgttctggagctcctcttcctggggaaaatctgttggaaaccttgagcaagcaccttctgttggttgtgtcatcaagctgtggcttgtaactgtgtatttctctgttttttttttcttcttctttgaggaggttttaactttcagggagtttgtcagatttggtacatagaggatctaaattttctttagaattttagaaccactattctttttagtgtcggtgttcaattgattataggtggcagtggcactttggaccatgtttggtgtggtttcatgattgtcattgatggcccatgtgtcatgtttctgcttctgcagaaattgtcactcaaattgagtaatttggaacatatggaactgcaatgcttctttgtgtacacattcatcttatgcagttagtatgcatttaagtttcaggggggcccggtaccaatcccctataggagcgataccgcgccacggncgctttanacgcgtacnggaaacctgggtncaacttaanccttgagaaatcccttccactggntaacaanagccgacgatgcctncnaattccncctaagnaatggacccc

SEQ ID NO: 22423 - DNA, 438 bp, Triticum aestivum
  Clone ID: PAT_TA_22423
gcagagtgtaggtggttggggcaattgtcatgcacagttcacagttggagcgcgcccactccatgagcatcaccccctcccctagatagaaagccgctgccccccgtccggacgacgagcctgcaggttgatggtcggccggacatggacgcgctcctcctcctcttcctgctcaaaatggaggctttccacatacagttcttcccgagcccctgaatctcgatcgtagccgagagcgcacacgctagctaggttggtagattgctgctggtggataggtacgtgcgttttgtaggcattaggcggcaggctggtgctgtgttgttgtcgtggtacagatcacgtggtggtggtggatgggcctcatggccgggatgctccctggcgtcgagtttgccaggaaggagaggctccagccggcggctgacgccccgtgcg

SEQ ID NO: 22424 - DNA, 1464 bp, Triticum aestivum
  Clone ID: PAT_TA_22424
cccacgcgtccggttggggcaattggcatgcacagttggggcgcgcccactccatgagcatgaccccctcctccaacctcccctagatagaaagccgctgccccccgtccggacgacgagcctgcaggctgatggtcggccgggcatggacgctctcctcctcctcttcctgctcaaaatggaggctttccacatacaattctctcctagcccctgaatatatcagctaggttggtagattgctgctggtggataggtacgtgcgttttgtaggcattaggcggcaggcgggtgctgtgttgttgtcgtggtacagatcacgtggtggtggcggtggatgggcctcatggccgggatgctccctggcgtcgagttcgcgaggaggcgacggctccggccggcgccggaggccccgtgcgccggcgcgcggcggccggcgttgatgggcgtgttcgggcatgaccacgcccacctcggctcggcaggttttgcgaagcagaggagcggcgtgtgcgaggaggcgtgggcgacgcagctggacagcatcgcccgggaggccaaggagaggctggatcacaagctcaggagccagagagaatctgtggtcaagaggcgccacagcacgggaagcctccggctcccggtcccgtcgagcaccaccagcgaccacccggcgaaggacacggcaggggcggcgagcacgctgcagcgagaggtgttcacgaagagaggcggcggccggcggttcagctggggccggaggaaggagcagcagcagcaggcggagtgcgcggtgtgcctggaggagttccgggcgggggacgtgctggcgcacctcccctgcgcgcaccgcttccactgggcctgcgccgtgccctgggtccaggccgcctcccgctgccccttctgccgcgccgccgtccgcctcgccgaccaccagcttctctagcgtgcgttaatgtcttcccggccggcgcggccgcgtgcgcggggccggcggaccagctgatcatggcgcctcggtggagccgcgtggcacagtacagcagacacctgcgcatgcatgggatcccttgtgtcgcggccgcgccccgccggcaagttgcggtgcactgctgctgctgtgtacgtgcggccgcgggtcgccggtgtcgcctgcgaaccaagcgtgtggtggtgcgcggggagacgtgtccggccgtgccaccgacgccgggagctgctcgcccggtgaccgcacctagccgtcgattattttgttgctgctttttttttaggatcttgttgctgctttctttgtgagcgttggattaacaatttaccatcaagttgcgctttgctgtgtgctgttatctgcttcatcatttccgaaatataagacgcgcttcacttttagcaatcccgttaacaataccataatagtttagtcgccaaaaaaaaaaaaaaaaaaaaaaaaagcttgta

SEQ ID NO: 22425 - DNA, 801 bp, Triticum aestivum
  Clone ID: PAT_TA_22425
aagtaccagccgaggctcgtcgtccttgtagacagttcgaaagtcgtctcgatccatcatccatcccgtctcgccagcagccgatcatggccgcgcaggcggcgccgccgccgccgccggagcagaagatgatggtggcgatcgacgagagcgagtgcagccactacgcgctcgagtgggccctgcgcaacctcgcgccccgccgcctcatcctcttcaccgtccagcccttctcccccctcagctacctccccgccggctccccgcgagcagttggcccgtcggtggcgtcgccggagctcatcaggtccgtgaccgagcaccagcggcagctcgcccaggcgctcgtcgacaaggccaaggccatctgcgccgaacacggggttgatgcagagaccaccatcgaggtgggtgatcccaaggaaaccatatgcgaagctgcggagaagttgaatgttgatctgctcatcctgggaagccacagccgagggcctatacagaggtttttccttggcagtgtgagcaactactgtagccaccatgcaaagtgtccagttcttgtggtgaagaagaaagaatgaaaccatgatgtctgctgtactcctgcacattgtctgaagaacccttgagtgtgtgtctacatgttgttgtttgtcatagtagctttgtttgcatataaataaagatactgtgccaatttggaaaccgctatgtattcagtcttgtacattaagaacgaataatgcaaagaggcaaactgagtggctggttattggaattgaatttgaagattcatggaag

SEQ ID NO: 22426 - DNA, 978 bp, Triticum aestivum
  unsure (1)..(978): unsure at all n locations
  Clone ID: PAT_TA_22426
ccgaggcccgtccccccttgcagacagggcgcgtcgtccttgtagacagttcgaaagtcgtctcgatccatcatccatcccgtctcgccagcaccccatcatcgccgggccggccgtctcgatccatcgtccatcccgtatcgccagcagccgaccatggccgcgcaggcgccgccgccgccgccgccggagcagaagatgatggtggccatcgacgagagcgagtgcatgccactacgcgctcgagtgggccctgcgcaacctcgcgccccgccgcctcatccccttcaccgtcccgcccttcgcccctctcaggatacctccccgtcggctccccgcgcgccattggcccgtcggtggcgtcgccggagctcatcaggtcggtgaccgagcaccagcggcagctcgcccaggcgctgcgtcgacaaggccaaggccatctgcgccgagcacggggttgatgcagagaccgtcactcgaggtgggtgatcccaacggaaaccatatgcgaagctgcggagaagttgaatgttgatctgctcatcctgggaagccacagccgtgggcctgtacaaaggtttttccttggcagtgtgagcaactactgtagccaccacgcgaagtgcccggttcttgttgtgaagaagaaagaatgaaactccgctatctactgtattcatggacatcgtgtgaagaacccttgagatgtgtatctacatgttgtttgtcacagcatctagttgcatacttgcatatgaataaacatactttgccaatttgaaaacaactatatattcagtcttgtacatgaacgaataatgccaagaggcaaactgagtggttgattattggggggggccggtaccggatccccggggtccgcctatcaccgcgctctcccccgccgctgacacgcctaagcccacgtnnctccanatgcnccgatggatggaacctntcggcataacgggggngngt

SEQ ID NO: 22427 - DNA, 403 bp, Triticum aestivum
  Clone ID: PAT_TA_22427
ccgtcccaagctccacccggccatggcgcgggcagatgggaaacccccccactccaccggtcattgcgtgagctacacacccgcgccaccggggagtctccaatgacggagatgaccggctcctctgcagaggagttggcaccggccagctagaggccgccgtcgctccagcaccgacggccactcactctcgtagaggccggccctgtcgccttgttactacgtcctcgccttgtcctgtgctcgttcgccatggatcttgcttcagtgttcctctttcgggtctctgctctctctgtttgctgatttgcagccagcaacacaccaatttggtgtcttattttccacttttactcgctcaaatagtctataaatttatctgtttgttgattcaaaggggggg

SEQ ID NO: 22428 - DNA, 1312 bp, Triticum aestivum
  Clone ID: PAT_TA_22428
gccggccgggctggcctctcgagtctcctcccttcccccgtcccctttcccctctcggatccgaccccccgcggtccgcccctcgccgccggcgaccatgtccaagtacggcaccatccccacctcctcctccgccgccgcgggggcgccccacctcggcggcgcctccccgctcgacttcatctcccgcgccaaggcccgcggcgcgacggcgctggccacgcgccggccatggcgcgagctcgcggacgtgcacgccgtcgggctgcccccgagcctcggcgacgcctacctgcgcgtgcgcgccaacctcgcccacttcgccatgaactacgccatcgtcgtcctcgtcgtcgtcttcctctccctcctctggcagcccatctccctcatcgtcttcctcgtctgcatggtcggctggctcgtcctctacttcctccgcgacgagcccatcgtcctcttcggccgcgtcgtcggcgacggcgtggtcctcgccgtgctcgctgctgtcacgctcatcctcctgctgctcaccggcgccaccaccaacatcctcacgtcgctgctcatcggcttcgtgctcgtcgtggtgcacgccgctctgcacaaggcggaggacaacgttgacgaagaggtcggccgctggtacgcgccggtgccagcgcagtagtgtgagatcgctcgccctccaactcttggttcgtggtccgtccatattattgttcagtcccgtgtatgcatttcggttcttcctactgctggatggtgtacaatttgtcaatgtgttcttgctgtgctattgtcacatgaatgcaagtgatgatccgcatgacgctggttcatctgaagttttgtcccagtgatgatggaaggttgtaaactttggtcgttgcgtacagttcaaagattttctcttgtttacatgtacccaattatgggagagaacgaatctgcactctgaagtgtgagaactcagctggcaggggccctctgtgaggctggtatgcattacttcgtgctggcaatttctgatctactcacgtggtttcatcttgtatgcacacggttttgtttgaaagagattgtccattccgcgccaattaaccgcgcggctactatctgcaagctgtcggacatctcgggaagtctatgtaggaaattgttttactctgttcattttatttactatatatcttctgaaatacgggatgtgtattgttgatcttttcttgtataccctctgtgtaacttaatataagacgttgttttgatactatgacagtgtcaaaaaacatcttacaaaaaaaaaaaa

SEQ ID NO: 22429 - DNA, 658 bp, Triticum aestivum
  Clone ID: PAT_TA_22429
atttgatgggtggagcgaaggagttatcagctttcctccaacatacaagtaccggtttaactcgaagaagtacacaagtgatgagccaaaatctggaagaaggacgccttcatggtgcgaccgaattctttcgtatggcaaggcaatgaggctattgtcgtacgagacggttgatacgaggctatccgatcaccgccccgttaaagccgtgtacacggttgatacagaggttttcagccccaaaaagttgcagagagctctcaccttcaccgacgcggaggtcgaggaccggctgtcctctgaggacgagcgcatcgctggaatctacagccttgggctgtcgtaagtccagggttaatatttgggccattttctgtggtgaggttgagccaagtcacaccgacagtgccgcttaaccctgtccagccatggcctcttggctgtctgccgagaccagcagcagatcagctggggctccccgctctcgtagtacgtcgcttccatgctctgaccatattttgaaaccagggcatgctatgtatgcatctcgttgtttgtttcccgccgtttgcctgttgtgtgcagcttcctgaaatgataatgccatctgtaatgatctgatctactccagttgtaattattaagagttgaaccctgt

SEQ ID NO: 22430 - DNA, 860 bp, Triticum aestivum
  unsure (1)..(860): unsure at all n locations
  Clone ID: PAT_TA_22430
cctgaatgcccttggctggactgttctcgcgcttccggcaactctccgagtgtcccgcccggggctccttgccgggcatccccgcccaagcgcatggctggtcttcgttgccgatctcgccgatatgtgttcccggaaggttctgcctgcccgtgatctagtagtgggtgatcattccttggtcgtctgtgatactctcacttgttcttgctttcactttgacctggattcccagaagcagcggattgttatgccttgcgctccaaaagaatgtgtctggcctaggctggtgtctaggtcccccccggtgcctgccagttgtgggtggggcgagggttgtaactgaactatcgcgacccgccggcttacgcctgagaaaccatccagcaagagcatgtgaccggagcgaattaagcaagtattctctcccacacgactgattgatcaagagaaaacaattgatcagatggaagtaatcaataccagaagttgtgctaactctttcggatgccgtattatggtgccttattttatggtgttccaatttgctagttactttgatcacaagtcgacctgtactttggttggttagactttcattagaccaggtaatgacaagtgaactggttctatttgaagttgtgtgcatcctctgactcccactggtcattaggatagattggctcctatggcattaggaagtcccatttgctctgctctgtccttcttgctccccccatttattttctatggactccacctggtactttattttggtagactctcattgcaccagctggtcagctagtgacaagtgaacttgtatnatcctctggttctgnaattctcacaagtcaact

SEQ ID NO: 22431 - DNA, 1079 bp, Triticum aestivum
  Clone ID: PAT_TA_22431
gctcgtcgagcctccctagctcatccgcgcttctctctctctctctctctctctctccctctctccctctctacatctcccttggatcctccactagctacgtcgtccatggatgtggtgctgcagagtcgtagcagcaacagcatggcggcggagccggaggaggaggcggacggagctccggcgagggccgtggacggtggacgaggaccttacgctgatcaactacatcgcggaccacggcgagggccgctggaacgcgctggcgcgggccgccggcctgaggcgcacggggaagagctgccggctgcggtggctgaactacctccgccccgacgtgaagcgcggcaacttcaccgccgacgagcagctcctcatcctcgacctccactgtcgctgggggcaaccggtggtcgaagatcgcgcagcacctcccgggtcggacggacaacgagatcaagaactactggaggaccagggtgcagaagcacgcgaagcagctcaactgcgacgtcggcagcgccaccttcaaggatgccatgaggtacctctggatgcctcgcctcgtcgagcgcatccacgccgccgccggcgatcccacaatcggcgacacctcgtgcgcgtcaggagtcaggtcgatggctaccaccgccgccacggccaccacatatcccgacaacaactctgccgccagcgcggtcaccaccagcaggtcggcatcgtcgggttccttcacgtcggagctctgcggcgaggagaaagaacctgcatgtccatggcagcggcgagaagacaacgagcggaggggactggatgcaggaagcggaccaagagttctgggccatgcatatgcagatccagcctgaggacggtggccttttccacgtcgaccacgagcttagcggatgggtgcagggcttctccgacgtcggcgtttcggctgacaatctctggagcctcgaggacatatggaagatgcaatgagttttctagttatcgaggagcgatttttatacttatacatgtgtatcatacaactaatagatcatatacatcggagtgaggatggcggcaaactt

SEQ ID NO: 22432 - DNA, 1080 bp, Triticum aestivum
  Clone ID: PAT_TA_22432
cccacgcgtccgcatcggcgtcctcgccgtcgccctacccatctcgccggcgccgtcggcggcccgcggggagcatggatgccatggaggaggatacgcctcccccgccaccaccaccgcatacgacgggcgcgaagcagccgccgtacaaggatcctgacgacgggaggcagcggttcctcctggagctggagttcatccagtgcctcgccaaccccatctacatcaactatctagcgcagaaccggtactttgaggatgaggcgttcatcgggtatctcaagtacctcaagtattggcagcgtccggagtacatcaaatacataatgtatccgcactgccttttctttcttgagcttctccaaaatgcaaatttccgaaacgcaatggcacatccagcaaacaaggaagttgctcataggcagcaatatttcttctggaaaaactacaggaacaatagactgaagcacatcctgccacgtcttcctcccgaaccaactcctgcgcctgcaccagcaccagcaccagtgccgacacctccacctgttcctgcaccaccatcgtctttgccaactatgtcagctgttggtgcttctgcaatgccccccatgcagtttataggaactcctggcaccaacaacccaaagaatgagatgagaaatgttatgggtggtagaaagagaaagatgggctagtgaaacatattgatcaacttcacggctgacggcatcccagagaagtggaaactcacctccctgtttcctgttggtagacctttgaagtagcagacaagttcgaagcagctcctgctttggagcagctggagttctcaacgtggcatgcgcacttggcccttggttgacttgatcatttatcttatcctggcctttgatgtagttgaatggaatctttacttgctgaaactttgtgccaacagtggcagccgtaaaagcgaacatttatcacatattcttagatggagccgcaacatttgcatacgcagctccatgaaacgctccattgctcgttcatattattttgctgcacagtttgtgcctggtaatggagggcttgcattgc

SEQ ID NO: 22433 - DNA, 1042 bp, Triticum aestivum
  unsure (1)..(1042): unsure at all n locations
  Clone ID: PAT_TA_22433
gcgacacgcggtcaccccccgcacccgcccgcatcgccgcgcgctccaccgccgctcaagcaagcaagtagcggcagccaggccgagaggatctcttctcgagggacgcgccgcacctgcccccccgccctccccggcgcccgcgcgccccggggggcgccccgccccctccccctccccggggggccggcgccgccgcagcaggggacgggggtggtgcgcgtcgacaaggcgtcgcccgcgtccagcttccgccagctcgacgacgccttcctgcagaaacaaacaaaaatctggcttggcgaagttctccatgtcaggtttgatgaagacattttggtagcagaccttctaggtgacggggaattgctatttcaagtttccaaagtgatatggaagaggctactcagaaagaacaaagaacaactcaagcaatcaaaagtatatatttatgagagaccatcttttggtaaaagcaacgggaaatatacgccctatccaaaagtagactcgtttctaaaggtatgccaaacccttggattagctggaattgatttgtttaccccttctgatgtggtcgagaaaagaaatgttcgaaaagtctgcatgtgcatacgctcactctctaaaaaggccgggatgatgcagctaaacgtgcctgattttgatgttgttacccacacaatagccatgcccaactatattgttggaggcatccgcagaagtctggagcagccacaatgcagttcatcttgttcgagtgggcacagtccgcgtgccatttctaaaagcatatttgaaggacagagtgatgagcaaagcgaccgacattatgactctgatgaagcagagagcagtctctttgtgctagggcctcaggattctcttgatgacgacaaactttctgagctnttgcagnttggtgatgccccccaggaagaaagagaaggctatggagacagtggtcatgaaatgcccaaagagaagtcgctagctgaatcagcgggatcacttgatgctgttgntatgggtgctgatacta

SEQ ID NO: 22434 - DNA, 615 bp, Triticum aestivum
  unsure (1)..(615): unsure at all n locations
  Clone ID: PAT_TA_22434
tttttttttttgaatggttcaaaatgattgagacgtcatgaaatttctcttttgaatctgaagtacaacttaagatttcaacaatactatactgcaatactagattttttagcaaacatttattctcttgttgtcattgttaacaacaacggaatgccaatttgaaggcgaaaacaagaacaaagtacctttggataaaataaagtttatctatagtattgttttatttcatacaagaattaatcatcatggtaaaatacgagaatatggcctttcagcaaccaggttgctcaaacccgaccaccagcagcatcgagaccgccacctgcaccagcaccaccgtcatgcccgccaccaacacctccaccaaagcctccaccgacaccacctccggcacctataccgccgccaagcccaccaccggccccccgccaatcgctcccccgccgcatggcgccgactccgccgcggcccctccgcctccccgccggtcgctcccagcctctctattctcccccaggcccccccgctccacgcccctcagtccccctcccctggtatcccaagccgcccacgctcggcgtcctcccctggctggcccttagncaatcccng

SEQ ID NO: 22435 - DNA, 839 bp, Triticum aestivum
  Clone ID: PAT_TA_22435
caagaaagaggtgtacaggacaaggagagataccagtctcagttggctgcttataaagaagaactgagaacaggccagcctatgagcaatcctatgcctattatcggcaatgcacctatccagcagacatttccccagacagaagtaactattgatgaagtggactccaaagtcagtaaaggagatatgctgctgtccaatcaaaggtacaacaacagtgacgaaggtgttgattcaggtggaaaacttgttgaagatgaagagttcaacacggatacatctcctgagcctagcattgataccactgattcgcctgggctgcttgatccttctgctgatggcgaccgatttgaacttcgcaggagggagaaccccaacaaaaatgagaaacagagcactgcacctaaataatgattggaaaatgacttaatggtacattcttctggtacaagattggaagtaataagttgaagcgagcggcaggttatgcctactgccttggatgtaggatcaggttgatgtctcatttttattccttctatatatcagcattgttgtagaaactgctacgggctgatttatgtgggtaacgctctattagcgcatgaaatgctgtggttttttcttcagtttggaacatcccaagttgatatgttgaattggttggatggacgatagatggttttgtgtcattttggtttcttgctgacattagtttcggcctgtagtaccactgtaacgcgttgtaacatggcttgatgaacttgaattcagaggaaatgaacacgatatagaactggatgtactcaaaaaaaaaaaaaaaaaaaaaaaaaaaaaaa

SEQ ID NO: 22436 - DNA, 595 bp, Triticum aestivum
  unsure (1)..(595): unsure at all n locations
  Clone ID: PAT_TA_22436
cgcatgttcccctcacgcccgccccgccctcggcccctcccccccgccccccatcgtcgtcgtcgcgcgctcgctctccctcggagctccccgcgattcctcccatggacgggctgcctggggagctgtgcttcaagatcttccacctcctcgatcaccagtccctcgccgccgctccccgagtctgcaggaagtggaacgcgttgacctgcgacgacgagctgtggcgcaagctgttcgaggaccggtggggagcggacgccacggccttctacgcgccggagccggagggcgccaagccctggaaggacgtcttcgtcgtgcaggaccgatgcgaccgatacggcctgggcgtcaggatcatcagggaggggaacgactactacctgatctaccaaggcgaagatcaagagctacctgggcacgaactgcgaccccaggggcccgcccccgcggggcgcccaaacgggcaggatggacggatctctccgcctcgcgtcttcctgcggctaccggaccctgcgtgcgccggcgccactcctgtctagactgtccgcgtccgtcatctgccttcctggtgctggcatagggtcnt

SEQ ID NO: 22437 - DNA, 647 bp, Triticum aestivum
  unsure (1)..(647): unsure at all n locations
  Clone ID: PAT_TA_22437
tgcaaggnnttgtcagcgtaagtgtacccggtttccgtcngacgtttaacgacgcngtgggngtatggctatntggcnattggtacggcccccccccggctcctctcgtttggtgcccccctgtgtaaccgcatcccgtttaaggccttcgagaagaaggctctagcgcagctcaaggagttgctcgccgtgtcaagacaaaccatttgatgaggccctgacgagctctttgaagtggttcagcactgtttttgggtcgaggtggaaagagcagggcgggattgcttggaagctttggcattgaaggtgagcgactacaactgcatatgttggttgactgccggaggaatccccaccctccgcccttcttctccgcctgcttttgatttgcatgttacccctttctccctgccgattgctcgaatcctccaagcttcccccccggtgatggctcttctgttagtggccaacaanccaagtgtcttgtttatccctattattgccgttgccgactcgccgatgttcccagccggccaggcccccaaacagcaaggttgcaggtacagtacagccagtggaagcttgcactacacatctgnccgtttgtaataatccataaaggattngttctatatgtggttttgcct

SEQ ID NO: 22438 - DNA, 659 bp, Triticum aestivum
  Clone ID: PAT_TA_22438
ctctgaactgcgctctctctttgagcaatttggggatatccggaccctttacactgcaaccaagcataggggctttgtgatgatatcttattttgatatccgagctgcacgtggtgcgatgcgttcgttgcagaataagcctctgaggaggagaaagcttgacattcatttttcgatcccaaaggagaatccatctgacaaagatttaaaccaggggactcttgttatctttaacttggatccctcagtttctaatgaagaagttcgccagatttttggaacttatggggaagtaaaggagataagagagacgcctaacaagaagcaccacaagtttattgagttctacgatgttagggcggcagaagctgctcttcggtcactgaataagagcgagatcgctggaaaacgcatcaagttggagccaagtcgtcctggtggaacacgcagaagcttggtgcaacaccttggtcatgaactagagcaagatgaacccagaggttacaggcattctcatgttggatcgcccatggccaactctcctccaggggcatgggctcaatatggcagtccaaccgacaacaatttgctgcatgcattcagcaactcacctactggaaatggaatgagttctatcggaatgtcccctacaatgatgt

SEQ ID NO: 22439 - DNA, 574 bp, Triticum aestivum
  Clone ID: PAT_TA_22439
gctaagcttgtcatcatggacagaagggcggtgtgcatcagctggcttgtgatcctcgcgcttgtgctgctcgccggcccgggcctggcggcgtcgtcgctcgcgggcggcactgccagcatcgacgtggcgcggcagttgatgccgtcgtcgttgatgaggctggaggacggcgtggcgccggagctggcggtggacctggggctgcaccggcgcgtcctcgccggcatcgccccggggggcgggaccactgaacgccaacaagccagcctgcaagcccaagtgcgcggagcccggacagcccaacaccggcccgggctgcctcaaaatttatggctgccgaaggaggaagctgagcggcacagcactaaagacgtcgactcaacctccggcacctacacagccatgggtgcatgcactcgcgttcccatgttctatttccgtttccattctgcaattcaacaccgcgtcgtcttgttgtactatggcgctggggcggtgttcgtcccccccgctcgatgatgatcaaaagtgaatattatcttacaaccagtttgtgaataaaaaaaaaaaa

SEQ ID NO: 22440 - DNA, 612 bp, Triticum aestivum
  unsure (1)..(612): unsure at all n locations
  Clone ID: PAT_TA_22440
cccaacctccactgcctccatagctggctggcagcctagcttagctcctgctctgctctgctgtctccgccggccggttagtcaccgatggaagccccgctcctcctccccgtctccaccgccgcctcctcctccacgtccatcaccgtcgacgatgacagccacggcacggcccacaacgtctccccttcccgcgcctcgccatccggccggagcatcgccgcgcgctacctcgccgtggccctcgtcgccgccgtctcgctgttcgcgcagcacgaggcgtccaagggcttccgcatcgacgtcgtccggggcggtggcgcggccggtgccgccggccggcgcttcgacctcctcttcgtcgccaacggccgcgccgagcgcgtgctcaacgcgccaaccgccgcgtcaaggagacgctcttccaagaccctcgttccgcgccgccgggtccccgcgtaacgtgcggcgatggccggcggaaactcacgccgatgagcgacgtcgcgctgcaaggactggagtagtattcctaaccaagctctgtccgtctcggaggagcaaaacccgggcgcgacttcctcgcgtgccccccttgccnaantgtntgaa

SEQ ID NO: 22441 - DNA, 580 bp, Triticum aestivum
  unsure (1)..(580): unsure at all n locations
  Clone ID: PAT_TA_22441
ccgaggtgtctcgagtttttttttttttttttttttttgagcaaagtgtcctttcttattattaatttctttccttgcaaaacaatcatcgttggagccacgtacgtacttacaagacttacatctgaaactataatcatcatatggtacagataaagaatgcacccggtttaccaaagcaatgccgacgccgtgatgtgtcgccgccggcgacacgcacggcccccgtggtgagcaatcaaaacttgacgaagaaaaaaagacatgcacgagccccggtcccgtacgttcctctcctcacctgacagcgccactccaccaaatcatgtcgttgccttcccttccttccttcacactcaacccccaccctcctcccccaccagaaaaaaagcaacaccgtccggcctcctatgcctgcgaacccgcgatctcggggagtcgtcgtggacccnttattggcttcggnantgttgcngtncccgttggtcggtaacggtganttgccactgtnagggggngcaaatcgccaaaaggccccttccgggtagntgccaactgccgggggcgccnaacnatccng

SEQ ID NO: 22442 - DNA, 605 bp, Triticum aestivum
  unsure (1)..(605): unsure at all n locations
  Clone ID: PAT_TA_22442
agagaactagtctcccggccccccctcgtgtttttttttttttggccttagttcgacgagttcctttactttgttgaagtagtcatttaccgagagacattcttcctcagatttgccaattacatggatgcgaggagaacatgcacccacaggtagaccagcgcgcaaccatggttgacacagcccgcacctactccgagtaactctggtgatattgacgcaagcagggaactccacatcacttggtcttgctcagcccaagactcacacccgggatttggcaccttatcggttccacctacatcgtttgttgctgacgacccccgggggggtccccttggccccctcggtcctccggcggacctggtcgcgccgcacgcccggcggtccccgattttcccgcgaagtccctccctgcagtgcccccagtccttccgatccccgctgaacccctatgccaagtctcgtgccggcggccccagggtgggttggtattcaccctctcccggccagcgtcccagggctgggggccgctgcgctccgccccctctgccgcccgcgtgctgctgaccccgtcggcccgctcccccccgccgtgcagcann

SEQ ID NO: 22443 - DNA, 1609 bp, Triticum aestivum
  Clone ID: PAT_TA_22443
tcggcagctagctacccactcgggtcgtccgtcgtcgggtgtgcgggctgagagacagagcaagaaggcagggagatgaacggcggagggggcgtgggcgcgggcacccagatcagcctgcggctgcagtactacgtgctgctggccggggtgggcgccgtgctgctcgtcggctgcctcaagtccatgccggccgcggctggcctggcggccggctgcgggccctgggggagcggcctgcccgtcgccacccgcgccgcggcgccggacgcggggcctgccaccacccggtcccccgtgctgcgcttccgcttcgcggcccccaacccccacacgggcggcatggcggcggccagcggcctcgacattgcgcgcccggggggccgcgcccacctccgccgcccccccggacgcctctccgacggccgcctcgtcatcgacttcatctgtgagagcctgggcacgccgcatctgcgcccgtaggacagggcgctcggctcccacctcagcaacggcgccaacttcgccatcggcggctcgacggcgacgccggggggatcccccttctcgctcgacgtgcagctgcatcagttcctctacttcagaaccaggtctttcgagctgctcaacaaaggtgagaagacgcctgtggaacgggaggggttccggaacgccatctacgccatagacatcgggcacaacgatctctctgcctatcttcacctcccctacgatcaagtgctcgccaagatccctgccatagttggtcacatcaaattcggcatggagactctgtacgcgcacggggcgaggaagttctggatccacgggacgggggcgctgggctgcctgccgcagaagctgtccatccccagggacgacgacagcgacctcgacgccaacggctgcctcaacaagtacaacaacgtcgccaaggccttcaacgagaagctcgccgagacctgcaaccagctccggcagcggatggccgacgcagccatcgtcttcaccgacctgtaccccatcaagtacgacctcgtggccaaccacagcaagtacggcgtcgagaggccgctcatggcgtgctgcggcaacggcggcccaccccacaactacaaccacttcaagatgtgcatgtcgggggagatgcagctgtgcgacatggacgcaaagttcatcagctgggacggcatccacctcaccgagttcgccaacgccatcgtcgcctccaagctgctcaccggcgactactccaagcccagggtcaggatcgccagcctcgtcaactccaccgcgcctcacgatggctagcttggcttggatcattcgtcgtgtatctgggtctgccggtgccattgatttgatttggttggcctaccactgccagagatgatgagaatgtgtgcatgatgcagcagatcagtgagtgagctgagagcaatcatctatctcttttctcaaggctcagatgagtgatttgaccaagaggggaaattcatggccgactcaatcaaggcacatttgactgacgtgtgtgtaaatgtaattcactttgaaatttgatcaaggaatcgatggagtgcatagttttcttcttgtaaaaaaaaaa

SEQ ID NO: 22444 - DNA, 653 bp, Triticum aestivum
  unsure (1)..(653): unsure at all n locations
  Clone ID: PAT_TA_22444
acgcgccacgcgtacgccggcgtcatggagaaacttctttgatcctatctaccgcgagacaacctatccccaatcacctatctcctccctcctttcccccacatctacccacgtcgtcaggctgtgaggcagccggctacgcgtggagacacacggcgtggcgagctcgaggtgttaactgcgtgtggagacctcggttggagatgctggaccggctggggaagctgcaaccggcagaatttttctgttgctggacatggccgttgcgagacgacggcggcgagccagagaagaggatgccaagatgctgcaaccatgggggccgttatgctgaaacctgcatgtgttccaactgcatgtgctacaacgaccatgccatgctagaggacggaagtacaactccgaaggaggaaaaccaccggcacggattctttttgtttttggcnggaccttaatttttttggctgtnacatctttttgtttggttgggacattncttttttggcaanaggagggcacaacccacacngtgatnacgacaccaccgacaggcaagnagcgccaaggtggcggcnacngcaagtttnggaantaaaacgcttacaaaggcccaggtaantttctttctaacanncatggggagnaagtttcca

SEQ ID NO: 22445 - DNA, 643 bp, Triticum aestivum
  unsure (1)..(643): unsure at all n locations
  Clone ID: PAT_TA_22445
acggaagtagtactacttacagacagtaggaggtgaccgttgctttatcgatggccaattgattgaaaaacggagagcccccctcattgggccttggcaccggttcaatcccaaggaggtcttgctcctctttaactctcagcatacaaagtactcctccccccagactctctgcaggttttcatgtaccaatcatgcaatcttcgcatcatcgttgttagagatctttcatctttgacgagaggcttcccgtactcgtatctgtgtatcgtccacctccaagatatcataatgtacatcgtcgggcaggtaatctccaggattgccaccaccgggcaccatcctcggatcattagcgacgatgtcgctagcaacaccttgagcggggggcacgattgcttcgcttgttcgccgagctggggcaattgttttcccagctcgtcgttcttctccccggtcacctctggtcgccctctcccgccccgtcgccccgctatatggcccttctgccttccgcgcatcggggccttgcagcggacactttcgcgccttctccggggccgcccctcggcgcgtcgccctccccggcccgatcatcacaatngtcgncatttngtttccccgncnccgangaaatccgngn

SEQ ID NO: 22446 - DNA, 615 bp, Triticum aestivum
  unsure (1)..(615): unsure at all n locations
  Clone ID: PAT_TA_22446
ctccagtgcacgcacgctcgcttcccccgacctcccttcctcgctccccctttgtggatataatcatatcctttcccacgaccttgtttaatcgcccacaaatccaacgccgccgccgccacatggacatggactcgccccctgtgcctgtgcccatgccgccgtccaagccggccgacctctcgctcacgctggcgccggccgcgcagtccgtcgccgaggctgacgggggagccggggcgggccgcgtccgcgcgtgcgtcgacggcaaggacgtgcgcctcttcccctgcctcttctgcaacaagaattcctcaagtcgcangcgctcggcggcaccaaaacgcgcacaagaaggagcgcagcatcggctgggaccctactctaaatgcgccnctcctcaacgcactccacccaagccgcacgcccaatctccggngccacggctccggggctacccggtctggcgctggcgggccgngcangcctacgcaancgtgcctagcggcttgccaacaagttccaatcgctccaaagtcataaggtcggtcgacggctcagtanancgcngcgaaggaantcgngtctcgcggggcggcaactgnaaaaaggatn

SEQ ID NO: 22447 - DNA, 1019 bp, Triticum aestivum
  Clone ID: PAT_TA_22447
aggtaagaaacagcctcgcgaacatcccggtccaaaaaatggccatggcaatggccgcttccttcgccgcccgccaccaccacgggcacctcgccgccggcctcccctccacccctcaatcgggcggaaggactagccgcagcgctgccaccatctccatgaaggctcagaaaaagcagagcagtgagcctggaagtgggaaggggggcggggacgggcgagtaagcggtgggcggcgagtgtggcgtcgccggaaactgaccaaagaggatgacatgttgcgttacaagttggatcgtatccctttcttagaagagaaagtgagaaaagtaagggaaaatgggaagcttgtgtgcttggatatcaaccagctcatgttatctcaagagaacagattcgcattcacaatggaggtggcagaagaagctaacgcctatcttgagaagcacaggcatgagtatggattgaaaaaacctatattgcatgtgctcagtgaccgtatgaatgaagctggattttctcggccagagggttacctttatccttatcctatcaagcctgggccttatttcataaaagaagaagggaattgaatagaatcacatgctctatagaccaaggaacacaagtttggggggttcctaacagaatggagcggtctggtctgcggggctcctagtttttcttgtatacactacgcagttgaggaaatttgaaagctctggaacaacttacaaaatcaaaatgctcagataaatcaaaatcaagatacgttttgtcccgggagctctgaagatttgcacccaggcctccatgttagtatataacgtgaagcgaaggtagcctgttgtttcttgacgtcgtctgtgttgcttcagtgctgtcacgggatcggaatgctgaggtttctgaacaagatctcctggcccattttattgttgtcttgaaatattgtatagatattgggatatttacgataatttacgtcttctttcgattaaaaaaaaaaaaaaaaaaaa

SEQ ID NO: 22448 - DNA, 577 bp, Triticum aestivum
  unsure (1)..(577): unsure at all n locations
  Clone ID: PAT_TA_22448
cctcttctctgctcctcaacccacgcaacaccacctccacctcccaccccgccgccgcagcacctccacctcccacctcgccgccgcaccacctccctcccggtgccgccggaccccatccctccccgctccgctgcaccgcctcccacgcgcaccatcgcaccacctcccgccccgcgccaccgcagtagttcctcctgccggccaccgctactaccttctaccacagggagagagtgcttcgacaggcttccgtcggcgagatggggggtaggaggtgcatccgcctccgatagcactccggccggccatgtccacgcagactgggcgcgccgccgccaacctgttcatcatcccccgaggcgacaggctctccaccggcggtgccctacagatctgggtgggatccggnaagtccggctgccgcactccctcctgttgacgcaaaggttgnactcgcccnggcctgctcggggtctgattcgggcgtnatccctncngcttttgggtttaaatactattctcaangtaattcggacaaatnagattgaagncnatnatctctaaaaaaaaaaaa

SEQ ID NO: 22449 - DNA, 597 bp, Triticum aestivum
  Clone ID: PAT_TA_22449
caaaattcggtttccctccctcctcccccgcagccgcgcccccatcccgagccccggccacaggcgcagcgccgaatctcaagcggaggaggagagagggcgagggcgacgccggcgccgacgctgacatgagggaggaggcggtggagcggctgcgcggggtggtgcgggacagcgtcgggaagcacctctacacgtccgccatcttcctcgcggacaaggtggccgcggccacgggcgaccccgccgacgtctacatgctcgcgcaggcgctcttcctcggccgccacttccgccgcgcgctccacgtgctcaacaactcccgcctccttcgcgacctgcgcttccggttcctcgccgccaagtgcctcgaggaattgaaagaatggcatcagtgtctgatgatgcttggtgatgccaaagttgacgaacatggcaatgttcttgatcaggatgatggcagtgacatctattttgataaggacgcagaagatcacgagatcaatatcaaatcagctatatgtttcttacgtggcaaggcgtatgaagcactggataatcgtgatcttgctcggcaatggtacaaggcagcagtta

SEQ ID NO: 22450 - DNA, 1639 bp, Triticum aestivum
  Clone ID: PAT_TA_22450
catcctcctcctcgtctccgcgcctggacctcgcgcgcatctcgcccgcccccctctcactcgcccaggtctagggttccggcgcccgattcgggccgaattggacggcgccgcggcggatcgggggtcggaggagcgcgggcgagagatgacggggaagaagcgagggagaacagagcagagcggagcagagggcgatgaagatccagtgcaacgcgtgcggcgccgcggaggcgcgggtgctctgctgcgccgacgaggccgcgctctgcgccgcctgcgacgaggaggtgcacgccgccaacaggctcgccggcaagcaccagcgcgtgccgctcctccccgacgccgccgcgccgcccaagtgcgacatctgccaaggaggcttctggatacgttcttctgcctggaggaccgtgctcatactttgtagagatttgtgatgttgctatacaccccagtgaattcctttattttcaggacataaaaggttcgtgctgagaggagtccacgtcgacatccaccctgtctctcctgttccgggaacttgcattaccctgtgtacgactgcgccatgttcgtccctgaagcaccctccctgcagaccaaagaagactccttcagcgcaacttccaggtgaaagcggtgcatctattcccagccaaaatgtaatcagtggagattattcaaggcagatttctgctccaaataccaagacaggaatgaccaattggactatggacaacagtgcacttagattggcagagcctccacctaagtacctgtcagatggaaattcaaaacttctgctctctaatcagaccaccacagctttatccaaccaaatgaacagagatagtggccgggcttacaacttacccctcgcgttcggcaatgggtcagacagtttacctgattggcctgtggatgaattcttcagtaacttgaatatggcccaaactttggcttcactgagcatggttcttccaagggtgacaatgctaagctggggagtgctgggggatctccacagtgccgtctagctgaaggcctgtttgcagaagacctgctaggccaggtacctggattagatgctgaggatccatgggtggtgcccgaggttccctccccaccaacagcctcgggtctatgctggcaagggaacttgcattaccctgtgtatgacggcgccatgttcgtccctgaagcaccctccctgcagagctcccaggaccacttcactgcatctgctggtttcaagcgtcgaaggagagagttttgaatacccgaaagaatatagcgttggacatatctgtcgaacaggggatcttgctgtaggtctcttggtgagccaaatcgcatagacaatcattcaaatggatgggttcttcgccggtcggtcaaaaaaatatatgttgtaattgtacgccttttttgggtcttgttgctgaagatcatggttagtgagttgtgagctctgagataacaggtttgtgtatagtgaaataaagaggagcgtcgtcaacaccatgtactatacaggtttcaaaattccattgagatgcatcagaaatcaatgttggatttgtgtgattcgattcgcatgaactttacatgtcttgaatcaaattttagtgct

SEQ ID NO: 22451 - DNA, 850 bp, Triticum aestivum
  Clone ID: PAT_TA_22451
cacgagctttctgtcagagccaaagaccaaaagctaaagccacaactaaagacacaaccaagtccagtttaggaagacgcaaagatggagttccaagggcagcacgacaaccccgccaaccgcgtcgacgagtacggcaacccgtttccgctagccggcggcgtggggggagcgcacgccgctcccggcaccggcgggcagttccaggcccacaggggagagcacaagaccggtgggatcctgcatcgctccggcagctccagctccagctcgtcttccgaggacgacggcatgggcgggaggagaaagaagggcatgaaggagaagatcaaggagaagctccccggtggccacaaggacaaccagcagcatatggcgacggggacagggactggaggagcctacgggccgggaactgggactggtggagcctacgggcagcaaggccacacaggaatggccggcgccggcactggcacgggcgagaagaaggggatcatggacaagatcaaggagaagctgccgggacagcactgagccaccggctccggctggctgcttccttgtagctacgggtcaaagccttccagttccacgtgatctttgttcaataataataagatgaagctgaacgaaaagttgtctctgatcgcatccgcgtcagggacacttttctgtatacagcgtgcgttgtgtctgttacgtttgtctgttgtgtcttcatgttgaaaaaaacttagtatacaactgaacttttttttctatcaaggaaatcgggcccttgttgatgttaaaaaaaaaggagtccatgccatttttgtgccttaaaaaaaaaaaaaaaaaaaaaaaa

SEQ ID NO: 22452 - DNA, 716 bp, Triticum aestivum
  Clone ID: PAT_TA_22452
gcctcatgattccactactgtttagcgtggtcgcggccgaggtgccgcggcgacgcatcggctccttgtcaggacaaagctgaggagcagcatggctgtgggcgcagtgaccgaggcgatggcattgcgtcatttctgcctccatttcataattttgatgatccagataaggctgtttgtcctggtttggaggcagatggtaaaattcagacctgtttttatcactggtggttgcgaatctcaggctttgcatgtccgtctatgacatccttgccgtcgaaggcagattcatctttccaggatagggctgctcgaccgtataaagctctacaggattcgatgatggatgtgtgaatgtgagcaatcaggatataaattcttccaacaacaagacatgcattcaggaatatgttgcgtcttagctttgcagcttcacattgtaggattaatatttggcacctgacatgagattgagaaataccatgctttaattaattattagtacataccttgtgcagggcacataaaatatatctgatatcgcttttttatgaatacttttatcttttctatcctaattcagtagcaccaaaaaaaaaaaaaaaataaaaaacaaaaaaaaaaaaactcgagacctgcccgggcggccgctcgtgttatgtatatttttgtcctttctaccctaattcagtagcatcattttttatgttattctt

SEQ ID NO: 22453 - DNA, 1342 bp, Triticum aestivum
  Clone ID: PAT_TA_22453
catttatccaatggtcgccatcgccacctccttctccgccgccgccgccgtcgccgtcgcccgccggagctccccggctcacctccagctcgtcgctcgccgccgcctcccgttctgcacagccgcctcctcatccaccgtgccacctgccgctgcggcgggctttgggtgggccgacgccctccgagttgccagcgaattcggggtcggcgatgagtccgacctttcgggatacttccagaaggtcgacatctgcaaccgaggaatgggtaacaagggggagttcgtggagttcatggtggaggatcaagtggtgggatacatccacaaggggtttactgaacacctgagggacttccatgatgtttttaccattgtctcgggcagcaatggcaagaacagtgtggagcatgtgactctccactcatcgctcaggactccagaagatcgaacaatcgccatcggagatgtcataaaaggcctaggggaactcattcctggtatacgaaatgagctctatccagtaacctcatcttacggcatgcctgtgtacttctctctggaacgtgctgctgctccctactttggtataaaggcttatggtgttcatatgaatgggtacatcgagaagcatggtgaaaagtctctttggattggtaagagaagtgatgtgaagcaaacttaccctgggatgctagatcatcttgttgctggtggcctgccttacggaatctcctgtaaagagaatatcatcaaggaatgtgaagaggaagcaggaataccaagatccatgtcaaccaacgctacttctgttggagccatttcttacatggatatcaatgggtttagatacaaaagggatgttctgttctgctatgaccttagacttcctgtagatttcgttcctaataatgaagatggagaagttgatagcttcagactaatcccggtaccacatgctgcaaacattatacggaggacagattttttcaagccaaactgcaaccttgtgatcattgacttcctcttccgtcatgggtacataaacccagactgtaatgggtacctgaagctgctgacaagcttgaggagtggtgattgttcctagggcttgcagttcgctgttcaaacagaagaatcagattaccagcattaatcgttgattttttggagtaagctagatggctgtccatcaaaatcagaatattaactttaaagtacaaactgtacatgattttttttctttctctaaatgcatttctgttcgcacattatctttgactcttcagtgagtttagggaggtaaggaagttcaggaggaaaggggggcataataaaagga

SEQ ID NO: 22454 - DNA, 1318 bp, Triticum aestivum
  Clone ID: PAT_TA_22454
ccggcccccgcgtcccgcggcgaccccccacgcgtccgattgacttgaccggactcgaactcgaccaaccgccgcgtcgagcagcgactgcttcccattccgattgagtcggctcccatggcggctccactgcctcgcgcccccgtctcctccccagcgagccgcgccgccctatgtccagcccgctccaacccttgcacggccgcggcgccatcctcgggggccctcgggtggcggcgcaggcagccttgcccggtgctctccattgcgccgggctccgcccggtcgacgccagcagccctcgccgtcgatcccaaggttgaagcgttactagacagtgtgaagtgggacgtcaaagggctggcagttgctattgcgcaaaatgtggatactggagccattcttatgcagggctttgctaacaaagaggcccttgcagcaactatatcaaccagaaaagctacattctatagccgttcacggtcttcattgtggactaaaggggagacatccatgaacttcatcaatgtgcatgacatattcttggactgtgaccgtgattcaataatataccttggtacgccagatggacctacatgccatacaggggcagagacctgctactattcttcagtctatgatgcactacaaggttcaaagtccaatcaagagaggcaggtcgccacaactctctactcgcttgaagacacgatcagtaggcggaaggaggagatagttactgaagggagtggtaagccatcatggacgaaaaaactactgcttgataaccagctgctttgctcaaaaatacgtgaagaagcaggtgaactaattgaaacactgcttgagaatgaggacaaatctcgtacagcctcggagatggctgatttactgtaccacgcaatggtgctcctcagcgtgagggatgtgaagatggaggaggtgctggaggtcctgaggagacgattttcgcagtctggcgttgaggagaaggctagccgcaagaaatcttagcatgatggcatgtaggtggatggatgaattccatgtgattgggcagggtgtagtatggagtagtccagttctgctatggtaccacctgagatttatgttttctcatcatgctctctaagaagaagactgtgaacttgtcttgtgttttttattttaccttttcccttgcacagtcgcagtggcgttgttgctgctttggccaataaagcataatatgagtctctgacccatgatatatgtgggtgatttatagtatggaaactatgttttgtcgtgcaaaaaaaaaaaaaaaaaaacgccccta

SEQ ID NO: 22455 - DNA, 561 bp, Triticum aestivum
  Clone ID: PAT_TA_22455
gccggccgtttcgggctctaaaaaaacgctctctggcagttgccctatttcctcccgtatctcttccccggtcgccggacgccggacgccgccttcccgccgccgccgtcgccgcagcgtcacagataaataagaacaagatggtgattaatggtgatgcacctgcaagagggagtgcagcagctgcggcaagcttgcgcagacgtagaaccaccagcggtgctgctggaggtggtggtggcgccagtacaatgcttcagttctacactgacgaggctgctgggcgcaagatgtcgccaaatgctgttctgatcatgagcatagggtttgttgccgtcgttgctgtgctccatgttttcggcaagctgtaccgttaggttccatatgcaaggtgcaccttgaacagaggaactcatagacttaaataactgcatagcaaatgactgtcgtatcctgaagacatttccatattaccatataagtttatatacctgataatatatactgagatgagaagttaattatggtcgaatacttgcaaaaaaaaaaaaaaggccccta

SEQ ID NO: 22456 - DNA, 815 bp, Triticum aestivum
  Clone ID: PAT_TA_22456
ccacgcgtccgatttcgcgctcgaaggcacgcaccaggtttggatttggaagccagacggacaagaggagaggaggatcagcgaggccgagttcatcaggtagataaaagaagatggtggctaatggcgatgcactgggccggcggaccccggggcaggagggtccggcatgcggagcagcgttaatcaagaaggtaggagaggatggtggataaaggtgacgcgccctgcaaggagggagtgcagctgcagctggcaagcttgcgccgacgtagaaccaccgggggggggtgctggctctgctggaggtggtggcgttggcgccagtacaatgcttcacgttctacactgatgaggctgctgggcgcaagatgtccccaaatgctgttctgatcatgagcatagggtttattgccgtcgttgccgtactccatgttttcggcaagctgtaccgcacccctaattaggttccatatataaaacctgagtttatgtgtctatgaatagcgaagtcgtagactttgcatagcaaatgactgtcgggtcctgaaaagatttaccttatactcatataatactggagatgttattgtcgaacctttgcaaggtgttttgtcttgtcatttgttctttacacttactagcaaatagtccctgccgtcgcgccggggctgtagtattcgtctccctccgtcccctaacaaaagacgttttcgcgactcttgtcccgcccgggcgccccctcgattgtgggacggagggcatagattggttcctgagacgaatcaaatgttccggttgtgtaaaaacttatg

SEQ ID NO: 22457 - DNA, 590 bp, Triticum aestivum
  unsure (1)..(590): unsure at all n locations
  Clone ID: PAT_TA_22457
ccgccccccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctcaagttctacaaggtcgacgacgccaccggcaaggtgaccaggctcaggaaggagtgcccaacgccgactgcggcgccggcacttcatggcaacacttcgacgcactacgcggnaatgcggctcactacgctacaacagaaggttaaggtcgtcctgtcngnctttactactacagatcaatccttaatttccttgcgtaaan

SEQ ID NO: 22458 - DNA, 393 bp, Triticum aestivum
  unsure (1)..(393): unsure at all n locations
  Clone ID: PAT_TA_22458
gctcccctcaccccccgagcattcgccactgagagagagagagcgcggcgcatggcgtccaacaccgcacctgcacccgccgccgacgacgagctgatgcacgangttcggcccgctcctccgagtctacaagagcggncgcatcgagcgccccctcgtgctcccgcccgtcgcaccagggcccgacccctctaccggcgtccaagtccaaggacgtcngacctcaggcgccntactccggcccgcccctaccgtgcccccatcccccccgggcgccgccctggcgcggctccccgcccccctctccgtcgtctacgttcaacgnnggggnggattncntgggcncganttcngggaaaanttcgcncaaancttatcaancgcnttcctcaa

SEQ ID NO: 22459 - DNA, 809 bp, Triticum aestivum
  unsure (1)..(809): unsure at all n locations
  Clone ID: PAT_TA_22459
cgccgccatcgcctgtcaccccaccaccgacccctgttactccttcgcctacaccaaaaacgccgccatcccctgtcaccccaccaccgacccctgttactccttctcctacaccgaaaacgccaccgtcgcctgtcaccccaccaccgacccctgttactccttcgcctacaccgaaaaccccgccatctccatcaccgcctgcaacaccgccgactcctatcactccttcgcctacaccaccatctcctatcactccaccaccgactccggttactccaccatcaccgccgatgggcaaatgcccagttgacacactgaagttgctagggtgtgtggacgcactcaaatggactggtgcacacggtgatcggcagcagtgccagcgacacatgttgcccactcttgtccggtgtggccggcctcgacgccgcgctctgcctctgcaccaccatcgagctcaaggcgctcaacatcaacctcgtgctgccaattgccatccaagtgctcgtgaaccaatgcggcaagacagtgcccaagcgacttccaatgccctgcgactccaccatcgccgacaccggtgatgccgccatccccaccagtaattgccgcccacccctgttacaccggttactccggcatcgccgacaacaattncaacaactatttcacgccggtccgcccccgccgtcccccgggcaccacttcgcacatcccccgccccccgccccctcctgcgccccggcccatcccctccgcgcgactgccgccgccaccttaatcggggtccgtggcccatcnacggtggt

SEQ ID NO: 22460 - DNA, 689 bp, Triticum aestivum
  unsure (1)..(689): unsure at all n locations
  Clone ID: PAT_TA_22460
atcctcctccaccaccactcctcccctcccctgtttccgctccgcccccggtaaacccccatcccgtcccgatcccctcccctcccctccccggaggaatctttgctccctcccacttatataaacccctctccgccactccactctcccagatctacatcctccctccaccccgtctcgccggccgcccggccgccccccaatcgtgcgtcggacgaggtgcgtacccagcgcgtcgtgtcttcgatacaaccgaagctcctcccaccctctttctatccatttctgcgatcgatctaacccacgcgaagcatccccggttgctccccaccaggccacgggcgatggatttcctcgcgggcgcccggccccagtggntcctcgccggcgccagcgctgctgctcggcaacgtcgccctcccctagggccgcctccgccccccccgggccccggggggccggcgccgccgccnattccgggggcgcctncntgggcgggtcntgncttcctgnggggccancccgtcanccgggcgatancccgctnngccctttnaacgtccanctaaccgcggttactcctcatgggccgagtctngggatnttanaaaanatccaatacaaaggggnacgttantcaatngccnggcttnagtaaanatagggggatnagttacngcnaggcaant

SEQ ID NO: 22461 - DNA, 931 bp, Triticum aestivum
  Clone ID: PAT_TA_22461
accactgataacaatgtcgatctcgttctcgcaagagctgctcatctccacactcgccatcattcttcttcccctgatgttgtacctcaggtctagcagatcaaagaacccatcagtgctccccataaactggccaatagtgggggtgttcccttaccttatcgccaacttccacaacctgcacgactacctcgccgtcgtcctcgccggatcaggccacaacttcagggcgcacggcccgcctgggaccgggttgcggttcttcatcacatgcgaaccggccaacgtccggcacatcttcacgacgaaccatgcaaacttccccaagggcgcggagttcgccgccatctttgacatcgcgggtggcagcttcttcaccaccgaaggcgagccctggcgtcggcagcgcgcaagagcccagagagtcttgagcaacccacggttgcttgcctgtatgaccgcttgctgccgcgacaaggtggagaacggcctcctcccggtgctcatgcacatggcgagcaccgggaccacgttcgacctgcaagatttgacaataaggctcgtgctcgacatgaccgccacgcctctcttgggcgtccaccctcgcccccggtcctccgaccccccgcccatggacgccgcgggcgccatcgacacggccacccggggggccttgttccggcacattgtgccgacctctggttggaaggtgatgaggcggctaaacatcggcccggaaaggaagctcgccgcagcacacacggttctacgagggttcattgaggagatgatggagaggaggaagaggaaggaacatgctggtaatgagggagctccttccgtggacatcctgtcttcctacatcgacgatccagactaccagcagaacgatggcttgctccatgcgacgctcatcaactacatgatcgcc

SEQ ID NO: 22462 - DNA, 851 bp, Triticum aestivum
  Clone ID: PAT_TA_22462
tcatgagaaaggtcagtatattttgtctgattcgctccttgcttgtctagaggaagagtttggcatggatgatagttcccaccccgtgcactacaatcatggtaacggcaatgttgaagcagcgcagcgccagcagcggttgaaggacccaaaagaagttatcaacaatggcttttcaatatccacagacggggcaggtgacaataacatgggcaataggcacgatgtttctcatgcacgttcaaacattaatcatgtgaatggtctactatccaaacacccagaaacatcatcaaaaggatcagatcatcatctagaacttatgggctgctacctgcacccgatgcccgtcttgtctatcatgctgaacaccaaagacagtagcagtttaaatatttatgtactctgtggatcttcagagagctgtaagagatttctctacgtgtatgacatcactcctaatgatcaccatgagaaaccacctaattttgttggttacactacccttctactaccctcattggagcaggcttctacaaggaattctacatttggaagatctgggatacagtttacacctgatgggcagtttcttgtcctccttagcggtatacggataccatgttgcaggatgcaaagcattgattgttcatgctccttgtgcaaagtggatcagtgcggcgacaattctctgaagattgtatctgttaacttcggctacatctcgctgttgaccaaattgatgccttctgggacagtgtcttgcttttcgatatctgagccaaattatgttgtagcagctgaagacagcagaaacttgcatgtatggatgatggtagctggatggagtg

SEQ ID NO: 22463 - DNA, 1432 bp, Triticum aestivum
  Clone ID: PAT_TA_22463
cgcttcgcggcgcctcagtccaaacccgatccgaacctcctccagagtccaaaccccaacctaggaaatggaggcgctcgtggtgcggaagctcggcgatcccacgctgccgcccggcggcgaggactcgccgtttgcggcggtctcaggtgaccgaccaattccggagctgtcctcgccgacctccgtgcgggtgcgcgtggcggcaaccagcctcaatttagcgacgttcctgcaagtgcagggcaagtaccaggagcgcccccgccctgccctacgtcccggggtccgactacgccggcgtcgtcgccgtcggccccggcgtgccgcagattccgccccggcggaccgcgtctgctccctcgctcgagcgtcgggtccttcgccgagtttgtcgtcgccgacgagaaggcactatacgcagtccctgatggatgtgacctcgtcgctgctggagcattacctgttgcatttggtacatcacatttggcccttgcccacagagctcaactaaaggctggtcaggtgctacttgtacttggtgctgccggcggtgttggggtatcagctgtacagataggaaaagtatgcggtgctattgtcattgcagttgccaggggagttgagaaattgcagtatctcaagtcaataggagccgatcatgtgattgactcgagcaaggagaatgttattgaaagtgccaagtcctttttaaaggctagtggtctcaaaggtgtcgatgttttatatgaccctgttggtggcaagcttactcaagatagcttgaaacttctcaattggggtgcacatattctgctcattggatttgctagtggggatattccagttattcgagctaacattgcacttattaagaactggacaattcatggtctgtactggggaagctactaagtcacttaactcacggaccagccgtactcattgacgcactcctggcatgcctgtcatggcgtttgatggctgtgatacctgctcacccctcccggcccgccgaggcccgtcgcgcccctgctgccctgttgctgaacttgagagttaggaaaggcggtcggtaaatgtgatgattcgttatggcttcctctaggcaaaatcatgccttttgatggatgtttgccctttgcatatccggatacttctttttcagctgccgggattctaggagagtcagattctggatgaaactgccctcatacttagctgtgtgtagaatcagttgtccaattcttttcagctgttgcagcctgagattgctgtataagttgtgtgctgaaagccgtcggattgttctataagtatgccaggctaccataaatttcatacaggagggtggctgaataatcctctgggtgaataaaagctttgggtgctatgtaaagtttccgcaaaaaaacaaaaaaaaaaaaactcg

SEQ ID NO: 22464 - DNA, 813 bp, Triticum aestivum
  unsure (1)..(813): unsure at all n locations
  Clone ID: PAT_TA_22464
atcggatccatggcctgctgggtggacctcctgcgcggtgtcgcattctcttggtgcaacaccctcttccccaaagactgtcgcaaggaacccacgcttaactttggcttcttttccttgcccagagagttgcctggagcagatcactgtcgcggcaacacccgggtggcacagccagaagcctaccgcaccataggcgtcgtccaaggtttcagcaggctcgtctccttcccgcggtcgcgcccgaggttcgacctcaaggaccgcaccttgacagtctggaagcgaacgttgaaccgtgtgtggcagttggagtacaagctcagtctcgagaccctatgggggctccagggattcggcgacttgccaaagaacctaactcccatgtaccctctccttagcacagagaatacggatattgtctactttgcacttggggaatatctggagaaccggcgcaggtggaagtttatcccaatatgtgcacactatctactcgcggtcaacatgcagagcaacacagtccaggcttccatatctctcgcagactgttttggtagtcctgacatcccagaccttgtttcttctagtttcaagcccggtatgtccatgtcgtggggcatgatctacacattatgatgatggacacgatgaacaaatggcgtcgatcattggacccantgacatgatgaaaggaggtcggaagtgatgaggagaccatnaactggcaaggacttgaagacaactatcttatcagctcgcacactccaacatatgctcnctaacaacagcactgagaatattcgngattag

SEQ ID NO: 22465 - DNA, 504 bp, Triticum aestivum
  unsure (1)..(504): unsure at all n locations
  Clone ID: PAT_TA_22465
gagcggtgggacgaaccgattgtttactgaggtcaccgcacacaattcatggacatcacaagaagatccgggtgaaccaacgtctagttgagacagaccttcaagcaagtatacctggatgctcaactaacaacagcctaccctgcagtcctttacaagttgacatcaacctggccgcaccttagtccagatgagcatctttattttgctttcagcatcaactttcacgctgtatgtaacactgggatcagcagccctcagctcgtccagagatgtccgttgtcttcgtagcatagtgtcttaggctttcatcaccaacttgcacgatatatgtgaactctgattgttcacggcttaagttgctgcatacggtcttaagcgatcgtttgggtgcgcattctctagggtcccgaagaaattcccgataatgctgtaaactctagccaggctaacatgtttctccctgagttgcttaaccaattaantcntttgtgcaaaaaaaaa

SEQ ID NO: 22466 - DNA, 672 bp, Triticum aestivum
  unsure (1)..(672): unsure at all n locations
  Clone ID: PAT_TA_22466
gagatgctcaccggcacggtggatccctaccaaccatgctgcccccgccgccgccgcgaaacactcgaacctgcccatcccccgccgccgaccgcaccacacttccgatgccgccacccgcgcctagtccggacccgtaccgcgactgggccaatctgccggagctgccgctggcggaggtgctccgcggcctccttccctgcatccgctcgctctacgccttcgcggggacgtgcagccccgggcgacacctgctccgcgcctccgccgccgatctcgttccgcccccgcgtcccgccgctcctcctccttctgccccgactttccgactgggtgccttttctccccgctcgttcgccccccaatccctctcctacccatccccgccccggcgggagggcgccacgctcctctcccgcctcacgccggcacctgattctcctccgccgggggtccctncaataacctacactccntcgacgccctcaacggcgccgacgccgcgcgttcacgtcccttcccgnacttccctatactatgcgcctaagcctccatctctgtcttcaatcatccagcccctcggccccccgcccgaagccaaaaaaaagcgccacggcaaagctccgggcgctcatgncaagtcnaattgggcgnctcgttacnagccaannt

SEQ ID NO: 22467 - DNA, 1558 bp, Triticum aestivum
  Clone ID: PAT_TA_22467
aacggtgatgttgaacatcgagaactgcacaatgcatatgggtactacttcatatggctacatcagatgggcttctcaagcgaggtgagggtaaagacaggccctttgttttgtcaagggccttctttgctggaagtcaacggtatggggcagtttggactgttgacaacactgcagattgggatcaccttaaatcctatattccgatggttttaactcttggtcttactggcatgaccttctctggtgcggatgttggtggattctttggcaatcctgagcctgacctattggtgcgttggtaccaagtaggagctttttatcctttctttagaggtcatgctcaccatgacaccaagaggcgggagccatggttatttggagagcgaagaactgccctcatgagggaggcaatacatatgcggtattcattgttgccctactattactctctgttccaagaggctagtgtaactggtgttcctgttatgcgtcctttgtggttggaatttcctgacgacaaggaaacatataataatggtgaggcttttatggttgggccaagcattttggcccaaggaatttacgaagagggccagaaatcagtgtcggtttaccttcctggaacggagttatggtatgacttgagaaatggatctccatacaagggaagtgtgtcacacaagctgcaagtttcagaagatagcataccaagcttccaaaggtcaggcacaattgtgccaagaaaggatagattcaggcgcagttctactcagatggtgaacgatccatacaccctggtgatagccctcaatagctcgggttctgcagaaggtgaactttatgtggatgatgggaaaacttatgattatcagcaaggggcattcatccatcggcgttttgtatttgcagacaataaactaacttcgatcaatattgcgcctgatagtctgggcaagaaggtatattcaactgagtgtgtgattgaacgaattatagtgcttgggttatcatcgggagcaaagaaggctatcattgaacctgggaaccaagaagtggaaattgatctgggaccgattagtttaaggagtggttcaaagtctgttgcgccaacagtcaggaggcccaatgttcgtgttgtagatgattggacgataaggatcgcatgatatgcagcccattcacatctggagcctgatgtctccgttgttcgctgtcaggctataaactcgggcaatgctagaagcgtagtttcagactcgtaaatgttatctgtggacacccaaatttcattgtttcagactttcagtggactcaaaatttctgcatgtacctggtacgcatgctgtttgtactcccaattttgacataagtcgtgacataaattgctgatgtatacctgtagcacttatactgaaattggtgtgccacgtatgatgtatgcgatatgaagttcttgcaacattgcaatttagtagtttttaaaaaaaaaaaaaaaaaatggatagttctttgcctaagattgtaatcccatcaacataggcaacatagcccaaac

SEQ ID NO: 22468 - DNA, 427 bp, Triticum aestivum
  unsure (1)..(427): unsure at all n locations
  Clone ID: PAT_TA_22468
gataccccggcaggcgaagccccagcgcccgtaaactctcggccctgccctgcctccgccgcactccgcgcgcgcggccctccctctgcgatcccgacaggcggcgccggcggcgagccgcgacgaagtccctatctcccgcctcgccgtcggccccggcctccggcccccactccgcccgccccctccgtcgntcgaccctgcgtgcgccggtgagcaggctttgatgactgcgtcacaaggatgaagatggcgtcccgtacaaagctatctggcatccagaggcaggccttggcattatacaaagggttccttccggacancacngntcaagtccccctagaggagncgcccncanggataaactccgttgtcntaagcanaanttccngtggngnaatggccatataagtggttaggatcgcct

SEQ ID NO: 22469 - DNA, 525 bp, Triticum aestivum
  unsure (1)..(525): unsure at all n locations
  Clone ID: PAT_TA_22469
gtcttcctctacttcctccgcgacgtcccgctcgctctcttcggccacaccatcggtgacggcgtcgtgctcgccgtcctctcggccctcacgctcatcctgctcctgctcaccggagccaccggcaacatcctcacctcgctgctcgtcgggctggtgctcgtcctgctgcacgccttgctgcatcgccccgcggacagcatcgacgaggaggccggacggtgggtacacacccgtcacaccgccgcagccgtactagtcttttaattctgagctgctccttgtaatctccgttggttcttgggctgtgaattgtgttccgtggattgcagcactcgttaattattttgttgagtcgtatccgtgtgaactcagtgtccttgctccatttttacttttttgacaaccgatgagacgatcaactatgggattattgggaaaagggatccacttgcaatccgacggccgctggaggcccggcaactgtatcacaaaaaataaatggntgcttaactcaaaaaaaaa

SEQ ID NO: 22470 - DNA, 418 bp, Triticum aestivum
  unsure (1)..(418): unsure at all n locations
  Clone ID: PAT_TA_22470
gattaacgtggtcgcggccgaggtccgggtccagcggccnnatcagncgcaactgcagggtcgtcaacagctagctgattggtcgtctaaatgatcaattgatcatgctacgtgatgatggagatgtctcaagtttggttgggtacgaaggtaaccaaccagcatgcatgcatggcagaataagagccgtttggttcaggtttagatgattgttgcctttgtccgtgcttcatcatgtaagttgccggtctctgcagtactactctcgtggcaatcaagcaactctcgaatgtgtatttgccacaaaactgacagagaagaagaatactggtcatatgaagtgtattcctgtagcaaatggagtacttgtttttttaggatatatatagtacttatgctgaaaaaaaagggggggggg

SEQ ID NO: 22471 - DNA, 709 bp, Triticum aestivum
  Clone ID: PAT_TA_22471
gcgtgctccgcacctccgtcggctacgccggcggctccaaggccaaccccgagtaccgcaacctcgccgaccacgccgagtgcgtcaagatcgaatatgatccccggctgattcagtacaagcagcttttggacgtgttctgggcaagccatgatccacgggaggtctttggacaaggaccagatgttggcaaccaatatagatccgtcattttcacgaatggaaccctcgaggctagattggctgctcttaccaaagagagggaacaagccaaggaccgcagcagcgttatcaccacaaagatccaaccgttgggggcattttatccagctgaaccaagaacatcagaaattcgagctgaagcgcaagcctttcctggtgcaactgatcgggaacctgccagaagaggagctcctgtcatcgacactgggccgcgaagctgaacgcatatgcagccgagctctgtcctccaaagacccagaagaagataagctccaagatcgatgagattgccaagaaaggttggcccatcctacgcgacatttgggccgcccattctgggtcccggttctcatcaaactgtaatccatcaagttgtaatccagcatagagaacaagaaagtctgcatgatttgccgagaagttctgtaggaatgttcaacagcctgctgacagcagcggtcaatggtcactgggcacggtgatcaca

SEQ ID NO: 22472 - DNA, 724 bp, Triticum aestivum
  unsure (1)..(724): unsure at all n locations
  Clone ID: PAT_TA_22472
aaatgaacccacagcagtctatggctctcggtgatacgggaaatccgaggatgaggtactgtaggaagtgcaaccaactgaagccccctcggtgccatcattgctctgtctgtggaaggtgtatccttaagatggaccatcactgtgtatgggttgttaattgtgttggggcgctgaactataaatactttcttctcttcctgttttacaccttccttgagacatcgcttgttaccctctctttattgcctcacttcatagccttcttcagtgatgtcgagatcccaggaactccttcagcacttgcaaccacatttctcacatttgtgttgaatctggccttttccttgagcgttctgggttttatgataatgcacatttcacttgtttctgggtaatacaacaacgattgaggcatatgagaagaaaactagtccacgttggatgtatgatcttgggccgggaaagaagaattttgctcaggtcctctggaaacgacaaaaagtatgggttcattccggcatacccggagaggactcnaaggagccgctcgcanggctcgacatccgtcangacagctggatgggcanagtgtaacgacacaattccantgcccgacaaaaacctgnctgacgnanaagttangtaaatcacggttactaactgcatggangaaagaaatagnatcgttaacactgtggtaaccangccaaggaantagnaa

SEQ ID NO: 22473 - DNA, 1359 bp, Triticum aestivum
  Clone ID: PAT_TA_22473
ccgcaagaagggcataccaacacaagcttagccatgacgatgaggaagcgcccatctgcatcctctcttctcgtagcaccgttgctgcttatgcttcttccagtgtttgctcttgctgccgggaggcacaacctgatcactagaaaccctcagtacggcccacgggcgaacccaaatccagaaccactaccaggaaaacagccagatccaaaccctcaaccattgccgggaccacaaccagacccaaagccgcaaccgctacccgagcctaaacctcatacaaacccacaaccactgccagatccacaacctgatccaaacgctcaaccattaccaggaccacaccctgacccaaatccacaactattgccaggacaaaacctgcaacagttgatgaacccacggccaaacacaaagccgtggccactaccagacccacgagcaaaaccaaaccctcggccattaccaggaccgcagcctgatcgaaatccacaaccattaccagacccaaacccgaaaccattgccggacccacagccaaacccaaaccctaagccactaccagggccgcaacctgatccaaacccacaaccattaccagaaccaaacccaaaaccattgccggacccacagccaaacccaaaccctcagccattaccaggaccacagcctgatccaaacccagaaccattaccggacccaaacccgataccattgccgaacccacagccaaacccaaaccctcagccattaccagggccacagcctaatccaaacccgcaaccattaccagacccaaacccgaagccattgccggacccacagccaaacccaaaccctcagccattaccaggaccgcaacctgatccaaacccacaaccattaccagacccgaatccacaaccactgcctgacccgaatgcacaaccaaaaccaccacttgggactcaagcagaaaaaggaaatggtgaagcaaacgtccaagagtaattgttggcatgagatgttcgggtacatcaaccgtgccagacatagtattgtcattacttatattgccggttggattaaataagtggtgtgttgtaacccaccaccattaagtcattccatgctatataatgtcaagatcaatcaagattagggcatgatgcccatgtaaatcttgtgattgttcttatttacttttctggcttgtacggaggatgatggcttgtgtgtgctggttgtactatgattgtgtgatgatatatactaaaattactttgtaccttttaaaaaaaaaaaaaaaaaaaaaaaaaaaataaaaaaaaataaataaaaaaaatgtctgtctttattaaaagatccatgataaatacg

SEQ ID NO: 22474 - DNA, 565 bp, Triticum aestivum
  unsure (1)..(565): unsure at all n locations
  Clone ID: PAT_TA_22474
cnccaggaggtacantatttacactcaaaaccttgtatcttcagttagtagtagatcagtgaacaacaaagctcatcacttgtcactcacgggaagaattttaactatatactcttgaatacttgagcntttcccatgaaagtgagatcagtggcgtccatttccgaagccaccgccggagccataaccgtatccagagccagacccggagccatagccagagcctccaccttgaccacctccgccgccaccgccgccgccgccgcctccatacgctccaccatatccactgccagacccggaaccgtagcctgagcacccgccagacccaccacctcctccgccaccgccgcctccgccgccgcctcctccgccaccaccctacccccgcacgctccgcgcccttgcggcgcgcgccggtgcggggggcgtcaaggacggcgggccccggatgcgtgggggtggcctccgtcgggctgcgccccgcccgccggctcggtgcgcgtcccatcaaggnatcacaaaccggnattcggcggtggcccgagggcggctnaaaccancc

SEQ ID NO: 22475 - DNA, 1570 bp, Triticum aestivum
  Clone ID: PAT_TA_22475
ggtccccctctccccccccccgtctgcaattcacctccgaattcggtcgcccatggcgccgcggctgctctaatcctacccacctaccccctcccccctcccctcctctcccagctgctctcccctcccctctcgtacaattgaaaatggcaatgctggtggatcctccgaatggcatgggaaaccaagggaagcactactactcaatgtggcaaaccttgtttgagattgacaccaagtatgtgcctatcaagcccatcggccgaggagcttatggaatagtttgctcatccataaaccgtgagacaaacgagaaagtaacgataaagaagatacataatgtattcgacaaccgtgtggatgcactaaggaccttgcgggagctgaaactcctccggcatctcctgccatgagaatgttatttctttgaaggatataatgatgcctgtacaaaggaggagctttaaggatgtgtacttgggttatgacctcatggtttccgagctgcgtcaacatagtcaatcccgcctcatagggctccattacaagcacctctgccgagatatctcctttcagttgcttcagggccagaagaaccgcatttggataagttcttgttatggaccactattaggtgtatgtatactgttgtgtgcaagctgtggcctgaagaagaactgttgaagccattcaagtacaaacagtagtaaaggccagtttatgactgaatacgtcgtcacccgctggtatagggctcctgagttgctgctttgctgtgacaactacggcacttccatcgatgtttggtctgttggctgcatctttgctgagctacttggccgcaagcctatttttcctgggacagagtgcctcaatcagctaaaactgatagtcaatgttcttggcaccatgagcgagtctgacctggagttcatcgacaacccaaaggctcgcagatatatcaagacccttccctacactcccggtgttccactcgcaagtatgtacccacatgcacatcctctggccatcgatctattacagaagatgctcatcttcgatcctactaaaaggatcagtgttacccaggcccttgaacacccttacatgtctcctctttatgacccaagtgcaaaccctcccgcgcaagtgcccatcgatcttgacatagatgagaacatcagctcagagatgatcagggaaatgatgtggcaggagatgcttcactaccaccctgaagccgccacggcagtaaacatgtgatgacgatcttgcagtgccctgggaagaacccggcaggctcatctcttttttcctcgaaaagactactgcgattatcgcacctattaagtaaccatgacgtgcagtgtggggagttatctccgtgtaaatacgcagtgcgatgagaaccgcatatggatagttcttgttatggaccactatttggtgtatgtatactgttgtgttgttgtatgagctcaagaaagaactgttgaagcgaattcagtaagtgttggtttgtgatggaaaaaaaaaaaaaaaaaaggcccctattttatcatgttttttt

SEQ ID NO: 22476 - DNA, 2098 bp, Triticum aestivum
  Clone ID: PAT_TA_22476
ggtggacgcaaaattccacgctaccgaaccaagccggcgagtcggaggcgccttctctacgccgccgcctgcgtgtggaccaggccgaacaaaccaacctcaagcttctcgccgtcccgggaacgcacgtgccccgggcgtccaccacaacggtgaggcccacgggtttgtatgcatgtgactcacttggacagcgggattgccggttgtagtcgcctcgggatactatcgtgtaggacacgcaaaatccagagccggtttcgattgtaacgtgcagagtacattttctgtaaatgatgtatttcagttcatactggcagtcattgttattttttgcggggaaatagagagatttcatactcccagaagctggaccccgacgacgacaaggcctacaccggtggcaaggtcgccgtcaaggctgtgcatgatggcgtcaatgttttcttcatgctgcaagttgatggggactatgcttacactaaaggtgaaagtaaaaagtgcccctctgttgctctgatgttccaagttggagaaaaagccacatattacaacatgggagggtgcaaggatttgcctggttcatgtacgagaaaaagttgcagagatcatgaggtcgacattatgcacttttcagttggaaatgctattcctggacgtctttatggtggcaatcacatagataatgcagctggaaacggaggtgatagatttggccatcttgttgatgtctatgcatggaatccccattgccgctaccttgatggtataggccctaaagaaaacaattcaaatgctcaaaatgattggcatggggcttggtggcacagttccctgaccttccattcaggttttgtggatgatgacagtccttatggaaagaaagatgacaagggcacatattactttgagttctcaaggcccctaagaacaatggaccagtttcagcaggatgcgcagttcacaataggcgagcccagcaatatggccgtagctttctggtacccaactgacggcaaaccatggagcaactcccagcattactcagccagctgcgactgggtgacactggacatacagccttcattggaagctgctcgataccgcccagcccctaaccgttcctgggatgctgcgaccgccttcgccttgctcctttcagtggtggccgtttgcgtgtctatctttgtgggctactcagcttcaaagaacaagagcggtgtccaatttacacagctggcacagatctagtttggttgcaggaattaattctattgtgtgccggcatttcatgacccacgccatccatatgtgaggataatgggtttgtaagatcctttcacacttggacagagggattcccgagtatagttgcgtcgggataatctagtgtaggacacagaaaatacacagccggtttcgattgtaacgtgcagggtacattttctgtagatgatgtatttatctatctactattttattacattattttccacactattacatgaaaaccagcataccaagggacatgtgcagaaatgaagttatagtgtcaagattcaagaaacattcatatcattgtatttctgttccttcgacaactagatctgcaatttgccagccttgctaaggaaactgtgtgcatgcaacattcccgtggttgggtgattatcggaaatgtctggtttgtactataagatacgtgcaccgtatgacaaagttattgccacggtacacttagggcactcaacccacttaaattgagactgtttagatgcttgggcaaatgtctgcactggtacggacgttcatatcttctgcaacacaagttcaagcacatcctcttacgatgatggccagtttgtgtgaatctacttcaaacctgcaagctgacacacacagggattaatgcgtctcaattgcatgcttcaagattatacaacacctttcaaatgattaaacataccttttggttactaaatctgtttggcacttaaatgtttctttggctatgcaggatgcgcagttcacaataggcgagcccagcaatatggccgtagctttctggtacccaactgacggcaaaccatggagcaac

SEQ ID NO: 22477 - DNA, 530 bp, Triticum aestivum
  unsure (1)..(530): unsure at all n locations
  Clone ID: PAT_TA_22477
gcccgtccagatccgctctctctccctctcgttccccctcccatcgcggctctccgccggctacccaccacggccacgcgccgccggctcgctcctcctcccatggccgcgagcccatctcctccttcccgagcagtgcttctctacgggtaggtgactgctcttcatccttgccttgcgtcctctatcgccagatccatggccatggaggtaagatgcagcgggcaaggctgcctcatcgacatcaagctttgtggtgatgatgttgggcaagcgacgaacaacaagtagcaagcatcaccaccatggttggcagctcagtggtggctagatctattcactgaggcatcaacaccactcctccggcaagcacgccggtggttggcagctcttcctcaatcttcaaactcaaattgtccaggtagcagagatccactccttgtttttttaaacaagcctattactcccaaatttttgagatgcatctggttacgtgtgtgattgttcttccgggaaggnttcaacaacaa

SEQ ID NO: 22478 - DNA, 560 bp, Triticum aestivum
  unsure (1)..(560): unsure at all n locations
  Clone ID: PAT_TA_22478
ttctccccagcgcccagccgtgcgcacgagttctcggccggcgagttcgcaatggcgacctcctgcgccccggcctcgacctcttgcgccccggcctcggcctccccttgctgctcacctacatcggcgccggcgaggtgaagaggaggcgcgacggcggcccgcgtaggcgtggtgagggagggcgcctcgctgcggccgcagctgcgcgtcgacgagccaaatccacaaactgtgggcatggaggtgcggtccatatgcttgatgatgaactccgctgccgccgggtgccctccatatctctccagtatatccctccgacgagccaaatctttctgatgtgtgccgccgccaagcaggaaccacgccgtcaagctcatctaggggccgcccggatgctcaagccgccgccgccgccggagctccattgctcccgcccgttctaaaccngacaacgcccgccgtttccacgccattctgaanccgtcctcaacangccggactccctatgcccgccgcaaagcaacaacaactgcgggacaccacgggaggaatgccnc

SEQ ID NO: 22479 - DNA, 509 bp, Triticum aestivum
  Clone ID: PAT_TA_22479
aagaaattggaaaattggatagatcgagcggtggctaccacgtactctgaggcctcaagctccaagagcatggcccggattgccccgctcctgctggtggcgctgctctccctagccgtgcagctcccgccgtccgcggcttgcccatcctgccccaaaccaaagcctccgccgccaccgccgcgtaagctgacgcctccgccgtccgtgccctgccctccgccgccacactctcccaagcctacaccaccgcacacgcctaccccaaagccaacaccacctcacaccccaacccccatgcctaccccgccacacacgcctacccccacgccaacaccgcctcacacgcccatcccgccgcacccgccgaccccggcgcccaccccgccccgcgcgcccacgccgcccacccccccgcccccgccccaactccgccgactcgcctccccccgggcccacacccgccccgcgcctccccctgtgccctcgccggctcccgcgctgcagga

SEQ ID NO: 22480 - DNA, 637 bp, Triticum aestivum
  unsure (1)..(637): unsure at all n locations
  Clone ID: PAT_TA_22480
cccgtgagctgttgcatcttctcccgccgtggacgctgctgccgtcatcgccgccatgccgcacgcgtagccacagagcaccccgaatctagccaccgcgtccgtcagctccaccgttggctgcttcgtcatccacatcgacctgttggagccgggaacccctgcatcaagccctgtgacgtcgtcttcttcctcgaccccaacgaacttcgtcatcgattccggcaacgtcgacccctccccgagcccaccttgctcatctacaggctcactgtagactacgagaccgacgctgctgctgcctccgttccgactacggagttgacgatccctccttgccagagaaaccagatgctggaagcccaagaggcagacgccatcgtcgacaatgactcctactacactggaggtgcctactactaacttgcaagccgatgacgacgactaggagtagtttaggaggttccaagcaggaggatgcgcctctttcgatcggtacccaatttgtgctancatcttaatggaacttgttaacttaagtcggtcccaaatattgttgcttccccggctgttatgccacactgtatcaacccccagnccccggcgtttaaatgctaaatactanttatttaaaaaa

SEQ ID NO: 22481 - DNA, 1269 bp, Triticum aestivum
  Clone ID: PAT_TA_22481
cccacgcgtccgactggatccctgctgcaacctcaagcattgtcagcattcagtacacctgccatgggttgcaacctgtttattcttgacagcaatgggaatcccctaccacaggattctgctggtattggagaacttgcgcttgatccaacattatttgggtcatcaacgacactgctaaatgctgatcatcatgaggtgtacttcagtggaatgccagaatggaatgcgaaagtcctccggaggcatggcgatgaatttgaacgtaccacagaaggatattatagggctcatgggcgtgcagatgatacaatgaaccttggtggcattaaggtcagttccatcgagattgagaggatctgcaacaggaggaatgatgccattcttgaaactgcggctattggggttccacctgtagggggcggccccgaacagttgaccatagccgtcgtattcaaagatcaaagtccgcaagcagaagatttgaaccaactgaaactaatgttcaactctgctctgaagaaattgaatcctcttttcaaggtttcatcggtcgttgtggtgccatcgctccctcgaaccgcctcaaacaaggtcatgaggagagtcctacgcaaggagttcacccaggcaaagcactctaaaatctagtagacgtgaagtgtattctgcgcctattaaaatttcagggaattgcacaccaaactgtgaatatatacgcaccagctcatgctcatgtcttcagaaattcaggtgtattatcacacatccattgtacagcgaggctaattcacattgattctgacattgcagatataaggtactaataaagcatgattgctgccatgtacgtactgttttgtttccataataaagaaattatcattggcggtttcatcacgtggatgtggtgccatcgctccctcgaaccgcctcaaacaaggtcatgacgagagtcctacgcaaggagttcacccacgcgaagcactctaaaatctagtaggtgcgttaggacgtgtatactacacctattaaaaatttcagggaattgcacaccaaacagtgaggctaattcacattggtctggcattgcagataaggtacccacccagcaggcttgccccaactgaaactaatgttcaactctgctctgaagaaattgaatcctcttttcaaggtttcatcggtcgttgtggtgccatcgctccctcgaaccgcctcaaacaaggtcatgagctggtgcgtatatattcacagtttggtgtgcac

SEQ ID NO: 22482 - DNA, 651 bp, Triticum aestivum
  unsure (1)..(651): unsure at all n locations
  Clone ID: PAT_TA_22482
gtagtgctagtcagctatcatcaacaggagcagcttttcccatccatctagggtttacacgcagattatcagtcgccgccccccccctcccgctcccgcggcggaactccggcgtgcacggaggcaatcggccggccggggctcgctcgcgttcttcctcaaaagctcagccagcctgcagggtcacttcagctcagctcgccgcctcgccctactaatccgtggcgatctgcggggagaagctggctgcccggctggcccacgatttctcatgcttgtgcctgcgacgatgagcgccttgagatgataagcgccggcgaccatgggaacgaccgccggaagttcgagccggcnggcggccggcaacaaggccctgcaagcggcggcggcggctcgcggcactgggtcggcgtcaacagggtcccggatcgtgcccgtgcccccgtgttcggcggcaaggaccgccacacaaggtgaggacgtctaagggctcccgacccccgggcgctctccctctcaaggnantcanattatnacttcaagacgcttgggtnaacaaccaaaagntttaanggtccaaaccccaaanaanatttaaatgggcntcaattcncnaaanaaaaatctggnncccaaaaanaaananatgag

SEQ ID NO: 22483 - DNA, 1551 bp, Triticum aestivum
  unsure (1)..(1551): unsure at all n locations
  Clone ID: PAT_TA_22483
gggacctgggtgtgacagggcgagggagaatcggagaagacgagcgcgagagatgatacgggcggcgtctccgcggcgagggacaaccggagaagacgaacgcgcgggagatgataagggcggcgtctccgcggcctccgtccgccgtgcgggtacgcagccgcggcgcctcctcctgctgctccgcgtgccccttcagggccagggggtccggaagtagggtcgcggcgacaagtgggaggaggaggaggaacgttatctcctgctgctcgtctgacgaccgggagggggcccgcggcgcggcgcctccggctccttccgacggatcgatacagctctactcccagatcgagaaggtgatcacggaggcggcaaagcagtccaaccagggctggagttccaccggagattggatcgaaatcgagggggcgtgggtgttgaggcccaagtcctcggcgccctcgtttgtcgttcattttattggtgggattttcgtcggggccgcgccgcaggtcacgtaccgctacttccttgagcgtctcgcagacaagggagctttggtgatcgctacaccatatgctagtggctttgatcatttcttcatcgcagaccaagttcaatttaaatttgacaggtgcttgagaaacttggtagaacctgtgaatgaccttcccacatttggtgttgggcactcgttgggatctgtcatccatcttctgattggatcaagatatgctgtgcagcgaagtggaaacatactgatgtcattcaataacaaggaggcaagcctggcgattccattattttcacctgtaatcgttcccatggcacagagttttggcccaatattatcccagctgacatcatctccaacaatccgttttggggctgaagcggctattaagcaaattgagaatctaggccctcctgttgttaaacaacttcttcccttaattcaacaacttcctccactgtatatggacttggtaaagggccgagaagacttcatcccaaaaccagaggagacacggcggctgataaaatcctactacggaatatctcgaaatctcctagtaaagttcgaagatgatcaaattgatgaaacctctatcattgcacaagtgctaagctctgaatctgccattagctcactgcttgatatgtcgattcgctcacttcctggggatcatggccttccattgcaacaggtacttcctgacgttccaccaggaatggctgatgcagtaagccgtggaggtgaactcctggcaaatctcacaacaggcacaccatgggaggctgttgctaaggaggtaggtaccacttttggcactgactctggcgttctgcgaacacaagtaccctgaggatgtcaatgcacttgtggatgtaattgtttcatggatagcttcaaattctggccccaaactacttcgttcatgaccacccacaatgcttggggatgtaaataacagtgtagaactgcggggtttactgactactggacgaatttatgagtaatggacttttggttccaaaaaaanggggggg

SEQ ID NO: 22484 - DNA, 717 bp, Triticum aestivum
  Clone ID: PAT_TA_22484
ttttttttttttttgaactttgctgccttacgcaatagagccttatcttaattcgtcagacaagcagtctcgagggacttcgcgcgccgccctgggtagtttttttttttagtcaacttcccatatgattctttcattccctatctcctacatagaactatttacatcatccaaaaggatggacagaaaaaagaaggtaaaacgaacactgaatcctcagaagccagaaacagctacttgctggctaactcccatggatggctccaaaccatttccatagtggcaaggtctcaccacagagctcaagaaagctctctctacctcttctgatgcgttccttctgagcaagcacatgacatagtccatcacagctgcatcacaaggcagggttatccttccatcgcttgtgaagccaaactcatcctgagacatcctcaggagctccccgatgatcgtcgtgctgaggtacgccaatggcacctcaaaccgcctcccgtcagcagtgtacatggcgcagtggcccttcactgccactgacgtgcagcactcatcgacttcttttgctgaacacatgagcctcttcctcccgatggccccccctcctcgcctcctccgtgtcatctctggaagtctcggggctctgaccatggttgtatcaccttctttcttggcagaaagctcagagttttgtgtcgagtgctaagctagtgacctcgg

SEQ ID NO: 22485 - DNA, 2069 bp, Triticum aestivum
  Clone ID: PAT_TA_22485
cgcccgcctcagcttcggcgccagaggagaagtgaacagcagcactagattttgattccccgtgtgacaagttcagcgcagcgcgagatgggagtaccagggacagcagcagcacggccgcgtccgacgagtacgggcaacccaggctggcccgccatcggcgtgcggcaccggcatgggggacgcacggcgggctgccaggcacagagaggcgggccccccaggtggggcatttccagcccatggagcggacggagcaccagactcggcccgtgggaccctgcaccgctccgggcagctccagctccagctcgtgctggaggacgatggcatgggcgggaggaggaagaagggcaccaaggagaagatcaaggagaatgctccctggtggccacggtgaccagcagcacaccggtcgcacctacggaccgcagggtactggcatggccggcaccggcggcgcctacgggcagcagggtcacactgggatggccggcaccggtggcacctacggacagacaaggccacactggggatggccggcaccggcggcgcctgcgggcagcagggtcacactgggatgaccggcgaccggcggcacctacggacagcaagggccacacctcgggatggccggcaccggagcacatggcaccacggccaccggacggcacctacgggcagcagggccacaccgggatgagaggcacagggggcgcacggcactggcggcaagtacaggctgcacaggcacaagcaccggctaccagtatagcatgggggacaagatagagaacgacgctgcctggtccgacactgcacgttgtgcagggccaacttggcagcaacaacaatgatttggggtttcagttctattacccttgctgtattaaatcgtaagatgccgatacacataaaatttggcgatgcatcctgatctgggctcacctttcagagtagcacctttgtaggaacctctgaatctaggctcaggttaaaaagaagtacaaacagcagcatactagattttgattccccctgtgacaagctcagctcagcgcagcgcaagatggagtaccagggacagcagcagcgcggccgcgtcgacgagtacggcaacccggtggccggacatggcgtcggcaccggcatggagacgcacggcggcgtcggcaccggcgcggccgccggtgggcatttccagcccatgagggacgagcaccagaccggccgtgggatcctgcaccgctccggcagctccagctccagctcgtctgaggatgatggcatgggcgggaggaggaagaagggcatcaaggagaagatcaaggagaagctccccggtggccacggtgaccagcagcacaccggtggcacctacagacagcagggtactggcatggtcggcaccggcggcacctacgggcagaagggtcacactgggatgaccggcaccggcggcacctacgggcagcagggtcacactgggatgaccggcaccggcggcacctacgggcagcagggccacactgggatgaccggcaccggcggcacctacggacagcaaggccacaccgggatggccggcaccggggcgcatggcaccacggccactggtggcacctacgggcagccgggccacaccgggatgacaggcacgggggcgcacggcaccggaggcacctacgggcagcacggcactgacaccggcgagaagaagggcatcatggacaagatcaaggagaagctcccaggccagcactgagcgctgaggagagcccgcggccgccacttctgagagtggaggtgccggtcgaccaccgttgcagaatcaataataagatcgcgatacgatacaataaaattccaccatacaacgtgagcctagttcacctagctcacttgcgtgttggaggagccactgtatctaggctcaagtttacgtgaacaaacagtgttttgagtttttcgtctgtttattacactgtataatcttgtaagtttcctgtggttaaaccctgtatgtacgctttacggtatggtcctcgcgtaaaaaaaaaaaaaaaaaa

SEQ ID NO: 22486 - DNA, 634 bp, Triticum aestivum
  Clone ID: PAT_TA_22486
tatattcccaggttaagtcaatctgaattcatcgggccctactggaagttcaccaaaagctttagtcaaccattttctgttggatcgaggttcaaaatgagatatgaaagtgaggatgctgctgaaagaaggtacacagggataattactggaactggtgatgcagaccctatgtggcgtggttcaaagtggaaatgcctgctggtaaggtgggatgatgatggtgagttgggtcgaccaaacagggtatctccttgggagattgagctgaccagttcagcttcaggatcccatctggccgcaccaacttcaaagcggatgaagccataccttccccatgctaatccggaattcacagttccacatggaggtggtcgccctgattttgctgagtctgcacaagtccgcaaggtcttgcaaggtcaagaattattgggttatagaactcatgatggtactgctgttgctacttcacagccatgtgaagcaagaaacttgcagtacatcgatgaacgaggttgctctaacaatgggagtaacaatgtcctaaggggggtcccaagccatggtgtgaaaacaccacttggaattccctaccattgctctggctttggggagtctcagagattccaaa

SEQ ID NO: 22487 - DNA, 386 bp, Triticum aestivum
  Clone ID: PAT_TA_22487
cttgcaacagggaggctggtggcggccggctgccggctgccggctgccggcgagcgattcccccggcgtccgtcgcacttgggcagctccctctggaattagccggcggctaagcgagctcctcgtcttgcctcgcgtccccaatcctctgctctgctctggcgagggactccggcgggacgggagctctctgccatgccatgaataagcatctctgtgttagaaagagcttactagtactgatatgagggtaatactaggaagtatggagtatggagtatgtatgagggaaatactagtactgatatggaatgcaccctggaaaataatgaagcgtggaaacgcagaataaagctccatttgattgttaaaaaaaaaaaaaaaaa

SEQ ID NO: 22488 - DNA, 1095 bp, Triticum aestivum
  Clone ID: PAT_TA_22488
cccttaaccccgaggcggcgacgccgacggccaccgacctcgcccccacgaccatgcggctccccggcggcgcccgcctcgctctcctcctcgcccgccgctccctttccaccgccgccgcctcctccgcccgctcctcctccctccacgcctcccgcgcgcacagagctagatggggcgacgcggcccgcgcgccgccctcctggaggccgcccttctcctcgccgagcaggttcttccacgggaccaggcctgtggcggtgagggactactacgacgtgctcggtgtgaggaaggacgccggccagggcgagatcaagaaggcgtattacgcgcttgcgaagaagctccatccagatacaaataaaggcgatgccgatgcagaaaaaaagtttcaagaggttcagaaagcttatgagactttgaaggatgaagaaaaaaaagcggtctatgatcaggttggccctgatcaatatgagagggctgctgctggaggtggtggagctggcggattcgaagggggttttggaaatccttttgaggatattttcaacgctggtcgtactggcggaatgaatgatttcctccggaacatcttcaaagatagagaatctggtggacaggacgttaaggttaagcttgagttgtcatttatggaagcagttgaaggatgcaaaaagacaatcaacttccagactttagtaacatgcgaaacctgcaatggagctggtgtacctgcgggaaccaaacccgaaacttgtctagcttgcaggggttctggatatatggttctgcaaactggtcccttcagaatgcaatcaacatgcacgcagtgtggtggatctggcaagactgtaaaggatttctgcaagtcgtgcagggggaagaaggttgtgccaggaataaaaacagtctctattgatatagcacctggtacggatgatgaggatgtcatgaaagtgcttagatcaggtcaagcagatccagacggtcttcgtgctggtgacctttatgtagccattaaggttcgtgaggatccagtattccggagagagaaaggtgatatccatgtagatgctgtcttaaacgtgactc

SEQ ID NO: 22489 - DNA, 1965 bp, Triticum aestivum
  unsure (1)..(1965): unsure at all n locations
  Clone ID: PAT_TA_22489
ccacggcgcccctccccacgggctttaaatcccccccgcacgccccagtcggcgagcgctcgcccgcccgttgccggacatggaggagatcacgcagcccaagcccgccaaccaggacgacccggagctccctaacggcgccggggacccggaccagcgggcgtcgcccgctgccgcggaggcgccggcggcagacgaggtggcggctgcagaggaagtcccggcgagatcggagccaccggagggcgcggggagcaacggggacagctgggacccctagagcatggacaagctggtaggggaggccgccgccgccgggggatccgacttcgccgccaacgcgaatggggccggagccgccactcccgagggctccacccaggacaacctgcaaatcctcaacccatcgtgatgttgctaccaacttgataatgacaggcactggagtaattgtgtcactggggtcgatgaagaaggtcgctctcgccaacgtattcttacctttgcagccaaaagatataataacaccattgaaagacactcggagcaccctgatgcatttggtacctgtgccctagttctccgggaacgtgctgaaaacgtggatcctaattctgattcttccaaagattcattgcttgaggaggcttgcaagaggtatgctgaagctacacgaaattgtccaacacggtatgatgcatattgcaactgggctagcgcatcggcccaacctgcgcgggcgtcccgggggggctgaagaactctggcagcaggctataaggaactacgacaaggcagtccagttaagttggaacagttggaacagccccaagaactggggccttggactacaggaattgaaggagattggtgcgattgatcctgctaaagacaagcaaacaatcataaaaacagctataagtaagtttcgttctgccatccagttgcagtttgacttccaccgggctatttacaaccttggaactgtcctgtatggcttggcagaggatacctcgaggtctggaggggccgatacctctcctaatgatctgtatagtcagtctgctatttacgttgcagctgctcatgcattgaagccaaattattcggtttatcgcagtgctctacggttggtccgctcaatgctaccgttgccatatttgaaagtgggatatttgactgctcctccggcagacgaccccattgcaccacacaaacattgggagaggtcacagttcatcttaaaccacatggaactccagcaggtcaatgattccgaaagcgcacctgtcaaagcaaacgcgctcgtggagaaagccaaaaggtttatcaaggtagacgtcgcggacatagtttcagtgtccacgtgctccgatctgaccctgccccctggcgccggcctttgtataaacacaactcatgggcccgtgttcttggttgctgatacctgggagtctctcgatggctggctagatgcgatacgtctggtgtacaccatatttgcaagagggaagaccgatgtcctggcgggcatcatcaccggctgatcaatgatgtctggttgtatgtgtgactagctgtgtctggacagtgcgacatgtatatcaatatgtattctgtgtcaattcaaagaaacccaccacagttgatttttatgtacccctccctccccttgattgctccgatgtgaattttcagagtttgtgtagagtaatgtggttacccatccgaatcataggcggcattgttttgtacctgtaacacatatataccttcaagtatgtaagacttgtaatagacgactgatgagaagatgagtttgtactgtcatctagttcaaaaaaaaaaatgttgtgtcctgtattttgactttcccaaattcgaacctctgttgtattaangggccgaaaaaaaaaaaaaaaaaacccaagggggggcccgggtacccaattcnccccaaanttg

SEQ ID NO: 22490 - DNA, 1784 bp, Triticum aestivum
  Clone ID: PAT_TA_22490
gccttcggcgagcgggaggcagacaggaacagtccagtctccactccagagccccccctgcacagagagggagaagggagagagggagagagggcggagcagtcgccggcggcggccagcagcggagcggagatgaaggagagaggcgggtcgagggcggcggtggacgagcggtacgcgcaatggaagtcgctcatccccgtcctctccgactggttcgcgaaccacaacctcgtctggccatccctctcctgccggtggggtcctcagtttgagcaggctacctacaagattcctaagcgcctttacctatcagagcagacagatggaagtgtcccaaataccctggtcattgcaaactgtgaagttgtgaagccacgggttgcagctgcagagcacatatcacagttcaatgaggaagcacgatcaccttttgtaaagaagtacaagactatcattcaccctggagaggttaaccgaatcagggagcttccacagaacagtaggatcattgcaactcatacggacagtccagatgtgcttatttgggatgttgagtcccagccaaatagacatgctgtcctaggagctactgattctcgccctgatttgattttaacaggtcatcaggaaaatgctgagtttgctcttgctatgtgtcctcctgccccgtgtccaccagcaccagatgtgctctcagctggggtggactggtccgtccttgggcgcagctctgcacttggcgactcctcacttggtgactcttccccaggggcatctggcagcaagcagtctggcaaaactgcaactgaaaaggagagtcctaaagttgatcctagaggtgtattccacgggcatgatagcactgttgaagatgtccagttctgcccttcgagtgcacaggagttctgcagcgtgggtgatgatgcttgtcttattctctgggatgcccggactggtactagcccagccgttaaggttgagaaagctcatggtggagatgttcattgtgtcgattggaatcttcatgatgttaactacatcttaactggctctgctgataactctgtccgaatgtgggatcggcgaaatctgggtcctggaggtgctggttctccaattcacaaattcgagggccataaagctgctgtcctttgtgttcagtggtctcctgacaaagcatctgttttcggaagctctgcggaagatggtttcttaaatgtgtgggaccatgagaaggtgggaaagaagaaaaatcccaattcacctggcgggcttttctttcaacacgcaggtcatagggacaagatcgtagatttccactggaactcttcagatccttggaccattgtgagtgtatctgatgatggtgagagcactggtggaggtggaactttgcagatatggcgtatgagtgatttgatctaccgcccagaggacgaggttgtttcagagctggagaccttcaagtctcacttggccagctgcactccgagggcttgaatcatgagatagtagttatctgtccatttgaaacattggtcatgtcctctgatgctagaacaacctagacttgtacccttaaggtgcttgtgagcttatttaacttgttgtatgattcgaatctgtatgctctgcgaacacagcggagctttatttctgtagccagactattggggtattggcctattgggaacattgtaccggtagcttctagcggaccttatgagattgcttgtaatgagtttgtgtttatcgtgtgctcagtttgctcgttctattat

SEQ ID NO: 22491 - DNA, 769 bp, Triticum aestivum
  unsure (1)..(769): unsure at all n locations
  Clone ID: PAT_TA_22491
tttttttttagcatcatggaagtttaatcactgaagaanattangtttagtacccggataccancatccgctgctggcacaacaaacatcatatgtgacgtatctttaagccatttagaattgtgaaaaaagaanagtgcgcccccccgggcaggtactatcctagaggaaatctacaatgtgacaaaaatgaacctcatgtgcagcatcacgctgtatgcaatacctagacttcacatggtgtctttgcatcgatggacagtcgcgtgcaagcccactcttgagctcatcctgcaggagatcatccacagcccggcgtcccttgaagcatgctncttcccctcaaactccttggacaaccacccgcacattggaatgcgtctctccatcgctacctgctaccccggcatgcccactgtgttgatacgaaatgtcctcaatcttgagctccactggtgaaagccctctctccaaactatcccttatcctctccttcctcccacctcnaaggctgccatttccttccacaacagcagccggttcctcctcggattcctcctcctcnnncctctccgcctccgaactctcatgcacttgcccaccgaaagcctcaaactgagnctcttccttcacccagctacaagttttatactttgaactgaagtaaagtatatacgcattggtgctnnnattcnnnnntcaactagatgccctnnnaacnnnnnnnacaaaggactntctgnnnacactatcctgacagctnnntgnn

SEQ ID NO: 22492 - DNA, 840 bp, Triticum aestivum
  unsure (1)..(840): unsure at all n locations
  Clone ID: PAT_TA_22492
nggcttattacattaggggatattagctgaatgggctttgaactggacggggaaagttacttaagtggagaccagctcaacnnngatgaagcctgttcaaccatctcgtcgtgnnncactcgaggattccagtaccaggggagtgagcgcggactgccaacatgctttccagataccgatttgaccactgccaaaaaccttatggaggccagagggataaagcagctgcctgtcgttaagcgtggcgttgggcatagaaccgaaagaaggcgcaagcttgttgcccttctctattatgattctatcggccactgcttacgggaggagattgagaactggaaagctatataccaaagaaaagaagatttccacattttagcaactggtcacacattacagtgacctgtgatatacacgaacctgtatagcttggaggctaccctccattaattggactcgagctgccttctgagggggtctacgcaggcaaagcctgaccaaatttgcaatggcggtttgtcaacaaccttgcattccctggatgatgtactattgggaaccatatatgactgaaccagtcatcttttgttgtttgcgacgctacttcacacgggaaaggcggatggagcatgcatgtttgagatcttaaggncccgagatgtcaccaaagaattaccatggataaggctgcnttggaagttagctatccaacttccaaaacaatanctngttttcaaatcttaagggtttnacccnaactaacccaatttngttttggggcnaaatcacnttncctaanaatttggtccnccggtttatgggccccttgagtttccctta

SEQ ID NO: 22493 - DNA, 549 bp, Triticum aestivum
  unsure (1)..(549): unsure at all n locations
  Clone ID: PAT_TA_22493
acgcctagaggaggcgacgccgaggaacaccccgacggcgccgccaggtttgatggctggtgaggaccgggagtccatggagcgtggagccaagatgctgaggtcgaacgcgtcggcgatgatgaggatctgtgcaccaccgtcaacgacgaactgatgctgctgcaccatctaagaaacttcatcgatatgtctgcctagtttggttaactccactcctgcgcgagtgtttttggtctcccttggatttgcccgtngggcatggtggtgtttggactgttatactcctgttggagttgcctgggtccgttaatttgcccgtgggcatggtggtgtttggactgttatactcccgttggagttgcctgggtccgttaagtctagaggtttgtgtgatcctggtctccccggaccccgccccgcgccgtctccggtgtccgtgccgttggggctcctcggtgcctgatccgcctacccttcngttcctaagcgtatcttatgttggtctatcggtgaacttganttcgtatcttaatggaagggtatgcc

SEQ ID NO: 22494 - DNA, 620 bp, Triticum aestivum
  unsure (1)..(620): unsure at all n locations
  Clone ID: PAT_TA_22494
cctcgatctggatcgggggggcgtacgcccgattccgccgctgcctgacgcggcctggatccgtccccatcgctctgacgccgtcgccttggacctcgccgcctcgtcctcaaccgcccatcgccggaccgcatcgcctccccctcttccccgagttggatgcgctgctgcccgagaacctcgccggaggccacgacgccagagccaccccgccggcctgcatcctctccgtccgtcgcctccgtccccgtcctcctcctccgcgccccactgccaatcccctatacgcgcgacctcaaagactgctgctgggtacccctgtgattcgactacatcgacgacgaanccttctcttgccagagagaaccagatgctggagcccaggagccagacntcacggtcgacgacgactactacatgggaggtgctactacaacttcaagttgctgacgccacaagaagtatttaaggggaaccaggaaggaggctgcccctccatcagtgccccttgtgcagctcgcagctatggtcttctatccgggcgganccgttgctcgcccgcctcctcatgacctgtagcgacctcccgccgccttgatagangctgntactattattaa

SEQ ID NO: 22495 - DNA, 1045 bp, Triticum aestivum
  unsure (1)..(1045): unsure at all n locations
  Clone ID: PAT_TA_22495
ctggtttccggcgcgggggttgactacctccccacgattatcatgcagcctggcgccgccgttgctgttatcctgccgccgccgccgccgccgccgcctggttcggagaaatgggcaaaagagccatccgatacgcccgtggtggatgccttcgcggctgagcccttcaagggcaaccccgccgcagtatgcctcctcgaagaggagggcgcctccgcggccatggacgaccggtggatgcagtccgtcgccgccgagttcaacctctcggagaccgccttcctcgcccgggactcctccgggggagccggcgcagccccgcggttccacctccgatggttcactcccgtcacggaggttgacctctgcgggcacgcgacgttggcctctgcgcacttcctcttcacgactgttcttccggagcatggcaagctggagttcatgaccaggtccgggatcctaactgccaagaaagtccctgcaccagggagcactggcgtcccaggtgaggagcaggggaagctgtttattgagctggatttccccatgattggttttctggaatgcaacgaaatgctgtcgattccggagaccctaaatggtgctcccattgtcagcgttcacaaatcggctaccgacggtgacctcattgtgggactttcttcaggaaaagaagttgtggatatccttcctagcatcgatgaaattaaaaacttggcctgcaggggtcttattgttacaggaccggcacctgctggatctgggtatgacttctttacacgtttcttctgcccaaaatttgggatagatgaggaccccgttacgggcagtatacattgtgttttgggcaccctattggggcagaaagctggggaagcaaaaattgacggctttcaagcgtctccaagaggtggaacactatacctgcaactggatgaccaaatcagagaggcaaatccaggagaagtcttccgtgtgggggggccgctcccccccccacgttccttggtggttcgtcacnnnatagcttganggacacatcatc

SEQ ID NO: 22496 - DNA, 540 bp, Triticum aestivum
  unsure (1)..(540): unsure at all n locations
  Clone ID: PAT_TA_22496
gagacctatagagagcgcttctccgacaagcactttgatcttgagacggtacttcatgccaagatccgcccactcacagttgctcctaacaagtcattcgttgggtttttccagcctgaaagtgcagaggatggcagtgggtttgacttccttgacggtgccatgtcattcgataacatctgggaggagatcagccaagcagcggaggcttcttctactgagaagcctaccctttatgttgtcagctggaacgaccattttttcgtcctcaaggtcgaggctgacgcgtactacatcatcgacacacttggtgagaggctgtacgaaggttgcaaccaggcatacatcttgaagttcgatgacagcaccacaattcacaaagagcccgctgaaaagaaagaaggcagccctgattccagcgcacaccacaaggattctgcagaaagctcctccaccgagcaggacagcggaaccgacgacaccgaggagagcgtgctcgtgnctcaaggggcaaggaggcgtgcaaggagtacatccana

SEQ ID NO: 22497 - DNA, 929 bp, Triticum aestivum
  Clone ID: PAT_TA_22497
gccggccgggctccgctcttcctcgcttcgccccaaatccattcccctccgcccccttcccgttgtcgaacaaaccttctgcaccccgatccggcctagttcgctggcgtctccacccgatcgactccactgcagtatgctatagcccgtggagcctggggcgttggttgtccggcagtcgattcccgcgggatctgccggggcgcccggagccggagaaggcgacgatgtcaacccctgcaaggaagaggctgatgagggatttcaaacgactgatgcaggatcctcctgcgggcataagtggtgcacctcaggataacaatataatgctgtggaatgctgtaatttttggtcctgatgatactccctgggatggtggtacgttcaagctgacacttcagtttactgaagattatcctaataagccacctacagtgcggtttgtttctcgaatgtttcatcccaatatttatgcagatggaagcatatgtttagatattctccaaaaccagtggagcccgatatatgatgtagctgctatattgacatccattcagtcactgctttgcgacccaaacccaaattcacctgccaactcagaagccgcccgcctattcagcgagaacaagcgggaatacaaccgtaaagtacgcgaggttgtggagcaaagctggactgcagactaaagtcgctgcatccagttgtgatgccagctaattgcccgttagcgccttgagtcctatgtactgaactgcttgcaaggtaattaaaatgttacatcatgctttgtcgtgtatgttgttgggagtgacatttttagacgctcagcatggagattattgtatccagtctacatataacataccatgctgcctttgaatcagatcgagcacaatatggatttgctatatgttagctctgttgtactg

SEQ ID NO: 22498 - DNA, 424 bp, Triticum aestivum
  Clone ID: PAT_TA_22498
ctgacatcatcttcagttctcttccagcaccagagtaatctttggtagctcgttgcagcagcatccttctaggagcaagcaaatggtgccgactctgaagctcaggatcctctccgtggctgccgccgcctgcgtcatggtcagcacggcctacgcggccgatggaccagctccggccccggcctccggcgcctcagcggtcgccccggctgtcgccatggcgtccttgaccgcactcgtcctcggctacttcttctgaggacattagacgacgtgggtcgtgcgcacaatcatttcagaactttctttggttcttctcgtgttcatacatgatatgagtacatattgtaaatttgcatgttcgtttttcatttcaataacatttgttggggcacatacttgtagctgtaactgatcttcccgc

SEQ ID NO: 22499 - DNA, 540 bp, Triticum aestivum
  Clone ID: PAT_TA_22499
ttctatattttttgtttttttatatgaatattttattatccaaatttatggacgaagtgtgatccaacatatgaggggtcttaataattacatgactttttttagacaatataataattacataactgaacgaagtagtatatatgatgcatgctactagggcgtgggcgtctcgaacgtgagcaggccaccggcaatgtcgaagatcatgttggtgcccgtttgcagcaggctgccgaggaccgatccacccttggacggcagtacggtcaggcacactttcaacccgtccttgaagaagtagttctcgggcttgacctccatcgtcgcgttcacgccatcgaacaccagcgtcagccccggctccggcccgtcgcggcacgaccacctcctgtagcacagctggtggaggtcctccgcgtccaccggagtcacaccctgagactcgatgctgctcaccagcgcgcgcctcaaggcgccgtacgcggtctctcgaggtaggtcgccggccaggtcgagctcaggaataccccgccggag

SEQ ID NO: 22500 - DNA, 911 bp, Triticum aestivum
  unsure (1)..(911): unsure at all n locations
  Clone ID: PAT_TA_22500
gcgtcgccgcccccgtcgccggcacgcggagctgaagaaactaagcacgagccggtggaatccatggccatgggtgctgcggcgaccgcggctgcctgtttctcctccgcatcctcaggcgtgtcacggtgtcgcgtcagggcgcaggcgacgtcgtgggcgggaggggcggaggaactggtgcggtcgggcgcggtgaaggccgtccggccgagggacgcggcggaggtcatgggctccgaggggttccagctgctggacgtccggcccgcctgggagcacgaccgcgccgtcgttcgggggtccgtgcacgtgccgctgttcgtggccgacgactacatgggcccagtagacgctgctcaaaaagtgggtccacctcgggctacatcgggctctggaccgggcattccttcaccaagatgaacgaccgctttcctcgacgacgtcgccgccgccgtcgccggggaaaggacgccaagctgctcgtcgcatgcggcgaaggcctcaggtcgctgattgcggtgaggatgctgcacgacgacgggtacaagaacgtggcatggctcgccgggggttttagcaagtccgttgacgatgacttcgccgagctggagggggagagcaagctccggtacgccaccatcgggggagtatcctacatcttccttcagatcttgctgctgctacgggtggtgcagtgaaaatcgaacggaatgcaatggtggtatggaatggcgcgccctctgctccaagttagcctctcaatccagttctgctctcggccttttgatttgcttaattttgcttcagccaagtgttgtatggtagatcgaacgatagttacaaagtaattcagattcagccgcgctcccctttgtcaacatcttgtactacatctnatctattataaa

SEQ ID NO: 22501 - DNA, 1146 bp, Triticum aestivum
  Clone ID: PAT_TA_22501
aaaccacagaagtcggcacaaaaatcaaaaagcggaaatggcaggcagttcttggtctatctactgccttctctcccccaagacgttcttggatagccgtgaggctcaggaatggcgccaccgggcggagcggcggcgggctgtccctgaggaggtccgccgccgccgccgtggccgtccgcgcggaggtgagcttcgtggacggcgacgaggcgaagcggctggtggcggaggaggggtacacggtgctggacgtccgggaccggcggcagtacgagagggcgcacgtcagggcctccgcccacgtcccgctctacatcgagaacgaagacaacgacattgggacgatcatcaagcggcaggcgcacaacaacttcgccggcctgttctacggcctgtccttcaccaagctccaccgggacttcacgaagacggtgaggagcaagttctcgccggagagcaagctgctggttgtctgccaggaaggcctcaggtccacagcggctgcagatgcattggagcgagcgtgcttccagatcctggcctgcatcacctcaggccttcagacactgaaaccaggaacgttggagaccttcggcaaagccgagctgcagaatgcggggaaagctggccttgtgaccatccaggggaagatctccatagttcttgggactgtcttgataaccttgttgctgctcataacagtgttcccggaccaggctgagcagatcttcgagtcggctggcatcaaattgtgatcaggatcgcggctcttctagttactctcttgagttcatatttttcactggcaggttaagtgtatcagtaggtgtacttggtgggatctcttcagactggaaagggatgttaggctccatgtgtaatatttagggactttctgaaaattctactactgtgtatttttggctcgagtaatttcttttttccacacacacccttttctgtgtcaattgtagttcgatccataaattttgtggcgtttcaagtaaaaaacagattatgttcaactcgtcgtttttgagttaggtgcctgtcctccttttttttgctaggcgtgtgcggattagtgctcccaggtcttccagtacttgaagaatttatccatctaaaaaaaaaaaaaaaaaa

SEQ ID NO: 22502 - DNA, 1046 bp, Triticum aestivum
  unsure (1)..(1046): unsure at all n locations
  Clone ID: PAT_TA_22502
attatacacccggcccgagcgctagcagcctcatcacccagctgccctcggcactctttcctctccctcacactaccacaccaccatcatcatcgccaacgagctcgccgcgtgccggtggccatggagaagtgcagatcggtgccgcacgagcacgccacggcggcgtactatgggtgcggcggcgggtacgactgcgcggacgattccttggtctcgcccacgctacccacaccaccaccatcatccgcagcagggagctggccccgcgccggtggcgatggagaagggcggcgccgtgccgcgtgatcacgccacggcgccgtactaccggggcggcggcgggcacgcgtcacgcttccatgggcccgggcggcgcggcgctcaagccgtaaagcttcaacggcccagcgccgtcgaggacccggcggccaagcggcggcggcgggactgtcgtcgtgcaacgatgttcgcccgtcgtgaggctcgcctcatctcctccgtccgcgtcatcccaatggctcaagtccaagctatcggaacgccgttacggtggcctcttaaactttttcctcaacctgccacgaattcctccatgaaactaaacctcttctatatacattgcgtgcatgctgcattgaaagaagtgatatatgtgtgtggctgcttagttgcttctgctgctttctatacgtgcaagcatggcccctaagttggctgcatatatgtgtgtactgtttaattacatggccgtaattatgcatgtatgaactgctgctgtgtgtgtgatgttaagttgctgcatggttaactgctagatcaatccatggatcggtctatgtgtttttggttgcctttttgagagactaagaagaaagacctggtggtttgttccgttacattcctgcttaagttgcagatcaagctgtatcaaagccatggactgtgtttttcctccaaaaaaataaatcaaaagagccatcctggtaagagacttcgcgcgccgggaccaaatcccctggttcnaaaatntccgttattnccan

SEQ ID NO: 22503 - DNA, 722 bp, Triticum aestivum
  Clone ID: PAT_TA_22503
gccggccgggtccacaccgcagagctctccggcagtctggctctctccatcccaatcccgacctaccgcccgctctcgcacgccatggacgccacggccaccggcgccaaggggaagaagggcgcggccgggcgcaaggccggcggccccaggaagaagtcggtgacgcggtccgtgaaggcggggctccagttccccgtcggccgcatcgggcggtacctcaagaagggccgctacgcccagcgcgtcgggaccggcgcccccgtctacctcgccgccgtcctcgagtacctcgccgccgagctgctggagctcgccgggaacgccgccaaggacaacaagaagagccgcatcatcccccgccacctgctgctcgccgtcaggaacgacgaggagctcggcaagctgctggccggcgtcaccatcgcgcacggcggcgtcatccccaagatcaacccggtgctgctccccaagaagacggcggagaaggagggcaaggcgcccaagtcccccaagaagactgccaagtcgcccaagaaggccgccaccccgaagaaggcctaagagatgcgttctgagttgtttagtctgtgtgctgtgtagtgttcgtctgaatagcggagtgaaggtgttctgtctagttgtcgatgtaacctgtgttgtgatggaagaaattcagaaatctcttttgagtttccaaaaaaaaaaaaaaaaggccccta

SEQ ID NO: 22504 - DNA, 676 bp, Triticum aestivum
  unsure (1)..(676): unsure at all n locations
  Clone ID: PAT_TA_22504
tgcccggccgttttggccgccttgtccttgcagatatcaacgagtgccaagacgaacggtacccctgctctgttccggatacgtgcgtcaataccatcggaggatacagctgcgtttgccctgaaaagacatccggcaacgcatacaacggaacatgcgagcaagacaagtctcagattgggtgggagatcgccattgggtccggcattggtgtgatcgtactgatagccaccgcttcctgtgcttacatgatctacgccaaacggaggctcgccaagatcaagagagagtacttcgagcagcacgggggcctgacgctgttcgacgagatgaggtcgaggcagggcttgtccttcaagctcttcacccaggaagagctggaggaggcgacgggcaggttcgacgagcgcaacgtgatcggcaagggggccaacggcaccgtgtacaagggaaccaccaaggacggcgacctggtggccatcaagaagtgcaggctcgccagcgagaggcagcagaaggagttcggcaaggagatgctcatcgtgtcccagatcaaccaccgctacatcgtcaagctctacggctgctgcctcgaggtggaggtccccatgctcgtctacaagtacatccncaacggcaccctctaccggctcatccacggccgccgcgagcgcga

SEQ ID NO: 22505 - DNA, 509 bp, Triticum aestivum
  unsure (1)..(509): unsure at all n locations
  Clone ID: PAT_TA_22505
gtttgtgattctactatccatacgactttcgtgtgatatatccgattcgtggggcgttcggaagaggggtagggcgagatggggctcgcgttcgggaagctcttcagccggcttttcgccaagaaggagatgcggatcctcatggtcggtcttgatgctgccggaaagaccaccatcctctacaagctgaagctcggcgagatcgttaccactatcccaaccatagggttcaatgttgaaactgtcgagtacaagaacattacttcactgtttgggatttgggggtcaggacaagtttagactctctggagnattacttcaaaaacaccaaggtctaactttgttgtngacaacaatgatanggaccgtttttgttnaaccaagnatnactccaanangattccnaattaggatnatttgcccatccggntttncttgtcttncccaanaagcaaattttccaaattcaanaatcngccgaaattncggaaaacttggataaatccctt

SEQ ID NO: 22506 - DNA, 575 bp, Triticum aestivum
  Clone ID: PAT_TA_22506
gaattccccacgacccatggctgccatggccaccgccctctccgcctccctcccgcacctcccgccccgccgcctcccttcctctcccgccgcctcggtctccctcgccccccgcggcttgcggcgtcgagaggctcctcctcgcctggcggccgtcgcctcggcctccgaggtcctcgactccaccaacggcgccgttcccgcgcccgcgagccccgcgccgtcggggcagcagcagtacggacgggagtacttcccgctggccgccgtcgtcgggcaggatgcaattaaaacttctctgctgctcggggcgattgaccgtgaggttggaggcattgccatctccgggaagcgcgggacggcaaagacggtgatggcccgcggcttgcacgctatgcttccgccaatcgaagtggttgttggctcaatcgcaaacgctgaccccaacattccagaagaatgggaggaccatttggctgaccaagtgcaatatgatgctgatggtaatgtcaaatctgagattgtcaaagcaccttttgtgcagattccacttggtgtcacagaggacaggctca

SEQ ID NO: 22507 - DNA, 1148 bp, Triticum aestivum
  unsure (1)..(1148): unsure at all n locations
  Clone ID: PAT_TA_22507
gccgaatcagtgaaagaaaaaattggaagagaggaaagggagagggagaaggaaagggaaaaggataagcttgctgttgaaagagctacaagggaagcccaggctgttgaaagagctataagagaagctcacgagaggtcttttaatgaagctcgtgaaaaggcagaaaaaatggcgttggaaaggattgcggcagcacggcaaagggcttctgcagaagccaagctaaaagaagagagggcaaatgccgaagctcggataaaagcagaaagggctgcagtcgagcgagcaactgcagaagctcgggagagggcgattaagaaggccaaggccgagaaggctgctgcggaggcaagagaacgcagagaacaaatcaggtcctcttccaaggatgttcgacaggacaatcagtttcagagggcaacttccagtggtttcgtaagaaatacagattctagtagcaaagtggttgattccgagtcggctttaaggcataaggcaagaatagagaggcatcaacgcaccactgagcgtgtgtcaaaagcactcgcggagaagaacatgcgtgacctgatggctcaaagagaacaggcagagaaaaataggttggccgatttcctggaccctgaggtcaagaggtggtcgaatggaaaggaaggaaacctgagagccttgttgtccactctgcaatatatccttggagctgacagtggctggcaaccagtgccgcttaccgatctcatcacagccgctgccgtgaagaaagcctacaggaaggcgaccctctgcgtccatccggacaaggtgcagcaaaggggcgcgacgatcaggcagaagtacatctgtgaaaaggtcttcgatcttctaaaggatgcttggaacaagttcacctcggaggagcgctaggatgggatgatggatggatggatggatggacagaagccggattcattttgctaagttgcataaccatattgttggttctttccattgggtattgctgtaaataggcagctcggnctaggtaccancattccaagatgattatagaangactccngangccggtcccnggntggaaangagannagctctggttgttctggaaaatnnatttgngatggttccaaatccaaganctgggggta

SEQ ID NO: 22508 - DNA, 409 bp, Triticum aestivum
  Clone ID: PAT_TA_22508
cggacgcgtgggatgagatgggtagccagggtcgtctaaagactaagtaaggttaattaagagtagtagaagaagaatgatcatcatcagcagcatacacaaagaggatcgatcttatcaaagagaggatttctatttataccttttcttcgagttagttttgtcaggaggtgttgtgtagatatcatgagtgttaatcttgttctaagaagggtctttccggatgaagatggagatggcccttgcagttgtgccgggccatcgtcgtgttcatctcaccaccgccatgtaaccatggttgtacttgtaaaaaagaggatggaaggaaggatgaagaaagtgtgtacatacataaacttgttggttatgcagctgtaccatgtaatcgaattgcataagttgattcaat

SEQ ID NO: 22509 - DNA, 813 bp, Triticum aestivum
  Clone ID: PAT_TA_22509
acctcggtcaccgccgccgcgcccaccaccaccacatccccaccacatatagcaatagcaatagccacagttttgccccgtcgtacacgcacgccgcgccggcggtgaggatccaggggttcgacgtcgccgccgcccggggctcccacgacaccaacggcggagtccagcagcactccgaccgcgcatgaagcctccccgtcagcctgacccgaccagagcccacccgcaagggagaagccacccaccgccgtcgtcctcaccaaccttgtacagttttccgccggccgccgcgtatgtacgtacgtactacgtctagtgtactggtagtatcaccatatgctacgtgtgttccttgtggtatatacatacatacgggtttacgtgatgaattaacatgagatgggtagcgagggtcgtctaaagactaagtaagtttaattaagagtagtagaagaagaatgatcatcagcagcagcatacacaaagaggatcgatcaaaggagaggatttctatttttacttctttttccccagttagttttgtcaggaagtgttctgtagatatcatgagtgttaatcttttctaagaagggtcggtcttttcttccccggatgaagacgaaagatggcctgtgcagttgtgctgggccatcgtcgtgttcatcgcaccgccatgtaaccatggttgtatttgtaaagaagagaatggaaggaaggaagaaagaagaaagtgtgtacatacataaacatgtttgttatggagctgtaccatctaatgccaccgccccaagttgattcaaaaaaaaaaaa

SEQ ID NO: 22510 - DNA, 630 bp, Triticum aestivum
  unsure (1)..(630): unsure at all n locations
  Clone ID: PAT_TA_22510
gcacgagagcacgcccagcgtcgccgcgctcctgcggcagctcggcgagctcgagcgcaccgtccgctccctgcaaggcgccggcgccgaaggcgtcggcgacgggaggcggcacaggcgcaccgctagcgagggcggcggcaggagggtggaggagagcgtggcggtggtgaaggagtcggccgacccgctcgccgacttccggcggtcgatgctgcagatgatcgtggagaaggagatcgtgggcggcgccgacctgcgggagctcctccaccggttcctgtccctcaacgcgccgcaccaccaccacctcatcctccgggccttcgccgagatctgggaggaggtcttctccggctacgagcgcaccccggacttcctcgtctcccactcccacggcaggaaaaggctccccgcagccaattccctccgctgactgacgagcgtgccaccccaaccacggcattgtgcggcgctccgtggatccaataccagccgccgattttcctttctggttgggacaaggtttttagtagggtttggtgagttcttggngnatcattccctttcttcgaattcaanattcngcctngnaaaaacttttnaannggccaaccccnggnaaanttt

SEQ ID NO: 22511 - DNA, 977 bp, Triticum aestivum
  unsure (1)..(977): unsure at all n locations
  Clone ID: PAT_TA_22511
gtgggcgacgcacctaccggccaagcttccaagccatcgcccgtgtcggtggcccagtcccatgcccacggcgcacatggcaagcgcctacctctcaagcttccagcaggccgcccccaccgccaccagcggcggcgccggcgcgtcaccgaggccgaggccaagagcggtggcatgccacgcctccgagccgtcgggcacgggcaggcgttcagcttgcctccgccttggcatcggcctcgccacctccgttgtgcctgtgctccacaccgcgcccgcccgcgccaccgctgacgccgacgaggacccggagccggccaacaacggctggtggctcaccgagttccccttgccggtgcccaagatccgcaacaaggagatcaacaatggcgagtcggggacgcggtccttcgtgaagaatggcatctacatggccgacatcgggccgagcttcgcggcgcacgcctaccggatacgcagctccgccttcgacctgctggcgctggaggaccctgctcggccaaggaggtcctccaactccgtcaccaagtccatccccccgaaggccagcttcacctactaccacttcgacaagcccacgaccgcggcccacgccgacgtcaggccgacgctcccccgcgctagccgaccccctctacgacagctccaaggaagttgcacgccaggccatcaccaccatggactagctcggaagcttgctcgttagtacgcacacttcatgctcattctctgaatgttcatgacaagaatggcctagctattagatagctatctagctcgctaggtcaaacgattctttacgcttctccgtggaatgcatcccacaatgctatgtacatttggtgatactgtgaagtatcacagactggaaggcggcttccaagcaaaaactcaaaacattcttgtggcgtcattcgcggcgcgcatacctggggnaaaanttttttcccacgnat

SEQ ID NO: 22512 - DNA, 2635 bp, Triticum aestivum
  Clone ID: PAT_TA_22512
atcgaatcccccaacgaactcccacttttccccagcggcgtcagcggaggagcagcgagcgagagaggagccaaccctagcgagcgcgcgccatgggataggtaggggctctcggcgggccatggagtgggacagcgactcggacggcagcggggaggaggacgaggaggaggaggagggggagggggggaccgggccgtggggcgcggatgggtgccggggcggcggcgggttctcgctggcgatcgagggcgtgctcggcggcgccgtgcgggctcgtcgtgtccgacgcgctcgagcccgacttccccatcatctacgtcaaccgcggcttcgaggacgccaccgggtaccacgccgaggaggtgctcggcaggaactgccggtttttgcaatgcagaggaccatttgctcagaggagacatccccttgttgatgctatagtagttactgagattcagagatgcttagaggaaggaactgggttccagggtgatctgctgaattttaggaaacgagtggttccccagtttatgatctagtctgcaactaaaagcccatatatgggagaatgatgaaacaataacccattatatgggcattcagttcttcaacgattgtaatgttgatttgggacctttgcctggctctatggcaaaggaagttgtgagatcaatatggattacaccagataataccctccggccaagtccaacagggaagggtaacttttgctctgagtattctcatctcttccaactgagtgatgaggtactgtgccagaagatcctatcaagattgtcacctagggatatagcgtctgtgaactctgtatgtaaacgtttgtatcacatgacaaagaatgatcacctttggagaatggtttgtcagaatgcatggggcaacgacgcaactcgggctcttgagaatgtggctggcacaaaaagtttggcatggggacggctagcaagggagttgactacactggaagccgtcacctggaagaaattgacaatcgggggttcagtggagccatctcgctgtaacttcagtgcttgtgctgtaggaaaccgtgttgtcctgttcggtggggaaggtgttaacgcacagccgatgaatgatacctttgtgctggatttgagtgcgagcaagccagaatggaggcacgtcaatgtggggttggctcctcctggccgctggggccataccctgtcatgcctaaatggatcgctgttggttctgtttggtggatgtggaggccagggcctgctcaatgacgtgtttattctggatttggatgcaaaacatcctacatggcgtgagatttttggccttacaccaccggttccacggtcatggcatagctcttgcacactggatggatcgaagctggtggtttctggtggctgtgccgactctggtgtgctcctcagtgatactcatcttctggatgtgacaatggaaaggcctgtttggagggagatacctgcaccttggactccgccttctaggttggggcactcactctctgtctacgatggcaggaaaatcctgatgtttggtggtcttgctaaaagcggccctttacgactcaggtctggcgatgtattcacaatggacttgagtgatgctgcgccatcctggcggtgcatcaccggtagtggaatgccaggagcctgtaaccccgctggggttggtccgcctcctcgccttgatcatgttgctgtgagcctacccggagggagaattatgatatttggtggctcagtagcaggtcttcactctgcttcacagctctacctcctggatccgaccgaagagaaacccacctggagaatactgaacgtcccagggcgacctccgaggtttgcatggggacacagtacatgtgtcatggaaggatcaaaggcaatagttcttggaggacaaactggagaggagtggacgctgactgaaatacatgagctctctctggcgagctcgttagtttgagaccagaaagtctccagcaaattactccggttcctgaaagccatgcaaatgggaatggtactctcgtgtgtgtatgattggaagaccagtctctagtagatcaaacctggctactctagcaatgtttcagagtcgcctcgtgtagtctatgaagtaggaatacgttctctccgctgctgctgtttgtttggtctactacaaggtaactaatcatcatccataaccctcaatgtgtgttgttctcgtcagatgtttccagcaccttgatagggaacacaaaagggactggcgtcctatacttggagtctccggcgcaacacttatgtgctgcggccccttggcctggccgtgccgccatggctgatgttgtaattggtcctgaaattccgaccgcccaccggttatgttgagctttggttttctgaaccttgtatgttttccgcgagctgcttggttactctcctttcacattgtttgtttactaataccgctgacaaaaacttttgcggtttatacctttgtaagttgtaactctgattgtagctaaaaagttatcaggactggttgtatggaaaaacaggcagagttttgcttccccgcgacatttgttgtagattgtaattttaacaagctcacaagcctc

SEQ ID NO: 22513 - DNA, 225 bp, Triticum aestivum
  Clone ID: PAT_TA_22513
gctttctcgcgctttctccaccggcgacgtctagcgcgtagggcatctaggctgtacctgtggtagtgcgcggcgtgctagctgccgatgcagcatgcactcacctcgcgggccagcgtgctgtcggcactactcgcggattcgcctccgaacaccggcgatcaggcgacgagcggtgctggtggactccgcccatcgtacaccgtcccgggggggggcccggta

SEQ ID NO: 22514 - DNA, 566 bp, Triticum aestivum
  unsure (1)..(566): unsure at all n locations
  Clone ID: PAT_TA_22514
atttaccagttatatctggactagatcttgaactgatctgcaatggtagttgccgcagcaactgctaatgtttattagtctttgtagtatttcgggtcaaaatttgaccatatgtttgtcttaatgcatgtcacaaaattatattgttgaatttgtatttgaatgtagcttcattttatgtttgctttgtataacctatactctctcagtccaagtgtagtcgatttatttcaagtttttataatttgtaaagcaacgacacttattggatggagtattttataagttaagtccgggcccaaaatccgactgaaaatatgaaatttatatacgctgggtgctacacaatacacctcatctgggttaatactccttgtcgtatttgggtcaaattgatnaatgttggcctaatgcatgcacaaatatatgtgaattattgaatgtggttcaattaagttgcagtanaccatacccccatccaaaatatgtagtgattataaatcttattatataacatggactataaggatgaggagattacagtaaatcaggcaaatcgaccaaaa

SEQ ID NO: 22515 - DNA, 541 bp, Triticum aestivum
  Clone ID: PAT_TA_22515
accgttaatgagccccataactttgcaatcggacgcgtgggttttggcatccaagcacctgggaggtgttccattatatctcatttgttctgcaaggagggtacatcatcaactgaaccctatattgtggctcacaacatactcttagctcatgctggtgtttttcatgcttacaagcaacatttcaagaaagagcaaggaggcctcatagggatcgcacttgactccaagtggtatgaaccattgtcggatgtcgatgaagacagagaagcagcagcacgagctatggactttgagcttggatggttcttggatccgttaatttttggccgctacccagcttctatgcagaaacttgtaggcgacaggctgccccagttttcaaaccaggaatcacagttagtatctgggtcactagattttgtaggcataaaccactacacgacattatatgctaggaacgacaggatgcgggtaaggaaacttgtcatgaatgatgcttcaaccgatgctgctgtcatttcaactgcttacaggcatg

SEQ ID NO: 22516 - DNA, 607 bp, Triticum aestivum
  unsure (1)..(607): unsure at all n locations
  Clone ID: PAT_TA_22516
ctgccgcccgtgatggcgagggggcggcggcctgcccaggccgacagaggcgccgcggccgtacgagctggtgttcgcggaggcggagctccgctccatggactgcaacctctcgacgctctgcgacaacgtccaggcagagggattcggctctagcggcttctccaatgccgttgtcaaggccatgggcgtcacctaccgtcttcaccgtctcctcatctcccgcaacacctattttaggtgggcttccttctcgaatatagatgcggcgaccgagtatttaggattccatatactgtcaatgcatcagtacgtctattgggctgcgccgtgtggatgtttcagtatgtctcatcccctcccttcagcaagcagcacactatacatgaggagattgaccccaaagtcctaagttggctatggttatcccatcctcaaatccccaaaagtatgcagtttccattttcctttgtcatgtgcatgtcaacaaaaaagaatagtgnttagatctcatgtaccagattcattgtttgccttgaattgtttatatttatcaggaggaagaggcacctttcccatccaaacttatgtgagtttcataaaaaaa

SEQ ID NO: 22517 - DNA, 391 bp, Triticum aestivum
  Clone ID: PAT_TA_22517
ggatgcgatcataccagcactaaagcaccggatcccatcagaactccgaagttaagcgtgcttgggcgagagtagtactaggatgggtgacctcctgggaagtcctcgtgttgcattccctttataattattttttgcgccttgtgagaaacatgtcgcacgtgcgcgatatatatcaatcccgttatattatgtttgacgtttgcgatatgtttaagctcgatgctcattgctcgcgcgtcttggggcggctttgtggcgcgaagagcgcgttctgaaaggggtggaaaaaactcgtgttgttgcggtatggagggaggggtggaaaccgtggaaaactcgtctccgtgattgagcgggagagtaagtagtataggacattatccattgt

SEQ ID NO: 22518 - DNA, 603 bp, Triticum aestivum
  Clone ID: PAT_TA_22518
aaatcgtctagactcacggaatagatctgttctctctcagactctcagcagcggttatccgtcgtacgctcctctctcggctcagcgcgccctccggacgcacggcggcgatggccgaggcggcgcagggcggggggctacgcggccgcggcgtgctgctgggcggcgtccaggacgcgccggcggggcgggagaacgacctcgcgaccatcaagctcgcacgcttcgccgtcgccgagcacaacaccaaggccaacgcgctgctggagttcgagaggctggtgaaggtgaggcagcaggtggtggccgggtgcatgcactacttcaccatcgaggtcaaggaaggcggcgccaagaagctctacgaggccaaggtgtgggagaaggcctgggagaacttcaagcagctccaggagttcaagccggccgcctgaaaagatgtaaataaatatgttatgtgagctgaaccgctgaagcttgtagctggagcctatcaaaaaacatgccagcctcactggatactggtgtaatatgatgaaataaacctgcttcctgcctgatgtgtatgattgattcccacaagtattttgcttgtttgcacta

SEQ ID NO: 22519 - DNA, 1041 bp, Triticum aestivum
  Clone ID: PAT_TA_22519
cggccttccgtcgcgccgcccccccaccacacccccggtctccgtgctctcagactctctgcagcggccatccgtcgtacaatccaccctccggacgcacggcagccatggccgaggcggcgcagggcggggggctacgcggccgcggcgctctgctgggcggcggccaggacgcgccggcgggggggcgggaggaccacctcgcgaccgtcaagctcgcacgcttcgccgtcgccgagcacaacaccaaggccaacgcgctggaggagttcgggaggctggtgaagaggcagcaggaggtggcggccggcagcaaccactactccaccatcgtcatgaaggacggcggcgcgaagctgctcgaggacgcggtggggtgggagacctcctgggagatcttcaagctgcagcacgagtttccggccgccggcaacaaatgaattaaatatcttacttgcggcagcggccacccgtcggacactcctctctcgtctcagagcaccctccgaacgcacggcgatggccgaggcggcgcagggcggggggctgcgcggccgcggcgtgctgctgggcggcgtccaggacgcgccggcggggcgggagaacgacctcgcaaccatcgagctcgcccgcttcgccgtcgccgagcacaacaccaaggccaacgcgctgctggagttcgagaggctggtgaaggtgaggcagcaggtggtggccgggtgcatgcactacttcaccatcgaggtcaaggagggcggcgccaagaagctctacgaggccaaggtgtgggagaaggcctgggagaacttcaagcagctccaggacttcaagccggccgcctgaaaagatgtaaataaatatgttatgtgagctcaactgctgaagcttgtggctggggcctatccaacatgtcagcctcactggatactggtgtaatatgatgaaataaacctgcttcctgcctgatgtgtatgattcccacaagtattttgcttgtttgtacttcacctcccacaaaaaaaaaaaaaaaaaaggccccta

SEQ ID NO: 22520 - DNA, 644 bp, Triticum aestivum
  unsure (1)..(644): unsure at all n locations
  Clone ID: PAT_TA_22520
ggactatccccggtatggcgccaatggccggcacaacccggagggtccgcacccgtgacagcggccaccacggccgccgcgcccgcgagatcaatgcgcgccggcctagctagccagctgctcgtcaccagatctgctactagttacagctagattggttcgcgcgcacgcgaccatcgccaccacccgtgcctgcgcgcacggcgagctgtcgacgcggccgcgtgccgcgccgttggcccgtggcttcgcttttcgctttccgacgttgattatttgtcttccgctactgcttcgctttctttgctttcgctctttcggccaccggctgctggacctgaacattgtgagttgtgacggcaacccgtatggtactgtgttcgtccttgtttttcccctgttaatggctagtcttttccccgcagggattctgcagaaccaagatccaattcttccttcaggggggccggggccgggtcccaatcgcctctttgaccccctccccggcgctggctcgctctaacgcgtgaccggagtactgccgtccccgactaacccctgtccactcccattccagcgccgtacttccctgcccctccactgccttccgagccccagctaatgcatggaccccctgtacgngn

SEQ ID NO: 22521 - DNA, 1255 bp, Triticum aestivum
  unsure (1)..(1255): unsure at all n locations
  Clone ID: PAT_TA_22521
gcctcccccttgcgcgtagactccgacagcctccagcgtcagattgatgaactggcctcgttctccgactcgccggcgccgtcggtgacgcgtgttctgtacagcgacagggatgtgcaagctcgaaggtatattaaagggataatgaaacagcttggcctctctgttcgagaagatgccgttggcaacatatttggccgctgggtgggttctgaggcagaactaggagcagttgcaactggttctcatgttgatgccattccattttcaggcaaatatgatggggtcgttggtgttctgggtgctcttgaggcaatcagtgtgctccaaaggtctggtttccagccaaaaagatccttggaggttattatgtttacatcagaggagcctacacgatttggaattagctgcttgggaagccgcttaatggcagggagcgaggaactagttcaatcactaaaaaggacagttgacaaccacaatgtatcatttgttgatgctgctgactctgctggctacaagatacacccagacgatctacataatgtgtttttgaaccaagatgcatattttgcttttatagaattgcacattgaacagggccccattttggaaaaagaaggcatcccaattggcattgtaactgccattgctgctcctgcaagtattaaggtggaatttgaggggaatgggggtcatgctggagcagtgctaatgcccgcaagaaatgatgctggattggcggcagctgagctggcattagcagttgagaaatatgttttggaatcaggatcgatagatacagttggaacagttggtattctgcagctacatcccggagctatcaatagcatcccaagtaaatcacacctagaaattgatgtaagagatattgatgagaaaagaaggaattatgtcattgagaaggttcacaaatctgccattgacatatcaaagatccgtggagtagaactatcggaattcaagatcatcaaccaggatccgcctgctctgtctgacaaatcagtcataaacgcaatggaatttgctgcaaaacagctgggcctagaatacaaattgatgataagcagagcttatcacgattcactcttcatggcccgagtttcccccatgggtaggtccttcccccctttanaagggtaaancaaaancccaaaatttcttccccgggggaatggnaacggntnaaaagcnaccttnaaatgcaaatgtccctgnantaacacgtttngga

SEQ ID NO: 22522 - DNA, 348 bp, Triticum aestivum
  Clone ID: PAT_TA_22522
gccagccgaaaagaccccctcggcaccggtgagacgcgctggcgggagcgagagcacgctcgcttggacggcggcggtcaccagtctcagagctgccggttcgccgcgcgaccttcggatgcctacaagttcgagctcggtttctcgcatgacgaagaatacggcgtcgccagtcaggcgccggaggacctctcgcgcaagctgctcttgccggccggccggagggagcgccagggctccaggtccctgaggttcagcagcaagcccgtgtccgcgggcgtctgtggcgcctaacatgccttgttgctttctgtcgagcagtttgcgtgcagctccagaccgttgcga

SEQ ID NO: 22523 - DNA, 479 bp, Triticum aestivum
  unsure (1)..(479): unsure at all n locations
  Clone ID: PAT_TA_22523
ggggcgagcaagctattcccggcggctccggcgttcctggccggcgtcctcctcctcctgctcgtcgtcgccgcgcagctcgccggcgcccagcacatcagctacttcccgaataggccggcgtgcccgggccagtgcggggcgccggggcagtcctacaccagaggctgcacgtacaaggaccggtgcccgcactgagccaacggcggccaggtggtacacaaacacaagccaggtggttcttttcttgccgaataagctgcgtgctcaagtgattaaatccagactcttcatgtaaaaatgcatgtacgatatgtgtagtatctgtgtttgatttcggcagctgcaatcattttctattggtccaagctccgaaacattgcattcaatttggaaacttggtactcattatatagcagttcggaactgagctcaaaataatgtanttgttcttataaaggatatatataatatcaatn

SEQ ID NO: 22524 - DNA, 754 bp, Triticum aestivum
  Clone ID: PAT_TA_22524
ggcaaaacacaatggccgctccttctcccgccgtcgccgccgtcagcagtgcgccctcgtccgggctcctgccggcgcggcgcgcggcgccgtgcagcgccgtccaggtccagctgccgtcgataaggagagccgcgccggggggcaggatggcgacggtggcgcgcgcggtgggcgacgtgggggcggagggcaacacgtacctcatcgccggcgccgggttcgtgcgcatagtccggctcgacgctgcgggcgaacgcggccaggaaggaccaggcgcagatcgtgtgcgccaactgcaacggactcggcaagctcgggcagatcgacaagtagagcctcccctaagcgacgtcccttctccacttcacgcctccttctgcgcatatatgtgcatcgatcccgtcgatcggtcgcgtcttcgtcttcctcctctcgtcctcccctgttttcttgcagttgcgtgggacgcaggaatcctacaggaactgatccatatagagaagatcgaggtcctgtagaattcccgggttcccaactgcatccttcaccgtgatttttcttctttcttagtttcttttaccgcgttgcgccggatgtgtgaggtctcgtgttaataactgtgtgcctgtgtatagatatatgctttctgtggaccgtggagtatatgtacgtgcgtgtatgacacaatgtactaatgtggagcgggattgctaaatctgagtctcctgagtcgactcaagactcaccccgt

SEQ ID NO: 22525 - DNA, 1049 bp, Triticum aestivum
  unsure (1)..(1049): unsure at all n locations
  Clone ID: PAT_TA_22525
aaacaatgcccgccgatccctcccccgccctggccgccccatatcacaccgctcgcgcaaccacactcgccgctccttcccccgccgcagccagccgccaacccccgcaagcaaacaatggcccgctccctcccccgccgtcgccgccgtcagcagcagcgcgccctcgtccgggctcctgccgccgcggcgcgcggcaccgtgcagcgccgtcccgctgccgtcgatgaggagcacggcgccgggggtcaggatggcgacggtggcccgcgcggtgggcgacgtggccgcggagggcaacacgttcctcatcgccggcgccgtggccgtcgcgctcgtcggcaccgccttccccatcttcttctcccgcaacggacacgtgccccgagtgcgacggcgccgggttcgtgcgcaagtccggctcgacgctgcgggcgaacgcggcgaggaaggaccaggcgcagatcgtctgcgccaactgcaacggactcggcaagctcggccagatcgacaatgtagaggcctcctgctgcgcatatatgtacatcgatccgccgtcccgtcgatcgatcgtttcttctgtcttcctcctcctcctgctcccctgttcttgcagtctcgtgggtacgcgggaatcctaggggaaccgatgtcccatccttatagagaagattcgtggtcctgtagttttccccgggtcccaaactgcgcaccatcctccactgtggcttttgttctttcttttagcgcgttgcgcctgatgtgtgaggtctcagtgttaataactgcgtgcctgtgtatacaactatagatatatgctttgtgtggactgtggaggtacatgtacgagcgtgtatgacacaatgtactgaattctaacgggattgctaaatctcagtcactcagactcgaaccagctgcccggcaagaactgcaggctgcacgcctagaatcctggtaatatgctgggctaagttggtaatgggtcaagaaaaaaactccaacccccctgcaaaaaaaaaaactgccccgggcgggccgctcnaaat

SEQ ID NO: 22526 - DNA, 1073 bp, Triticum aestivum
  unsure (1)..(1073): unsure at all n locations
  Clone ID: PAT_TA_22526
aaacaaaagaggacaggccaagcggagaatcgagggtttcggcttccttgtcatctcgccgtctccgacgccggcgaccagggagcgagacctccaacccccgtcctctcgccggctgcgtgtttccccgttccgtagaccaggtatgaagagggccgcgccgtcggaggagccggtggagctctcttccggcgacgacctgagctcggattccgacgatgaggccgggaacgggaaaggcgagaactccttccggctgcccatgtcctccaaatctacagctccagcaaaaggtgcattgatcaggagggctgaaatgtatcaagagtacatgaagcacatcccaattcctgatcactgcagctccttgatcccatccacatcatggctgggactcggaagatcggtgaagcagttgtacgagcagcccttgcattacctcaccaacatcctcttgagacagtgggatcaacagagggttgggagcgataatgagcaccagcctctggatgctatcattcaccctatgaaagctcaagccctcatttgggccactgaagaagtccataggctgaccacctctagtgaccacttagagaaggtctgggctaaagaccccatgtatcatgctaacatagatccagtgttcccttccctaaagttgcattagcaaacatcgcaagttggaccgtcttatcctgtctattttgtttctgcctgctgtgtaatgctggcacattttggttgttagcgaagttatatgaaccatatatcacgtattttaaccgttttatatgtcaaggtcagtggtatcttgccaggccagtgttacctctcctgtagacctccgtgtccatcctaggctaaaccagatgcagcggatcgccttgcttccagcctgcacccgccacggtcccgggcggctaaactaaacggacctccccccccgagggtgaacctactggacttggccactgggaagatccatgagaagaantcaaacgatccttnaaaacggaaccnnaggntgcagtactgaaggaaaaacttaccgngtatnaccccaccaagga

SEQ ID NO: 22527 - DNA, 662 bp, Triticum aestivum
  unsure (1)..(662): unsure at all n locations
  Clone ID: PAT_TA_22527
ccctcaccggcgccatcccgccgtccctcgccgacctcatcagcctctccagcatcaacctccgccgcaaccgcctttccggcgccatcccgtcgctcctcctctccaagtcccccaacggcgcctacctccagctctcccacaacaacctctctggcgccatcccgactgagttcgccgccgtcaacttctcctacgtcgacctctcccgcaacgccctctccggcgaaagccgcctgcctcttcggtgctgacaaggccctccagcacctcgacgtgtcccgcaacgccctcaacttcgacctctctgccatcgagttcccggagcagctcacctacgtcgaccttagccacaacaccatccgcggcgccatcccgacacaggtcgccaccctaaccggctccagcattcaacgtgagttcaacaggctgtgcggaccgtgcccaccggcggcaacatgtccagttcgaccgctacagtactccataacgtccgcctcggccccgcgccgctcacgcctgccgccagangccgtcggtactcattagaggtctcatcatcggttaataaagctcaaaataacatgatatataaatggaangattaganggcaaatntccaagggtngtagnngganccaaggtaaaanntcatttnccgg

SEQ ID NO: 22528 - DNA, 831 bp, Triticum aestivum
  Clone ID: PAT_TA_22528
gcgggatagaacaagcagaaaggctcacacttagttccagagctttctacaatgacaaattcccagtctttgcggagtatttgacgagcatgtttgggtatgatatgatgttgccaatgaacactggagccgaaggagtggaaacggccattaaattggcaaggaaatggggttatgaaaagaagaatataccaaagaacgaggctttgattgtctcttgctgtggatgtttccatggtcggacgttgggggtcatctctatgagctgtgacaatgatgcaactcgtggttttggtcctttggttcctggtcatcttaaagttgattttggagacattgatgggttggagaaaatctttaaagagcatggggatcgtatatgcggttttttgtttgaaccaatccaaggagaagctggggtaataatcccaccagatggttatttgaaagctgtcagagatttgtgttctaggcacaacattctgatgattgatgatgagatccaaacaggcatagctcgaactggcaaaatgttggcatgcgactgggaagatgtacgacctgatatggtgattctaggcaaggcacttggtgctggagtagtcccggtcagtgcggttctccgcggataaggagatcagtgctgtgtatcaagccaggagaacatggaagtacatttggctggaaacccattggcaagtgctgtggcatcccatctctgaaaggggccaaggatgaaggccttgttgaaagacccccggtgggccggcaggcgttcacatttcaaagtcaacaaattccccaaattacaaggaatactggaaagttgct

SEQ ID NO: 22529 - DNA, 751 bp, Triticum aestivum
  Clone ID: PAT_TA_22529
gctcatgcccacaccccaagcgaaaaaccccattcccccctcccaccctcccccatccacaccagcggcaaatagtagtaatccccgccgcccaacccccaccctcgccggcgcgtgcgcttgcgatgcttccgcgccggcgtcggccacgggtggtgcagtgatggtgggcttcttccgcagcggcaaccttgcctcaagggtgttcgaccggcagtttctctctccgcgccccggcgcaaccgttaatactgtcagacaattctatgagaatttggttccaagttacactatatacgacatagattgcccagactattcgtttcgcaagttcaccgatgatggcaagtatcttgtggcctttagtcgaaaccaccaagatttgattgtgtaccgtcccatctggttaacgttttcatgccatgaagaatgtgattctcatgatcttccggccaatgcagagagatttgacagtttctttaagcagctctactcaatctcacttgcatccagcaatgagtacatttgtgaggactttttcctttacatggagtgccatcaatatggcttatttgcaacgtcaactgcacaaagtaatgactcaagtgtcaactgagggtgcaattcacggggtaccatcaattgagaaaataactttctatcttgtaaggctagaaagatggtgcaatactagacgagaaagctttctgcaatgattttatcaatttggctcatagtaattggtgcatac

SEQ ID NO: 22530 - DNA, 588 bp, Triticum aestivum
  unsure (1)..(588): unsure at all n locations
  Clone ID: PAT_TA_22530
gtanaggaaggcaagcttggcgacgccggacaaggtccttttcttgaagtacgaagagatcaaggaagactctgtgggagtcgtgcggaagctcgcggtgttcctgggcgtcccgttcagccaggaggaggaaagttctcgtgtcccggaagaggtcgcgagggtctgcagctttgaaacactgaggagcctacaggttaaccaggtaagtgttgttaatgagcacggaaatcacaggtttcctgctaattcagccttctttagaaaaggacaagttggggactgggcgaaccacatgagccgagagatgggggaaaagatggatcagatcaccaaagaaaactcaagggatctggactcgcattctcatttgcatttctggttcctttccgcacagctctgttcgtactcggacatttcggattaaagaacttcattaacgtgtatcttcccacaatggtgctctacaatctgcataataaatatagacttnctcactatatgtaaaaagggggccggtacaatcgcatatggtctatanccgccacggcgtcgttaantctactggaaacctgntacactacgcnt

SEQ ID NO: 22531 - DNA, 1110 bp, Triticum aestivum
  Clone ID: PAT_TA_22531
ccacgcctccccactccccatccgcgcaagccgggaccccccacccactcggccgcgtagaccgccgccgaccagccccccagtcccgcccccactgccccgaacacccgcggccgactccccggccctcctccccttccccgtcgccgccgctcccgctgtagtaggttgcatgagtgcgggtggtcctcttgacgatgtgccttgtaaggtggtgtcttttgatattcatcaccttcataggatagggtttcgtctgagaggattggctagtagtcttctccttcctgcgaatcgtgttctgcttttgtctggcggttggtcggaaatgggctattctgttcttcccaaatcataggtatgggaagggtaccatctcttttagcgcaggctttttcctggttctcattggatagcctttctttggcatgctcttagaggcatatggctttttcctactcttcagtgggttctggcctactcttgctgttttcctgcaaaggattcgtatccttcgctggatttttcgacaaccatttgtcacttcgttccttgaccgttacagagggaaacgagtgccggtgtagtatcatttcgtgctatgtcttcttatgtagcagttgaagtttttttcccttccctggggataacagcaagtagttgttccatcctggtctttccctttacctgtttacttactggtgactgtcctttgtcaattccaccccccgatggcattttcaaagaccaagatgcaaattctcccatggtatgggctgaagaaacttcatacgtggacccgtacgactcagatatgtagctgcagaggaataggcggctgttgtagaagctacttgttacgtctcttttgtacttacgttcagatatagatattccggtccctcgagtcttgagcttgtgtttgctttatttttgtgcgcacttcatagcttgaagaaaggcaaatatgtgctgccgctctctcgagtcctgggcccgtgcttgctgtggttctgtgcgctcttctcagcttgaagaaaggcaaatatgtgctggaactgaaattaattcatgattcatacaaacttttaaaaaaaaaaaaaaaaaaaa

SEQ ID NO: 22532 - DNA, 751 bp, Triticum aestivum
  unsure (1)..(751): unsure at all n locations
  Clone ID: PAT_TA_22532
gaggtgttgaaaagtgcgggggtttcttctaacccacaggagtctactgccaatgcggaacctgagatttctgcggctgagaaacaagagctccagaataagatggcgaaacttttggccatgctggatgaggttgaccgaagcgtccggcattatttccatcaaatgcaaattgtagtgtcgtctttcgatatgattgctgggtctggagctgccaaaccttatactgcagttgcccttcagacaatatcgcggcacttccgatgtctgaaggatgctatcaacgaccaggttaatgttatccgaaagaaactgggagaggaggatagttcatcgggcagagagggcaagttaactcgcctccgttacattgatcagcagttaaggcaacaacgagctttccaacagatggtatgttacagcaaaatgcctggaggccacagaggggactgcctganaactcagtttcaattcttcgtctttngcttgtttgaacacttccttcacccgtatccaaaagattcagaaaagctaatgcntagcgaggcaaactggtttaacaagaagtcagatttcgaactggttcatcaatgcccgtgttcgcctgtggaaaccgatgatcgaagacatgtataaagaagagaccgggngaggcagagctcgactcaaactcctnctcggacaacttaccaagaagcaaggacaaaaggccgtcttgtgaagacagggaagatctgaaatggctcatgag

SEQ ID NO: 22533 - DNA, 610 bp, Triticum aestivum
  unsure (1)..(610): unsure at all n locations
  Clone ID: PAT_TA_22533
cgaattcgcggccgcgtcgacgtgaaaatggtcttgctcggtttttaattgggtaggacgaaattgataacaagtgtgttacaacagtgcacctagcaaaacatcaactactaatgtttgcataagaaaacagtgtccttaaaaacatttactcttgggatggaaacattcatatatgagggttcattcatctagcgtctaagccaaatagcatcaacataccaaaatcaaagcgctacagcgctacgaatgacgccttaatagcttcaagtgcatccgaagggactggagattcattgccttgcaggcgcataacctcatagagcatcaggtccctgtgaatctccaggttcgctttagttagtgggatctagagtttgtcaccatcataattcctggcaaaaaacgaagcacacacgccatagtcttccttttcaatgttctctaacatgatcacagggaatgcacgggtccattctccggaacgccaggcccgggtcccttatattggtcggaggcatctgcaccgtgcaccgtcaaccagggcgggcacttgtccgcgctggttgacccttcggccgctgccgcctaatgggccgcctncttggcn

SEQ ID NO: 22534 - DNA, 440 bp, Triticum aestivum
  unsure (1)..(440): unsure at all n locations
  Clone ID: PAT_TA_22534
ccaccgccggcgccgccgccatggtcatgcccaccgcctcccacaaggggagctccggcgggttcgagatggccggcggggagaccggcggctgcgactgcaccacctgcaagtgcggcaccgcctgcggctgcgcctgctgcagctgcaactgagccggcgcccaggaggccggccggcagaggcgagcacgaggatgaggaggagaagcaagcaccatcaccagttcaccaccacccagcgtatcagtttgatcaccagccgctgcatgcgcccgcgcgcgcgcgctaaaataaaataaaaccgtcgtgttccaccttaattaattctgtatgccctgcgtgtgttcgaccagtgtccttcctcatgcctccacttcaaatgaatatatggcgcctcaactttcaaaaaaaaaaaacaanaaaaaaaacngggggggg

SEQ ID NO: 22535 - DNA, 720 bp, Triticum aestivum
  unsure (1)..(720): unsure at all n locations
  Clone ID: PAT_TA_22535
ttcttttacggtccctggagatcccatgcatgaggaagctttgtccatattgaagaagctacagataattgagaatgatgctagctccggtgacttctgtactaggagggaatttgcaagatggtttgttaaattatgctcaaaattagagaggaaaaggatgcacaggatcataccgaatctaataacttctggttcagtcgaaagtgcgtttgatgatgtagattttgatgacccggatttcttgtatattcagtctttaggagaatctggcattgtgcctagcaagctatcaagcttctttggaacatcggcaaatggctctcaaagtgccaacacaaattccaacttcctacctgaaagttatctgtcacgttttgatcttgttaactggaaactactagtggagtatccatttgcatcagaactagaccaaaagatgctgagtaaaaatgttcatactttggatttgagcgcttggccagatgtaacagcgtccgtatttgtggacttgtttggcggtgaccacagcnatcgtcangcaaatnttttggaaacacccaggcgccttcaacatcataagcctgtacaaaagcacaaccgctgcgctctgtcagccgaggatggaaggatatactgataactaatagactgaagcagaaacatccggcttctgcnaggtgaatgatggaagattattatagagggatataaacatat

SEQ ID NO: 22536 - DNA, 761 bp, Triticum aestivum
  unsure (1)..(761): unsure at all n locations
  Clone ID: PAT_TA_22536
aagaaagctgttatagggagggggaggaatatagtttttgccccctagaaattcatatccccaccgcccacacccacagacaatcaaccttgtgtagctcctccactgaagtcaaatctggccaatccaaagagctctatctaggagttgcacagttttgagcccttcaaggaatcactctgtccatccatgcacacttctcacttgtagtattcagtccaacacttgtaggattcctataaagtgttatgatctgatgtaggagctctacaagtttcactacaaggaaatggatcataattactacagcaacataaagtcccataaattcatcatgtgacattttgaagttctgctgaatctcataaaaaaattctgaagttttctcagtataggaaaggttctgtgaaccaccagcaatgatttacatgctgcaaagctgtttacgatgcaaactgtcctcactaatgggtgatgcattatcaatctcggtaaaaggttggtcctgtgggttaaggcagacctgggtctcctggtaagtaagttgtcatgacatagttgagttcagtccaactgaagagatgcttcctggaggttctccctctccccctccgtccgtcccgggccccgcccgcggccgggtgtcgtccttttcacccttgcgcccgccgtcatgctccatcattggccgcgtatggctgggaattctcgggttctaaccccgtcgttatcgcccgcatcncgggaccaannagtttatg

SEQ ID NO: 22537 - DNA, 583 bp, Triticum aestivum
  unsure (1)..(583): unsure at all n locations
  Clone ID: PAT_TA_22537
ccgagtgacgtttcggctgttgtgctagaatgttgancgggaggaggatccggacccaggatcggganccaggacgatgttaacntcccttggtgaattacggggaagtgatcaatggggtggtgggagncgacctccggggaggngccaagcaccagggtggcacctggcctgctggcttgggtggcacttgtggtgcatcccagtggacccggagaaaccggcccgtcggatgacaaaggttcgtgaacattgttaacggggagcttgcagagtttgcagatgcccccggaagccttttgtcttcatatgaaaatgaacctatgccataaatcaaaacagggactaccatactctgtcaacattcagggactaccatgctctgtcaacactgtatttctatactttcagtccatataataggtctggagatgtatgaataatcactggtcactaccattgtaatagtactctactagttgtttgcaagacacgcagattcacaattggacttgtattttaacagctacacccatatttatcttcctcgggcccaattccgctcgtgattaaaaaaaaaaaa

SEQ ID NO: 22538 - DNA, 1244 bp, Triticum aestivum
  Clone ID: PAT_TA_22538
ctcgtgccgaattcggcacgaggcagaacgaccgcgcgactctcgggcgcctcccccccgagccccgaccgaccgcccgctccgcccaccctacgccaaaatcaaacccccgcccgtccgctccggtgatccgccgccgcaggaggcgaagccccacgacccgaccgcgcggagcatctgcccgccatgactgagtactgggtgagccaaggaaacaaatggtgcgacctgtgcaaaatcttcatatcgaacaatcccttcagcatcagaacgcatgaactcggcaaacgccacaaggacaatgtcacccaaagattgtctacgatgcaaaaggatggcgctgccaaggaaaaggagcagcaacaagcagcaaaagctctccaactgatagaggctaaagctaacaagagttaccagaaagatttagagaataatcagagaaacactgatggtgacagttctgcagcacctggagaaggatgggtatttgactcaacttcaggatattattatgataagtctactggactttactacgactcgaactctggattctattattctgacggcttaggcaaatgggtcacccaggaagaggcatacaagtgggcggaaacctcaaaaactaatgttgcccaatcgtcgacctcacaaccaaaaccggctggtggaagcgggcctgtcgccggtattaaaggagggccagccccaggtgtggtcgtaacgaaaccactgaacccgatgagagctgtgaagggtgctccgtcagctcttgccgctaacaagagaaaaagagaggacaccaagaagcccaaggtggttaccaaggaggaggaggcggcactcagagcgcgggaagcagctcggaaaagagtggaggacagggagaagcctcttatgggattgtacaagacgtactgagttgtcaatgctcccaagctcaaggtgcgcgcccagtcgcgctaaaacagtggaaatgctgatggatggaattgctctgaaagtaaagattgggagaccagcgccgagccccgagcttttgagcgtcagtgacacatacatgtatgcattgtacaatacctcgtcaagagttcctaaatcagccaggctccctttgtgcgaaacatgtaaatgatcagctcgtcgattatcatctctcgtgttgtgttttccccattataatgctgacaaatgcggccaatgcgattgctgctggagataaaaaaaaaagaaaaaaaaaaaaa

SEQ ID NO: 22539 - DNA, 914 bp, Triticum aestivum
  unsure (1)..(914): unsure at all n locations
  Clone ID: PAT_TA_22539
caatgcgcacaaatagggttnttttaannatctccggtnttggcacgagaggacgtgtatcttngtccgtgcattgatcatgtcatgacggacggattggaagtaacttgttgtgagtgtnattcccccgttgcccgttacctgcagtngtactaatccttntcaangagtacacggaggtcctattattccntgtcagtggaggagggtttgaagctcggttgtgaaacacgtcgagagatcactttggatggagttaaagtcttcgtgtagcgttaggcgccaccgttcatgatgttctatattacatgagtcctatctactgccagcatataattgactcggtctcgggtcagttgaacccaactgtatatgaagtttctgaagagaaatcctggttacagtggaaaggtatcattatatggccattcgttgggaagtgttctaacgtatgatatactttgccaccaagaatccctttccgccccatttccaacagattattttaagatggaagtttcgtctgatgaaggccaagtaggaaaaggacccaacacaattgatcatgactctggtgtaaaagagcatgatacttcttccacttcagggcattcatgtgtagataatgtaaatcgtgtggatgaagagagcaccagaactgatcattcacttacagacaagactgttctgccatgtgtgcttgaaaatgtgccaaacaatgatgatgcacttgaatcacctattccagttgatggggtgcaaactgaagtcgaaaatcaggttgagaatcatcaaatgacatatactgangagctacccagcgtagcacaaangatgctgatgaggcattcaagatcgcaaggacccatgngccctgacaanacagntaatccacactaaanagaggggncact

SEQ ID NO: 22540 - DNA, 544 bp, Triticum aestivum
  unsure (1)..(544): unsure at all n locations
  Clone ID: PAT_TA_22540
gctaacgagattattatctgagcaaaaattcgatgaggcgtttacgatggctcttcaaagaagtgacgtctccatggtatcttggttgtgctctcaggttgatttgcaagggttgtgtagactgaaccccgttcctctgaaccaaggggtccttctggcccttttccagcaactggcatgcgacatagccaacgacacacccctgaagcttcaatggatgacagcggtcgccatggcaatccaaccaacccatcagatgattgcagcgcatgtgaggccaatatttgagcaagtctatggcgtcttggcccgccaacagtcggtgccaaggaaccaccccactgggaagcgaacaacatccgcctaatgatgcatgttatcaactccgtgatgatgaccacaagtgacatgatagggcgcatcctgtaaccgctgtaagtttgaaccaccatatgatcatttgtgacccgtgtacagaggaantttgaaaatggctcttgaaccggcaaatggaatgataactaaaagngtggtatggtatgtc

SEQ ID NO: 22541 - DNA, 539 bp, Triticum aestivum
  unsure (1)..(539): unsure at all n locations
  Clone ID: PAT_TA_22541
gaagatcctgctagtcgctacaatagaccgggggaaatcactaccgccggggcggagcagagaatccactgctggaggttctgaaaaggaggcgggggcaggtcttgggcgctcatcggcactgtcagccggggcggagcagagcaacccgggcgcaggaggtgctgaaaaggaggcatcggccggtcttgggagctcatcggcactctcggtcgtgtgcatctcggccggaaattccagtaacgaagcccccgttccccttctgagtcggaatccgttgatccggaaagacttgcctgggggttatgagtaaaacaaattttctacctatatatgctaatgaattggtcaaagtgtatagatgtatatgtaggttttgtacctttgttgggctgtgctcactatgtatcaagaattaattgtaggttcctaaaccatttaactcaatagcctttcattgccaatttgctgtgcancatgttgtaaaatataagttgtataatttaatccttcagtctccacatttcaaaatctgttca

SEQ ID NO: 22542 - DNA, 683 bp, Triticum aestivum
  unsure (1)..(683): unsure at all n locations
  Clone ID: PAT_TA_22542
actgtcgtgaatggtctttttgcgcacatgagcatgaaggagcaactccaggctatcctggaagcttcagtcataataggggctcatggggctggtctgacacacctggtttcagccacgccagacacaaaagttcttgagataatcagcagcttctatagacgcccacattttggcttgatctcacgctggaagtcgttagaatatcatgccataaatctccctggatcatatgcaagtatcccagatgttaccagtgagttggggaatatactgaaaggtctcggatgctgaaacagagtgattcttggcgttgaggtattcgccgtgaaaaccgccacgagcattgttgagtgngataattctgtttagttcatatacactgggtcacactagccacgcccatgcttgcagttacagttggagagcgcactctactggtcattcattcagtcacgcccgtggcctaggagccacacagccccagttcttcgcagaggaattttcggctgccagatgtaaaccgattttccgctgacaagctactgatgacacgaagaaacccaattgacactgtccattccgttctcgacgtgttcgccccgctccgggggatggatcgaactgtaattgtaattttatcgtttgggcttggaaagtttttgtgttgcaaaaaaaaaaaa

SEQ ID NO: 22543 - DNA, 652 bp, Triticum aestivum
  unsure (1)..(652): unsure at all n locations
  Clone ID: PAT_TA_22543
gggatntcnaancggaggctncggcccgaggccggccccctcactctctgttcttccactgatctccggcggaagcggcgggcaaggggagcgtcaaggttcagcaatggcagctccgaatacctacgctgtccatctctcctcggagacccacaagatcgaggcctggtgcgaatcggacgaggctttggctaagcaattgcaagaggaggaggattcgctcgctacaagggaatttgccggcagcgtgtccttggaaccatcatcaccagctgttgagtataggcctgccaataatgcagctcaggtggcgaccgaagataatgtcgacccggataatatgtcatatgagcaactacaagcaatcggtgaagaagtaggaactcaatccagaggattatcagatgatctgataagctacctggagccttttaggaacaaatgtaacttcttctcctgcaaaaagaataccgatgaatgtgtgaatctgcaaatcgaactataaaagcctacagaagttgataagattgccctgcagccattgttaccatgcaggttgcataactcgctggcttaagattaacaaggcatgcccactctgcagtatcgtgtcttcggttaacttcccanggttntggatttttttncccnc

SEQ ID NO: 22544 - DNA, 609 bp, Triticum aestivum
  unsure (1)..(609): unsure at all n locations
  Clone ID: PAT_TA_22544
tagcgtggtcgcggccgaggtggtattacaataactgagtgtcttactgaattccttgatcgaacttgaaattttggtgtgtctcagaatgatgctccttctgatggactgaatgattttacggaatttattctcatgtctgtgcagtgggagtcttgtacccgcccgggcgccccctcgtggccaagcaccagtattggatgcgtcatatatcggactgatcaaacccaacagcctcgttcggttcagggggatggttcaggacatgctcggggcgggttctatgccgactctttaaaggatgtgctacctggaggacaaaaaattcacagacttctcaccattctcgatgatgtacccatgtgattcacatctctgggtgcgccatctctgccattgcgtgcctgtgcataagcagaatcttggatactggatctccccctggacctgtcttcnccagatggcaaactggttgacacctgaaaaaagagataaaagaagaaggatggggatggtgatgtcaatgtagccctgggatgtttggtacanaatgatccaaatttggnntcacaaacacattgtancaagcatgnntntaaaaaaaaaaaa

SEQ ID NO: 22545 - DNA, 513 bp, Triticum aestivum
  unsure (1)..(513): unsure at all n locations
  Clone ID: PAT_TA_22545
ngtatacaggggaaacatcatttaattctgggttcgttttgtcttttattaaaaatagttggtagtgaacttaatggaacatgcatttatttcataacaagtcgttggtaccaggttgctgctgccgccggatagcgcgccctcgccctattgtgtctaggtgaaaacaccagcatgttgtttgaggtgcatgcatcggttgcagcggaagatgtgcgtatgaagatgcatggctgaccatggagcactgcaaggcttcagaatatgtaccgcaacttgctcctaccaccatgcaagtggtcgatgcttcagttatgaactattgattaatccctcttttttctttgatctatgtgatggtaccccttaccataaatacttgttatgtgaattcaatagaaatgatgttttatgaatgtttgatagttataaaacaaatgtcatagacgatagctattgctattatggaggtgttttcaactattgttcaactgctattcaaaaaaaaaaaaa

SEQ ID NO: 22546 - DNA, 417 bp, Triticum aestivum
  unsure (1)..(417): unsure at all n locations
  Clone ID: PAT_TA_22546
tttttttttaatgttcttccttctgtttctcaccaatcatcaaagtcagaggccaagggctgctactacatggatccatttgctccatcaacaaattactgtatggacaacggttactatacaagcaaaaatgagcattactaggcgatttccaggggccaaagccaacagcttcatcatatctgacgatgatgctacactactaagtactcgctaaatagaaaagaaagatctggcgagcagtttcagacggaaaaagaatcagctatcaatatggcaagaatgggccagggtgctcatctcctagttcgancctgccagttccttgctacatgggacgtcgacgatgacgaagatgaaaggtttcgttctgttaaacccccttgtcctcgctgaanccttcaaaactacttgcag

SEQ ID NO: 22547 - DNA, 524 bp, Triticum aestivum
  Clone ID: PAT_TA_22547
cgtcccccgcagcgggcctcccccccgcccctggccctccggcgctctcgccggcgcgtggtgccccgcgcgcagttcgcctcccctctccttctcgcgccgtcgccctcgtctccggttccgtgcgccccgccctgtgcccgcgccgcgtccgtcggggcccgggtggggcgtcgcgccgctcgccctggccgcccacggatctcctcgttgtgcggtgcccctcgttcgcggtgcacggcctctgccgccggcgccgtgcggccccaggccctgttcgcacgcgcggccacccccgcttcccttctcgtccggttccttttctcatccattgcggtgcgcgtggggcgcccgtgggtgctcttgtgcaatccctctttgttccccctcgcctccctctgtttggtgcgctttggggtgcggtgccctctttctggccgcgccctccgctcggcaccgcgcggcgtcaagctcagtttgcacgcgcgtgcagctctgctacctatttcgtgcagttctttttc

SEQ ID NO: 22548 - DNA, 598 bp, Triticum aestivum
  Clone ID: PAT_TA_22548
atgtgaccgttgaccctagagctcttgctatctttgagcatgcctcaaagctcgtcggaattgatgagcccaaggctgagctgatcaagttgttaactgacaaggatggagttgcatcaacacaacaacaagtgaagatggtctccattgttggatcgggaggaatgggcaaaacaactcttgcaaaccaagtgtatcaagagctgaaagagaaattcaagtgtaaggctttcatttcagtgtcacgaaatccagatatgacaaatatcttgagaaccctccttagtgaagttgggtgtcaagattatgctgacactgaagcagggagcatacaacaactaataagaaagattaccgactacctagcagaaaaaaggtatattatagtgattgacgacatatgggatgttaaaacatggaacgttattaagtgcgcattccccatgaccagatgcagtggtgtaataatcaccactacacggctgagtgatgttgcatgttcgtgtcattcatcaaccggtggccatatttataatataaggcctcttaatgtggagcactcaagacaactattccctcgtgccgaattcggcacgag

SEQ ID NO: 22549 - DNA, 1122 bp, Triticum aestivum
  unsure (1)..(1122): unsure at all n locations
  Clone ID: PAT_TA_22549
gngnagnnttgatacncctgctcgaaattaaccctactaaagggaacaaaagctggagctccaccgcggtggcggcccgctctagaactagtggatcccccgcgctgcagcatcgcccccgaatcctaaaccctagaacacacacagcacacgaacgttgcaaaggctctctcttcccgtcctctctcaaaactgcctacagaagagggcagggcgagatccaggagttcctctgtccccgtcggcaagaccggtggtctccttcacctccggtggccattatggctgccggaggggtgggagatcccggatctgatgcctggcggtgtatatagtcctagattttctaggtttggtgtcctttgcaccggcgtcatggcggaggaggcgtcggtgtgcggaataaagtggccatgtctccttcttcgctcgcccggcgtcgttcttggcactagcgaggagctggggtccttttggtctcgcggatctgagtgtttacgatcctgcgagttggtcgtcgtcgtcatcggtcaccgctgggctctttggtgtggcgagacggcgaggggggtcgaggattctgacccatggcgttcgcggctttggccctgtggagcggtggttggggcttgtccgcttcttcggctccatgggaagatgcttctggcgcttcttttgttgtggatgcgggaggtggctacgacaaggatgaaggactggaggttgttcatcggcgattggtctttgaacctgcttcagcgaagctggccgatgcggatccggtgcggcatggggcgttgctccggccgcctgggcttttcagctctgctcaagatctcgcctctcgcggcgggctacgattgtgcggctcacaaagcttacaagcgatggtgcttctccggatctaaaggggttgctcgcttttcttctctctccggcggcgacgacggcgagatgggggtagcagcggctgtgtggttgagttggatttggtgttcttccgtatcctgcgtggatgtactcgtatctactgtatgtctccttgtaatgttttccttaacataatataatcacgagtatttccctccaaaaaaaaaaaaaaaaaaaaaaaaaaaaaaaaaa

SEQ ID NO: 22550 - DNA, 1631 bp, Triticum aestivum
  unsure (1)..(1631): unsure at all n locations
  Clone ID: PAT_TA_22550
cgtcaccggcgggaatgcttcttggcggctccggcgacgacatgcgcagctgctgcgtccggtccccttggatggccagcggccgcggcctcgcctccaaacccgccgggcagcccatctacctgacattcccggccgactccaccttcagcgaggaggacgtgtcctcatacatccgtcgttactaccgtcctgagcaggaagtgcgcacctcatatcagcagaagcgctcgttcccctccttcccctactgctcttgggatgcccccttacaaatcctgcttcttccaagcgcccagttcctcaccggcccatggggccatggggcggtgaatattaagcagaaaacaggggtctcctttccccttaagcagcggaccccgcagcacgccgactgaagcgagtgcacgaagggtaaagggctctaacatataagagaagtgatcgagagagaggcgcagcgacaccacccaacaacagcaacagcaaaaaaagggaaaggaaaggctaggttgttttagctctagccagactaaattaagtcggccggtatatgatagtagtagtataaataatacccccccttcgtagtaagctgctccaacaagaagaagacggtgtgcctgtcttatcgtcctgcagtatctccgacgctgtctctcccgctgcccgatggtttcggcgacggctctcacattcatgtggaggatgctgcaatccaagatcacaagatgagcagtgccatgatgatggcgtctgctcctgctgctatttgtgccaccattgccacgcagggcatgcgggacgagggcgacgggnagtgccaaccaaggggtcaactccggggaagatgagaagagggaacctggtcctcctggagcagcagcggccagtgctaatggattccaagaaagcggcgtggaggagcacaacctgcctgacagcccctttgcatctcccacaaagacgaaggatgctgctgctgcttcttcctctgcagaaccagcccacgctgggtagcatcattggcaacaacagcagccctcatctggtggcctcgtctctgttccctcctaccccaactgcccttgagctgcccccatacaaatcctgcttcttccaagtgcccaggttctctcctggccatggagccatcgggctgtgaatattaagcagaaaacaggggtctcctttcctcttaatcagaggaagccgtgagcaccccatgaagtggatggaaggaaaaggctctaacaaataatagatgtaatccccagagaggagcagcgacaccaccaacaacaacagcaacagaagaaaggaaaggaaaatctaggttgttttagctctagccagccttaattaagtcagtcagtatatgatagtagtagtataaataatacccctccttagtagtcagctgctccaagaagtagtagtaatcaagaagaagaagaagaagaagaagaaaagaaaactgtgtgtctgtctatcttcatgcatcattttgtatgctgtgctctgtaattttaggaggatctcagaaggtgagctagaacaaccgggaagtatcaaaggagatggtcttggccttcttgcctggtgggctgcaggtgaagaggatggcttgg

SEQ ID NO: 22551 - DNA, 348 bp, Triticum aestivum
  Clone ID: PAT_TA_22551
tagcgtggtcgcggccgaggtacaagagaatgcaaccgatcgaccaaccatgggagatgttgtttcaatgctaggcagtgagactatgatcttggatgagcctaagcagccagcatatatcaacgtaagagtgggaaatgaacatgcgtccactgctcccgactcagatagtattagggatatggccttatctgtcacaactccgagatagtcttttttcctcgtgttatgatttttagtgtcatgttgtagtattcacataacttagatgttgtacctgcccggccggccgctgttgtctcaaatgtgaaatctagatgaaaagctgtaaatagtaaaaaaaaaaaa

SEQ ID NO: 22552 - DNA, 620 bp, Triticum aestivum
  unsure (1)..(620): unsure at all n locations
  Clone ID: PAT_TA_22552
cggcccgaggtacgagacngggacctccggggccgccagacgtgngggaggtctatggcagcctcgctctcgggcaactagccccccagctgctcccgcacgtcctctcaaaggtcgagcttgtagagggagacggcggcgtcggcacagtcctgctcgtcactttccttttgttaggagcttccgaaccaagaagccacaaggagaagttcaacgtagtcgaccatgagaagtacatcaaggaggcagagacggtggagggaggctttctggatctcggcttccggaaatatttggtgcgattcaaggtcgtaggaaaagaagatggcgcatccgttataagatccacggttgagtatgaagttgatgcagagcatgccaagaatgtctcctttgtcagcacagaagcaatggcttctattgctgaggccatcaccaagtacatcaaggagcagaagaagagccacgagcaagccgccgagtaaaattcagaagaacatgcatgtagctgcataagagtatgaaagacgaagtgtccaactgaaatgactgtggcagccaagttcgagcaaattcccctgtaccattttgttctatatatgcagtgctcatgcctttgg

SEQ ID NO: 22553 - DNA, 1242 bp, Triticum aestivum
  Clone ID: PAT_TA_22553
gggcatcttcgccatgtggttgacatctccttccctcctctcttccccgctcccctcccgcggcgccctcgtcttcaagaagccgtctgcttcgtcgctcgcagtctcaacggcgaagcgtggagtccgggtggtcgcagaggccgcggcggtatcgtcccccgcatcgtcggtgtcggcacagcggacccagccgtcggcagccgaggtggcgcggacggtggttgagctcgcgccttccgggacgctgtccgtcgtgggcgccgacggttggccgctcggtgtcggcgctcgttttgtcgccgacgccgctggcgcgcccgcgctctgcctagccacagcgggagtgaccgtgcctgatgcgcgggcaagttttcacgttgagtttcggcaaagtggagccaggacaccacaatgtacttttcttggtgccttgactaaacctagtgataaatatatgctgaagaagctgtctactaggtgggaaaccaaatttggggaggagatagatgaagatcgtttgtatctaatatctgtagagcggatcttgcacatggaagacttcaacgagggccgtgtgtgggtagtcccgtcagaatacagtgatgcagaaccagatccacttcgaaactttgctgaaagcgttgttgaggaaatgaacagtgaacatgctgaagatgttcataggatatacaatatttatgccgaatcagattttcaggcattggatgtgaagatgatttgggtagacagacttggttttgacttgcacgttcattctgaggaaggcatcttcgctgttcggatacctttctcaaggcaggtctctgaccagaaggcggtgaaatcgtcattcaacatgatggctcatcatgcatgggaggtggacaagagttatgccaccccagagtttgagaaggtacaattcttgaagaaggtcacatagatggtgtgatatctgtattcgatatgatacctccattgtcagtattttctgtcattttttcctttttcgaaacgtttcctttatcttttagcacaaagcgaactattcttcgccttttctgtcatttagatgactatggtgtgatatctctgcctcttaacatatacggagtagtttaatgtctcggggtgccttcccccccccctcgtcgccttatcggcctcggattggcgccattctgcgttaagagcggcccggttcgaccgccatgtttcttgccccttgtagttggttca

SEQ ID NO: 22554 - DNA, 550 bp, Triticum aestivum
  Clone ID: PAT_TA_22554
gatcaacccattggatttccagcaaaaggttatacacaatgtggatcacgtcatcaaccgtatcaaatccatatcaccacattatcttgctgacgaggaggagagcacaacagaaccgccccagtctgtccaaagaggcgttacagaactggtggaatcggcgctatcttcgaggaacctgtgcatgatggatccgacgtggcacccgtggttctgagggacgcgaatcacattttgtagcctaatgagcaactagtgtctccctagttaatatctcctgtagtcctgtgaatataaccttatgtagcagaaccggtccgctagcttgtatcgtgttcgtgtagataaaggaggaagctggggttgcagctctgttttcctgccggtattgacatagtctgattttgttggtttagctgggcagcatgaatgaaccaacggtaacatgtccaatttcgaaaccgagacatgactcctagagaatgagattcaacaaataattgttgtgacttttgtcataattgtggcagacgaatccaaaaaaaaaaaa

SEQ ID NO: 22555 - DNA, 694 bp, Triticum aestivum
  unsure (1)..(694): unsure at all n locations
  Clone ID: PAT_TA_22555
ggcggaagctgtccttcagatttgccatcgtgacggtgctgaatacctcgtccgggatcttggtctgttggttgagaatgcaacagtagatcaacttgggacagcaaggaaaatcacaatccatcagactacaactaccctcatagcagatgcggctagcaaagacgagatccaggcgagggttgcacagctaaagaaggagctttctgaaactgattccatctatgattctgagaaatggctgagaggattgccaagctttctggtggtgtggccgtcatcaaggttggagcaacaaccgagacagagctcgaggaccgtcagctgcggatcgaggacgcgaagaatgccactttcgcagccatcgaggagggcattgttcccggtggtggcgcggcgtatgtgcacctgtctacttacgtccctgcgatcaaagaaaccatcgaagaccatgatgagcgccttggtgctgacatcattcagaaggcattgcaagcaccggcgtcactgatcgccaacaacgccggagtggaaggggaggtcgtgatcgagaagatcaaggagagcgagtgggagatgggttacaacgcgatgaccgacaagtacgagaacctgatcgagtcgggcgtcatcgaccctgccaaggtgacgagatgcgcgctccagaacgccgnctcggtgtccggaatggtcc

SEQ ID NO: 22556 - DNA, 745 bp, Triticum aestivum
  Clone ID: PAT_TA_22556
catcaagtccctcctcctcccctgcctccaccttatcctcacctcacctcagctcaccagctcgcccccgcccccaatggcgtccgccaacgccatctccaccgcctccctcctccgctccttctcctcccaggggaggctgaggaggtccaagaacggccgctcgtcgcggctggtggtgcgcgcggacgccaaggaaatcggcttcgaccagaagtcccgcgccgcgctccaggccggcgtcgagaagctcgccagcgccgtcggcgtcaccctcggcccgcgagggaggaacgtagtgctggatgagtatggcaaccccaaagtggtgaacgatggtgttaccattgcccgtgctattgagctagctaacccaatggaaaatgctggtgcagctctgattcgtgaggttgctagtaagaccaatgattctgctggtgatgggactacgactgcttgtgtccttgctcgagaaatcatcaagctgggcattttgagtgtaacttctggtgcaaaccctgtatcgcttaagaaaggaatagacaaaactgtccagggtctgattgaagagcttgaaagaaaagctagaccagtcaagggcagtggtgatatcaaagctgttgcctctatctctgctggtaacgatgaactttatcgagccatgattgctgatgccattgacaaagtgggcccagatggtgtcctttcgatcgagtcatcttcatcttttgagactactgttgat

SEQ ID NO: 22557 - DNA, 1112 bp, Triticum aestivum
  Clone ID: PAT_TA_22557
taggggcctttatgcaaaagaacgacagtcatttggggtttgatgatatcgccgacataatttgatttatttccaaacacaaagacatttagaaatactagacagcaacaagccctgaacttgccaaacatatccaactacgttatttcatgacacgggaacgatgcaacacatgtaacacactaacatgtcgatcacgacaactcgcaaacagagctaagcagtgacagtggtcttcgaagaagaacccgagatcgctccagcctccgtcagcagagcaaccagcttccctcccttgttcagtgcaatagtatcgtcacagccaccaatgtgttttccattgatgaagacattgggaacagtcctctgcccagtccattcagcaagagctgactgaatctcagttccatcgctttcagtgtccaactcaatggccttgaaacttgctcccagctgcgtgaacaacttcttcacttgtacgcagaaagggcagtaagacttgctgaagacgacgacgggagcggaggcgacgatctccttggccttggcgagcgccatagctctggactctggggtggaagaggaggaggaggaggaggaggaaaaagcggtccccatctcgcccacgggcgccttgtatttatacagccggagggcaggtgagcggcgggcggcgagggcgctgtgctggtggggcggggctgggctcgcgtaatcagtgaggcgtctccagccgacgaccgcgtgggcgtggtagatcggacgcgtggggcctcggtgtccggaatggtcctcaccacgcaagcgatcgtcgtcgagaagcccaagccgaagcctaaggtcgccgagccagcggaggggcagctctccgtctgattgagctgtatgtaaagctctcttcaggcctcctccgtgtttttaaatgcttctgttcagacaggccaagcagtagaattttggttgagatcaactggaagtgaaaggtctagagtaagagtaggattgccatttttgcgactcaaacggtaaaccttcctcgcctgatctgaactcttgtgaatcagagaaatattccgcttcatttttgaaataaataaatactgataaccccc

SEQ ID NO: 22558 - DNA, 714 bp, Triticum aestivum
  Clone ID: PAT_TA_22558
gagcggccgcgcccttaggggcttttttttttgatttccccaaaataatttgctttatttttaacgagttttaccctgagatttaacagtcgctgcggacatgctagacagcaacaagccctgaacttgccaaacacatccaacttcgttatttcatgacccgggaacaatgcaactcatgtaaccccctaacatgtcgatcccaacaactcgcaaacaaagctaagcagtgacggtggtttttgaagaagaaccggagatcgctccagcctttgtcagcagagcaaccagcttccctcccttgttcagtgcaatagtatcgtcacagcgggcgatgtgttttccattgatgaagacattgggaacagtcctttgcccagtccattcagcaagagctgactgaatttcagttccatcgctttcagtgtccatttcaacggccttgaaacttgttccaagctgcgtgagcaactttttcacttgaacccagaaagggcagtaagacttgctgaagacgacgacggaagcggaggcgacgatctccttggccttggcgagcgccatagctctggactctggggtggaagaggaggaggaaaaagcggggttttttttttttttttttttttttttttttttttttttttttttttttttttttttcattattggtaaacagaataaggtaccagtgtacaccccgacccggccggc

SEQ ID NO: 22559 - DNA, 2020 bp, Triticum aestivum
  Clone ID: PAT_TA_22559
gtctcttttcttttaggccttattgcgtccctccttcttctttgctttcacctttgatgatatcaccaagataatttgctttatttctaacgagttttacactgagatttaacagtcgctgcggacatgctagacagcaacaagccctgaacttgctaaacaaatccaccttcgttatttcatgacacgggaacaatgtaactcatgtaacacactaacatgtcgatcacgacaactcgcaaacagagctaagcagtgacggtggtcttcgaagaagaaccggagatcgctccagcctctgtcagcagagcaaccagcttccctcccttgttcagtgcaatagtatcgtcacagccaccgatgtgttttccattgatgaagacattgggaacagtcctctgcccagtccattcagcaagagctgactgaatctcagttccatcgctttcagtgtccatctcaatggccttgaaacttgctcccagctgcgtgaacaacttcttcacttgtacacagaaagggcagtaagacttactgaagacgacgacgggagcggaggcgacgatctccttggccttggcgagcgccatagctctggactctggggtggaagaggaggaggaagcggcgctgatcgccaacaccgccggcagtggtataggtggtcggcagcgaggggagcagggagagcgagggggagggggggtgacgacgcgatgaccgacgtgttggggaacctgatcgagtcgggcgtcatcgggcgccgccaaggtgacgagatgcgcgctcgagaacgctgcctcggtgtcccggaatggtcctcaccacgcaaggcgatcgtcgtcgagaagcccaagccgaagcctaaggtcgccgatgccagcggaggggcagctctccgtctgattgagctgtatgtaaagatctcttcaggcctcctccgtgtttttagatgcttcagttcagacaggccaagcagtagaattttggttgagatcaacaagaaaaaaaaaaaaaaaggcaagatcttgatcggctgtttgaaaatgcaaaaggagaccaatctgtggctggagagaacaacagtataccaacttgagacagcaaggcatattagaattcatcagactacaaccaccctcatagcagatgcggctagcaaagacgagatccaggcgagggttgcacagctaaagaaggagctttctgaaacggattccatctatgactctgagaagcttggctgagaggattgccaagctttctggtggtgtggccgtcatgagacagagctcgaagaccgtcagcttccgggagcgaggacgcgaagaatgccactttccgaagcatgccgaggagggcattgttcccgggggtggcgcggcgtatgtgcacctgtctacctatgtccctgcgatcaaagaaacaatcgaagaccacgacgagcgccttggtgctgacatcattcagaaggcattgcaagcaccggcatcgctgatcgccaacaacgccggagtggaaggggaggttgtgatcgagaagatcaaggagagcgagtgggagatgggttacaacgcaatgaccgacaagtacgagaacctgatcgagtcgggcgtcatcgaccccgccaaggtgacgagatgcgcgctccagaacgccgcctcggtgtccggaatggtcctcaccacgcaagcgatcgtcgtcgagaagcccaagcccaagcccaaggtcgccgagccagcggaggggcagctctccgtctgatcgagctgtatgtaaagctctcttcaggcctcctccgtttttttagatgcctcagttcaggccaagcagtagaatttcggttgagatcaactgaaagtgaaaggtctagagtaagagtaggattgccatttttgcgaatcgaacggtaaccttcctcgcctgatctgaatgaacttttgtgaatcagaaaaaatcttcagcgtcatttttgaaataaataaatactgataacacaaagcggcctaaaaaaaaaaaa

SEQ ID NO: 22560 - DNA, 988 bp, Triticum aestivum
  unsure (1)..(988): unsure at all n locations
  Clone ID: PAT_TA_22560
ctgccgtacgggccggccggcccttgccgcctccccccgccccaaacaagccccgcccccgttctgtccctccgcaaaaccctagctccgtacccgcgcggcggcctccaccatgaagggcaaggccgacacctccaagaagggcgagggcaggctcaaggccgccggcggcgccagcaagaggaagaaggacgccgctgccgctggcaagcccaagcgcccaccctccgccttcttcgtcttcatgtctgagttcaggcagcagtacaacgcggagaaccccaacaacaagagttgtcgccaacgtgagcaaggcggcgggtgagaagtggagagctatgtctgatgaggacaaagcaccttatgtggaaaaggctgaacaggaagaagaagggactatgagaagaccaaagccacctttgataacaagggagagtgcgagctccaagaagaaggcaaagactcagaacgattaaggaggtcaaatctgagggtcgaaggatgagggtagcgatgaggaaaacgagggacgatgatgagtaaatagtgtatcagaggtattgagggtagcaaattgggtgttgggtccccgcttagttgtactagtttgctatcctgctatcctcagtgttagatgatgagatttggaagtagatgttgtgtttgtgtgttaagggggcccttttagacttgtggactcatggtttgagaagttgcttagtagtgtattagcagagaggaagctgagaatgctaccagctgttccaatgcttcttctctttgctaaccacctgtgtaagaacttgttttcattcgctaatcctgatgactgcccagccattgctattggttaatagtttaataatcgtcaaaaaatagccgcggcttccctcattcgacctaanaagtgagtcgtattaccgcgccgctcaactggccgttcgttttacaaacgtccgtgaactggggaaaaaccctggcgttaacc

SEQ ID NO: 22561 - DNA, 456 bp, Triticum aestivum
  unsure (1)..(456): unsure at all n locations
  Clone ID: PAT_TA_22561
aagcttgatgcgattgtgcatgaccggcttgcgaattgcgtttcgttttgccagtcgtatttttctggtttctcaagagatggagatcttttgttgcatgtgctgcagacgctgttcaagacgctggccattactttctccaggatgatgatcttcaatgggatcacgtctttgtacggtagcatcctccagtacgcgaggccgtctagcctcgtgcgtgtctgggtcatcgtctccttcttcacctggttcatcggtgttgtcatgttgggggtttctccttccctgtaagcacacaccttcccataacttgccagattcaagaatcaaccctatctgtgattgaaattttggtgctctgtttatccgttgcttataacattcagtttggtttgggtccgtctcagtcaaaatgatgccattgatatacataantcctgcaatttgttcctgact

SEQ ID NO: 22562 - DNA, 938 bp, Triticum aestivum
  Clone ID: PAT_TA_22562
cccacgcgtggagagagagagaagaggaaagagaaaataaggggttagctaaaatggcaatggccacagcaaggctaatccacccatccatggtggtgtccaagagctcaagagcgccaccagcacccttgctcctccacacccataagcccctaaccaccgcactgacctcatcgtttcacttcacgctccactccgtcgacgtctccaaggacgacaagccgctggacacggcgctcgagaccaaacaagaagatgcaaccgccgccgccgccgccggcgacctggcgacaccactgccgggggagttggacgcggaggaggacaggccgaagcttgacccccgccggtttgaggagcagttcgcggtgctgaacacgggggtgcacgagtgccggtcctgcggctacctgtacgaccaggcgaagggagatccgtcctacccggtgccctcggggctgccgttcaacaagctgccggacgactggcggtgcccgacgtgcggcgcggcgcagtccttcttcgacagcaagagcgtcgagatcgccgggttcgcgcagaaccagcagttcgggctcggcggcaactcgctcacctctggccagaagacgctactcatctacggaagcctccttgtcggcttcgccttcttcctctccggctacttcttgcaatgagtaccgagctaggcatcatccttcctttgatccattccaggaggcttcttgcaattagtgaagaggagaaactgagtaaggctgttaccgggttaatcttgataagtactgtactaaatttgtgtgtatagatacctattgcttctgctacaaagcgcccagcgaggggcgatgtatagcagaggggaaaagggacatttgttttgaggtgctggcttataattttcttgtgaatgcaaaagggggggaaaaaaactcgag

SEQ ID NO: 22563 - DNA, 1073 bp, Triticum aestivum
  unsure (1)..(1073): unsure at all n locations
  Clone ID: PAT_TA_22563
naagnantttgntaacctatganntncccactntgattncctangacagtaaggtgtccacgtcataggatgctgagtgancctccatgatggtcgaggccattcgattagccccttatgatattgtcggatgtccctacgatggaataacggcaagatgccattgannganttggggggatgntctatgcaaaattccccggaggcgcgtttgcntccctctttggggaatgagtaacatatatcatgttcaccgttttgacaggggggggggatatttgtccccctatgttcggtggacgggntccttgtcttcgtcctngnttggggacccttctccttattctcggtatttaattactgcctgtttaaagcctaacacttctgttggtatgattagtgggtttatcgggggtgccatggatctgacatggttgatcaggtattcggtccaagctagatgagcccggattacttcttttaaatggcttcttccactgaccggacttggagccactgaatccggcgttgaccgccgtgtcatcggtattgtcaccgttgcttcgacgcttgtgcctgttgcgtcggggcttgccgttgctatttctggcttcagaggggccaggttcgcttacattattantgctacgggcttgccagctatcttcacccacgcaaaagcgggtcataagtgtcgtgacggctgccatggacttcggcttttcttggccgaggtgtcgggcaagccattcgtcgcggatgctatgcttaaaggccgctagggcttcggcatccggacagttgacgatctggttctttttagttaggaacctagtccagattttcctgnctgactctccgggctgttgaactatgtaacttaatcatcatcatcnaaggtcggactatgtaccttggaattgtcgccgaangatcttccaatctcccaactgccaatagatttctaacaagtgttaacaatgccgactggtccctgatttaacggangtattgatggatgaanatgtcaccgcggcatagaacataagaanaatctaagcatacgcggattg

SEQ ID NO: 22564 - DNA, 1567 bp, Triticum aestivum
  Clone ID: PAT_TA_22564
gacccacgcgtccgcccacgcgtccgcacgcgcaaacctgacgaaagaaaaaatacccaaaaccggagcccctcctgaccctgagcgagagcagctcagctccttcgcctccatcgctcaaggcctcgagctctcctccatctcccctgcgaatctccgagctcgtccaccgctggatcgatcgggtgcagagttccatgaaagaggcgcggttttgggaggccgttgtaaccgaagccgagccccgtggtgtcccgagacgggtctcgctggcggcgggggcttcgtattcttcttctccctccggctgctctatcttgttttagttcacgggttggaactggttgggagtttacgagatatggccaggttttgctgcttcggcgctggttgctccgagttgacagggcatgcatcaaccacctctggtaaagggaaaggctgtcagggccaagtcaaggttagctacgggtttagccttgtaagaggaaagacaaaccatccgatggaggattttcatgtcgcagaacttgctgaagtgaaaggaaacgagcttggtctttttgctatttatgatggtcatttaggcgatactgttcctgcatacctacagaaaaatttgtttcctaatattttgaacgaggaagagttttggacacatccggacagagcaatcacaaaggcttatgaaaagacggacaaggctattctgtcacatactccagatttgggacaaggtggctccactgccgtaactgccatccttataaacggcagtaagttgtgggtagctaatgttggggattcgcgagctgttcttctgaaaggaggtgaggccatacagatgtcaattgaccacgacccgaatgctgagcgcggcgctattgaaaataagggtggttttgtttcaaatatgccaggagatgttcccagagtctgtggtcagttggccgtgtccagagcgtttggggacaggaatctaaaatcacttttgaaatcagagcctgatgtgaaagttgaagatatcgatcacactgctgagctagttgtccttgcgagcgatggagtttggaaggtaatgaacaatcaggaagccgttgatgtggtgaaaaggtacaaggacccacaaacagctgccaagcaattagtcgccgaagcagtgaaaagagacagtaaagatgatatatcatgcgtggtcgttcggttcaagatgtaaatttgttgcaggcaactcgtgaagaattgtcaccgagaggagagcacaaggaattataacagcaaaacatagcctgcttgacaaggatagtggtaatgcaaaagaataattctctggaatgctggctgtaaaggatgtgttagcttgattgtaagttcatatataaatatgctagaattctttgtttggtgattccagggtacatgcgagtgggtccaaatagccttcttctgtaaataatgcttttcagatattcaaagctcagggtgctccgttgtgagagctctttgggtgggttgtcttcatcttccaacttggagtttaccccaaattgggtaaaattgattttaa

SEQ ID NO: 22565 - DNA, 389 bp, Triticum aestivum
  unsure (1)..(389): unsure at all n locations
  Clone ID: PAT_TA_22565
gcgaagagcagccacgcgagcaggggagggtcgtactgggggatgaggaagggcaaggtgaagcgctgctgcgagatcgccgggttcgcggcgcaggtggtcatctccgcggtgctcggtgaccccaccgcgctcatacccggcgtcgtcggctcgctcatagcgcggtgaccaccgccggccgccgccgcgctcttggagtgaaacatgtttgtaaatactactcctgctcccttactcccggacgtgacctacgttggcgctgcatgcaaattatataaccggtgtccacgtcagtgcatcaatgtcccccgcgtgtcagtgtagcgtagttctcttttaaaacctttttatcgtgttccgggagaaaaaggtaaaaaatcctcaan

SEQ ID NO: 22566 - DNA, 560 bp, Triticum aestivum
  unsure (1)..(560): unsure at all n locations
  Clone ID: PAT_TA_22566
agaggctgacatcatgtacactttacaaaattgatctgtcacctacaatgtcttgcggttttgatcttagtggttgtgatggaaaagaccagtacgtctgaagagaaactcgaatgcaaatgggtacgcaaacgttcaggcattcggtgtaccaaaacacatgcacgccggggcaaatagtttcttgctanccatgcctctcagtgttgattgttgtacaaagaattgttgcatcacactccggctagaattcgatgagtctggctagttgttaatgttagatacctgtgctaaatcttcgtcgtggcgcaaggaattcgatatgcgcacagctgttgcatatggggttgctgtatctgtatctgaattgttggaggaggctgctgtatgctgtttctcctgcctggattgcaaaggacacgtggtgtatgcctgggttgtggattgtttcaggcacttgcgttctcagagcagtcacattctcacttattttgaggcaaagttttttccaaaaaaaaaaaaaaaaaaaaaaaaaaaaaaaaaaaaaaaaaaaaactcga

SEQ ID NO: 22567 - DNA, 628 bp, Triticum aestivum
  Clone ID: PAT_TA_22567
cgacccacgcgtccggctgaactccccgaactccgaaatgttcactcgtttataaccagtcgcctccaactcaaaggcctcagcatccaagatcccatccccacgcgtccgcaagaactcagagatccaggagctgagccacggtttgtcaatggcagcggcggcaggaggagacgaggtgaagctgctaggcgtgtgggacagcccgttcgtgaacagggtgcagatcgtgctgaacctgaaggggatcagctacgagtacgtcgaggaagacctccacagcaagggcgagctcctcctcgcctccaacccggtccacaagaaggtgcccgtcctcatccacaacggcaagcccatcccggagtcgcaggtcatcgtgcagtacatcgacgaggcctggcggggcaccggcccgagcgtcctccccgccgacccgcaccagcgcgccaccgcccggttctgggccgcctacgtcgacgacaaggttgggtcgccgtggttcaccatcctgttcgcccgcaagaccgaggagaagatggaggcggcagtgcgggccatctcggcgatggagacgctggaaggcgcgttcggggaaagctccggggggaagccgttcttcggcggcgac

SEQ ID NO: 22568 - DNA, 445 bp, Triticum aestivum
  unsure (1)..(445): unsure at all n locations
  Clone ID: PAT_TA_22568
ccgggccgaggacgccctgctctgcctcaagcaccgcttccccggcctcgcccagaccacgctcgacgccagcaatgatacagcacaacaaggacgttgggcaggccgtcctggagagctactccagggtgctggagagcctggcgtacaccatagtgacatgtatagacgacgttcttttcgccgacgagtcgggcgaagaagatctgatgatgatgatcatttgttcatcctgcctggacctggacctgggaccaagaaaaccaaaatgccggtccatacatccctccaacaatatgtgcattatgccataacatgtaaggggtagtagtacactaatgggaagattgcagcatgagcacagtaggctanagtcnctttttccttttttgcanngggaagctntggancaaanctccaagggggggcccngtaccnattcccc

SEQ ID NO: 22569 - DNA, 703 bp, Triticum aestivum
  unsure (1)..(703): unsure at all n locations
  Clone ID: PAT_TA_22569
cccacgcgtccgcccacgcgtccgcgccgctctccctcccttgcactctcatcccctccctcgtcgccatggccgtctccacctccaccctccacgctccccctcctcttcctccaccgctccaccgcaagcccgaaccccaccgcgctctccttcgcctcctccctccgcgcgtccccgctgcgctcccgcgcctccgccgccccgccagccgagaccctcgccgacgacctgccctccgacacgcctccggttggtgaggggtcgggaattccgatgccgtcgtcgattggggaggatggggagggagctggggcacccaagcagaagatcagaatcaagctggaggtcattactgggtgccacttgataggaggactcctgcaatgcaggatcattgaagctgcaaagagaactaatgccaaaagacaatgggtcctgttcctactggtcaaccaaggaagagaatatactgtgtgctcaaatactccccatgctgaatactcacacaatgcacaaacttttaaatcggtaccaccaggtgatgcaggaaaacaccattgcgtgttgtcatgaaaccaagtgccccgaccccccacaaccacttgactcgttgatgcatcccgggcttgctttgatgtaactagtgcccaacccttaaaantcgtgtatgtaatgcnctttcganaatttcagttgncat

SEQ ID NO: 22570 - DNA, 419 bp, Triticum aestivum
  Clone ID: PAT_TA_22570
gtgaccacggcgagcagtgaccagcagggcaagaaggtctgcgccgccagccgcggcgacagcttctcggtgtccaagatctggcagtggggccgcagcggcaggaggctccccgtgctccctgccggctcgtcgtccccgacagatcaggacctcccgtgggcgtcgccggcgagcgcgcgcagctacgaggcagagcaaaccgacacctgataacgatggtagaatctatacacagatacacacacatgcatgtatttcgtcctgtgccgtttatttgttcattagtgctacgagtagctagcaataagcatttcatgttaagagttttcctgcctttttgggggggctttttgggcaatgttgagtagttgacgtttcctcggaagtggatggcaaatgaacgcacttttgctggc

SEQ ID NO: 22571 - DNA, 1215 bp, Triticum aestivum
  Clone ID: PAT_TA_22571
cccacgcgtccgcccacgcgtccgtaacaattggctgaaaaaattcgagccggttcttccagcaaatccgccacaaaaaaaacaccatttcttcggcgcggatcatcccatccattctccatccggcagctagcgctgcgttgctcttgataatccaaggggatggaggtcatccgcgggccgattctgccgcgctgcgctgcgcctgctctcacctccggctctcggatcggcggccagctgctgaggcgcgtgcgcatgcggaggagggcttgcggtggtgtctcgccgggcgactaccaccgcgtgtcgcccaggttcttcggtgccccggcccagcagcacagcactagcttctggcctgtttgctgtagctacggctcgtcatctgacgggaacggcgccccgccggcgaatttcgacgccagcggcgaggagttcgtcgactccagcgtcatggaggctgttgagctcagatgtgtgtcagatggttttgtgataagaatgcgcgacggaagaaaccttatatgtgtccagaacaatccccgcgtgctaagactgcgcgattctacgcctgaccacgcttataatgtggtaaaattgcccccaatgatgggatatccgggaagtttggttcggattacagaaaatggtgcattatgctctattctagattgtatcgtgcaaagatggaaaatggaagcgatctattagttttgatcttaagccatcagatgccatcaacattgctttccggtgcaaggttcctatacaagtcaataagcggattgcatccaacaacggtctgaaagttatacaaccaaagccaactgggagttacgtgaactctgaccaaatccagtacacaagactggacaagcctggtgaccagccttgctttgaagcccaggagttcgatttggtccgcggtatgcttattgctgctgttgaggaacgctataaagatgctgctcaatacagagaccgccttctcatgttccgggcaaacaaaaagaacacgatataacagagcctgatgggggtgtacatagtgaccgttgccaaggaaatagaagctttcgcaagcatcaagaagcacgatgtgaatatgtacatagctaatgattgtaacttttaatatttttcttttttgaagacgggttgtacggaaagctgtacaattgattatagtcaaacatcgatcaaattacttag

SEQ ID NO: 22572 - DNA, 1434 bp, Triticum aestivum
  Clone ID: PAT_TA_22572
aaataatgcgagctggttctcccagccaatccgccaaaaaagatcactatttcttcggcgcggatcaccccctccattctccatccggcagctagcgccgcgtcactcttgaaaatccaaggggatggaggtcatccgcgggccgattctgccgcgctgcgctgcgcctgctctcacctcccgctctcggatcggcggccagctgctgaaggcgcgtgcgcatgcggaggagggcttgcggtggtgtctcggccaggtgacggctacgaccggcgtgtcgcgcaggttcttcgggtgccccgacccatgcagcacatgcacagcacaagcgcctggcctgttcgctgcagctacggctcgtcatctgacggggacgccgccccgccggccgaatttcggcgccagagtagctgatttcgtggactccagcgtcatggcggctcatgagatcggatgcgtgccccgctggcgtgttataacaatgcgcgcgagaagaccgtcgactcctgcgtaatacaggctgttcgtctcagatgtgtgtgagattgtttcgtgataagaatgcgcgacggaagaaaccttagatgtgtccagaacaatccccgcgtgcttcgactgcgcgattatacatttcaccacgcgccgcccttcaggatcaatggtatacccagtccaacaatttataatgtggtaaaggagatgaccgataatgatggaatatacggtacgtttggtgcggattacagaaatggtgcatgatgcttactattctagattgtatcttgcgaagattggaaatgaagaagagactattagttttgatctcaagccatcagatgccatcaacattgctttccggtgcaaggttcctatacaagtcaataagcgcattgcatacaacaacggtctgaaagttatacaaccaaagccaactgggagttacgtgaactctgaccaaatccagtacacaagactggacaagcctggtgaccagccttgctttgaagcccaggaattcgatttggtccgcggcatgcttattgctgctgtcgaggagcgctataaagatgctgctcaatacagagatcgccttctcatgttccgggcaaacaaaaagaacacaatataacagagcctgatgggggtgtacatagtgacctttgccaaggaaatagaagctctagcaaacataaagaagtacgatgtgaatatgtacatagctaatgactgtaacttttaatattttccttttttgaagacgggttgtacagaaagctgcaaaatatagtcaaacatcgatcgaatgattgtaacttttaatatttttcttttttgaagacgggttgtacggaaagctgtacaattgattatagtcaaacatcgatcaaattacttagatattttttagggaatcagacgactcccttacctctg

SEQ ID NO: 22573 - DNA, 710 bp, Triticum aestivum
  Clone ID: PAT_TA_22573
gcacgaggctgcactcggcggtcctaaatgtgaagcatctgctctggctcattgagaggatggtggatatgagggtggccgataacgcggtgaagctttggagcgagcaggtcgcgcttgctgctgacttgcagaagttgctcaacgatgctgacatgtggaggaacatggctcctgggctcccgatgcttgtgaccagatgcacgctcaggcttgcccattcagttatgattggggagacactggttcctcggcaggtgaggatgaagcttgtcaaaagttggcttcctgtcctgaatgtctgcagggacatcgcccaacctatgcatagtggatacaaattgtcgaactgccaagagctggaggagacatttcttaagatcatctccactttatccgtcccagatgctcaggagctgctgcaacaatgccttgggttctcaactcgcaacgtcgatgactgccagcatttggtcaccgccttcaagacatggttcaggcgagcttccagggatccacaaggtccacaaggcggggaagactgagaggtggaactgacgctaacgttttcaagcagcgtgctccgtgcctcattgtacaatcgaacctgtaattctcggtgggccccctccgcctcgaatatccggagccttgtttagcccagtgcctatcttttgtatataaaatccttgattatgcactaagccaag

SEQ ID NO: 22574 - DNA, 937 bp, Triticum aestivum
  Clone ID: PAT_TA_22574
gcggttcgcgcaggggggcatcctgcgtgcctgccactctccaacgcgtcgcgaggggaggggcagtgtccgggctggttgggccggcttgttatccgggatcaaaggcgaaggcaagtactactagattcctgcctgtctctggtcaatattcctccattgattgcaaagggaccgtgctggttggaggagcatgttccggttcagcatcggcatgcctggagggtggttgctggtcaaattggctacgttgtagttgcagctcccgcggcaggggtgtaagcatggcagggggacggaaacgagcgcgcacgggatgggcatgccggggagactgtcggcgtacatggggggcatggtgttggcggtgctggccatccgggtttcggcgtgcctgcttgtcgctaatgagatcgcccgcggcatgcgggacggggcgcattgcaccttagtcgactgctgaatctcacatccggtagtggacatcctccccgctggccctttcctgtaagtgatagtttctcgaatttatttttttttacctcttttattttcatttatccagtctcctgtttagcattgttgatcatttgtttttcttttacatttaaagtagtgctataaagacaagttcatctgctcaataatgtttcataaacatatgtgcatcttcatgttatgttcttttacattataatttcccttggccgtatactaggtttctaaagatatgtccaactgcacaataatcttgcggaaacatatgtgtaacatgcacgaagaaggaaaaaccgtgctaatggtctgcaaggcctttccgcccgcgacccagtcccttttgctcccgagtctttcgccaggcccacaaacccttgttgcccttggggcctcaacaagcccaaacaacccaagtttagggccgatttgagggatgggg

SEQ ID NO: 22575 - DNA, 895 bp, Triticum aestivum
  unsure (1)..(895): unsure at all n locations
  Clone ID: PAT_TA_22575
ttcacatgctcacatgtttgtcttgcctgatgccccgatcccctttcttcttcccttcggcccgccgctcactccaaaattgctgccatcggacgagccgtcccaatagtttgccctcttgatttgttgccttgagcctgctcctcctcagctgtaggcatccccgcagctgaactcgttgtccacaggccacaggggtgactgtgtacggcggcttgtctcctgggacggtaaacagcgacggatgtgtagcagggtccgaggagcatctgcgcaagggaggaggcaagatcgtcgatctgcacggtgtcatttccctgggcgtccgtgtgggtgatgtgggcgtggatctcgtctctcgcagccagcagggatccagcttcactatgaggatgcgagcgaccttgtcctcccctggaggcagggccatccgctttgccgtcgacccggcaccaaccggccccgccctgcgtcctccctcgacacagcggcagtcgtctgccatcgacagaggagattggggcgcttgcaactattggaggaagatgatgtccatgcgccgatccctggaggaagacgatgttgaaggtgggttctgacgtgcgccgcgtgctgaacctgatttgatgctagctcgcacggttggttttctcgccctgccaccattgctaacctgattgccaaagctcacaaaacacaaccttgccttctcgcggtctcaccttgccccgatcgctcaagatagcaaccgccgccagcctgggtacaacaaatctgtctaaagttagacttgttcccatggtgttgtggcatcaaaaattcagatgatctatatccttcctaacccatagttgtgatccttaaatgtagttacatgtgttccanaggatccntc

SEQ ID NO: 22576 - DNA, 424 bp, Triticum aestivum
  Clone ID: PAT_TA_22576
acgattataagattgtcagagatgaattaaggatgtataaccccaaatacctggagcggccttatgttgtggtcctgaacaagattgatcttcctaaggcccaagataggttatcttcattagcacttgaaatatcttcagtaggctgtgaagaatgccacgacaacaataccagcaaagaaaagctaaatgaaaatttcaacagacaccatatgtcagaagacgatgataaggaacttggggactatccaagacctcaagctgtaatcggtgcaagcgtactgaggcacatcgggatcgacgagatgctgaaggaaatcaggacagccctgggaaaatgctccgatcacatgtcaccaggaccatgaatctgaaagcctgcatgctggagccctaacatgagtccaacacctggaaaggatcg

SEQ ID NO: 22577 - DNA, 830 bp, Triticum aestivum
  Clone ID: PAT_TA_22577
cggccccacgccgccggcaccacttgaacctgaagcagaggccacagtgcaggcgccacttgaagcagggacaatgaagccgcagacgcagctcctcctcctcttggcctacatcgccgcggcgctggtcatgagccgcggcgtcctcgccggcgccggcacccatgcggcgatgccggtgcgcaccgtcgaggacgacgaggtgggcttcacggagcgtgaggaggaggcggcgtacccacagaggagggtgcttgcttacagcccccagtacatcggctacggagggctggaggcgaacaaggcggcgtgctacggctcctgccccggccgggggcagccctacaccggccgcggctgcaaagccatcttcggctgccgcgggcgttgattatctcatctcatctggaaggtactgccattcctgtttgcttcatggcaggaacaagtgcccttcttccactgacccagaaagctgtggggagataaaaaaaaaagtggttactgtgtaagctcaagtagttttacatgcatgtatttgtgttcttgtatgtaatccttggttccttgtgtgtacaataatgtgtgtttggatgaattcaagcatgcatacgattcagaaaaatggtttgcgttatcagtttccaggaagaaaggaataaacagctgaaacaagaggaaaatgttagtgggatatgattgactagtcaaaaggagactaaagatgtaatctgctcggcttctaaaactgactcatcctgtactaatattagccaatggctagccattcaaacgccatgtgcgtgagttcatgttaaaaaaaaaaaaaa

SEQ ID NO: 22578 - DNA, 447 bp, Triticum aestivum
  unsure (1)..(447): unsure at all n locations
  Clone ID: PAT_TA_22578
gaggaaggggatacaaagtcaatgcttctggacttgtatgcatctcgatggatgcatgtggaaagagcatccgatgcaataaaaaaggggagtacctagaactcatctagatgagacgtaatttggtctcattcacctgaaaaacaagaatggatacaacccatatcagcacacacgcatcttatagcaccacatccaatggttataaaaggtgaatgagaccaaattaaatctcatctagatgagttctagcaaaactgataaaaaagagcaatttgtcgtctgtcttcggccgttgtggggtatccatggtagagttagccatggttgtttttttttttttgaggggattagccatgggtgttaaccagcataatctaatcgcattgatgtcttaagccanacatatattatttggttgtatcaatcaagatgtacccgagttct

SEQ ID NO: 22579 - DNA, 1161 bp, Triticum aestivum
  unsure (1)..(1161): unsure at all n locations
  Clone ID: PAT_TA_22579
cgtccgcccacgcgtccgagtccccagtcgatcccttccttctgcgggtgcgcgtcgagatccgttaacaggcgccccccctccggctccggcgacagagagggaggccaccgacggcggccggcgaccgaagatgttccttgtggactggttctacggggtgctcgcgtcgctcggactgtggcagaaggaggccaagatcctcttcctcggcctcgacaacgccggcaagaccacgcttccctccacatgctccaaggacgagaggttggttcagcatcaggcctacacagtatccaacttctgaagagctgagcatcgggaagatcaagttcaaggcatttgatttaggaggccatcagaattgctcgccgtgtgtggaaggattactatgccaaggttgatgcagtggtgtacctcggtggaacgcctatgacaaagagaggtttgccgaatccaagaaggagctcgacgccctcctctcagacgattcgctggccaccgtccccttcctgatcctgggcaacaagatcgacatcccctatgccgcctcagaggaagagctccgctaccacctgggtcttagcaacttcacgactggcaagggcaaggtgagcctcagcgagtccaatgtccgccccctggaggtcttcatgtgcagcatcgtccgcaagatgggctatggcgaagggttcaagtggatgtcgcagtatatcaagtaggtcaggcaggggggagtggtgaaagaaaaaaaaaagagttataagtagtcatggtgataatcttgttttaccttaccttgccaccagagtgttagggagctagctggtcatggtgccagtacatatgtgatgtaatggatgtagttcaaagtctggggactccgtcctagattttttttggttgagttattacaacaatgtgatgtctgaaaaggtgatatgctttgaactcctggtattctgcttgaaagtcaaagcaggcctcgtgcatgcagattggctgttggtcatagcagcctcgtgcatccaagatttgctgttctttgtgtttttgctattctctgaagctggtgctccccancagctggtgcgttgacacacctttcatcagtattcaagtcaatttgagggttgtcatctattttttcgggccctacaa

SEQ ID NO: 22580 - DNA, 557 bp, Triticum aestivum
  Clone ID: PAT_TA_22580
caacaacaatatgagatggagatggaggaagagtttggggagctacaaggaacaccaatgaggttcacatttcagcagctaaaagcagcaaccgagcaattcgcagacaagctcggggaaggaggatttgggtctgttttcaagggtcaatttggtgatgaaaggattgcagtaaaacgtttggatcgagcgggtcagggcaaaaaagaattttctgcagaggttcaaacaattggcagcattcatcatattaatttggtcagattgattggtttttgtgcagagaaatcgcataggctcttggtatatgagtacatgccaaaaggatccttggatagatggatctatcatcaacatgacaatgattcacctcccctgaattggagcacgcggtgcaagattatcactcacatagctaagggtctcacttatcttcatgaggagtgcatgaaaaagattgcccatttggatgtcaaaccacaaaacatgctcttagatgataacttgaatgctaaactttctgattttggactatgcaagctcattgacagggatat

SEQ ID NO: 22581 - DNA, 678 bp, Triticum aestivum
  unsure (1)..(678): unsure at all n locations
  Clone ID: PAT_TA_22581
gcggggccagagatctatattgaagattcttcccagcttacggaagtatatttttcatctttatatccgtccggaattctctcttacggtcgtgcaaagcttccatctatcgccagcaatgttgagaggcttaccctggtgttctgcggtgagaatgtcaacactccaatgcttcctgaaaagctccaccacctcaagactttggagtttgaacttcacggctcaggagcctgctcccctgtctatgatatcttctctctggtttcttttcttgatgcttctcctgccttggaatctttgatcttgcgtgtaggacgaaacgccataggagatcatggtgatgctggggacgatgtatacctaaaggggaaatcagcatgccagcttgaccgcctcaaacgggtgacgatcacgggcttctgggcagccaagagcctgattaagcttgtgatcagcatccttgagagcgctccttcactcgagcgcctcacgctggatacgacaccgcgtggctgcggtaggaagcttggcgatactagcatatgcactgccgcaaaatacaggagtaaatgctgttggataagcaagagatcctcaaagatctaacagagctgttgaggctgcagtaatacatccagggagantcatcggctgtnaattgnggncnaacccttagga

SEQ ID NO: 22582 - DNA, 448 bp, Triticum aestivum
  Clone ID: PAT_TA_22582
cggacgcgtgggcccgcgcctcatccacaacaaaacgggcgcgacatgtgctcgatgttttccctctgagaccacgcggccatggcgctcgccttcctcccacccgcgcccgcagtccaccatccgccgcgccccctcaatcccccgccgctcgcgtgcgccaccaacaccggcttctctttcctcttcccaccgtcctcccgctggccctccctgcagagggccagctccgcggcagccggcgatggcgccggctcgtcagaagcgccgggcgacagttcgctcgacgcagacctcctcaggagagtctccggggcagaggacgcggaccgagcgctggacattgttgcggagtcgctgggaggcggggccggctccggctcgaaagcgtctctcgactcgtccgactgcaatgcgatattagcggcggcgcttgaccggggcaacg

SEQ ID NO: 22583 - DNA, 883 bp, Triticum aestivum
  unsure (1)..(883): unsure at all n locations
  Clone ID: PAT_TA_22583
acgacttctcaaccgatggtgctgaaatttctagcgcaatcttccggcccactaccaccaggcgtcggcctagggctccacccactggatgtctttcgccggagcatgctcactggtaagtgccatcaaatccgtagtccccaggacaatgaggaggacaacacaatcatccggtcagcagtggagctctatgaagccgggattcagttcaagccgagcaagacgccgagcctgcacgacatccggttccggcggggcacgctgagcatgccgacggtgtcggtggacgactccactgagtacatgttcctcaacatgatggcgtttgagcggctgcacgccggcgccggtaacgacgtgaccggctacgtcttcttcatggacaacattatcgactcagccaaggatgtggcgctgctcagctccaaggggatcatccagaacgccatcggcagcgaccaggccgtggccaagctgttcaacactatctccagggacgtggtgcttgagcccaacagcgcgctcgacgccgtgcagcggcaggtgaacggctacttccggcagccatggaacatttggcgcgccaacctcatccacacatatttcaggagcccctgggcgttcctctccctcgccgcggccgtcttcctcctcggcatgaccgtcatgcagaccgtctacaccgtgctgcagttcacgggaacgacagcaacgnctgccaccatcggnaccttctcctatgtgagccagccgggcgcaaaaactagtaatcactaagtacctgcactcgatctgcctgttcatgaatcgttttgctgtttgttttgcaacgatcgnttttgctgntgtttgtttttncagcatcnattttgttgttgtggga

SEQ ID NO: 22584 - DNA, 594 bp, Triticum aestivum
  unsure (1)..(594): unsure at all n locations
  Clone ID: PAT_TA_22584
caggctcggcgggcagtaccctaagaggcaggcgcaggacatggccgcgctcgcgctccgctgcctgcagaacgaccccaagtcccgcccctccatggccgacgacgtcctcccctccctcgagctcctgctgcagccaagcgccgccaagtcctcctcctcctcctcgacaacgacgtcatccagatcgccggccgcgtcggcggcaccggtgcacagaggccaccgtcgaaacaaagcctagctagcgtaggagactcggttcatttaagtactgtgttcaattagtgtgttcgtctgtgcagtagaacagaatttgtagattggaaattggacatcattttctctctcgtttcagcncgtttggaatattggagtagtagtattatagaataaaagggggccggtaccaatcgcctatagtgatctattaccgcgctactggcgtcnttaaactctgactgggaaaacctgggttaccaataatcgcttcagaatcccttccagtgggtatacganagccgacgatngccttcaacattgnagctatgcaatggacccccntacgggataaccgnggtgtgngtacccagg

SEQ ID NO: 22585 - DNA, 622 bp, Triticum aestivum
  unsure (1)..(622): unsure at all n locations
  Clone ID: PAT_TA_22585
ttttttttttgcacgacaccggcctctcatgccgggttggttacttggcacagtgacgaaaacacttgagttgaatctagtgatgctctctagcaccgtgcacagattacatacattctactttgactgatatgtagcaaaactgcactggcttgtcttccggtgccagtggcaaacctgggcattccctatgagcatcaaagaaggtaaattggcctgtacatgattgtaaacaatttgaaccatgcacaagactgccttctgtaagaatttgaagccaaaaaatttgcaaagggcgtaactaggtgagcctgttgcacagccgttccgctatcaacaagaacgttgtgcaggattgcagctccatggtcacatcgcagaagcaactctccccatctagctatccacagaatggtggcagccaatattgccgtacaacagctacccgtcagcttgcatcgaccgcgatactgctctaggacaatcaggcttacaccaggccatcaaatcaaatcactttcctcgaactggggaccccccgtatctgcccggcccgtccacgggctgccaaggctccgccccgcgccggtcgcgcctcgagtcttgtgagtnaaatgttgta

SEQ ID NO: 22586 - DNA, 367 bp, Triticum aestivum
  unsure (1)..(367): unsure at all n locations
  Clone ID: PAT_TA_22586
ttttttttttttcggggctttcgtttcttcttctgtagtcaagtagtgcacgtctaactttaatcttttcttttcacatcacgcatgtagacagccatattgaccatctcactaccttttctgttcagcattcactcaaataaacgaattataatatagtaaggaatcgaagtcacgacaagtacgcagggtgttcgtcctcgtcatcgcacgcgataagagccttgaagatgtcgtccatggccggcctgctgctcctctcctccacccatgacaaggggatcttcaacatttccatggcctgtcgagggttaaacggtccgttccgcctgctctccaccggatgacatgatgtntccgctcgcca

SEQ ID NO: 22587 - DNA, 783 bp, Triticum aestivum
  unsure (1)..(783): unsure at all n locations
  Clone ID: PAT_TA_22587
nggggctttgtagntatcatggcctcctattatcagaaccgcctctactgatngtagatgacgaantngggtttgctcctnatgnctgtgttccttgcacggntnnagtcaaactttgtgatgcatntctccatgtgtcgtttgaccccccgcgctccgtcccctccgccacgcgcccgtatccaagggacatttgggtacctagatcccttgtacttctacacgggacagctcaccgagaagagcgacgtttacagcttcggtgtcctcctcatggagcttttgacaaggaaaaaaccatgctcatatcggtcatcccaaggaggaaacccttgtctcatatttcacctcttcgctagcagcaggcaagctggttcacgtgctagatcctcaggtcgttgaagaaggcggtaaggaggttgaagaggtggctgtgctggcggtggcatgcgtgaggattgaaggagaccaccggccaaccatgaggcaagtggagttgacacttgagagccttggggcctcacattatagctttgtgatgcatgacatggatgtgcccaagtatccagtgattgagggtacaaacatggaggaaacgagccggcagtatagcttggaagcagagtacttgttgtcatcaaggtatcctcggtagtgaataaaattgttgtgtgatcagtttaatttgaaaactgatgactccaaaggntgcacttgtccccntgtctaatatgcntttaagatcacagnatantcgngtaaatggtgattaaaaaaaaaaaa

SEQ ID NO: 22588 - DNA, 575 bp, Triticum aestivum
  unsure (1)..(575): unsure at all n locations
  Clone ID: PAT_TA_22588
ggcacgacccccagccccggatcccagagagaccaagagatggcctccttctccaagcaggcggcactcttcttgctggcagcgctgctgctgtgcctcctctgcactagagggcaagcagcaaggcctacaccaggatccagcctccaaaaatcacagggtgctggctccgccacctcccatgagaagagtgctgcaggaaccgggatggaaatggagcaggtagatcaggaggcgatgagaggtggcgagggaggggaaggagcggaggagtgcctgatgaggaggaccctcgtcgctcacaccgactacatctacacccaggggaagcacaactagacggtgcgctgaaagcctgaaaccctgaagctggtggngcttacgaaggactccgtgaactgaaggccatatctggatgatcgcatgcttaagcaggccctacttaagaaaggctttcttgagctcctcgtctttcgcatccatcatctcgtaatacantatatcgcgctccttgtatttcctgtcctggttcagtattacgtctgactcgaatttacacatgtagtctatgatan

SEQ ID NO: 22589 - DNA, 609 bp, Triticum aestivum
  unsure (1)..(609): unsure at all n locations
  Clone ID: PAT_TA_22589
gttggatcaaaagatcacaacaggagtgcactcaatgagttcttcattctatactgtgactctgccagctcaaccattttgcatggattatccagaaggaatatgttgaactcgttcaacatgctaatctatgcaaccacaactcagaaaatcatatgttcttttgagttgtccctctttagttatttctgaccttcgtctatcaattgatagttaagagtatgtgtgccttcggttcatcgatgcctattactctcgtggtccgtcaatccattctattccgggatgactagggagaaacaaactccagtacgtcatccatatctaggattggggtcaaagcagttgtgttccgcagatcaatactaatccagcttttgttctgtcctaccctgaagtataccactttatgtcaggaatgtcgtcagaactgcacctccctttgaatcttgatgtagtgatactctcgccatcattaacatcctcgggttcctgttgtcgcaacagaaggcgatagtgatcatgagtgtgaaccatacctacactcgtgctggagntaatggcataccnatcagntgtgatatgatntncctaggnatggcaacagcc

SEQ ID NO: 22590 - DNA, 439 bp, Triticum aestivum
  unsure (1)..(439): unsure at all n locations
  Clone ID: PAT_TA_22590
gagccgcgccccagtagcaagccggggacgtgtgggcaggccgtgtaagttcatatagcttagtggcaaaaatcgctccgttttattgcttctttcccccgctgtaattcccgggggatacacagcagattctgtacaggagaaaagactcggccgtgtaatatttgcctgatgggatcaccacggaggtgaggtgagacggggaggaggcgatttgtttgattgggaggtgatttgagtgtcgtgaaaagtagtgttgtctggcaggctcccgcgtttcagttctgggtttgcttgtgaaggtggagtgttccactcgttcactgttgatgacactagaaaccgacctgtaactgtgatgggcgcgaccggggctcgggcatttcagttcctcctggtcacttgggctgatgtatataaggacactgtntttgtaagg

SEQ ID NO: 22591 - DNA, 2076 bp, Triticum aestivum
  Clone ID: PAT_TA_22591
agctgctgcggttcctcgcaactccgcagcgcccacgtgtatgctcgccgctgtttgcacaggtaacgtggtcgcctcagcgagcccttcatccgggaccagcgggcccatagaagtggccaggttgctagctgatcgctccgggggccccgcggcccgtgccagtatcccactcctcaatgcgaacggctaaagccgccagcaggagtttgttggttgacctttttgttgtttgggctatcaagccgatgaaagcaagagtgatgtcgaataagtaaatactatattgtgcttgatgttccccctcaaatatcgctgattgatgatctttttgagcgttatccgaagtaaaaagggtggatttgacttcaaaacagctatagttgattaaattatcatactcatgagaaatattcgtaatactacagaaagtggtttatttcacttatgtgaattcatcgaagacaatgaattcacgtatctgtccactcagatccttcactttttgggaaatgaagggccgaagacatcagaccctagtaaatacatacgctatatatacaatagggtgatacttgaaaatgccactgttcgagctagtgcagtaagtacattggcaaagtttggtgctttggttgatgcactcaagcctcgcatatttgtccttttgaggcgttgcctgtttgatggcgatgatgaggtccgtgacagagcgacactttacatcaaattgcttgatggggaagctactgttggtgagactgagaaggatgtgactgactttctctttggttcacttgatgttccactagctaacttggaggccagcctgcggaattatgaaccatcagaggtaccttttgatatttcatctgtacccaaggaaacaaaatcacaaccccttgctgagaaaaaggctacaggcaagaaatcaacagggcgaagcttctgctctctttggtcctgttcctaccattgatgcatcctatgagaagcttctttcatccattcctgagtttgctggttttgggaaactctttaagtcatcaacaccttttgaattgactgaagccgagaccgaatattcagtcaatgttgtgaagcacatttatgatgggcatgttgtgcttcaatacaactgtacaaatacaatacctgaacaactgcttgaagaggtcgtggtgtttgttgacgcttccgaggcagaagaattttcagaagttgcatcgaaacctttaagatccttgccttatgattcccccggacagacctttgtggcctttgaaaagccagaaggtgtccttgccaccgggaagttctcaaatatattgaaattcattgttaaagaggttgattcgtccacaggtgaagctgaggatgatggtgttgaggacgagtatcagctagaagattttgaaattatttctgctgattatatgttgaaggtggggatttcgaacttccgaaatgcttgggaaagcatggatccggaaagtgagcgggtcgatgagtatggactcggtgttagggagagcttggccgaggctgtgagtgctgttataagcatcctcggcatgcagccttgcgagggaactgatgttgtccaaaacaattcgagatcgcacacttgcctgctctcaggtgtgttcatcggtaatgtgaaagttttagtgagactttcatttggaatcagcgggcccaaagaagtggccatgaagctagcagtcagatcagatgatccggaggtcagtgacaggatccatgaaattgttgcgaacggctaaaaccaccagcaagagttttttggttgacctttttgttgttttggctttcaatctgctgaaagcacaagggatttcgattaattatagtatatggctatatgtaagttggttttctcgttggaatcccactgttgttgcagcaccattcttgttcaacgcagtaaaacaaatttttgattgatttggaaccacactattttcttatatccccctggacttgaaaagtacatgcaataatactgaaatgggggggccaatgcaaaaaaaaaaaaaaaaaaaaaaaaaaaaaaaa

SEQ ID NO: 22592 - DNA, 596 bp, Triticum aestivum
  unsure (1)..(596): unsure at all n locations
  Clone ID: PAT_TA_22592
ccggcgttgctcattctggaggtgactggaatggggaagttcagcaatacaagcttcacaattagccatacagttgggttccgatgcttgaggaagttctctttggaatcatgttaatggatgttgtttgaagcaggatccatgcctaagctagaaaagctcgaaattggagttcgtttctacaactcatccgattctaacacaactagtggtagtggtgatgcttttgatttaggaatgggaaacctcccctccctcattaagtctcaaatttgcaatatatggctggtttgatagcactctcgcctctgcacaggctgctatggagagagcatccggtacacatccgaaccgccctactctaatctttcagaaaatcggcactagcagcttgagctcaagctagaaagtcatcttgtgatgccaggatgtgataattgttgaacaatagtcccactcttgaggaacaagcattgtcacatgtcagcatcgatcagttgcagcaacatacgtctagacagtaaatttgactcaacacggtcgaatcccanttcttgcggaaaggaattcatactaccgcgcaccctcggcaatgt

SEQ ID NO: 22593 - DNA, 571 bp, Triticum aestivum
  Clone ID: PAT_TA_22593
ggtctactacgctgcgctacacgcacacacagacaaagagaacccacgcgtccgcggacgcgtgggcggaggtcagaatcaaaatcattcgagccatggctgagctagctccgctttccatgctcttccttgccctgctcgtcgtcgtccccgtgctccacttcatccggtcgtcacgccggcatgagggaagcagccggccgcggcctccgccgtcgccatgggcgctgccagtcatcggccacctccaccacgtcgccggcgcgctcccgcaccgcgcgatgctgggcctgtcgcgccgccacggcccgctcatgctgctccgcctctgcgagctccgcgtcgtcgtcgcctcctcggccgacgccgcgagggagatcatgaagacccaggacctggcgttcgcgtcgcggcccatgaccccgacggggaaggccctcctcggcgacagcccgggcatcgtgttcctacgcgaccgtggcggaactcgcaagattgcacctcagctctcactccgccgctaggtcttcgggccgtcgcaagaagaagtcggcggtgctcggtcgtgcgt

SEQ ID NO: 22594 - DNA, 893 bp, Triticum aestivum
  unsure (1)..(893): unsure at all n locations
  Clone ID: PAT_TA_22594
cccacgcgtccgcccacgcgtccgcccacgcgtccgggcagaacagaggcagtgattccacgggccaccacctactgcctaccatggccgccacctgccgcttcgccgcgccactgggtctcgccccgctgcctcgcagctgcgccggcgccaagagcgtcgctttctcgataggcaccaccaaggtagctacacggacacggagcgtcgcggtgagggcgggcgacggctcggcggagacgccggaaatcctcaaggctgcgcaggacgcgtgggcaaaagttgaggacaagtacgccgtggccaccattggcgtcgccgggctcgtcgcgctctggacagcagtgggggcgctcaagtccattgacaagcttcctatcttgcctggtgtgttggagctcgttggaatcgggtacacaggatggttcacatatcgcaacctcatctttcagccagacagggaaactctgatcagcaacatcaagagcacttacaacgaaatcactgggagcagcagctaattatgcagcatttgcaagatgacgtcagtaaacagagggtaactacatcagtgggcaaccattcaaaaatcaacaagtagtgacatctcacatggatgttactgtacttttctattctttttggcttttcgctcaagtgaaagaagaaactttgctggtgagctggtaacttagtccgaatttctaatctacaactatgatatattacagttcatttgcagacaggcacactgtcaaggtcgatgtggggtttcagataacattattgttggctctatgtattttaaccaattgtagtcatatgatcaatcgatatcaaatcacattaatgaaccaagaaatgaatgaacacgtgaaagtnncttacggtcc

SEQ ID NO: 22595 - DNA, 603 bp, Triticum aestivum
  unsure (1)..(603): unsure at all n locations
  Clone ID: PAT_TA_22595
gagagaactagtctcagttttttttttttttttttggaagaacttgctgaaaatgaacggcatgtcaccaccatgcgcaaaacttacaaacgtagttccatagttactagcttgttttgttgttcgatagatagggattagtcctgcatttttgttnaccgcgggacatacaagaattccaggaacagaagtaaataaatactggttacactcgtgcactgcactgcactgcacgaaaaacagacgaaaaggaacaatgcaggacgaagatggacacatttcatatagtctacagaggaatgctcttgatcatctttaatctgaatcccaagtaatctttatcgaattggtgtgctgtggatttctttccgtctgaactccggaagaaccagtcnatatcggtacatcggttcnttcacnaactttccgaagcgttcctcataggctcctgccggagccccgcccccgaacgggcaaccgcgccccgccccgtctctcccggatccgtcaaccttggcggtcaaaccttcgggcctcaaaccccttgagccgcgcacaangccacctgtaaaaagnnggggcaaaatcnttccncgnaaacaa

SEQ ID NO: 22596 - DNA, 417 bp, Triticum aestivum
  Clone ID: PAT_TA_22596
agaagccgctgatcccgctggtgggcgcgctcttcatgaggaagaagaagagctcggcgtccgccaccggcagcaaccacgccgtcgacggctcgtcggcggtcaagccgcgcccgtcgttctgatcgttgacatccgtcgtgatgcgtgcttgcgggagttggtctcttgagtcgtgagtcgtgacaccactatacattcggtgatagtgatgaatcaataaacgtttagagcatgcaacacctgtatatttttgtttctcggtataagaaaaaacgacagaatttgctatggacaatatgtataaattgcacttcttgtaattagtgtactccatactacttttatgttcattaaatttggtcggtatacttaccaaaaaaatacatcatcggtatttccatcaaaaaaaaaaaa

SEQ ID NO: 22597 - DNA, 1415 bp, Triticum aestivum
  Clone ID: PAT_TA_22597
ggaatgataagtagcctaggagcaaggccaatttcaagctattttagatcccgcggcttctgttgcagccgagggtcgaaatggagacgctgctcaccagacgaaagcagcagtcccaccgccgcccacgcccgctctaatatgtggtgattcccccagcaacacgaattgggtctcctccaagcatggcttctgcggtagcagctacagttgctgcggcttcggcatggtgggcaacacaaggtcttctccctctttttgctcccccaatggcttttccacttttatcattcccttctgcttcatttcccacagcggggtcgtatcgatttcgataaactgttcagtaggaggaaagcttccccaaagcttttctcctccaacaagcagaaggattgaaggtggtacccgaggggggaacaagacgaagctactagcggtgacggtcgacctcaacaagagtgctgcagttatagaccatgaacttgatacattggttgggccaagagctgctacctttcccattgaattgtcacacctgaatatgaaatcccgccggccaggcttcaaaccttacaagaggtgctcggtggaagcaaaggagaatagggtgccggctgctgacgaggttggtaccaagaggattcgccttgacagcgaaccctccacgtgatttacttgcgacgacatgattacctagcctccacgagtagtgatattttcaagaaaattgcaagtttttacatcgaatggcttacttactataggacttctcaggtccttgcaatgccagtgcatttcacatgctcccaaacttgttgtgggattgtatgttaatgcttgccgggcagcccttctagactctcaagttggcggtcggcacctacgcgtgcgccgctgttatggaccatcaacttgatacattggttgggccaagagctacctttcccattgaattgtcacacctgaatatgaaatcccgccggacaggcttcaaaccttacaagaggtgctcggtggaagcaaaggagaatagggtgccggctgctgacgaggttggtaccaagaggattcgccttgacagcgaaccctccacgtgatttacttgccacgacatgattaccagccttcccgaatagtgtattttcaagaaattgcagtatttacatctaagctactactataggacttctcagtccttgcaatgcagtgtttcacagaactcaatttgttatgtgttgtatgttaatgcttgccgagcagcccttctagactgtcaattaagcattaagcacctatgcatgctactttattggtaaaaggcattatgcttatttttgtgtggtgaaggatcatacttgtaattttggttcattttgctggatcatgtagattcaattcccgaagggagagca

SEQ ID NO: 22598 - DNA, 661 bp, Triticum aestivum
  Clone ID: PAT_TA_22598
cgagcaccaatgccaggagcagccacgccaaggaactccagagctcgcagccgtcggacgccgccgtccgcgcgaagggtcggtgcccgcacctcccaccgcagcacgccgcaatggaggccgagtgtccatggcatcgcccgaggttacctcccagtcgccgttctccttctaattcgtcgggatccggctggattcggacacgagcgccctgttcagaccttcccgcctcgcttgggtcgtcggccacatcgacgacgtcataccgctcacgggatccagctaaaccgctggctggccacttccccgcctacacgagacgcccccacatcagcgcctcttcaacgagcaacagcagcgaacgcctcgcgaagggtgtctctggtggtgtctttttcttctaaatcgttttaaagaagtttgccagatctgtgccagaaaaacaatggcgatgaactatgattgatgtcctgcgaaggctagatcggcgcttgatgtggtggcagaatatctccgggcaaactagtaggctagatctagaaagaaaatctgtaaagttttttgttgtgtatttcttccttttggtaaaagtaaaatttagttacctggtatgtttaaaaaattttcctttttctttacaaggcaatgagcatacataatc

SEQ ID NO: 22599 - DNA, 695 bp, Triticum aestivum
  unsure (1)..(695): unsure at all n locations
  Clone ID: PAT_TA_22599
ctgaatcttcagcttctgcacatcggtcgatcgaatgacggcgacaagggccgtaattaatctgcccggctctcctctctcgccgccaagtggtcgctgcccctcgtcctccggcctaccatgcggggtgctgcccatgcggccgagcagatctccccggcctaccgtcgccgcagtggccaagaacaggcagctggaagtcggagaaaatgctgcaagtctgcaaaaccagctgttagtattaataaatggcatggatcggaagaaggttagagagactagaagaaagcagcagctccaggaacccgaaccggcgccatcttcccacgacacggcaggggtggctacggcggcacccttgcctttgcctgcctcccctccgatccaatgcttcccaacgtcttccacaaatatacatcaccaactatccatgctggacgtccttgaaaagatcgggatatcccggcattttgctggtgagatcaagagtgtcctggacttnacttacagtcgttggttgcagagagatgaggagatcatgctggacacggggacatgtgccatggcatttcgtatcctaaggatgaanggatacgacgtctcntctgatagcttatcacatcttaccgaagcctccgttcatctgaatgatacgagatctttgttagaactatacaaggtttcccaagtcagta

SEQ ID NO: 22600 - DNA, 586 bp, Triticum aestivum
  unsure (1)..(586): unsure at all n locations
  Clone ID: PAT_TA_22600
gggccgacggncgaggnanaggcggcggcgacggaagccgcggtggcggcgctgcagaagatggagggcgcgttcggcgagtgctccaagggcaaggccttcttcggcggcgacggcccggggtacgtggacatcgcgctcggcggcttcgccgcgtggatgcgcgcgttccacgcggtggccagcgtgaacctcctggacgccgcccggaccccgttgctggcggcctgggcggagcgctttgccgcgctcgacgccgccaaggaggtcatcccggacgtcgaccgcatcgccgagttcgccaagcacgatctgctgccgctgctccagaaactgcatcccaaaaactgaccagtggtacacagtagtgatcggcgagccgaccatttaaggcggattctactgctagcagcaggcctcgaattggtggcggtgctgctgctgctcgaaagaaggatgcacagtggttcagaaaaaaaatgcggtactcatcaatcgtggcttgttacacatgcacttggtactaatccttctgcatgtatcttcttcatgtgtgacattgcaaagataataaaagtgccttctc

SEQ ID NO: 22601 - DNA, 1430 bp, Triticum aestivum
  Clone ID: PAT_TA_22601
cggaactgtgtcggagcgcagaacaaaaacctcagccatcggccggagagcacgcgagaaatcagttcgtccgacgacatggcggccggagcagcgggaggagggagtgacgagctcaagctgctgggggcctgggtgagcccgttcgtgcaccgggtgcgggtcgcgctgcacctcaaggggctcaccggctacgagtacgccgaggaggacctcaccaacaagagcgacctcctcctcgcctccaaccccgtgcacaccaaggtccccgtgctcctccacgccggcaagcccgtctgcgagtccatgctcatcgtgcagtacctcgacgaggccttcccctgctccggccccgccctcctccccgccgacccccacgaccgcgccgtcgcgcgcttctgggccgcctatgccgacgaccagttctttgcctcgtggatcaaggcgttcgtggggacgacggacgaggagagggccgcggcgacggaagccgcggtggcagcgctgcagaagatggagggcgcgttcgccgagtgctccaagggcaaggccttcttcggcggcgacggcccggggtacgtggacatcgcgctcggcgggttcgtcgcgtggatacgcgcgttccacgcggtggccagcgtgaacctcctggacgccgcccggaccccgttgctggcggcctgggcggagcgctttgccgcgctcgacgccgccaaggaggtcatcccggacgtcgaccgcatcgccgagttcgccaagcacgatctgctgccgctgctccagaaactgcatccgaaaaactgaccagtgatacacactagtgatcagcgagccgaccatttaaggcggattctactgctagcagtaggcctcgaattggtggcggtgctgctgctcgaaagaaggatgcacagtggatcagaaaaaattgcggtgctcagcaatcgtgggttagggcacatgcgctatcttcttcatgtgtgacattacaaagataataaaaatgccttttcacgccgcccggaccccgttgctggcggcctgggcggagcgctttgccgcgctcgacgccgccaaggaggtcatcccggacgtcgaccgcatcgcggagttcgccaagcacgatctgctgccgctgctccagaaactgcatccgaaaaactgaccagtgatacacggtggtgatcgagcgagccaaccatttaaggcggattctactgctagcagtaggcctcgaattggtggcggtgccgctgctcgaaataaggatgcacagtggatcagaaaaaattgcggtactcagcaatcgtgggctgttgcacatgtacttgccacttgttactaatccttctgcatgttcttcttcatgtgtgacattacaattacaagttactaataaaagtgccttttctcaaataaccaccacccac

SEQ ID NO: 22602 - DNA, 779 bp, Triticum aestivum
  Clone ID: PAT_TA_22602
cttgaaaagaaaacttgaagatgagaacaccctcttttctttttgcgactgaagacgagaacacctgacacggttaaactgagcaattacgatcgcacacagaacatgcttagaatgcttggtcaaaccgattacagggtacaaatctgaaccaggtacacgcactagagtctcacacgattcacaacatcagccatgcattcttagccaaagcactgctccgacggcaacgggcccgggagcgacccctgctggaagaactgcagcccgaacacggcggcgatggcgacgacggtgaggtacgcgacgccctcggcggcgccgaggaggccgtagggcccggccgggaggcccgacccggtgcgcaccttggtggtgagcgaccagccgacgaggcccgccaccacgaggtagctgacgccctccgccgcgcccagcgagccgccggggcccgggggcaggccgcagcccgtcgccttgagggtgtagagggaccacgccaccgtcgcgcacgacgcgagccccgccgccccggcggccagctccacggtgctgttgccgccgccgctgctctcggccatgcacgtgactggctgccggcgacggagaagggtagagctgccgcggcgggcgcggttgagagttgtggtcgtggaagcggccgcggcggctgctggcatgatgggcctgagggctaacgacgccatggctgcctggattctggctggacgaggagagctgctagaccggtggaagccggtggaagcgatggggttatc

SEQ ID NO: 22603 - DNA, 330 bp, Triticum aestivum
  Clone ID: PAT_TA_22603
ccgacgtgctcctcgacagcctcggcgaggtcagggccacctgcggcgtttttgttgactagccttagcttcagggctgcacttgcacatatacacatacactggttgatttgtacgggggtttatcgggttctctgatctttatttatgctaatagtattattaactgaagatgcaaaagagatgcaaggcagtttcatacgctttttagctgagggggtcatcacctgtaacttgtacaaatagcatccacgttactaatacttatactgtactgcggcctccgtccttgccgttatgctcctcgggtcctttgaccaaaaaaaataa

SEQ ID NO: 22604 - DNA, 690 bp, Triticum aestivum
  unsure (1)..(690): unsure at all n locations
  Clone ID: PAT_TA_22604
ccgacgcgtggttgggcaccgagtctatctcacgatgaagatagatgccctcgctctcttcctcctcctcctcgccttcgcatcccatggcacatggtgtgaagcagctccgagaaggaccatggccggtgcagctctccagccccatgaaatccaaggcaagaggctcctggagatcgtgagccgcaggaagcttgggcacacgggaggccgcggctccggcggtggagcgagcggtgccgggagacacaccggtaccggtggcggtgcggcgaacacgaggccgcacagcaccaagaacggcggcgctgtggcgctgccggctctggtgacctccgctctggcactggttttcaccactgtcattcttctctcggcgctcagcttctaaagtactgatcttgtcaccggtggtagtgctagtatctgtgtagtgctgcagtttcagaaattgtttgcctataatgtttgttgatatcgtgctgatatgttgtttactggctagtatttatcatgtctgtgtgcttcgtaaattcttgaattaccaagctatgtttagtcagatagtaccggattatcgtcctataacagtctgtataagtatgtacaccaaggaatcgacagtattgtacggatcaattggaattcagacattgcatataatgaaatgacatatcctggcatccaana

SEQ ID NO: 22605 - DNA, 668 bp, Triticum aestivum
  Clone ID: PAT_TA_22605
ggcaattggtcaaacatctcaagatgcattggtttgcactgtaaatcttatggagggtgatatgatagtcagtggctcagatggattcttcgacaatatatttgatcaagagatcctttctgtcattaatgagtctccaggcacagatgaagctgcaaaagctttggcagagcttgcaagaaaacattcagtggatgtaacattcgattcaccctactcgatggaggcccggagtaggggttttgatgttccttggtggaagaagctacttggagctaagctagtaggcggtaagatggacgacattacggtcattgtcgcacaagttaagacagtggtgatcccagatgatgagggtagtggagttgaactggagaaagtgggtggcgagcaactcgctgctgctggagttgcatccactgaacagaatgaatgaaaaggagttgtatatattgaatagaaattcattttctttcccattttggtcatgttgtactataccgcagtccaaagaaactgaagtgaaatgtactagttgtgaatacccatgcgtgtataattcctgcagattgggcttattaatatgagtaaaattactctttgaatctcgacttattcaggagtggattaacaagcagctcagctcgttaagactcaaaaaaaaaaaa

SEQ ID NO: 22606 - DNA, 666 bp, Triticum aestivum
  unsure (1)..(666): unsure at all n locations
  Clone ID: PAT_TA_22606
gagagatcaaacacatagctactggtatacaccctcagccccgagggtgaactacttcctcctcatcatggagagcgccgggatgatgaagatggccaccagtgatggacccccccttcggcagggtgccggaaccgggtcccgattggttatttgtggctacagaggcttgcggcggcggaactcccaatctaggttattttttggaggtttggggatttataggagaggttggcatcgagaacaagtcaggaggccccacaggaagtccacgaggcacaggggcgcgccctccaccctcgtgggagcccatggtcctcccctccggtaactccttgttctagtattttttatattttccagaaaaacctccgttgattttcaacgcattccaagaactttaattctgcacaaaaacaacatcacggtagttctgctgaaaacaactcatccggataantctaacaaatcatgtnnaaatattataacatgnatgagtacatcaaaatttagatacntgggactacacatctcaagctaantcngccgtctcagggggggccggtacaattccctaaggatctataccccnacngcctctttaantccgacggaaacctgnttccaantacnctganaaacccttnaatgntanacaaagccccc

SEQ ID NO: 22607 - DNA, 648 bp, Triticum aestivum
  unsure (1)..(648): unsure at all n locations
  Clone ID: PAT_TA_22607
cccgcgcatctggctaaccctcgcgagagggggagccggcgcgaggacctggaagacggcggcgcgaggacctgcaggcgaagacgccgacgctaggtccaagaggcgaagcccaggctggtcttggtcgcagtggccgctcgcccacgtacgtccccgccgccgccgccgtgaggttctggaggggacgacgccggcgcgtggtcttggaggtcccggctgcgcttggtcgtaatgatggacgaacagagagttcgtgtattccctacgacagcaaaaacggcgtcaactaaggcagccaccgatttgaacagtgagcatcaggtttattgtctgtcttgggtggtcattgtagcagtagtgtttgtactggacaaccttcagccaccgttgtttacttcaaactcgccggcaagccacaangtctacctcctgtctcgttggatcgccggacagccgctgtcgtctactcgcgccttgcaatgacagacggcatcaaatctttctnacggggnagcacgcgtctactctgctcatantaattgngtgcacaatctccggagaatggtaggtatcaacncaanagtancatatctgttctaanagtanctttaggatttanttaattatttcagggctcangntntt

SEQ ID NO: 22608 - DNA, 830 bp, Triticum aestivum
  unsure (1)..(830): unsure at all n locations
  Clone ID: PAT_TA_22608
aacccgtcccgcctgctccgagctccaggcttctggtttagcctgtggccggccgacccgaatagcgccgcccgccgtcgtctccccactctccgcgtgcccctcctgtctgttggagtcgagctcgctgttagggttccccatctcaccagatccccttacatggcggacgaacccaaccgagcggctttcgtagagctgcagagccggatgatcgagaccaccgggaagatcaaacagctacaaactcagatgcgttctaaagagagtgaaaagaagcgtgcatatcttacactggaggaacttatccaattacctgatgatacgaacacttacaaggccattggtaaagtgtttattttggagccgagatcacttatggtaaatgagcaagagaaaaagctaaatgatagtgagactgcaatatcgtcgatgcagacttccaaggaatatcttgagaaacagttgggagaagtggagaacaacgttagagagctacttcagcaggaccctgggcttgcacgccagattctctcaatgactgttcagtgagaggttgtttctgaatgtatttctagatgggacgtgtcaacaagatttgtgttttgccctgaggaaggagaagccccttctgtcatgagcttaactggaactggatttgtgatgagcttaccttccatcatcatattgtgaaaaatatgacgtggacaatccatgcctgaatgttgtatgatgttgaattatcatttatctatattgcgtgcgctttccatgacaaaaaaaaaaaaaaaaacctgcccaggcggccgctcgaaatcagtngtgaattc

SEQ ID NO: 22609 - DNA, 439 bp, Triticum aestivum
  unsure (1)..(439): unsure at all n locations
  Clone ID: PAT_TA_22609
ctatagggncgaattgggtaggtggcctcaagtttttggtgggagtgggatgtggtgtctatgtagctcagaactacaacgttccaaatgtcaagaagctgttcaacacgtatgttttcctggcaaagcacattgaggaaacataccgtaagccgaagaaagacgacaaggacgagtgattatcgcgcccctgggccaaaagaagtttgttctgacatgacagcaatgtgatcttcaagtgcttagaagtacgacggtgcatagtgggtactactagctgtgaaatttaccatggcaaggtttgtggatctttatgatgaaaccttagtacgtattttttaagtaggagagagggtatgcaaacatccgatcgatatatcatggcaccagtacaagtttcataataaatggaaactcttgtgtctccaaaaaaaaagaa

SEQ ID NO: 22610 - DNA, 560 bp, Triticum aestivum
  unsure (1)..(560): unsure at all n locations
  Clone ID: PAT_TA_22610
gcggcctccgtcgtggccacccccaaggataaagcctcggtcgctgcgctcggggcgacggccgaggcgctcgtcctgaagcgccctaagctcctggaactcgttggtgttgtgggtgtcaaggttgtggaagacgcagaatgggcggttatccttgactagctcatcgcggtccgcggccgtgcttcaactcaggctctgctgccagcacgatggggcccttgagcttcacctccttagccttggccttcttttcttcaaggatcaatgtcagggtgcttgtagcaaagagaggcgacctctttcgccctgggcacatctgtccgccaggttgaacatctctagggctgagcacaggcatcatgtatggcgactcctcaccatctggactccgtgagccctccgtgaagcccaatgatggcccgccggagcttcgagtcttgagggaacttggtgaacatgattacttcgaaggtccaccggtgnactacacccacagncantgacgtaaggacgtatgggtgcccaaagtgggacaaancctgaactancacaagaat

SEQ ID NO: 22611 - DNA, 819 bp, Triticum aestivum
  Clone ID: PAT_TA_22611
ccgcgtgcacccagggccgccgagaggggaaccggcggtggttctgtgctgaacaactctggcaatgctctcagtggcagtgcctgcggcagctcttccaaccggatcgccacccctactgagcagtgtaacgcatccgacggtgctaccgaaaatccaagcatggagggctcgcatcagctgagccaacgtgagattgcactgaacaagtttcggctcaagaggaaagaaaggtgcttcgagaagaaggtgcggtatcagagcaggaaactacttgcggagcagcgtccccgggtgaagggtcagtttgttcggcaagagcagaacatccaagcaagctaggtggacaaccgtttgccgtgctgcgcctactgagtgttctggtcgtcggcgtgttctttgaaagagtggagatcaactatcaacctttctttcttgtatcctacgtatacgctgacttgtcgtagattagctcgtacatagtagaatttgtcagtaggcggctagagaacacactgcctgacttgttacttgtttgccgtatacgttgttggactctgtgtggttgcaaaggtgtcagtcaaggatgtcctaagacacgcttttgtgtgctttcttgaactgagcatcgttgctgcagtttagttcactgcctcagcaaaatgctgtcgtctttccgtactagatggatttatattcaaaggcattttgtaatttttcggtacattttggctgaacttctggccatgtatggacgatggctgggcgagttcttgcgtattttttctgtgtaataaattaccggccgcttgaagtttg

SEQ ID NO: 22612 - DNA, 594 bp, Triticum aestivum
  unsure (1)..(594): unsure at all n locations
  Clone ID: PAT_TA_22612
ccccgctcctctactcccccgaagggcaagagaagactgcgaaatcatgggatataaaattcctgagggcaccaacgtacaggttaatatattcgcgatttgtcgggattgcagatattgggatgcccccgaagcatttaagccagagaggttcaaagagagcaacatagatcacaaggggacacattttgagttcacacctttcggggctgggagacggcaatgtcctggaatgttgttcggcacatcaaccgtggagatcgcattagcaaaccttctacaccactttgactgggtgttccctgatgggcctaatccggggtcgttggacatgtctgagaattcgggatcaatgtacgtagaaagtccgatttagagcttagagcaacccatatgtgctctccaaagctgcgtaatcaagggcctgctggggacgcagggaaaattggtccccacacgtcctcctcacttgcctctctgtctctcacaaccttccgttgattccttggcccctccttgtaagcaccctctttgggcccctttcaatggaaaccaagtggggaactctccccaagtganattcgataaaaaaaa

SEQ ID NO: 22613 - DNA, 555 bp, Triticum aestivum
  Clone ID: PAT_TA_22613
atcgcgtccatttcccacaacccaactctgcaaatcgacctcccacgcacgcgcgcgcgcgcctcccctgacccgccgcagcagcggcgccagagcgatcggccgccatgagcggcggtggcgccggcgacacgctggacaagctggtggtgttcctggcgaagcgcgacggcatcgacaagctggtgaagacgtaccagtacgtgtcgaagctggcgcactgggcggcggagacgtcgcacccggggctggccgggcgggccaagagctgggagacggcggccgggctgagccgcaaggtgttccggtcggggcggtccctcacgggcttcaacgcgctgcggcggtccccgggggagttcggcgcgctggccgtgctggccaacgccggcgagatggtctacttcttcttcgaccacttcacgtggctgtcccgcgtgggcgtgctggagccctggctggcgcgccgcgccagcttcgtgtcggcgttcggcgagtgcgtcggctacgtcttcttcatcgtcatggacttcatcatgatcaggcgcgggatca

SEQ ID NO: 22614 - DNA, 442 bp, Triticum aestivum
  unsure (1)..(442): unsure at all n locations
  Clone ID: PAT_TA_22614
ccaagcaccactaccacagcaaccagaaggacgagctcgacctccacgactacgaggcggagtacgccttctaccgcgacctcgccgagcgcccgcaggtagtccccttcctcaaggacactggcttggctgtcccgcccgtcgtattctaccattaggcgccagcttcctagggtgcgggcaacgtgctcgacgttatgcttttctttttggacctgcttgtttgctcagtgtaaaatgtgctctgcgaggtgggttagttatttattgtgattagatgataggtgagttgagatagagaattggagctgcaagtgtacattaagatttaggatcctccactggtataaccgtatangagaggtgcttgtgtttttggctgcttcacgacgacagctantgaagtgtaattcagactgattgtcctgataaaaaaaaaaaa

SEQ ID NO: 22615 - DNA, 803 bp, Triticum aestivum
  unsure (1)..(803): unsure at all n locations
  Clone ID: PAT_TA_22615
nnnnagcacttaatngctagctggtaannnngcagctgcaaaggtggtcaccaatacagcaagcttgctttgctacaccacagccatggcannnnncccccagcagtcgagggagtttgagttccacatgtcagctcccgttgaccactgggagcccatagcatcgccagcagatgagctcttctacaagggcaagctgctaccgctccaccttccaccacgcatccaaatggttgaaaggctcctcgagatcgcagctgacaagggcctcctctccgcgagcactgccccggcgacaccataccagtcgtgccacgtttcaccagcaaattcatgttatgcaagtggtgagctcaatgcagagcagtacttcagcgagtgcgcatccgccagtattgctgctgctgaggtggaagcagcatgcgaaaagaagccatggtccaagaagctcaagttcatcaagaatctcaaccttggtctcaagctcaaggcatcaaaggcttacctcaagacaatatttgcagctaaagcaggggatccagatgacaagggtggtgcaccaagagcaaatgagttctccaccgcccaggtcaagactggaggaagaaccatttggcagtcagaagcacagtacacaactcgccatcacaacagtgcacactgggagggaagcttaaagaagtgagtacggcataggagncatctcaatgtataccgttccgcatcagcaagtcgctccgctatccccccatgctctcgcacctcacacccngttgggcatgtagggggacatcantaantgg

SEQ ID NO: 22616 - DNA, 738 bp, Triticum aestivum
  unsure (1)..(738): unsure at all n locations
  Clone ID: PAT_TA_22616
ttgatgtgaaagttctttcggggttgtgctgcgtgtgtgcgtgtgttcctccatgtatgtgtgtttgagtagttgagttgaatagaagccaacatataggccgttcggcggccggggcgttagtcgccggaaaattctattcatcttcttctatcttccgtctgggtgttcatcaccggagggctgttcggcgtatgtcgtccggtgggntttgtcccaacatttggatatcatgagcttgggtatcttggggtgtgcttgccgtcccggaggcgtgacaccggtgacggcgctccccggcggctgcgcgatggagctccgggcggtgtgtcggcctatggaggtgtgcggcgctgcagcggtcatggcggaggcgaaggcgacacacggtgagtccgcgatgagctcggcggacgtggaggcttcggcggcgcggtggcggcacgcggcaagcacggtggcgaccgatgtcggtgcggcaggtcgagtccgtggcagtggcgaccggcgttagcgcgtcaagtcaggtccgcggcctgacgacaatgacgatggaagcacagcgtcaactccagcgacacagcagcacatttacaggacacgaggtgttaagacactcacacatcgggcctgttggagcaccggcaagctggtaagtaaattaaaaacactttcctctcagcgcgcgtcagcgctcatgctgcacttctgttgnntattaacacaataatactccat

SEQ ID NO: 22617 - DNA, 532 bp, Triticum aestivum
  unsure (1)..(532): unsure at all n locations
  Clone ID: PAT_TA_22617
aggagaagagactcaatgctggggacaccgtttccttctgccggggcgccaccgaggccacgcgggaccgcctcttcatcgactggaagtgccgggccctagtccatgattcgttgccaaaggtagacaggccgtcgagggcggtcaagaagcgggtgcggctgttcggagtcaatctcggcacccagcagccccaaggtggcgagttaacccacgatgccaatgccggtgcagctggagtggagtcctcagctgctgcctcatcgccgtcatcctcccangacagaagcacattcctccttggatctcggtctgtgaatgcgtgcccacggaaagttcaacagcacaattccttcagtttgtcacctttantttcttctccaccttttgtggtccngtctgttatacattgatataagccaacattcaagcttttggttaggcnatcaaatcctgggggggggcaaattataatacagagagatgaattagngaatatcaatccccatgattgttggtcaaaaaaaaaaaa

SEQ ID NO: 22618 - DNA, 432 bp, Triticum aestivum
  Clone ID: PAT_TA_22618
tccttccctccccgctcaatcccatggcgaaccccgtcgcctcccctctcctccatccctcctgcgcgcgtcggccacctccctccggcggagctcgacccccacccccaagcatcgctgctccaccctctctcgagcccctcgatcccagatccccgtctccaagtcaccctctccctccctcagatctcgatccgccgccgccctcaccatagacgagatcgatctcctccctccctcccgttctcccctagccttatccactccgagccaaccaaccactccggacccctcctcccccacccagccttcttcttctccacctccgccacaggttccaggagagctcgcctcgccttgctgctacctgaagccaccagcggaggcacgctggagggagcatgaatgtctccgtcgtgccccggagcggcc

SEQ ID NO: 22619 - DNA, 710 bp, Triticum aestivum
  Clone ID: PAT_TA_22619
ctttgggtacaatgttctggggcattggcaaaaaaagacacaatcaacaggacttgttcaatgccatgggttccatgtattcctcagttttgttcatgggggtgcagaactctgcctcagttcagccagttgtggctgttgagcgcacggtcttttacagggaaagagcggctcacatgtactcacctttgccatacgccccggggcaggttgcaattgaacttccatacatctttgtccagtccttaatatatggtgtgctagtatatgctatgattgggttcgagtggacagctgtcaaattcttttggtacctgttcttcatgtacttcactctagcttacttcacattttacggaatgatgtcggtgggcctgactccaaactacaacgttgcctctgttgcttccacggcattctatgctctctggaaccttttctcgggatttattacaccaagaactggaagcccgctatgggcgcgctgggtcttctcgccctgcccttccgcctcgacacccaatggcctagtctcctctccgtttcgagttgtatccgagctctttgctaatggcgtgcgggtgtccgggttcgtcctcagctatttccggttccggcatgactcccggccgcccgtcgctgtggtcgtcgtctcattcgctcttctctttgctttcctattcgggctctcaatcaagctattcaacttc

SEQ ID NO: 22620 - DNA, 563 bp, Triticum aestivum
  unsure (1)..(563): unsure at all n locations
  Clone ID: PAT_TA_22620
ctcatccctggctcagcctccaggtaagctgatggacacaatcagaaggccggtcacagcagcttcatctcttggccaatcagcggcaaatcatctccagccactggtcacattggctcagaggaatggagttaacaggaggtgcctcctcactctgctggcatccgccgcagccatacccgaggccagtgaatcaagaaaggcgctattgcaagattatgtgaagaggtcaaaggaaaacaaagagaagaatgacaaggagaggctggacgacttttacaagaggaattacaaggattatttcggtttcatggaaggctcggttagagagaagccagcggaggagctcacggagtcggagaaaggaattcttgcgtggcttgacaagaacaagtagccagctgcatgagaggagaaccacgccaaccaccaaatagctgaaacaccttttgtataggaaaactccttccacggtgaagttcagcttatcatgcgtgtagtagcacaaatctttgcttgatctcatattatgtttcattttttgccannnaaaaaaaataann

SEQ ID NO: 22621 - DNA, 724 bp, Triticum aestivum
  unsure (1)..(724): unsure at all n locations
  Clone ID: PAT_TA_22621
agcagcaacctgccatgtaggaaatcaagagagcacactggagagcaaactcatctcatcccatggctcagcctccaggtaaactgatggacacaatcggcaggccggtcgcagcagcttcaacccttcatcattcagcggcgaagcatcttcagcagatcggagctgaggagaggagtctacagaaggtgcttccttcctctgctgccatcccccagagcaacacatgaagaaagccactaaagcaaggttatatgaagagattatgtgaaaacatcaaaggaaaagacaggaaagagctggacggagtttacaagagaattcaagatattttggtttcatggaagctcggttagagagaaccgagtgagggaacccagggaagcggctaacggaattcgagaaaggatctacaagaacaagtaacaagagcaggacatgagatgagtgggagcaaccaccaactggccaccacagggtttccactcgttaaattcaggaacccggttaagttgtcaaagttttaataagcttggaatttggaaccccacttgcctcttaaatctggtgcaactttctccggttcatcattgtcatctcatctgtgcagcacaaatctttgcttgacctgatattatgtttcattttttgcaaaatcaaagaattacaaaagtacttgaactctcaccgcctctaatcggggnactgtccgttacaaaaaaaa

SEQ ID NO: 22622 - DNA, 633 bp, Triticum aestivum
  Clone ID: PAT_TA_22622
cccacgcgtccgcccacgcgtccgcccacgcgtcctgtttggcttggccagaacagacagagagaccgagaagagagggcgaagaggggagcaggaggaggcaatcgcgaacagaccaaccatgggcgtgaccaaggaggacgtggaggccgccgtcgccgccgcgctcagccctacccacctcgtggtcaccgatacatccggcgggtgcggcgcgagctacgagatcgaggtggtgtcggacaagttcgaggggaagcggctgctggagcgccaccggatggtcaacaccgcgctggcgccgctcatggccgagatccacgccgtctccatcaaggcgctcacccccgcgcaggcccagcccaagtcggagccggccgccgccgacaaggcgcaggcctgactcgctctttaggattcactagtactgaattcacacatgcgccgctggatgtcgggagctcgcatcatacagtactctctgcttgaatgaataatgtagcaactagcaagatgcgtctgcggaatcgagactttgcagtggcgctatgcctggctgataagactttgctgcattttgtctatgtgattgtgattgtgatgattcagtgcttctgctctaaaaaaaaaaaa

SEQ ID NO: 22623 - DNA, 1301 bp, Triticum aestivum
  unsure (1)..(1301): unsure at all n locations
  Clone ID: PAT_TA_22623
tgattggtacctctccaacgcctgcttcttgggatcagttggccggaagatcggcagctttagttgcctactgattcctcttttgcttgggtgtggaaggatggcacagcactctgagaatgcggcagagaacatgatgagcggcatcatggacgccatcgccgacaagctccccaagcaaaagtcggtcaggttcgatgatgagggctccatctccggccaagccaagaagctcttcggcggccacaagtctgtgcaccacgtcctcggcggtggaaaatccgccgacgtgctactgtggaggaacaagaagatctcatccagcgttcttgctgttgcaacagctgcctgggtcttcttcgagtggctcgactaccatttcttgaccatcgtatcatttgtgcttgttcttggcatggttgtccagttcggatggtccagcttcgcaggcatgctcaatgggtctccttctaacgtgccccgtgtggagttacccgaagagctgtttgcaaacatgggcgccgctgtcggcgcccaggtgaacaaattcttgggaagccttcaggatgtgtcctgtggaagagacctgaagcagttcctcatggtgatctccggattcattgtcgccgctttcattgggagctggttcagtctcatcaccgtcatctacatcgggtttgtgtgtgcacacaccctaccagtgttctatgagaggtatcatgatcaagtcgatgaggtgctgtacaacatgcttggcttgattgggagtcagtaccagaagcttgacaagggcgtcttgagcaagatgcctaaagggaacctcaagttgaggaagagccagtagtagttggattcaccaacggaacatctatgcctgtgatccggatgaacttgttagaattaatgggtttgaccatgtgcatttccagaaattccaaacgcctatgaataaatggtaagacgtggtgcaaaacatcggatccccaaaanaaaaaaatatnaaaacntcgaggaggnccttttaaganccggcccgcggggccccattcgaatttttncacccccggnttggggggnanccaaggttaagnggggancccccaaatttgcccttanaaggggangtccgnatttaccaatttccaattggncccgnncggtttttnacaaannnncctggacttgggnaaaaaccctnggcggtttacccccaactttaaacccctttgnnaaaaaaatcccccttttcgccaanttgggcggaattaccaaaaaagnccccaaaccngantggcccttnn

SEQ ID NO: 22624 - DNA, 803 bp, Triticum aestivum
  Clone ID: PAT_TA_22624
cccacgcgtccgagtcagcatccttcaagttaggaatgttcagtattcccatatcttttatcttcttggttacccttgctccacgttcctctgctccccccttgcatgtcgacaatggaggctttacatcacatttcgaggcagtggtgcctgcaataggtgttgatggcgaggaagagctgcatccactaggttgttgctgctacaaatccaaataattgttttgttatccatggtgcttctcaatgttcaaaaaagcagaaagcttaagcggagcagaaggccacaactcagagcaatgggcgcttaagcaattgctactcgaattttgttcaccattcatagaacaacactctgctggtcttgctattcgccattttcctcccccctatagtgctgccactctgtgatgcctcggcaagaaggccaatcgcagggagatacgctatggcatgtcctgaagaggcaatcaggtatttcggtggcctcaagccctcaaccctctggatcatccgtccgttgtgcgtgctctcatccgggttgccgagggacgcctcctcctgcggcgctcctgtccaattttttgtttatgtaaaaaaattcttaccatcacctcacctatttggaaaattaggtgagctctgcaatttggttctgtatccttaaagagggaacacatttttccttagtcatgctaccatagtaacataaactcttactccatagttacaatccctaaattgtggtgagatgcaatgctaagcaaatggaagataacagtttgtaccatcaaaagttcaaaa

SEQ ID NO: 22625 - DNA, 683 bp, Triticum aestivum
  Clone ID: PAT_TA_22625
tcggcacgaggacgccgcaagcctccgccgccgcaagtcgcccgagggcctcatgccgccgccgccgctcgcccctttctctgtaggtcgcccacgcaatcctcggccccagggtcgttccctcctccccaccaggctcgaggaggcccgaggaggcggccatgaggagcgcgcagccgccggagtcctgggcagatctagccggggccgtctgcagccatcccttcctccgggcggccatgaagaattgaagcggcttgagcagaactagcgcatggaccatgcgcgcctcccgcggtagaagccactggtcctcgtcatctgctgtcatccacgaggaatccatccatatatccaaaagaaggataagtgagttgcagatgagttctccagttggatgaagcatataaaactagaagattttacttagcaataaccatagtttacattgatagattgaaaaatgtaatgccattcacaagacctttttctttcgtcgtcctgcccttggtcctgtggtgcattccccttcacccgtgtcttctcgattggcctcttgatggcactgttacgttcttgccccaatacctgcgcgatttttttattctgctgcatatgtctcccgcgcgcctgtttgggcagtagaaattccgttgagattctcccacaatgtactttactga

SEQ ID NO: 22626 - DNA, 1093 bp, Triticum aestivum
  Clone ID: PAT_TA_22626
cccgcgccgaccaaccggaccggcggcagctgaagcctgagagcgccacgacgatgatggccgcagcgagaatggccttcgcatcaagctgtcgcgtccacctcctcctcccttcctcaccttcaacccccatcttcgccaggacccgagttggcttcaggggcatagccaaatccatctcgttcttggccaccgttatcggctgctagatccgccgccctcttctgctcttgctcctcgccttcctccgacgccgtcgtcgcaccggcacctacgcaggcggctgtagaggagaagaagccggcgcccgcagttggggaggaggagaaaggcgaggttccggtgggcgagctcgctggcctcctggacatccgggtggggcgggtcgtgaaggcgtggctgcacccggaggcggacactctgtacgtggaggaggtcgacgtcggcgaggagcagccgcgcaccatctgcagcggcctcgtcaagtacttacccctcgaccaactccaggacagcaatgtcattgttcttgctaacctgaaaccaagaaacatgcgcggcatcaagtctagtggcatgcttatgtgtgcctctgatgcttctcacgagactgttgagttgcttacccctccagaaggttctgttcccggtgaaagggtatggtttggatctgaagatgaaaagagtattcaatcagaacctgcaacgggaaaccaggttcaaaagaaaaagatttgggaatctgttcagcctcaccttaagacaacggataactgcgtagcagttcttggtgagcaaccaatgcgcacctcagcaggcatggttttctgcaaatcattgcagggtgcaagcgtgtcataatactgattgaagagattatttcttcttcctttttggctgtatccatataatgtatttccctgaaattaattatagtaggagtgaaatctttaatgaaaagattgcttttgaggatatttaaccaaaatatagagtttcacagtggtcgatggacagaagccactccatagacggaatctatcgtctctttcacttacaatccaagattcacaattgaattttgcataactgt

SEQ ID NO: 22627 - DNA, 493 bp, Triticum aestivum
  unsure (1)..(493): unsure at all n locations
  Clone ID: PAT_TA_22627
ngntctttgtcctnttgtcctcattcattgcggttgaccnggttgccggcaatgggatcctgggagaaagcccacggtggcggcaatgacaatggcgacagggcgttttgtgaggaaggtgctgcgggaggagatggtcccaggcggacgacggaaggtgtcgttgacattggcggctcaaagaggaagagccccggtggcccagacccgcagcatcattaactgatgtcgaggtctccttgcatgcagattctctaaaatggcatcatatacatgggacctgaatcccaagatagatcgatccatcaagtttgtgctcttgtcttgatatatagcgaaaaagatggttttgttttgcaagcatatatgtatacatgttacagtaggagacgcagcacaagttggtggaacagaccaaatgttgtgactcgttttctcaaaaggaataaaatttaatttttcgtttgcaaaaaaaaaaaaaaaaaaaaactcg

SEQ ID NO: 22628 - DNA, 558 bp, Triticum aestivum
  Clone ID: PAT_TA_22628
cccacgcgtccgcccgctcgtgcagcgcatgagccaccgcggcctccccgggaacgaccccaccgactgcgccatggtcttcctctacttcctctgctccatgagcatacggaccaacctccagaagctcctcggcttcacgccgccccgcgccgccgccggggccggcggtggcctcttcgccatgcccgatcccaaaaccaattgagcttgatgatcccctcgatacatacatgtgatgcccctgatgtcaagcaagcatatgagttggtctcccagaaagagttgctgtcctgaaaggaagataaataacctacctagtcgctcagaggagagaaacactgcaagacactgtaatgacacaattcattttttccacccatgataagcaggcatgaaccgtacgtaggctggctgtatcatgaacattcttgagttggcccaagcaatctgttgtcgggtttgtcgtagagttgtattttatcatcagtctctgtactttatcatcagtcgttctagtaaaaaaaggggaaaaaaaaaaactcgtcgccgccgcga

SEQ ID NO: 22629 - DNA, 715 bp, Triticum aestivum
  unsure (1)..(715): unsure at all n locations
  Clone ID: PAT_TA_22629
gtttctcagaagaggttcaggcataaatcgaagccctgaagagacaaccagtcagaacactgatgtacagggaagcacttcaagagtcaatcctatgaaaaccaggctggctgattatcaggagagaccaagatacttacatggctcatataaatatgcaagctcaaatgtcatgtctggaagcccttccaaatttcctaagaactttccccttaggaaatttggtgaggaaaagcgaaggcagacgttgttggaaggggctgacgttgctgaaagtagtagaagaaagtccgatgccgggtgtctggagggtagtaagaaaaccattgtagagaatcagagttcagatgctccacagactgggacagaaggattaactgccaaagatcatgaactgatagcacctgatccagaggtttcgcatcctgctggttcttcaggtatgcatgcacatacagctgagtccttgggtaaggagtgcttcactaagttctaaaacacatagacagaaggataaggaattgaatttgggcacagctggatctgctcgcgcctccgtccttccagtaatcagcctagtatacctagaattcctatcgctggtgcgaagcatcatatatcctgttantggagaacagagacgtggacacgtggcctaaaaatctgggtgcactcantcnctgagttctgcatcangatctggccgatcgttcga

SEQ ID NO: 22630 - DNA, 319 bp, Triticum aestivum
  Clone ID: PAT_TA_22630
gagaatctcattgaagaagagactcaccacagggatcgagtcgtttgcgatatttcactatggtgagataaggcctggtcatctagccaaaagggtgtacccaaagtgctcaatgctcgagggaaaaaaggtttttgtgtgaggtgtgttccaagtgttggtaggtgttgatttaacaattaagtatgttagaagtgtggttactcttggttgagagtttgttttaacgcgtgaacagcattattaagttgttacctcgagaactatattaatatgttatgtcgattgttctccgtaaatttagggtaaaaaaaaaaaa

SEQ ID NO: 22631 - DNA, 1253 bp, Triticum aestivum
  unsure (1)..(1253): unsure at all n locations
  Clone ID: PAT_TA_22631
tcgatcgacccatcgatgcctgtagtaatgtgtgcaatgctctaccatccattcattactcagnaagcagtacaatcttagaaacgatttggaatgttacatactacaaagaactacacaccaggtgcatttcacacaaagacggtgcacccgcncagttccttcagttacacactaagaatctctttcataaaggaaatgcacctgaacattgctcccgattctttttacaaactcgaggataccataaccccaacctaacaggagaccatgcgtgatgcgaaaccaaacgtttccgtgctgtttactactggatgttccttgcccgcatcaatgcttctattttctcaacgtcttcgggcgcatccacaccatgggcatcatggtccaccttgataaccttcatcttgtagccattctcaagaactttaagttgctccaggtcctcttctagttgcagtggggttggtgcaagctgtggatagatcttcagaaacttcgaatcaaagcccgaaattccaagatgaagaagatatggaaagtgaggattgactttccctgatttgttaaatgggatcagccctcttgagaagtatattgcataaccctggttgtctactacacacttcactcggtttgtgtcaaatgcatcttcaggttttagtgccgtggcagctgtgctgaagactgcatcaggagctcgctgcaatgccataaccacaccgtctatgatatctggttcaataagaggctcatccccttgaatattgacaacaatgtcgtaatgtttcctgagcttttgaagtgcctcacagcagcgctcagatccattttggcatgatactgatgtcattataacatcagctccaaatcctctacagcactcggcaattttctcatcatccgttgccacaacaacatggtctaacgaagaagctagcataactctttcccaggttctctgtatcatgggcttgccgaggatgagggcgagcggcttgccctcgaagcgggaggaggcgtagcgcgcggggatgatgcccaccgccaggctgcggaacccgcggggccggcggtacacgtaggcggccgcggcggccgccgccgccgcgccgagcgccagcccgtggaagatccacgcgcggcccccggaccccgaggtctccggcggcggcgggcagatcggcatcgcgccggcggtggcggtagggtggatccggcgcggcgaagcgatcctgagcttcgctcgtgcc

SEQ ID NO: 22632 - DNA, 1419 bp, Triticum aestivum
  Clone ID: PAT_TA_22632
ccgcagtctgttaccggcctgatggaaagggggtagtggttgggaccataacaggaaattgccgctactacgatgcatcagaaaatcgtctagaactggaatctcaggtctctctgaatggcagaaagaagtctccacttaaaagaatagttggtttccagtactgcccatctgatccaaagaagttgatggtaacatctggtgactcacaagttcgcattcttgatggggttcatgtaatttccaactacaaaggtttacaaagctcaagccaagttgccgcatcatttaccccagacggagatcacattatctctgctagcgacgattcccgtatctacatgtggaatcatgtgaaccaacttgccccagtcacaagccgcgtgaagacagtgtggtcatacgagcgttttttcagcaacgatgcctccatcgccataccgtggaacgcctcacagtcaaggaactctatttcactggcctgcaacatcccgtctttgcggcaagaagtctcgggcgacctctgcgacatacaggacagcagcacatcacgctgccagactgaagattgccttgaagatgacaacatgttccagttaccatcgggcaatttcactctgagcagggcgttccttgcggagtctgctccaaggggaacagccacgtggccggaggagcatctggcatccaactccgcgacggcatctactttgcgtaaatctcagtacaagttcctgaaggcgtcttgccagaatgcagccacacatgcctggggccaggtcatagtcaccgcaagctgggacggccacatcaggtcattccagaactatggcttgccggtgcaagtttgacatcgcgtcttctcggcattgcttcatcagtgggtttcccagaagcacggcgcctctcgacttcacggcgaatgcttagatgccccgcctcgagaagcctggctggcccgagcttgacgctcgtccagatatactgttgcggtacaaagcgtcacatggctggtttcttgtgctaacatgcttgtggaccataagttgtatgtagcccgggtggtcctccaagatcccgccagcgtcgacgccgttgtagcagcaggcccccttgggaagaaggcggacgccttccttggctgaattatgcaatccttgtggtggggtctgggcaccaagacctcttgatgcctttattttcgctgttccggagccctcggtaaagtaaatatataggagaggatgaacatatgtttttgaccagtttcgactcccctcgccccggtcgaccggtcgatcgacgggggcgagcggggaggtagctagggctcgatcttgaggatggggtgcacatatttggattcatttcatttgttgttacatgttgtgtgtgtgagttaatggtgttgtactgtgc

SEQ ID NO: 22633 - DNA, 309 bp, Triticum aestivum
  Clone ID: PAT_TA_22633
ggaaagcccgcctgcgagcccgagtgggggcattaaggtggtgtggacgctgttgtagcgctgcgggcctggtctgggtgtgctactgttggcccgcccgttccaagttgagtagtggaccgcttggtggggcctatgcgaaagttgggcctcacggtccataatgtggcaggcaccgcgtgaggctggcttcacagagcagcgacaactgcccgcttccaacggtggaaggataacgggccgctgcactcctaggccgcttgggcctcgcagcctactccagcaaaccaccatctttaaaaaaaaaaa

SEQ ID NO: 22634 - DNA, 599 bp, Triticum aestivum
  Clone ID: PAT_TA_22634
cccggcgacgcgaccgctcttatcgcctcgaacgtatcgaagccgaggagagcggagcagccgacgagccgccgatcgacatgggtctcaaggaggagtttgaggagcacgctgagaaggccaagacgctgcccgacaccaccaccaacgagagcaagctctgcctctacggcctctacaagcaggccaccgtcggccccgtcaacaccgcccgccctggcggcctctttgatatggccggcaaggccaaatgggatgcttggaaggccgtcgaagccaaatccaaggaggaggccatggctgactacatcaccaaggtgaagcagctgctggaggaggctgccgccgcatctgcttgatcccaggccacaaaaccgcaatcgctattgttatcctggtggtgcagccatatgtgccagcaaacacaaataagtttcaagtactagttgttgtcaagcttatcgccgtcgtgggtgtaattacgttgaacaagccctgtgatacatgaaagtgcaatctcagtttacaccatgattgattaatactcctacatgtcttctgttgttaagatgtttttttcctttggggaataccggttc

SEQ ID NO: 22635 - DNA, 2265 bp, Triticum aestivum
  Clone ID: PAT_TA_22635
gtaacacttcagccactctcccctaatccctatccggccgcttaaccaaccccgcacggatcgcggagctggttgcctcccacttctccggcggccgccgcgttgcagagacgtttcggtatgaggaagggcgcggagctcttggtcctgctggtcgcgtcgtccctctgcctgtccgctgcgattgccgcgcaggaaacctgcccggccgacatcgacgccaagtgcggcgatgccgcttctgatgactgggagggcgagttcttccccggcattaccaagatcagatatgagggtcctaccagcaagaagccgctttcttacaagtggtataacgcggaggaagtgatccttggaaagaaaatgaaagattggttgcggttcagcgtggcgttctggcatacattccggggtactggaggagacccttttggtgcagccacaaagaactggccttgggaggatggcaccaattccttggccatggctaagagaagaatgaaagctcacttcgagttcatggagaagcttggagttgagaggtggtgcttccatgacagggacatcgcccctgatggcaagacactcgcggaaacaaatgctaacttggatgagatagttgagctggcaaagcaactccagagtgagaccaatataaagccattgtgggggactgcacagcttttcatgcatccacgttacatgcacggagctgctactagcccagaggtcaaggtgtatgcttatgctgctgctcaagtgaagaaagctttggaggttactcactacctaggcggtgagaactatgtattctggggtggaagagagggttaccaaactcttctcaataccgatatgaagagagaacttgaacatttggctaactttcttcaagctgctgttaaccacaagaagaagattggctttaacggaacattgttgatagagcctaaaccacaagaaccaacaaagcatcagtatgactgggatgttgcaactacattctctttcctacagaagtttggtcttacaggagaattcaagataaatgtcgagtgcaaccatgctactctctctgggcatagctgccatcatgagcttgagactgcacgcattaatgatattcttggaaacattgatgcaaacactggtgatccacaagttggttgggacacggatgagttccttacagacatttcagaagctaccttgattatgtcaagtgtagttaagaatgatggacttgcacctggtggcttcaacttcgacgccaaattgcggagggagagtactgatgttgaggacctgtttattgcccatatctctgggatggacaccatggcccgtggcctccgcaatgttgccaagctgattgaggatggttccctggacgagcttgtccgcaagcgctaccagagctttgacactgagattggtgccatgatcgaggctgggaagggagactttgaaacgctagaaaagaaggtcttggagtggggcgagccaaccgttccatccggcaaacaggaactggctgagatgctgttccaatccgctctgtagatgacagcccacggttctaggaataaaagcaagaccacgccttcgaacgcccagtcgtcctcgtcactatgggtgatgttctatagttaggcctccatgcaatgaaccctgtaaacaaactgcatggagctgaaaataatgtaaccttatatcagaattaaacttgttcgccaacatggagttgggctgaactatgttccaattttctccccatatgttaccaaaaaaaaaaaaaaaaaaaaaactcgagaaggggcccggtaaacaagccccccgattgtgtgtcgttaccggccccgtcaacaccgcccgccctggcggcctctttgatatggccggcaaggccaaatgggatgcttggaaggccgtcgaagccaaatccaaggaggaggccatggctgactacatcaccaaggtgaagcagctgctggaggaggctgccgccgcatctgcttgatcccaggccacaaaaccgcaatcgctattgttatcctggtggtgcagccatatgtgccagcaaacacaaataagtttcaagtactagttgttgtcaagcttatcgccgtcgtgggtgtaattacgttgaacaagccctgtgatacatgaaagtgcaatctcagtttacaccatgattgattaatactcctacatgtcttctgttgttaagatgttttttttctttggggaatccctgttcctgat

SEQ ID NO: 22636 - DNA, 1128 bp, Triticum aestivum
  Clone ID: PAT_TA_22636
gccggccgctcgagcggccgggccagtcgttccactgcacgaagaagcacctcgcatcgcatcgaatcgatcgctcttatcgcctcgaacgtatcgaagcccaggaggaggagagcggagcagccgacgaggccgccgatcgacatgggtctcaaggaggagtttgaggagcacgcggagaaggccaagaccgctgcccgacaccaccaccaacgagagacatgctctgcctctacggcctctacaagcaggccaccgcccgggccccgtcaacaccgcccagccccggctgtgcccctcgggacgcctggaaggccgaggtgggatgctcggaaggaccacgcagcccaacccaaggggggagtccatggaggaggccatcccaaggctgaagcagctgccttgaggaggctgccgccaacttcctgcttaatccgtagggcccaaagcccgcatatctctactgcttgcctggaggttcagtggtgagaggcagcagacacatataatttgcaatcactagctcttatcgagcttatcgccggtgttggtgccttgtgattaccaccaagacctatcgaagatgaacgacaaattaagtttcaaagtacgagggtaattataaaggcttatccgcacgccctgggtgtgattacgttgaacaagcctgtgatacacagagggcactctcggtttgtcaagatgcccgcccccgaaagttcacctcaagggctaggccaagtgggacgcctggaagtccgtcgaagcgaaatctaaggaggaggccatggctgactacatcaccaaggtgaagcagctgcttgaggaggctgccgctgcatctgcttcttcttaggccatggtgctattattgttattatcctggtggtgcagacacatgtgtcaacaataaacacaaataaatttgaagtactagttgtcaagctcatcgtcgtattgggtgtaattacgttaaacaagccctgcctatggttttatgccatatacttgcaatctcaattttacgccgtaattgattcatatatgtgctatcttgttaagattggttttctttggggaaagcgtgtgcttcagttcctcataagttcttctgaaccctcataaaaa

SEQ ID NO: 22637 - DNA, 772 bp, Triticum aestivum
  Clone ID: PAT_TA_22637
ggattcgcacgcgccacgcacgatatggacggcaacgccgcccctgacgcctacgccaggtacgaggcgatcgcttcctccctcccgacgtcggcgtgccagggcctgggggccgccgcgtacaagaaccaccgcggcttctggtacccggcgcaccagatggcgccgacgctcgccgcgcgggacaccttcgtcgcccgccccaccgacatcctcgtcgccaccctgcccaagtccggcaccacgtggctcaaggcgctcgtgttcgccgtcgcgtaccgccgcacgcacacgccagcactggaggacggcgcggggcagcgccgccacccgctcctgggctccagcccccacgacctcgtcccattcctgcactacgtctacgagaagcaccagtcggccgcggcgccgctcctggaggcgatgccggcgccgcgcgtgctggccgtgcacgcgccgctctcggcgctgccggcgtccgtggccggctccggctgccgcgccgtctacatgtgccgggaccccaaggacgcgctcgtctcgctctggcactacctccgcaaagccaaccgtccgggcgccaccgcggcgtcgctcgaggagctgctcgcggcgttctgcgacggcgtctcgccgttcgggccggcgtgggagcacgtggccgagtactggagggagagcctggcgcggccggagcaggtcatgttcctccggtacgagcacgtcaaggaggacacgggtggggagcgcgaagcggctcgccgagttcctc

SEQ ID NO: 22638 - DNA, 1078 bp, Triticum aestivum
  unsure (1)..(1078): unsure at all n locations
  Clone ID: PAT_TA_22638
tctgacatctgttgngagtggtccaaccggggggggggcttcacggttgccaaatttgcgagctgtggttctgcacagtcctattttatctggactgagagtgctatatccagtcaaaaacattctttggtttgacatttacgcggaggtcgacacaatcagcttggtaaatctgtctagttctggcattcatggcacgtcggatgacgttgttgattggtcccatggaaaagcagctatgggagctttgcaaggtgaaacattcacctttgtggctaagtggcggtgggcactgcaacctggagctgtatcctgactacatcaggcacttgaagaagttcgtgtcaagcctcggcaaaaaatcaacaaaacctgacttgaaagagttaccagcaacagaagacacatctcgcaaggacgcagaatctgtgtcctcggacaaaccccaagaagctgcgaagtgccgacagatctcccggaagagcttagatagtagagttgggaaatccaaaacagtggatgctcctgaaaagccacgaatgagctcagatgacgttgacaagtttaggaggagaagatgcttggtttggtgatctatgatatgacgtctgcacagttcatggagtagtttccgaacaccatggaatgggattcaagcaactgtgtcatactgtatagcgaggaacaacgctgacagttcccgcagtagagggataatagctgtgttaaatgtgggagaagaagaatcatgacgctggtgaataagctgttatttatcaaaagagggtacgtctcaacatggtaactttctcggttaattaacctgtattgcaacccccagtggcggtaggatttccatcatgtaaaagtgttgtctgtaatcacgagggacaaggatagaacatttgctgccactttgtggcgcggtctaaagtcttggagcaatcacaagaagcaacatattctagtctggatatgcaaatatagtgttcatatgttttgtggctagaaggacttccattcgtggtcaaaaacccaaaccacggcgccgttaaggaccaagttagtaggtgcagcg

SEQ ID NO: 22639 - DNA, 646 bp, Triticum aestivum
  Clone ID: PAT_TA_22639
gccgtgtgggtgctcctgtcggcggctggcgcgctggcggacggaggcaatggcacggtgtgcctgtgcacgggcccgcagtgcgtgccgccgtgccccgtcccggggacgccaccgacgacgtcgcccacgcagttccccttctgcccgcagcggccgccggcggtcgggcccttcccgtgggagcagcagccgccggcgtcgccgaggtcggggtcggggttccctcaggacgcgggcttcctcgctgcagccgcggcgagccccactagcccagcggcggcatggctcgcggtggccgccttgtgctctgctttcctgctgcttctgccgcagtgaccctgcctctctgctcgctcacccagccctgtagattgatggatgtactagctgcgagttcatcaggaggcgctgtctgaatctatatgtatgtaattctaggtcttgatttcaattcagtaggctcatatgaaggaacaatctaagaaggattgggttgggaacttgggatcctccctttctgcatcctgttcttgttgctcccttgatttgttcattcatgggaggcaataactttaacttttcgtttcaactgtatgctggggcactgccagatctgatatataatatttggaaatatgagcaa

SEQ ID NO: 22640 - DNA, 579 bp, Triticum aestivum
  unsure (1)..(579): unsure at all n locations
  Clone ID: PAT_TA_22640
ctctcctccatcgcatctcttcttgctctattctccactagaaccacccaattcatcaatggcttcatctctgaaggtggccgccatcgtcgctgtttgcgtcatgctcgtcctcaacatgggtcacccggcggcagccacagaatgcgaagattgtctgggcgcctgtgttgcaacgcccaccccctaccctcatgcggcggcctctgccccctcctcactcctgcctcccgcgcgcctgacgtcgcggcctgcggccattgcggtccgtcgtgctacggccgttggcccctcttcccttttccccccggccggccgggccctgccccgcgccgcgagctctgcttcgggcttccttgcgttcgtggttgcctctatgtcccttggcacctcgctgttcctatcctgtggtggggtgcttggcgagcgaaggtccttgctgtgtgcagacccccattgttccaatcatctataaattcgccttccggtccaaattcctcttaaataaacgagaccgcgctctcggccgtctttaaagtctacggaaacctgcgtacanntatccctgagaatcccctt

SEQ ID NO: 22641 - DNA, 1387 bp, Triticum aestivum
  Clone ID: PAT_TA_22641
tttttttttttttttttttttttttttttttttttttttccacaccaatcagatattaactcgttattattacaacatatcacaatcagacaatgtcatcgattcgcttaggcaacgggcaaaaacagtctgattgatctaagcgagacatgggtgtcagagctccaattttcgttgatggacatggagcccaatctctttcttttctgtacagttaaaacaagaccagcatccagcaatgccaagaaatcatagaaatgccgtttttctcgtgtcagaccggcaatcaccgccgcgcctttccgcggggtgatgaccggggcctatacgacgcggcggccatgtcgttaaggtcctgcagcggcgtcagatgcttgacaacctcgtccatcatcgggcgcgacttgctgtcacggttgaggcagtggtggcagatctgggcaaccttctgaacccctctgacggaatagttcagccccaggcgagggtctacgagctgatagagccttcgccggtcgctcagatacggcctcgcccacgcgacgaggttctgctcccccggggcccacgcgtccgccactgatctcctgccagtcagcacctccagcagcacgactccgaagctatatacgtcgctcttggttgttaagtggcctgtcattacatactcgggcgcagcatagccataggtgccaagaactcgagtagagacatgggttttatcaccttgggggccagcttttgcgagcccaaaatctgaaagttttgaattgtactccgcatcgataagaatatttgatgtcttaaaatccctgtaaataactggtttgggaccaacatgtaggaaggctagacctttagcagcaccaagaacaaccttcatcctgcacggccaaggtaggggaagagtccttctgaaaagatgattttctagacttccccgtgccatgaattcatacacaagcagcctttggtcatcctcaatacagtatccaatcagcttaacaagatgtttgtgatgcagctgtcccagaaagtcaacttccgccacccattctctatgaccttgaagagcattttccttcagacttttgacagctacagtcagaccagtgccaggttttgcaggagctgtactgtttggctcaatccaccccttgaacacatacccaaatccaccttctccgagaatactgtctggtctgaagttaacagtggcagatttcagctcttggaaagtgaattcaagtagcttgggtgatattttcttctcaattgatgagtcaacaccattttcgtcaccaagcttcccctgaaaatgatctgcgtcgtagacatggccgcctttgaccgcggcccgtcaagtcgaggcggcgaggtcaagaac

SEQ ID NO: 22642 - DNA, 653 bp, Triticum aestivum
  Clone ID: PAT_TA_22642
tttttttttttttttttttttttatttcgaaaaagtattttatatatatatgagaggagggagtagcttttgttattatttcatggacattgattgagttaatttattaaaacacgtactacaccagatgaccagaagcaggactggcatcgggctatcttctcacctactctgcactatcaacacgtattcattttcttctttctctagtctttgtctctttcggagctcccagccatggaacggagcaaaaggctgagccagattagatccactccatctcaagacaagcccgagtctcccctcggtttgctactttgtggtcctcacctccacacgcacctcgtggctgggatgatgcttggatcccggccggtgaacacgtagcagggacctaatagcagctgcgtgatggagaacgcgaggtcgtcgaactcgacgatgcctttcccgtcagcgtccatggaggcgatggagtggatctcgttcccttagctcctgcgcaattttggggatcctgggagggttatccgtccccaaccgtcgagctgcaggcgtcgttgctgttcccaagcgaggcacctgacgcatcttcttcatcctctacagtagcagcccggctttggcgttgcattcttccacctgcaatatac

SEQ ID NO: 22643 - DNA, 2002 bp, Triticum aestivum
  Clone ID: PAT_TA_22643
ctcgtgccgaattcggcacgaggcgagctcgaggtgaagacctaggtctggcggccgcccctccccagatccccccgccgactcgccgtctcgacctctccccagatccccccgccgactcgccgtctcgacctctccccggctccccccgccgcctgttgctgagctcctagcctcccgcggtcccgctacgatccacatagataggggattggggaaccctcgcggatcgggagagaggaacgcacggggacaccgccgatcacgcgagaggaaacgcaccgggccgccgccgccgccgcctctgtctgggttcagcgatcagttctgcccatcgatacctgtcttgtaaccatgagaggcagcatcttatactcttcatttcggaggatttcccagggccacccacccaagtccagtggatttcacaggtcatctccactggctgctcagaggtttgggcggtccaaaagatggattgctacatccgatggtttacccggtgaaaagatgatgcttgtgaatgatttagtttgcccggtcaagtatttcacggaggaagttccactgcttgaacccttagacaacaatattctcttgaagaccgttggaggacccagaggaaagacactggttgcatggaaagcagggaaaaccatcagaagtctgccagagctgattgcagcatatcaattgcgtggatgtacactgggcaaccgtctccggttagagaacttaaagatttctcggtcttcagggaggtttgttcttatagacacttcagaaattggtccaactgagaagaagggaagcttcatacaggactggaacctgggtggagatgtccttgatacgattgctaggagagttctgggtgtgggtaccccttaccccaaggaccttgagaaatacatcaacaatatgcggtcagcggaacctaagctttggcgtcttctctacaattcattgtttttatccccagaagcccgctattggctaagagtctatgttaatcagatgtcccgagaagacttcaaatccctctccagaggcatgaagcataagatgcaaaagttctttggggagctaccttatcaaggaggagaggaggatgagggctcgctgaaatggctgtcaaaaaacgaggaattcatccgtgctacgctcgctgagtcaaggaaggatgctcaaaatagggttactggtcctaactatctgagcactgaggaggccaggaagagagacttgggtagatggctggtctgtgtcaaccgcgacggtttgacacatgggacgagaaccaaggcggagcacctgaaagatatcaaaagaaatatgctcactgcacaaaacatatcgcagctgctacacgtggagtttgatgagctggaccaggaatacattgatctgtgcggcgaggataatgggctgcgggagctcctcagcatcgaagggatattcttcgagaccccagagacctggaggactgccattgaagcacttgagaaggatattcaggcagtgcgggaactaaaagagaagaatttggtgctgctgacataggcatcaacagccgaagcggtggtgctccattttgtcaggtttctaggacaagtggctggaatgtcatactgctggtttgctttgtcttcgaaatgtttgggatagtaccactttgttgtcgttgtagtgctgatatttcctgctgtagctgtttgtaggctggttacctgcatgtgttcctcgagttgtctgataaccggcgcacattgtggttgctgctacttgctgcgttgtgtctttgtgtggtatcttactggagttgagatgttatctgttgcgttgtgtcttcgacctattgtaacaggaaggcgaggagcacaaagtgcggtggtgctccattttgtcaggtttctaggacactgttgtctagggtcatcatttttgtgtctatgagactgctgagttgtgcgcaacctctggtccatgtggtttgatgagt

SEQ ID NO: 22644 - DNA, 389 bp, Triticum aestivum
  Clone ID: PAT_TA_22644
agtccccagtggcggcggcggcggcggcggctgtgacgcaggaggcgggatggcgcgtcggcgcgtgatggcgtgaggcacgtgggcaggtcatgatgctgtagcgatgcgccgaactgccgaaggagccgcagttgctggatcgagtggagacggagacgcgcgagccaccggccggagtcaacgcactgagcacggtcgacggcagcaacagcaagtgatcaacgtgagtgtgatggcagaacaaagttctcgtatttcgcattcagacacctccccttacaacgcttcaaacttggagaaggacagtcatgatgggcaacagctccccgaccagcagcagaaggagacgaccgaggctgagaagaatacagaaaatgccaagaaaa

SEQ ID NO: 22645 - DNA, 659 bp, Triticum aestivum
  unsure (1)..(659): unsure at all n locations
  Clone ID: PAT_TA_22645
cgcgttgcctcgtcgccctcatcgtcgccttcgtcccgtataccaagatcgactgggacgcctacatgtctcaggtcgatgcttttcgggagggggagagggactacaccaagatcgagggcgacaccgggccgctggtctacccggccggcttcctctacgtctactccgccatcaagttcctcaccgccggccaagtgttccctgctcagattctgttcggcgtcttgtatcttgtcaacctgagccttgttttgctgctttacgtcaagactgaagtgcttccttggtgggctttaggtttgctttgcttatcaaagcgagttcactccatctttgtgctccgtcttttcaacgattgcgttgctatgacgttgctccatgctgctatggtcttgattgtctatcacaagtggtacctcggcctaattattttcagtggagctgtctcagttaagatgaacgtgctcctttttgctccatctttgtttctactaatgttgaaggccatgagtatcaaaggatttntcttgctttgttgggagctgcaggaatacangttttgttgggcatccattcntgttgtcaatcctgttgagtacatcccaagatttncaatcgtgggcgttcncatcatttcnggccgtaactttaanttg

SEQ ID NO: 22646 - DNA, 584 bp, Triticum aestivum
  unsure (1)..(584): unsure at all n locations
  Clone ID: PAT_TA_22646
ctctgacacctccaacaagttcacggtcatcggttgccaagcgctggcgtacatcatcggcgatggcggcgaccacggcgatgatggcgattacagcggcaagtacatgagcgggtgcgtggccatgtgccggggagacgatgtgaggtcgaccctgagcaacggctcctgctccgggatagggtgctgccagaccgccatccccagggggctgcagtactaccacgttggagtccgaccctgccttcaaacacgacggagattccacaacggtcagccgctgcagctacgccggtgctcatggactcctccaacttcaccttcttcgaccaacctatgtgacctcgccggcgttcaagagacaactacggcggccaggcgccgttcgtccttgattnggccaatcgggaaccacacatgcgacgtcccccaagaagccgggcccccgcccgtgcggcccaatagcagtgctcaactcgctcatggacagctaatctcaactgctcaaaggctcatggtatcttactgaaatcggacacggatcaanaatgtgatgagcccccacgttatganaangggggttn

SEQ ID NO: 22647 - DNA, 740 bp, Triticum aestivum
  Clone ID: PAT_TA_22647
tagcgtgaggtaggttacatgggcctggcgactctgatcctgccaaggataatgacaacttccgtataagaagatacatagcaaaatataccataaatcctgctatagtaagcggcttctcagattttgttggttctgtggaggcgggaaagttagctgatctagttctttggaaacctgctttctttggtgcaaaaccagaattaatcataaaaggtggtgcaattgcgtgggccaatatgggtgatccgaatgctagcattccaacacctgaacctgttatgatgcgacctatgtttggtgcatatggaaaggccgggagttctcactcgattgcatttgtgagcaaggctgccaaagaagctggtgttgcatcagagtacaaactagcaaagagggtggaagctgttgttggcgtccgccatttatcgaagctggacatgaagctcaacgacgcgcttccgaaaatcaaggtcgaccccgagacctacacggttactgctgatggagaggtcctgacttgccagccagcagccacggtgccattatctcggaactactttcttttctaggccacccattgcttgagaaattcttggaaggtcaataattcactcaactagcttcgacggtaacttcaagttgcgcatgggagatgtgctgctggctcaaaataaacaattatacatttacatgaaaaaaaatcacacgtatacatattgcaatacttcagtttcttg

SEQ ID NO: 22648 - DNA, 505 bp, Triticum aestivum
  Clone ID: PAT_TA_22648
gaggtggtggttttggagcttttggcagtaataaccaagggcccacgcgttcgctcatcattggtgggagtggcgctgcagggcctggaagacccccggcggattttttgacgcagatgagaaaatagtgcactttgtctccaggcacccccaagttccgtccagaaatgttcaaacggcttttgctcttgtatgtaaatcaaaaaccttttttgacatgctggatggcaacatttgtgggaaagctgatgttggtaaaaaaaaaaaccaatttatacctgtcccggattcaggacagccctacagcatttagtcattgttttgaaagacgagaggatttgtggcaacaacaatgttttaggtggggacaacaaattgttggggttgggtcatgaagcattcatgtaaggtgaaggtgggtttcgccaatgccagggaccttgtcagcaaaagacattttgagagagggcaaaaaagaagcccttgaccattttttcctagaaag

SEQ ID NO: 22649 - DNA, 629 bp, Triticum aestivum
  unsure (1)..(629): unsure at all n locations
  Clone ID: PAT_TA_22649
aagacactgtcgatcagcaaggtcaagcagagcgtgtcgcgttgggctgatgagatgggaatggagacgcctgatgatttgtcaatcaattgcacgaaccttggaaacacatctgacatttttagcaagatacttgaaaaattccagactcggaaaaaggcaagtggcaaattgtcaccacttcagcaactgcagcgtatgttttcacacaaagaatctgctccaaggaggatgctattgatcgttgtggatgagatggactacttgataacaagagaccgggctgtgctacatgaccttttcatgcttaccaccctccagttctcgagatgcatactgataggaattgcaaatgcaatagacctagcagatcggttccttccaaagcttgaacccttaaattgcaaggccacccgttataactttccgangcctattccaaggatcaaatatccaacataattacacagtggtggtccggtcttggggtcgtggtctttgagccagtaggcggcaggatttcgcggctcggggaagtagctcccgccgctggngatgacgagaaaaagctcttggngtttgcaggagtgccgtgggaaatatttggatccagggcctacaagattctt

SEQ ID NO: 22650 - DNA, 256 bp, Triticum aestivum
  Clone ID: PAT_TA_22650
cttctgttgatagaagagagtggggatgagatgctgcttaggatgctttatccgcactctcttctatcaacagaagtcactatgacaggttagatactacctaatcaactgactggtggggctagaagaaagagccgatgagacgctcgctaggatgctacatccgagaattattatagagtcacgcgacggtaagttactcttctcttttaaaaaaaaaaaaaaagggcggaccctctagaggacccaagcttac

SEQ ID NO: 22651 - DNA, 1245 bp, Triticum aestivum
  Clone ID: PAT_TA_22651
cccccgggcgcgccccccccgccgccgcccccggcccaggctccccgtcccccccccccccgtcgcggcccgggcccgcccgccgccacccctggcccgccccgcattcccacgcccaccacaacgccagggcgccctccacgtctgcgccgccccatggggtccccagtctaggagccccgctcgccccggacagcgctgccccgcctgtgcccgttgccatcccgggtccagcctcaacccccccctccaagccagcacctcggccgcgcaagtaccggccgcactggcagcaccggctccccccccacccgtcggccgcgagcccccccccgcggcgagcgacgtgcgccgccgccccgcggccggcgccgccgatggggccgaagccccccgcgtggggcggggggatgcgcgcgcttgcaacgcagcacccccccactgctcctcccgcccgccggcgggcaccccagcagcactccgcccgccccttgcgcgtctcggctgctccgtcgacggccccccctcggagcaccaccggccagaggcactcaagagcccgcgccctgatgccggcgtgggctcccccgccgccgccgccatccgacccggctttctggcaccacccttacatgagggggcccgcggcgtatatgccgacccatgggactccttgcatggcaatgccgatgacaccgaaatttcctgctgcacccgtgcccgtggccatgccgtgcccagtctatgcgtccccctccccggcaccagcgctggcgagcaagagccaacaagattcgcagctccagctccaagcacaaccatcaaatgagagcatagacgcggccattggtgacgttttatccaaaccgtggctgccgctgccgctggggctgaagcccccttcgttgggcagcgtcatgggcgagcttgaaaggcaaggcgtggccaatgtgccccaagcctgcgggtgagcgttggagggtgcatccgcgtgcactccatgcatgactgctgctccgttcgatggagcagctagcagcaacaacaacatcgtcgacatgtctttgttcctttgaacgttttgtggatctctctctctctctcttggtcaacttgtgcataatttcgatcaagagaaacatcgttattttgagttcactcccgagacacatttttgttacacctaaactttaagtttgcggtaacagcagcatcaacaacatcatcaaaaaaaaaaaaaaaaaa

SEQ ID NO: 22652 - DNA, 663 bp, Triticum aestivum
  unsure (1)..(663): unsure at all n locations
  Clone ID: PAT_TA_22652
ggcaggtggacgtggtcatctgcgcggtgcccacgaagcatgcgctcgagcagaagcctctgattcgggctataaaggaagctgggtgcgtgaagagatttattccggcggaatttggagttgatcacacaaaggtgcagatttgtgacatggaccatggcttctatgagaagaaagctgaaatccgccgtttaatagagagcgaggatattcctcacacgtacatctactgcaacttcctgatgccctatttgcctccttccctagtgcagccgggtctagatgcccctccaagagatgaagttacaatatttggtggaggagatactaaaggtatcttcgttgaagagggtgatgtggctaaatttacggtgtgtaccatagaggaccccagaacattaaacatgacattgtatctgagacctccgggaaatatctactcactgaatgaattgggttagcctctgggagacanaaatcaccaaatgcctaaaaaagatacatatanctgaagagcaactcgttaaaaacattcanaatgcaccgtttcctcccaaaaatggnttganatttanatattcagcttttgttaanggggaccacacgtattttggnattgnctcatnaagtgaaggaaccaactgtttcntgangtaantatnn

SEQ ID NO: 22653 - DNA, 652 bp, Triticum aestivum
  unsure (1)..(652): unsure at all n locations
  Clone ID: PAT_TA_22653
tcggcacgagctggtttcatgtggtgatatttcgttgatttcttcatatgagaaggtggagaactgtgtatacacctctacgctgctaagaaaatgtggtagatggggttctgaggtggcaaatcctaaaaataattgttccaggtggaaattgacacatgctgagaggtttgctgctgatttctacataacagatgcaaaatcaggtaaaagagccttggtgaaagctgggtaccacacgaaagttgttccattgatcgatgaaaatgttttggttacaacaagcagaagtaccgatctatcttcaaccttgaaatgttggctacaagaaagaaatctttattctgaagaagctcagcttatccgtcttgaggaaggatatatcacggaaggaatgaagttgagtgtgatcggaattttgagcaagaagaatggagatttcctgatatttcctccccgtgaacctatatctacaggttgtgtgttgctgtcatttctccttccagcttactttgatggaatagttctgagactagtagacaagagttattttatgccacattctggaatttcatgaaatattatgacaattcatgagatgtaacagctaacattttcaatccaataccttttcccctgaaaaaaaagtttn

SEQ ID NO: 22654 - DNA, 1491 bp, Triticum aestivum
  unsure (1)..(1491): unsure at all n locations
  Clone ID: PAT_TA_22654
gcaccacctcccccgaccccagccctgacccgcctcctccccagcctgactcgggggaccctcagccccttccaccccaccgcccctcatgctcctctcgggggtccccctctccgccgcgtcatcccccccggcggcacaccagcgaatctcccgtgcgccgcacaagcttcggctccggcaaccccacggtcgcctcgcggtggcgttggggcggacggcgtaaacggctcctctgatagaatgcgcattacctcgctcggtgccggtcagccacaaaaatgtcaagcaccttccgcgagctcaagtgataaggaagtaactactgtgcaaggtctatatcaggggtggccatcgttccaaagagaattgaacatcgggggttcaagtgcctagcgcaagaagaacttagttaagttgattttgaagaccccgatgatatcctagatcagggggttgtggcagcagaatgatgatttaataaagatgcggcaagccactgcaaaagtcttggcatctcaaaagcggcttgagaacaagtacacagctgctaaacaagctgatgctgactggtatcggagggctcagcttgctcttcaaaagggtgatgaggagcttgcacgtgaagccctgaaacgacgtaaatcatatgctgacaatgcaagctccttaaagacccagcttgatcagcagaggagtgttgttgaaaatcttgtttcaaataccaagcttcttgagagcaaaatagcagaggccaggcagaaaaaggataccctaaaagcccgtgctcaatcagccaaaactgcaacaaaagtgagtgaaatgttggggaatgtgaatacaagtagtgccctgtctgcatttgagaaaatggaggagaaagttatgacgatggaatcccaagctgaggcacttggtcagttaggagcagatgatctagaaggaaagttcgctatgctggagactacatcggttgatgatgatcttgcacaaatgagaaaagaactgtctgggagctctttgaaaggtgaacttcctcaaggtagaagcgctactcctcgagacagggatatcgagaagggagttaaatgagctgcgggagaaggccaacgattattagattttacaggacatgtccgtgcaccgggctggacgagatctcctcaatcagagaaccccagaagagagtatagcctgcagattagtccaatgcgcatttgacccgtcagtgcatgtttacttttgtggtaaaggtatgaaggcatcgatgcgcgaaagattctctgcatttttcctgtgaatgacattgtacagttaaccattaccccagtgtaaatcgctaatattgatagagcttagccgagagcctgaattgcccacccttttgtaccttataccatttggttggtgccataacatgtatgaaaaatttgacccagtgatccaaaacctgcccgggcggccgctcgaaatcacttagtgaattcnnnn

SEQ ID NO: 22655 - DNA, 740 bp, Triticum aestivum
  unsure (1)..(740): unsure at all n locations
  Clone ID: PAT_TA_22655
acagccaagcccacaaaagcatcacaacagcaaaacaccgactacacaagggaaatccatggcctctgccgcgctcttcgtcctcctcgccctggccaccatgcagccgcagaccgcgtcgtccgagaaggagacgcacctcaaggtgtactggcacgacgtggtgagcggaccggacccgacatcggtgccggtggcgcgcgcggccacgaccaacacctccaagtcggccttcggcgtcgtcatggtcatggacaactcactcaccgaggggccgagcctcaactcatccaggctcatgggccgcgcccagggcacctacatcgccgccggcaaggaccagctggcgctgctcatgctcatgaacttcgtctttaccgccggcaagtacaacggcagcagcgtcgccattatgggtcgcaacgccgtgtttaccgaggtccgtgagatggctgtcgtcggtggtaccggcgtgttcaggtgggcacgcgggtacgcgcaggccaggacgcataccttagacctcaagaccggcgacgccaccgtcgagtacaacatattcatcatgcactagtctcggccgttgtcaaaatttacttttgaaaacgggtttgctatttcacatctaaattattaggcggtgggatacttatctcacatctaaatctagaacagntgatattgtttgtctttaattttcgtgcaaacatgatcgtctcgcctggcgcacccgttcgctg

SEQ ID NO: 22656 - DNA, 372 bp, Triticum aestivum
  unsure (1)..(372): unsure at all n locations
  Clone ID: PAT_TA_22656
gttggtagcgtggtcgccgccctgctctccttgtctatttttcagccaggaggagggagtgtttcaaccatttttcttcttgtcattgtttcttctgtcgtcgtcgtcgtcgtcgtctaatgtccagttctattgctaatgtgttgggaagcagaccacttgccgtgtgggtttaagggcctgttttaggtgctagcaaaggtagaaaaaggaaggggaaaaaggagctggaaaagttccacctgcgtttttattccactagggtagattgacctcagtttgtacctccccgggccgccgcccgttgacgagaaaaggagaaaaaaagggaccggngatctgttcatcancaaatcccgttcgttaccgtgc

SEQ ID NO: 22657 - DNA, 941 bp, Triticum aestivum
  unsure (1)..(941): unsure at all n locations
  Clone ID: PAT_TA_22657
ccggagtaccggccggcggcgagcccgacgttcgtgccgtccaagcattccaactcgcaccgcaaggtggtggagctgcggcgccagaaggacaccccgcagcggccgccccggcaccactctccccgccccccgccgctgcagcgccccctgccccctgctccccacccgcccccccgcccgcagccccgcctggggcccgggcctggggtttccaggtgccgggccccgctgctgttcgacgggccgcgcctgggcggcggcgcggacgagttcctcatccgcaaccgcatagggcccgaccaccggcagctcatctagcctagcttagctagccagcgccgcccggctcgcctaggaggaggatcgttccgttagccccagcagcaataattcagcaagaagaagagccagccagcccagcccagctaaaacttttttcctaggagttgttgtttctccggattttaatttacctttttccagagacctgtatgcttgcttgcttgctacactctccgtgtttctcagtcagctcagctctcgagttccttagaaactaatcctagggtgcagtgctcgttttccttccttctcttcttttttcatagactttttctttgcttttccnctagatttttccttcattttcttgtaatgccaggcccacgctgccaggggtatccaaagcccctagaaatncntatgaaccaacgaagggaacacnaccaacacggaagggcaaacaggcaacggagcnagcagggggtttgccntnggacaanacacagacacaccagcacaccanaacacantacaacgancacgcanangcaggaataaaaaaccccgctcgcgaatatgagagagagaagtgacagccaccaccanacaacagnaacacagacgagcaacgagacaccgcactangcgacacgaag

SEQ ID NO: 22658 - DNA, 1125 bp, Triticum aestivum
  Clone ID: PAT_TA_22658
gccactcttccggccgtccggctagatacgagctcaaatctacgtgcgcatccacgtacatacgccatggcgctccctgggcttgctttttctaattctcaggtcgtcatgttggcagcatgcacgggtccgccggtaacagccggacgaccttcaagggcacgcttcatgtattccttgacgtcggtgaaccgtaagctcatcgtaagctcgtcctctatcaataatccctacacggcagctggcggcatgcaacaagtggcagcaggggaagacgagcatgagctaaagctcctagggacatggaggggccctttcgcgatgcgagtgaggctggcgctcaacttcaagggcctaagctacgagtaccaggaagaggaccttgcaaataagagcgaccttctcctcgcgtcaaacccggtgaacaagaaggtgcccgtgctcatccacaatggtatgcctatctgcgagtcgcttgctatcttggagtacatcgatgaggtctaccatgggataggaccctccctcctccccgccgacccctaccaacgtgctagggctcgattctgggccatctacattgacgacaagctagtcgcgccatggtggaagatgtttgtgggcaagacagataaggagaaagatgaagggacaatgcaaacgctagcggcggtggatatgctagagggggccttgagggaatgctccaaggggaagccgttctttggaggagacaacgtcggatatgttgatgttgtgttgggtggtatggttgcatggatgcaaggaaccgaggcgctttgtggtgtggagcttctacataccaccaagactccgcttctattggcatggatggagcgctttggcgaaatggaacccgccaaggtggttctgccaaaagtcgataggctggttgagtttgcaaagatgaaacgtgcccaaagggctctaatctaagatgtctcagtagtccgagaatagctaaggatcttgataggagtgcaatgcaaagaaggagtcgcgacaccgaatactattgttctttctctcacaggtctgttgtgacaacgtagagtgttattgttcagacaacctagtactttgaagttcaatcatcttcatgtt

SEQ ID NO: 22659 - DNA, 676 bp, Triticum aestivum
  Clone ID: PAT_TA_22659
tttttttttagactatgtatttggtcatttcagtatatgaaaaaaaagaatacacatggattaaaatcgacgtgtagcaacgggcagtgtttgctagtataagcaaatttgaactttaggttggttccgacatccaacccacccaatacatacaggctcatcatgcatgctagaccgctagtacggaaggattccccagggccttccgtagttgatgacgtcgtcatatatctcgtccaatgccttgtacctgaactcgaacccttcgccgacgagcttcgccgacggaaatgcagactctcagcttctccgggcgacccaccgaacctgttgacattgacgttgtactgcgggtacttggcggccaggaaggtggctagctccgtgagggtggtgtcaaggcagctgcagatatatcttcctgacgcggcctcctcctcggctacgaagatatttgcgcggcagaggtcgtggacatggaccatcgggatagcgctggactcctccgcggtgtctgctgggtcgcgccccctctcgccctcaccaggcagcggacctgggtcgaggcgcccgctgctcccgacgatcttcgctggcgcctcgccaaccgtgacagcggggcacaccgtaactaggctgatgccgcagtcctgcgcgaaagtccacgccgcctttt

SEQ ID NO: 22660 - DNA, 365 bp, Triticum aestivum
  unsure (1)..(365): unsure at all n locations
  Clone ID: PAT_TA_22660
ccgggccgacattactaaactcgcccagcattataaggtcaagctgggagacaactgatgagttctcggcgtacaagcacctccctcggagactacggtcggtcaccagtgcaagcagatccttgttctgccgagggcatcccagtcgtagatgtgatggtgcgatagtaatcatccattggctagtcatcgagcgtcgatttgttaggtgcagccgcgctctagttgtggccagctgcaaagcagcagttccttagtgtaacaactgtgatccgatccgttgatggtacgcttggtgtgataacaatctttgtatgacttccaagcttagcatgtcggcaagatgatccatancnnnannnngg

SEQ ID NO: 22661 - DNA, 1193 bp, Triticum aestivum
  Clone ID: PAT_TA_22661
ctcccgtgcgcctcagccccgccggccgccgccgccccgccgccccgcgccccggccctcgctccctctccccgccccgccgccgcttccccaggcgtcggcgccgccgccgccgccgcccccggccctcctcctcgtcgcctgggcgccgtgctgctgccgactcaaccccgtctgcccacgcccattgggtttgaggagctcctctatctggctacatccgacgaacaagctgccgataagtaacacgacaacaaggacgaacaacaggatcccaacctcgacgggcaggcttagaggaagatcgacgttttcgagccctgcatcctgagcacgacatacatcgatcacctctcccccctggacaccgcccaggtcatcaaggcgtctctcgcccagtgcgccaacgtcgtcagcacggtagttcattcagaactacacgatccagtacgagatccccgccgctgcgttggtggaggtggacaacgtgtcgcaggcccaagctgctgtggacctgatgaacaacttccctttcatgttcggcgggatgcccaggcctgtgagggccgtctttgcaaagcccgagatgtttccggaccgccctaggaagcctggcttgaaggttgagttcagctgggttaagcaaggagatcccgcgtatgatgggatgaataagctcaagggccttatcaggaggcaagaagcagaaaatatggcactcatcaagaatcaattggaagaggagaaggagctggcggcgcagcagcaggaaaccctggaagcaagcaccaccaagtacgtcacgctcctcgccctcctgtacaacggggaaatcactaaactcgctcagcattataaggtcaagctgggagaagactgataggttcctgacgttcaagctcctccctcgtagactgactgcagtcaccagtgcaagcagattcttgttctgcccagggcatccccactcacagatgtgatggtgtgatagtgataatccattggctagttctcatcttgtggtgtgatgatggtaataaagcattgatttgtttggtgccgccatgccctagttgtggccagctgcaaagcagcagttccttagtgtaacaacagtcgatacattacgaccgtttgatggtacgcttggtgtattaataatctttgtatgacctccaaaataaatacaaata

SEQ ID NO: 22662 - DNA, 561 bp, Triticum aestivum
  unsure (1)..(561): unsure at all n locations
  Clone ID: PAT_TA_22662
ctcgcttgtcttggtcctgtccatttcgtggcctgctcccccacttttcggggtctcctcccccacgattggggcttccatctgtgcagactggtgcttccatgtttgccgtcgcgcggagtcgggtcctgctgcgcgcggcgccggtgccggttgcgcgcctcgcggtggggaggcatctggggttctagtcttcggttcggttggctttttggtgctccctcgctccttgatgtggtgtccatcccggatctcccttttgtctgtctctcagcgtctgcttcgcgttttcgtgatctccgttcgcatgccgtatctgtactcccacctggggtctggcttctgctttcctgtggtcccggcccgcttggtagcgcgtctgggggggtcgcggccgcacggggttccggttctggtacggccgccctaatcgagcgcccgccggccttcatgtggggtacgtgccgtcactcccttctcgccgtgctccaacgggcctggcggttgtccctctgcacatagtgtcataatgtcaaagcccttgtaantatcaatcattgt

SEQ ID NO: 22663 - DNA, 508 bp, Triticum aestivum
  Clone ID: PAT_TA_22663
agaacctggtctccagcagccagctcgccaaacttggctacaccatcaccctcggcccttcggagtgccgcgtcaccaagaacgatcagagccagacccttgtggggatggctcatttcaccgatgattacctgttcgagctggacttcctcagggttccttcctccaccgcctgatggtgcccctgcctgcccatctatcgactgtgtggtcgtcactgcctacatcatagaggttggagagtaatgatgaatatatgcatacatgccgcagtcttgttgtaataattacatacaaggtggatgattatgtcgtgagattggagtgtttttagatagttactgtgactttcagtactctacattcattatacccagaacatgccaatcgtcctccccctatgttgaatccatgaatggcatgttttgttacatgttcagtctgtactgcaagaggctgtgtgtactggtcaaaaaaaaaaaaaaaaaaactcgctcgtgccgaattc

SEQ ID NO: 22664 - DNA, 588 bp, Triticum aestivum
  Clone ID: PAT_TA_22664
cggatttgtggccaatgtggtaagaacttcaatttggcctgcattgatgtcaaggccgaaaatgggctaccaccgatctacatgtcaccattgttaccccccaataactgcatgtcgaagcttcttactcgagacgacgacaccgaagaggttgttagaaaccgcctacggatctacaatgaaatgagtcaacctgtggaggatttctaccagaagcaggggaaggttctcgagttcgatttacctggaggaatccctgaatcttggccaaagctgctcgatgttctgaatctcgaggaccagcaggagatgaagttggccgcggcgtaagtcctgcccgtgggacataccttacatagtccaaagcataccatacattttttcaataatggaaaagggataaaaaactcttgtttccatagatatgtgtgcctttgtgagcgtaattttttgaccactagcgagctgtttattcccgccggcgttttcgcgagccggtgctatgtaacgatcataacgatattttgatcttgacttttttgagttaggggtttgtggtgcgtaaggaccccatgtaatgttgattcc

SEQ ID NO: 22665 - DNA, 1391 bp, Triticum aestivum
  unsure (1)..(1391): unsure at all n locations
  Clone ID: PAT_TA_22665
gctcgtgcccccctccctcgcctcggcccggcttcgtgctcgcgacgacgacaccgacgagccgccgcgacatcgcttcgcgcgtctccgacaaaatcacgcacccggcggaggatggccaccagacgcaggggaagttctcctaaaaccccgcgcctccgtccccgccacgcgcctgcctcaccatggcggccgtacagcgcctgctccgctcctcggccgtcgccgcggcgggcaggaggcgcatggcgacgtcgctggcgcccgggcaggcgcccgcggcggcgccggccttcccgttcgcgggggcggagaggaggcgccggccggcgcacgagaggaacgtgcagtgggtcttcctgggctgccccggcgtcggcaagggcacctacgccagccgcctctcccgcctcctcggcgtgccccacatcgccaccggcgacctcgtccgcgacgagctcgcctccaccggcccggacgccgtgcagcttaaggaaattgttaatcaaggaaagctggtttctgatgaaattatcatcaatctcttatctaaacggcttaagaaaggagaagagaaaggcgaatcagggtttattcttgacggttttccacgcactgtaaaccaagcggaaattcttgatggagttacagacattgatatggtggttaatctgaagttgagagaagatatcatagtacagaagtgccttggtagacggatttgtggccaatgtggtaagaacttcaatttggcctgcattgatgtcaaggctgaaaatgggctaccaccgatctacatgtcaccattgttaccccccaataactgcatgtcgaagcttcttactcagagacgacgacaccgaagaggttgttaagaaaacgcctacggatctacaataaaatggtttccccggggggaaccctgactcttcgccgaagctggcgcgaggttctgagtctcgaggaccagcaggagatgaagttggccgcggcgtaagtcctgcccgtggggacataccttacatagtccaaagcataccatacatttttccaataatggaaaagggataaaaaactcttgtttccatagatatgtgtgcctttgctgagcgtaattttttgggaccactagcgagctgtttattccccgcccggcgttttcgcgagccggtgctatgtaacgatcactaacgatattttgatcttgacttttttgagtgacccggtttggggtgcgttaaggacaccattgtaatgttgattccaagatgaagaggggttggaccgcccaactcacatgtaaacaatcccggaccgcatgccaaaacacgggccggcccggcacccaatcngcccttttgccatccctattccccgccctcgggnttnnt

SEQ ID NO: 22666 - DNA, 1236 bp, Triticum aestivum
  unsure (1)..(1236): unsure at all n locations
  Clone ID: PAT_TA_22666
cccgccgaacagcatcctctgcaacacgctgctcagcatgtgcgccgacgtggggctcgtggccgaggccgagcagctcttcgaggagatgaagaacccggacctcaccgacgtcccccagccggacaagtggagctacacggccatgatcaacatctacgggagcatcaaggacgccgaccgcgcgctccagctgtttgtggaaatgctccagagcggcatagaggccaacatcatgagctacaccatcgtgatccagtgcctcggcaaggcgaacaggatacgggacgccgtggaggtgcttgaggcggggttggagaggggcctcaagcccgatgaccggctatgcgggtgcctgctctccgtcgtcgcgctaagcaccggtgaggagacggagctggtgctcggctgccttgagaagttcaatggaaacctggtcaagctgatcaggatgctcggggatgaccaggtgggcaccgacgagctcaaggaccagctcaaggccgtgctgaacgccgcggagaccgaggtgcgccggccctactgcaactgcctgattgacatatgccagaaccacggcctgcctgcccggaggccgagggagctcttccggctcgcccagggctacggcctctactccaagctccacatcaggaaggacgacgaagtggctgctggacctgcggtcgctctcggtcggcgcggccaagacggcgtttgatgactggatggcggccctctcggagcgcgtgatgcagggccagcccctgccgcagtccttcaacgtgttcaccgggtccagcacccacaagttcgcgcaggggctggccagcgccttcgccgcccacctcgaggaggccgcggtgccgttccgccgcagcgagtcccaggtcggcagcttcgtcagctccagggttgagctagtgccgtggctgcagacaagcagttcatcgtctcgggtcgtcgcgggatgattgatagctgaacattgccgagatgggttttgatgctgaatgctcccagtcccatggattggcgaaggatgactgaactgggggtgttgtctactaggctcatcatccagtcagtgcagtgcatgcattagttattaggaagtcaagtatgatctctgatctcttcttcataaggagtatgcaatgtagttcctccatacagagagagatactgtccagaaacgattgacctggttcatcgtacctactnagttatgtaggg

SEQ ID NO: 22667 - DNA, 1248 bp, Triticum aestivum
  Clone ID: PAT_TA_22667
ctcgtgccgccttcggcacgagaatatatccccaattcgccgcacatcgaacaccccgcctacccggcgcgaaacccccttccccacccccaccgcgaccgccggtgagagaaggcgtcggcggcgacggatacagaccccgtcccaaccgaaatccccaattccccaccccgagagcgtcggcgagagagatggcgtcggcgacggagatgcagccgctggcaccgtcgggctaccgccgggcgccggagatgaaggagaaggtggaggcgtcgtcgatcgacctggaggcggggaacggggagacgctctacccggggatctcgcgcggggagaacgccctccgctggggcttcatccgcaaggtctacggcatcctctgcgcgcagctggtcctcaccaccgtcgtctccgccatcaccgtcttccaccccaccctcaacgccacgctctccaactcgcccgtcctcgcgctcgtgctcgctgtcctccccttcatcctgatgatcccattgtacatctatcagcacagacaccctcacaatcttgctatcttgggtttgttcactctgtgcttgagcttcagcattggtgtggcttgtgcaaacactgaaggaactattgtgcttcaagcattggtactgacctcagctgtggttgtctctctgactgcatacacattctgggccgcaaagaagggcaaggaatttagttaccttggaccatttctgttttctgctctcaccatccttgaacgtgataagctttacccagatcttcttcccattcggacctgcatcgaatgctgtttattcggcgggtttggagctcttcctcttctcaggctatcatcgctctacgacactgagaacttgataaagcgccacacttacgacgagtacatctgggcgtctgttgagctttacctcgaatatcctcaacctcttcctgaccatcctacagatgctcaggcagaatgacaactgatgggtcctgtctgaaccaccaggaccttgtgccaacccaggcatatgtccaacatttatcaagtcttttgaattgctatctacataactcggaagacatggtagtgagtttttgccatcatccagagatgaggccaaagtacaaccatatgtataggtgttctactgtgagtttatgtgcctgagtgttgttaaactgccaacaatcagtgatcgtatgaacgttttgtaccaataattgtcgcgtcgtttcgttcgtgcg

SEQ ID NO: 22668 - DNA, 1244 bp, Triticum aestivum
  Clone ID: PAT_TA_22668
gcacgaggagggaagggggagaagaggagtccggaggaagcaacacccaagagcgagagaggttttgcttcgctttcgcccctgctcgagccgtcctctgctcgcgcggcagccgggcgagcgcggtccggcccgatccccgcccgatcgccgcggcgggaggagcattcggggagctgctcgatgatggagtcgtacgccgcgtcccccaaggacggcggcgccgagggcggcctgcgccgacgctgccactggcctggaagagtcgatgtggaggctggggctggccggcggagaggaggccgccggggaggggctgccggagcgcccgggcgaggccaactgcgtctactacctccgcacgggggcctgcggctacggggagacctgccgctacaaccaccctcgcgatcgcgccgccgcgtttgatggagggacaaggaccgcacgcacagtggagtacccagaacgcccaggtcagccaccgtgtgagtactacatgaagaatgggacttgtaagtttggctctaattgcaagtataatcatcccagagaaggcggttctgtacaaccagttgtcttaaattcctgtggttaccctctgcgtctgggtgagaaagagtgttcctactatatcaaaactggccattgcaaatttggatcaacatgtaaatttcatcacccagaagggccagaacatggtgttgtttcagagacaccaaacatgtatccaccagtgcaacaactgcctgtctcttcccctcttccatatccacctctagccagttggcaattggggaggccttctgttctgccacgatcatttttcccgggctcttatcctccaatgatgcacccatctgcagtcatgccaatgcagggatggaacccttacatgccacctatcaaccaagtcgcgtcagctgggggacagcaaactgttcaggcaggatcattgtatggcttatcacaccaaggacctccatctgcagttgcttatggcagtaattatgcatcgttgtcttcttcagcatggccttcaattgacaaacaagaagttgtctttccagagcgccctgggcagcctgaatgccaccactacatgaagacagggacctgtaaatttggatccacatgtaaatacaatcatcctcagtacctgagtacacctaggtccaactatatgctgagccctctaggtcttccaattcgtccgggtgcccagccatgtctttactactcac

SEQ ID NO: 22669 - DNA, 638 bp, Triticum aestivum
  unsure (1)..(638): unsure at all n locations
  Clone ID: PAT_TA_22669
cccaaccatcagatcaagaagctttgggagagaagctccggccgtgagcgacaatgccgctctgcagcttctacgcctccacgtccctcccggtggccaagccccactccctgccctcctccgccaagctcccctccaccgccgccgcggcgatcaccaccgtgcagccaaagaagtcgccggcggccgtggctgcggccgcggcggcgaccgtcctgccgacgacggccgagaacacagcgtccatgacgccggcggaggcgctgtcgctgcacctgccggagctgccgtcggcgattgcgggacaagatcctggagcctggagctgatgggggtggactacgggcgcgcgctgtcgctgaacccggcgctccgggacgcggcgccggagtccatccacgcggtggtcaccttcctggacgccgcggcgccatgcgcccgctgggcccncttcggaantgccgtccgtccaacgcaagtccggncnactcgccctcttgcttctcaacgacactcgggtgcgaaggcgctacgcgctggtntaattgcccggngtccctnaagtcgcaacanctcgcgggctantactcgcgctcggtttcgaaacnncgctggttcaagaccaactcctttcaang

SEQ ID NO: 22670 - DNA, 596 bp, Triticum aestivum
  unsure (1)..(596): unsure at all n locations
  Clone ID: PAT_TA_22670
taggaagaagagataggatatctgcttgtgttgttccgagcaatacggctacactttcacacttgaagtttcatacaacttttttaagactttacactcagacaagtgcaacgtggtccactagcaaatttgaagaaatctacggtgtcatcctaacataacttgtcacctgattgcagccacaggaacgcgagtaagttctggcgatcgtgtatatcatactggctgacacactgtacctcgcccgcgccctcgctctagctaggattcacaatttcacgtactctacgtcttatgtatcgggccgcgccgcactggtcactgggtgcgagacgacgaaccgcgcgccgatgatatccatcacttgccgttggtcggcggcgccacctgcccagcgtcccgtcctcaacttgccggcgcgggcctccgcggcgatcgccttggctcgtctangagctcaggcgacttgacaccttacatggaagtcaaacttacgtagcctggaatgaatacatacgcatctgatacacatcgcaactattacatggtgatcaacggatcgcaacggcatgaactgtgatgncnaagaaaaggaa

SEQ ID NO: 22671 - DNA, 1433 bp, Triticum aestivum
  unsure (1)..(1433): unsure at all n locations
  Clone ID: PAT_TA_22671
gtcccggagagcttgtgacccgtgggggcgcgtgtatgtgatgtggatggttggtgtgtattctcggcctgggcctgtgggggtgactttgccggcttgcccgttccaaactgcgtagtgggctgggtgggctggggcgggagcttcaggcctctcaaggcccttgaagcggcaggcaccaccattaggctggctccacagaatcagcgtttaccgccggcgtcctcccgtgctgcgtacaacaggccccggttcaccactcgatccactcagggcctacacccccgtcctacccagaaaaaactggccacttccctgaaagatttgggagtcaataatggtaacctgatcaggggtgcacacatgtcaaccatgggtactggtacttctggtaactcttttgcaaacatttcaaatggtgcaccattggctcctacaaatagggcagttcagtctcttgaatcaaacaacaggcaacaccttggtcggataaattcgtcttcgacagactcatttagctcattcgctagtgattctccccactttccagatcttggaagaagtagtaacacctggcaaactgcagttccgtccaacattcagcaacttggtcagaacggcagcatgtcccaagcaagcttgcatgggaatggccctaggatggaacctgtctctagctatacaccaccatcaaatcagattacatctctgggaaatgatatgcagaaccaagtagcaccactagctagcaatacccttccaatggtattcaatcagggtgcagcgccattcacctttggaaacagcacaaactcgagagaggcgctcaatagcaaccttgcgttcagcaactcaggcatcaacacttcattgccaaaccttcgcattgacaattcggttgtgccaaggcagactctggatggcgggaatacaggcggtgttccctctctgcaggatggcaagattgatcagcaagctgttggtaatcagctcaattacaacaacaatgatctcgtggggacaagtgggctgcaaagggagctcagtggtggtctggatgacattgttgttgacatgttcaggccggataatgataatggtggcattttcatcgacacggactgggggctggtctagccagtcgtctcctttcaccaagtcccatgcgcaagattttccgcatttgtgtggtgtctgctgctgatttgtccatcatgcaattgcctgctcaaagttgttcatagtagcaagccttcatcacaaatgccttttgcatttggttttctcagtttagcgttcatgttcccgtgttagtcgtccagtattcagagttatattgggtaacaactatgtgctgtttgggtccgtgactcgtataactatcttaattcaggtataccctgttatcgtaagatatagtatgnctngtatgc

SEQ ID NO: 22672 - DNA, 669 bp, Triticum aestivum
  Clone ID: PAT_TA_22672
tggagacagatgcatcctccatctctgtgcgtggtgctgatgctcctggtaaggatgtagcagcctgtaacagtgtagcaaaggcgtctagtctgcaaagtgcagatcgctgcactgtaaatgatgctgtttctgctaatgtttctggcgcttccgaatccaacggctcaactcaggtcatcgaaggaaaatatggctcggcagattcccagaaactcacccagaaccccaatggagaggatggcacaagagcaacacttgtagtccagaagagccggactggcagcctgattgatggattgacacaaaaatggggttccttcttcaagaacaatgactgaggcaagcaagatatacagtgacatgccgttgacgctacacgtttgcgtgttaatatagcccataggttgccgctggcttgcttggttagcctgtaaaatggaaaaagtaaaggcaatattgtgcatgacccgttttagtgtgttggtggtgtatatatagaactagaaaaaggtaggatcccattgattgtatatcatgtctcaacacttagcgttgtgaattggtaggtgcgtgtttgctgggaaaataaaaatatgctgttaatgtaatgcagggaaatcacgttatttgttatttgttgcatttgtgaaaaaggaataaaaaaaa

SEQ ID NO: 22673 - DNA, 400 bp, Triticum aestivum
  Clone ID: PAT_TA_22673
ctgggcaggatcgtcaccatgctcgccccctgctccgcgcggccgggagaacaagctgttcgatctcaagaacgtgctggaggactggaagacctataagaagcgcgtcgccgccgggaacacggactacttctcgtggagggtgcccgggaggtgcatacactgattgattaggggttgcaaaacacacaaattgcaaacggtgctctcttgttactttttcttgtaggatgtatgtagagtttcaaagttttttgtaagatagagagaagctgagatcgtgtcaaggctttgggttttctgttacggaaatgttaacgcccgcacgtttgcatctaaaaaaaaaaaaaaaaaaaactcgaaacctcggccgcgaccacgctaatcgcgtagtctattc

SEQ ID NO: 22674 - DNA, 877 bp, Triticum aestivum
  unsure (1)..(877): unsure at all n locations
  Clone ID: PAT_TA_22674
gactggctacggaaagacttggctttgcagcaaattttaagatatccttctatcctggcaagttctcaaaagagcgacgaagcattattcctgcaggggatacctcagaattcattccctcaagagaagctgatatagcaattctggaagaaccagagcatctcaattggtatcatcatgggaagcgttggacagacaagttcaatcatgtcattggtgtagttcatacaaattatctagagtatatcaaaagggagaaaaatggtgctcttcaagctttccttgttaaacatatcaacaattgggtgactagggcatactgccacaaggttttacgtctttctgcagcaactcaagatctacccaggtccatcatttgcaacgttcatggtgtaaatccaaagttcctcaatattggcgaaaaagtaatagcggacagggagcgtggacataactctttttccaagggagcgtattttcttgggaagatggtttgggctaaaggctataaagaactgattgatttgttatacaaacacaaaaatgacttggagggcttcaagttagatgtttatggaaatggcgaggattcacaggctgtccaggctgctgctaggaaattggatttgggcatcaatttctacaaggggaaggaccatgccgatgattcactccatgggtacaaggttttcatcaatcccagtgttagtgatgtactgtgcacagcaactgctgaggctcttgcaatggggaaatttgttatctgtcccgatcatccatcaaatgaatttttcaagtcatttcccaactgcttgatgtataaaactccagnnnaatttgttgcccgagtgannnnnnnnatgtctagtgaacctnn

SEQ ID NO: 22675 - DNA, 979 bp, Triticum aestivum
  Clone ID: PAT_TA_22675
gaattcggcatctggtcagcatttgctgctccacaaaggaattgctacccaaccattagcaattcaaaaatccaattatctggagatttcaaaaaatggagggaagaatttgcacctcccacttcagcatttctaattcctaacccgccaaagccaatgctgctcatgctccgcagatcgaggaggctctcctacatctcccctgctgcctcttctgctgctgctccgaaccccagctacagacggaggaagggcacgtcgcccccgccgccgtcgactgccgccaccgccaccgccctcacctcgccgcccaagccggtcgcagcaagcaaggacgacgggaagaggacctaggacgaacagcgtcgaacaaacaaaagcaactggtacatcgaaggtggactacccggcgaacgaacgagcagggcaaccgatgcgcctctggtcgtccaggcctcgccgccggcctactggttcgcttcaggcggcgttctgcaacgcgctggaagaggcgatcaacaccctcgtcgacccgccggtgctgcggccgtcggtggacccgcggcacgtgctgtccgccaacttcgcgcccgtggacgagctgccgcccacgccctgccccgtggtgcgcggcgtcatcccgcgctgcctcgccggcggcgcctacatccgcaacgggcccaacccgcagcatctcccgcgcgggccgcaccacctcttcgacggcgacggcatgctgcactctctgctcctcccgacggcgcccgactccgaccccgtcctctgctcccgctacgtgcagacgtacaagtacatcgtggagcgcaacgcgggcgagccggtcttgcccaacgtcttctccggcttccacggcctggccgggatggcgcgcggcgccgtcacggcggccagggtgctgacaggccagatgaacccgatggagggcgtggggctcgccaacaccagcctcgccgtcttc

SEQ ID NO: 22676 - DNA, 645 bp, Triticum aestivum
  unsure (1)..(645): unsure at all n locations
  Clone ID: PAT_TA_22676
gttcagctccgtgcgcttcgacaacggctacttccggaacctgctgagccgcttcggcctcctccactcggaccaggagctcttcaacggcgggcccgtggactccatcgcgcagcagtacgccggcaacggcggagccttctcggccgacttcgtcaccgccatgatcaagatgggcaacatcagcccgctcaccggatccaacggcgagatccgcaacaactgccggaagcccaactaaaggtgcaccaacgaacgaactccccgagattcgtggggttcgctcggcactgccagctagtaccattaggccgccggacggtgttgctttttttctgggtgggggagagggtggagtcttgatggaaaaggaaggaagggaaggcaacgacatgatttggtggagtggccctgtcacgtgacgggaggaacgtacgggaccggngctcctgcatgtcntttttctcgtcaagttttgantgctcaccacgggggccgtgcgtgtcgccggcggcgacacgtcggggcggcgggcttgcgttgccggcgctcgtgctctccttatctgttacactccaggtattccggttggctgttggccccagctggtgcagacgtggttccaacgccttgtgttttcacgga

SEQ ID NO: 22677 - DNA, 380 bp, Triticum aestivum
  Clone ID: PAT_TA_22677
cttcaaagggagggattttcagtttctgccgtttggagctgggcgaaggatatgtcccgggataaattttgggatggcgtctgtggagatcatgctcgccaaccttggatttccttagtgattagcgtggtcgcggccgaggtggcaagaggacctggatatgactggtgtgtttggcattacgatgcgtcggaaggagaagttatttcttgtcccgagaacgagatgttaatcatgcataatatctgtcatgaattatgtgcacttgtaaagctagatattgcactagtatatatggttttcccaaaaaaaaaaaaaaaaaaaaaaaaaaaaaaaaaaaaaaaaaaaaaaaaaaaacctcgagccacctgcccgggcgg

SEQ ID NO: 22678 - DNA, 845 bp, Triticum aestivum
  unsure (1)..(845): unsure at all n locations
  Clone ID: PAT_TA_22678
ccggcggctggagcggcggcgggcgcgcgcggacgagctcgccgtcgccaggcggagggccgccgagggcgtggaacggcgcaaggagcagatgcaggcgcagatcgagcgggtgctgccgctctccagggccctcgccgccgcgcaccgccaagtgcaggaagccaaagagttgaaatccgcggagaaggcgcggcttggggatctgcagaggctgctcaggacgaggcagcagtccatggtagcccaggtcgccgccctgtaccctgtcagggtcttccgagacctgccggctgcagagaaccaccattcccgtaccaatggagagtgccgaacaccttcggaagagaatggggcacttccgcaagaaatgaatggaaatggaacacatttgctcagcgttatcaaatctccgcatgttggccccttgacattttttggttggcaaattggaaagcccaggacaaagcagccgacttacagccacaaggagcttcagaggtcagcagctgtgcttggatatgcagcgcatccgtgccttctgccgcgggtcctgccgttccccgccgcgtccccttccccgtcgcagggccaccagcttatccccttttcttggaattccaagatgattcaacaaaggcatcctacgccatttacttgttcaaaaggatacggagcagctcttgaactacatcggagcagagattctggaagaatgcatcgtaatctgcgggagctataggatatacagtcantgagtattgtcatatgataatccgtgtacatatttggtngcacatcgtnatatataatggtagatnaggttagtagtatcttctgttctt

SEQ ID NO: 22679 - DNA, 539 bp, Triticum aestivum
  Clone ID: PAT_TA_22679
agcagatcaagagagagatatccataatgaagctcgtgaggcatcccaatgtggtcagattacatgaggttttggcgagccgaaagaagatatttataatcttggagttcatcactggtggtgaactatttgacaaaattattcgtcatgggagactcagtgaagcggatgcacgtaaatactttcagcagcttattgatggtgttgatttttgccacagcaaaggagtctaccatcgagatctaaagcctgaaaatcttctccttgattcccaaggaaatcttaaaatttcagactttggactcagtgcatggcctgcacagggagctgcccttctacgtactacctgtggaaccccaaactatgttgccccagaggttcttagtcataaaggatatgatggagcacttgctgatacatggtcatgtggagttattctatatgtcctgttggcaggttatcttcccttcgatgaagtagatttgactaccctttatgggaagattgagagcgcagaatattcattcccagctgtgttt

SEQ ID NO: 22680 - DNA, 722 bp, Triticum aestivum
  Clone ID: PAT_TA_22680
ggggcgcgcatttatccccatctgatgcagcttcaatcatagaagcagcacagtcgaaagatgccatccacatcaggcctggggaaagccttccaaatcagctgaaaccattagcccccaggccactctcctcactagcaccagccatcgcgcccagttcggcgcagcatctgcagcagcctggacaaagcagcttcggcgactctaccgcagccaaggaagcaattttcggctccacagatggcagtgatggcgacgagtacgaagacgaagacactgacgacgacgacgacgaggggctaaccggcgatgaaggggagcaagagtgatcttccagctgttgatcgagccgtctctccagtcactaacctctcccaaggcttccccccagcccctgctgatatattgacaacatttttcaccaatggaaatggagtctcatcatagagcaatagctgtatacatacatgtttatagcctgtatctaatgtcccagcagccagccatcacccccccatgagcctaggagccttctttttctttcttattaatctagagatcccttttttgtttaacctaatcggacatgaagcttcctcaagcttgtttttcattggctcttgctaaggtttggtcaagttgtcagctccaacatgtggtagctatgaacttatgatgatgtatgtagtaccgcggccctgactacgctttcttattcttgc

SEQ ID NO: 22681 - DNA, 634 bp, Triticum aestivum
  unsure (1)..(634): unsure at all n locations
  Clone ID: PAT_TA_22681
tggtaccggccccccnttcgtgctcgcgcgccgtcttccgtgtgcccctcccctggccctaggtacggccaatggctgcaccgcccttaagatgtagccatctgtgcggtgctggtggtcatcctcatgtcttgccgcggggcagccggcgatggcctacgtcgacgggaaaccgctagcttgccctagtgcggagacgccatgccgcgcagcatgcgtacctgcgtgcaatgcctttgcggagaagatgtgcgtcgtgctttgcatcctcactccagggttgggccagacgtgcgtgaatcagttgttcaccccttgccaggtcgcctgcaagaacttgtgcgagccccctccagtttagactccctgaccagacccccagcagacattgccggcaacatgcatgggtgttacttcggagcttatttaccaccgtgtaatccactctttaatgttcttcttttcctttcacaataatttctgtcacacatcactggtcgtctatccttgcatggatcgacagtggtggtgtattgtgtcatgttacaatatgtttttactgctccttcacgctgtaacaagctacatgtattgtttgtattgttcttgttaaactgaggcaacatcagaaaan

SEQ ID NO: 22682 - DNA, 501 bp, Triticum aestivum
  unsure (1)..(501): unsure at all n locations
  Clone ID: PAT_TA_22682
ctcgttcgccttcaacacctactaccagtcgcagggcaaggccggcggctcctgctacttccagggcgccggcatggtcaccaccaccgatcccagtcatgatagctgcatctttgttggaagtaaactgtatagcaacgtcaccaaatctgacggtgcaaacacaaccacgacgcagacaagtgatgctgaaggatgtgcggtatggagactgagaacaggaagggagaaaggtttcttgtcggccccccgtttgctgttgagcccgaatggtggtggttatcaatgacgaattcaaacttttgggacataacaggaacgtgttaattgaagagaattagaatttggggattgacatattaaangtgggggcagtggttgtatgcttagtgatcctttattgtttgataagcctccataaattaatcctttttttcccctccagagcctggatacccggaatttcaaacatcccaagactcccgggatgtgaagtgacaa

SEQ ID NO: 22683 - DNA, 818 bp, Triticum aestivum
  Clone ID: PAT_TA_22683
gtccagaatgtgaggaccatgttaatggaataattgccaagatatgcacattgttggaggagtacactcttgagagtgatgatgatcatggacaaccatcttcctcattctcttctctggaagctccaacccttatgtcactcttcaatgcacgtggtgctcaaaagaggacaacatcttttaggatgaaatctgaactagaccgttacttggaagatgagctagttccattgtccaatgataagttcagtgtgttagattggtggaaagtttctggaacacgctatccaactttgaggctgctagcacgtgatgtttttgcaactccggtcagcacggttgcctcagaatcaacattcagcacaagtggtagagttctaagtgacaaccgtagtcgtcttacccctgaaatcttaggggccctcctgccttctccagcgtccgcaagaagctgatgtctagatgctgacaatgaagacggacaaagattttggagttgtcttcaagacattcaagagggaatgcgggacttggcactctgagttggcatgctttgaagattgtcttttggaggcttggaaatgggcgacgcgcccgcgtgatgaccacattaatttgatccgtgaactacaaaatctattttagaatttatgtattggacaatttcgtatcatttgtgctcgtgatgtgtgaaccatgatttctatttcaatacttctataattggacatcttgttgaacaatgtatgcccaaaatatgctcctgtttgttgctgaaatatctcacctcgttgttgaaatgggctataattgtgctg

SEQ ID NO: 22684 - DNA, 583 bp, Triticum aestivum
  unsure (1)..(583): unsure at all n locations
  Clone ID: PAT_TA_22684
caaagtctcacatgctgtccatctctcattcaacgggaaagactgcagatcctgactctagcatttctgagcccttactgaaagaagcagtagaaatcacacagcctgaagaaaatgggctgaagattgactgcatccatgaatcatatttcgcagcaaatccagaacacgacctttcagccgtatctgtcgacacttctgaagaacgggtcgtactagttaacaatgatgatgatgtcggtgtcgagtctgctgctgggtcagcagtatctgcatcacaaggggatgtttgaaagcaaagcaacattgggacaccgagcaagcgtccttggacagcaaaggnaagaatgtcccanagacctgaagggcggccgttaaaggaaaaaccagaaaggaatcaccgtctgcccctgcgctgcgccaanttttccctcccggggagaatttcctaggcgcccccctcaccgtcccggccccgcgcccaacagcacggcccgcctcagtggaggcgtcacgcatgtgattgttggaaataggtccgcaatatatnacagcataatccagtacatagtcatgngtcgtg

SEQ ID NO: 22685 - DNA, 526 bp, Triticum aestivum
  unsure (1)..(526): unsure at all n locations
  Clone ID: PAT_TA_22685
gcggccctgccgggagacgggcctggcgggaacctccggggcggagcggcgcgcctggcgggagcctcccgggcgggagcggcggcctgggnggagcggcgacctggcgggagccggtcgggcgggaacctccctggtggcagcggactggagggaccgggcgggagctgcgtacggacgggagacgacaagaagaagacgcggcggcggcgagagaggatcggagcacgagttgcgcgtgcgaaaaaagaaacctaaagctctaataccatgttaggaataagcaacttgtattcccatgaggccataggccgatatatatacatgtacaggtgtggtacatatgcaggaaaccccttatactacaggataaatacaaaggtgtatacatgacttatattataactctaacaagtgtgactacaaatttctttgccgtgaggggcttcacacaaatgaccctagctgtttacttgctgcacctgtatggaggcttgtctgctccgtaagccggttacacttttat

SEQ ID NO: 22686 - DNA, 1161 bp, Triticum aestivum
  Clone ID: PAT_TA_22686
tgcgagtctagctcgttacagaggttcttgccaaccaggaacactggcggcggcaagggggaaaccctaacaacaagatagcggccgcccctcgaccccatcgcccgcctgttgcgcctgccaaagggaggcctaaggcgcgcataccctgttaggaagaggcggccgctgcgcccctggccccataggccgctgcgtcctcctgtgcagccgcggtcgcacggcagcgaaccgccgctcgcccgggcttaatacgtggcgtaaagcttctaataccatgttaggaataagcaacttgtattcccatgaggccataggccgatatatatacgcatgtacaggtgtggtacatatgcaggaaaccccttatacaacgggataaatacaaaggggtatacatgacttatattataactctaacaaagtttagcatcaagatcgcccacaggtcacactcacaccccaaaacacgttggagcacatacccccgcaccaagaggcgtccccagctatcttgagattacaacaggcacagacgccatgctgtcaagattgtacccttcgcaacaccatgtcttttgtacgcctgcatagagtactcgctgcatgttggcacataacggcagctagaaggcagcaagggtgatatctctcttttgtagaattttagcatcgatagtgccacgctgactcccaaatcgttgacttcctttgcgcctggtccggctccttgtcccaagtgcctccccactggcccgcctctcctctcgcggagtgccgtcccgctgatgcgtctctcccgcaggcgagttgagcccccggactcctgagctcccgtgggttctctggcccgtggttctgccaatagcttcgctccctcatttaggtgaaggatcggtctcgcccgggcctatgctggggcagccttcagagacttttcgacagcggtcgcctcctgcgtaagtacacggaaaccaactgcagtcagcccgtcgtcgtcggcagcacagcagacccgcaccatcggaatctttctcttattcttgtagtgcggaccagtgaaagaaggtgcgctcctcgcgagaggcaagagggaagcggagacgggggcggccatggcgacggtggcgtggcgcctaccggcagcacagacgagcagtg

SEQ ID NO: 22687 - DNA, 750 bp, Triticum aestivum
  Clone ID: PAT_TA_22687
gcccctatttgctcccacctcacccgagacctgcataccctttccccccgtcatcagccatggcgaccgcaacgaggctgctcccgacgctcctcagaaccctaaccggcacccgccacgctggcgcggcgcggggcctcgccacggagaaggcagtcggtgccgcggccgtcgttggaagccacaccgccaaatggatgcaggacacaagcaagaaatctccaatggaactcatcaatgaggtgccaccaatcaaggttgaagggcgaattgccgcatgtgaaggggataaaaaccctgcccttggccatccaattgagtacatctgccttgatctggatgcacctgctgtgtgcaaatactgcggccttcgctatgttcaagaccaccatcactaagtagagaagattaccatcctttaccacatcagaatttggagttgctgcatgctcattgggttcacatatgtatgccgactgttactgtgtgattgcgctttgatggcaaaatgttgtctttgactgtcatcctacttttttgtcacataataatgttgccattaacttcgaattgattttctgtagctgacatttgtcggcatttcctgaattaatgcactttccgtatcaaactccctgcactctggataaaagggttgagagggaaggatcacgtatgaaatgataaaaaaaaaaaaaaaaaatgaacagtaaaaaaaagaaatcaattcccctagggccgcggccgctc

SEQ ID NO: 22688 - DNA, 1014 bp, Triticum aestivum
  Clone ID: PAT_TA_22688
cgacgcctcaaggttcgacctcgtcgatgctatgtacaaagagatggctgagcgctccgtgacacccaacacggtcacgcagaacattgttctcagtggctactgcagagcaggaaggctggacgatatggagaagctactctctgcgatgctcgaaagtgcaaattgtaaaccggatgtctggaccatgaacattatcctaagcctgtttgggaacagtggccaggttgagctgatggagaagtggtacgagaaattccgaggctatgggatcgagccagagactcggacgttcaacattctcattggtgcttacgggaagaagcggatgtatgacaagatgtctgcggtgatggaatacatgcgcaggctagcatttccatggacgactgctacatacaacaatgtgatcgaggcatttgctgtggcaggtgatgccaaaaacatggaggacacatttaaccagatgcgctcagaggggatgaagccagatacaaagaccttctgttgtctaataaacgggttcagcaatgcagcccttttccacaaggtggtaggcatggtaaagcttgctgagaggctcgatgtaccggcgaatacgtctttccacaactctgttcttgcggcatgtgcgaaagcggaggatctgatggaaatggagagggtcttcaggcacatgaagcatatgcagtgtgaagcagatgccatcacatactccatcttgttggaagcttatcggaaggaaggaatgaccgacaagatgtatgctctgcaacaggagaacccaagtttggtttcgactgagcttgtcatggtgtaactaacctcataaattgattatggtgttgagttcatctgactgaaatgaaaaatccgttcctcttcatgtctggaattaatagtgcaacctagcaaattaactactgccagaattgttttatttctgttgacctacaagattagtatgtatgataactgtattgctgtaaggacagagaagcttcattatatcac

SEQ ID NO: 22689 - DNA, 1033 bp, Triticum aestivum
  unsure (1)..(1033): unsure at all n locations
  Clone ID: PAT_TA_22689
catccccttctacggcgacaactggcgcaacccggccgcctccggcccggcctcctcgctcctccccgccgtcgtcgccttccccgaccgccaccgcatggccgccttctccgccgctcgcagcgccgccgacctcaaggagaccttcgccgcctggatgacggagcagcactgggaggacatgaagcagctcttcgagtcctgggtccgctccctcgacgccgccaccggcaagcccaaccgccccgacgtcgacctcttcaaccactacctccgcgccaacctcatgtccggcgccctgccgcacgagatgctcgatctcgccgaccagatgcgcgagttcgacctcgcgcccaacaccgcctcctacaacctcgtcctcaagaccatggtcaaggcccgcgaggtcgaaggggccgagaaaatcgtcgaacggatgctgcaaacaggaattgtgccagatgatgaatcctacaatttggttgtagatctgcttcttagacacaaccgtgctgactcagccttcaaatatttggaattgatgcttaaatcaggctacgcggtatcttcacttgtatttgctgagtatgtccgagtatgtgttaaatctgggagtttggacacattggcatcaatcatagagaagtgcaaggcaacagagaagaacaaactcttgtgtccacaatgggcctggtgcattgacatagcagaagctgcttttgaagctaacaatagcaagctagccatgtttggtttggatttcttgcgagatggattgcacatggcgagggttctaaaccccctattcaccgttcagtcatgaagnttagtactctcagctttcagtgctgctggtagaactgcagcagtgactcntgaaccgctggcaatataccaatcctgcgcagaaaggnaccatgccagagactacctgcaagattagccatcacaatgtcactcaacactttggacctcggaatgaaatctnagacttgngtacataaacctccacattactatgcacactgtgtgn

SEQ ID NO: 22690 - DNA, 1660 bp, Triticum aestivum
  Clone ID: PAT_TA_22690
ccgccgcagcgcggccgccgtcctcgccgccgccatgacccgccgcgccgccctgtggggcgccgcgttcgcgcgcccctccccgtgcctctgcgcccccgtggtcgccgcccgggccgggggcgggccccgcccgccgcccgcgccgtcgcgcccggcgccgcccctgcgccccatggccggcgccctggccgacgcccggggcgtcggccacgggcggccggcgcactcccgggccttcgagcgcgccgtcgaggccgtcgcggcctccccggtccgcgccggggcgcagcgctgggtgccccccggccgctggctcgccggcccctgctgcctctcctgccgcgtggcgcggtccctccccgggggcgccgcgagccgcggcattacggacggccatgtttggccgttgatgccagcactgccatcttatggatatgggagggagcgcaaaggacctcgtttctgtagtctaattcatggacagaatttgaaagatgttgtcattacaggacacaatggtagcataaatggccagggtgaagtttggtggttgaagcatcgcagaagaatgctgaagaacacaagacctccacttgtacaactgatgtggtccaaggacattgttattacaaatataacgttgcggaattcacctttctggcacttccacccatatgattgcacgaatgttactgtttcggatgttacaatcttagctcctatttctggtgctccgaacacagatggcatagatccagattcttgtgaggatgtcttaattgagaactgctacatatctgttggtgatgacgcaattgctataaagagcgggtgggatcaatatgggattgcatatgggcggccgtcttctaacatcttaatacgcaatgtgacagtccgatctttggtcagtgctggaatttcaattggcagtgagatgtctggtggagttgcaaatgttacggtgaagaatgtacgcatctgggattcaaggcgaggcgtgagaataaagactgccataggaagaggaggctacatccgcaatatctcctacagcaacataaccttcgacaatgttcgtgctgcaattgtgataaaggttgactacaatgagcatgctgatgatgggtatgacagaaatgccttcccagatatcacaggcatatcattcaaaaaaatacatgggtggggtgttcgtgtgcctgtccgtgctcatggcagcaattacatccccatcaaggatatcacctttcaggacatgtcagtaggcatcagctacaagaagaagcatatattccaatgctcctacattgaaggccgtgttatcgggtcagtctttccaaaaccatgtgagaatttggacgtgtacgatgagcaagggcagcttgtcaagcgtggggcagtgctcaacagcacagaagttgattatgatatatgagacacatacagttcactgatagattttcaatagtgtaaattaggtactatcattttttttgttttaatcttttgcctttttgttgtagaactgtaaatacagaggagattctcttcttcataggtttgcctacattggctcgtttgtatctcaccaattatttggctaccattgacattttgttcttgcaaaaggtgggaaaccttgtgatcttgcaat

SEQ ID NO: 22691 - DNA, 531 bp, Triticum aestivum
  Clone ID: PAT_TA_22691
cgtccgcccacgcgtcccgccaccatcactgctcctccctccttcagtccccactactcttccccgcacgtcccacgcagctggggacgcccaagtactacccgcatcccctcccatttactgagcctctgaaccaggaggaggaggaggaggaggagaagaattgattgctgatccggcgcaaaccaataaattcctcctgccccgccgcgcgcgcgcgagatcatcatggctgctgctgctgctggcgccacgaggagggccgcctcctcgctcgcctcccgctgcctgctctccaggcccgcagcgtcgcccgctgctgtcccctccgcgctccgcagggcagatggagcacgtggattgttgccaggactccttcagaggttcggcactgccgcagcagcagaggagcccatttcgccttctgtccaagtgggcgagacgcagctccttatcaacggcaaattcgttgatgctgcatctggcaagaccttcccgactctggatcctcgcactggggaggtgattgcc

SEQ ID NO: 22692 - DNA, 585 bp, Triticum aestivum
  Clone ID: PAT_TA_22692
ccgcaggtgttttcaccaacaacctggacacggccaacaccttgacgcgtgccctcagggccggcacggtctgggtgaactgcttcgacatctttgacgccgcgatccccttcggcgggtacaagatgagcggcatcggtagggagaagggcatcgacagcctgaagaactacctgcaagtcaaggcggtcgtcaccgcacttaagaaccccgcatggttgtgagcatagcgcacctatggtcctacttgagactctggagaacgtgaagactcgcgacaattggatgagaagaggaagatgacgatgatgacaccaacgaggatcactaataagccctgccttcatgggcagccaccgtctaataaatatcatatgtgatttggtttgctttgtcaaccgcggcaagacatatgttgtagcaacattatgtttattatcgcttgttggagaagtctctggttgcagtacatctgttttttttttatcagtcattgttcttctacacatatgaagctaatggtgttcactaccctagttaattcatgcccttgttaagcagagaataaagttcttggtttggttg

SEQ ID NO: 22693 - DNA, 2305 bp, Triticum aestivum
  Clone ID: PAT_TA_22693
cccgggtcgtccgcccgcccgccccgcggcatccgcgccgccaccctcactgctcccctcccctcctcagtccccactactcttcccacgcagctggggacgccctcccatttactgagccaagagaaggaggaggggaagaagaattgattgctgatccggcgcagaccaataaattgttcccgcctccgccgagatcatcatggctgctgccgccacgaggagggccgcctcctcgctcgcctcccgctgcctgctctccaggcccgcagcgtcgcccgctgctgtcccctccgcgctccgcagggcagatggggcacgtggattgttgccaggactccttcagaggttcggcactgcggcagcagcagaggagcccatttcgccttctgtccaagtgggcgagacacagctccttatcaacggcaaattcgtcgatgctgcatctggtaaaactttcccgactgtggaccctcgcaccggggaggtgattgcccgtgtggccgaaggagatgccgaagatgttgaccgtgcggttgttgcggcccggcaaggcattcgatgaagggccatggccaaggatgactgcctatgagagatcccgcattcttctgcggtttgctgatttgatagagaagcacaatgacgatatcgcagcactggaaacgtgggacaacggaaagccctatgagcaagctgcccacatcagaagtgccaatgcttgctcggcttatgcggtactatgcaggctggactgagaagattggacttatcatcgccctggctgatagcgtaccgcctgaagggcctcatcatgtgcaggtgctgcgcgagccgattggtgacgtcggtcagatcaccccttttgacttcccgcttttgaggtaggcctgcaaagtcaggcgtgctctcgcctgtggtaacgcctgtgttctcaacaccgctgtctaaactcctctatccgccctcgatgtttccaagctgttgcatgaggctggtactaaccgaaggtgtcctgtatagcgcttctggcttctggtcccactgctggcgctgctcttgctacccgcatgggtatgttgacaagacttgtattgactgaattaatcctgtgctggctgcgcggagcaatgataagctagtgacgcaggagctagaaggcaatgatccttttatcgtcgtggatgatgcagatatcgaccaagccgttgagcttgcgcattttgcgctgttttttaaccaggtttaatgctgctgcgctgggtcgcgcactttcgtacatgagcgtgtttatgatgagtttgttgagaagtccaaggctcgcgctttgaagcgtgtagttggtgatccattcaggaagggtgttgagcagggtcctcagattgatgatgagcaattcaagaagatcttgcgctacatcaagtcgggtgtggacagtggagccacccttgtgacgggtggtgacaagttgggtgacaaaggttactacatccagccaacaattttctcagatgtgcaggatggcatgaaaattgcccaagaggagatatttgggcctgttcagtcaatcttcaagttcaatgacctcaacgaggtgatcaagagggcgaacgcaagccagtacggattggctgccggtgttttcaccaacaacctggacacggccaacaccttgacgcgtgccctcagggccggcacggtctgggtgaattgctttgacatcttcgacgcggcgatccccttcggcgggtacaagatgagcggcatcggtagggagaagggcatcgacagcctgaagaactacctgcaagtcaaggcggtcgtcaccgcgcttaagaaccccgcgtggttgtgagcatagcgcactatggtcctcttgacactccggagaacgtgaagactcgcgataattgaatgaggagaggaagaagaagatgatgatgatgatgacaccaacgaggatcactaataagcccctgccttcatgggcagccagccaccgtctctaataaatatcatatgtgatttggtttcctttgtcaaccgcggcaagacatatatgttgtagcaacattatgtttattatcgcttgttggagaagtctctggttgcagtaaatctgttttttttttataagttgttgaagctaatggtgttcactaccctatttaattcatgcccttgttaagcagagaataaagtttttggtttggctggtgttcaataccctagttaattcatgcccttgttaagcagagaataaagttcttggtttggttgaaaaaaaaaaacaaataaaaaaaaa

SEQ ID NO: 22694 - DNA, 555 bp, Triticum aestivum
  unsure (1)..(555): unsure at all n locations
  Clone ID: PAT_TA_22694
aagcaccttggtgtagaagacgttgaagcagaggctcttgaccatggcgaaggcgatcttgacgggggatgagccaccgcgccctggcccagcgcctcagcgcctcctcccgccgccccaccggcatgtcggcgaagcggcgcacgtacgggaactcgccggagacgcacagccggccgcacagcgccagcgtgcccagccgcgtgcacaggagccagagcgtgacgtgcaccagcacccccgcctcccacacgcaccgggtgaaggccagctccgcgacctcgccgggaatcctggcgcccgcgccgggtgcgtggttgtggcgctccgggcccgggtcgcgtggcggctccctccccccgtcctgggcctcctccggcggcaccctcggctggagcccgccgcgcgtgccccgcagtgcccctgaaatanaanaaaaaaaagggggccggtaccaatcgcctatanngatcgtataccgccnactggcctcntttanantcggacgggaaacctgggtaccacttagcccttgagaaatcccttccacnggtn

SEQ ID NO: 22695 - DNA, 534 bp, Triticum aestivum
  unsure (1)..(534): unsure at all n locations
  Clone ID: PAT_TA_22695
gtcgttccatagtacctgttgagaatcttgtgaatcgaagaggctctaagagcaaggatatacatgtttttttgaacaattgttctatcgatgactacacgatgaccattgtgtggtactttgctgaaagcctggtaatgcaatggtttctctgttttacactttattagtattccttttgttacaagcaacaggtttgcgtacataaaccaatggaacagacttctggtgggtaaataggtcccttgactgttggggtgttagctacctcaatagtaagtatcccaacctacacggtatccattgtgcatataatcttcctaattttcacttcaagcactgcaagtgggaatactcgcgctaactcagcacatactgggacaatcactagtgccaatccagacctatcacatgtttttcagccctcagaactactctaagaacgttggatattcatcattcaaacaacagaaataatcagccagccatatggaattccagtanacaaanagttggcaatttgnacagntttgc

SEQ ID NO: 22696 - DNA, 471 bp, Triticum aestivum
  Clone ID: PAT_TA_22696
ggccgttttcgtgggcgggaggctcctcggcgggctcgaacgggctcatggccgttcacatctccggcgagctcgtgcccatactcaaggacgctggcgcgctctggctctgagacattttgattaggagttagtacagccagtaatctcttctccttctcatttcttcttttgactcgtgaggtcatgtgaattactgctgctcgaccttcctctctgcttgggatcaatcagtaatggtgatgatagttagctagacgatgatagttttaaattctttttaagtgaatttagtttcgaccacacacgcctgtaaatagatcgatgagtgaagatggatgtactctactgggagtatttagcactccatgttaaatgatgctcgttcccttctgtacagcagctagctttgcatggttctccgggatgacaatcaaatcaatctgttctgtttttgccaaaaaaaaaaaa

SEQ ID NO: 22697 - DNA, 728 bp, Triticum aestivum
  unsure (1)..(728): unsure at all n locations
  Clone ID: PAT_TA_22697
tcctcctcccttccaccttgccgtgccataccgcgagtgtaggataggatcacttcgagtcgaggccagtgagcaggtgaagggacgaccgccggcggccaccgtgggaggaggaggaggagcgcggggctcccgcatcggcgcgtcgccgtcgctccccacgccggacacgggttcctcgacggcggacggaagcgggactcgcggttgagtgggagcagacgccggccggccgctacgggcaatttttggatgggtactgaagactctaaagatatgctgaagaatgcagactggaagactgtgagtggtgcagttactgagtcaagtcagccggttgttaggaagcgccttccgaagaaaataagacaagttcctgagtgttactttctccctcgacgatctttgccttctgcactggcaatctatggtgctgtttgcgccgctggagttggtgcagggatgttgctcgaggtttggtcaacaaaaagatcaaagaggatggcggcgttgtctgggaaatgggcaaatgatgttcangccttctgttgctgttaattgtatcacagagataacatgtttttgttgttttggatacttttaacttgctgacgaaacaaacaatgttccagtgtaaactgtcctgtgtcctggttggtgtagaagcgttgatctcaacttatataagcaacaagtgaaacacagcacacacanggaaaaaaaaaaaa

SEQ ID NO: 22698 - DNA, 1321 bp, Triticum aestivum
  Clone ID: PAT_TA_22698
gccggccgggccgggaaaactcgcgtcccttcccctcctcgcgtgcccccccttatccccttcaccatggccacctccgccatgacactcgccatggccgcggccacggacgcctccctctttcaccccacgttcctcgcccaacacaagctcgccccggcgtccgcctccctcccactcattttctctcgcgcgccgctcctccgctccacccgcccccgcgtcccccttacgcccctcgtcgcctcctccgacgccgccgaggcgggcctcgactgggccgacgcggaggaagccgaagagacggtgacggaggaggagcccgcggtggcggcctccggtggggacgcgggctacgcagccgagccgcccgaggaggccaaggtgtacgtcgggaacctgccgtatgatgtcgacagcgagcggctcgcccagctcttcgaccaggccggcgtcgtcgaggtcgccgaggtcatttacaacagagagtcaggccagagccgtggatttggatttgttaccatgagtactattgaggaagctgacaaggccatcgagacattcaaccgctacgacatcagcggaaggcttctgaacgtaaacagggcagtctcaaaggggctcccgtgttgagagacctcctcgacagtttgcatcttctttcagggcttatgttggtaacctgccatggcaagcggaagactctaggttggtgcaattgttcagcgagcatggggaagtagttaacgctacagttgtgtacgacagagaaactgggcgttcacgaggatttggttttgtaactatggcttcaaaggaggatcttgacagtgctatttcagcgcttgatggacaggagatggatggccgcccactccgagtgaacgttgccgcggagcgaccgcagcgagggttctgatgcagaggagagcgggtgtttcttttggacacacgagaacaacactgctgaaatgttactgcggaagactgaagcatgtcaccacttaaaaatcctgcactagcctcctgatgttgggctatctcctcccatcccatattcttttttcatgcttccgtttgctgctgatgtcatcatgtcactttcttgtcaacaccatccagttcaacttttcaagtaggctactgtaatgatgtcctagtgttctcatgataatcgaagaaggttttgttggtaatgctaaaaaaaaaaaaatgcaaagggcagaatgcacggtacccttgtttgcttttgcaattacattagccttgcaacctgacatttttcacagaaccaaagaaattttgggttgcttgaatttcc

SEQ ID NO: 22699 - DNA, 475 bp, Triticum aestivum
  Clone ID: PAT_TA_22699
atggcgccggagccgatggccgccgcgcccgagcacgcgctggggctggacctgcagctcagcttgtgacgactccggtcgatcgagagccgcgtacactgttgctccggtaaaaaaggaagggatgaattacccacccacgcactaccactagtacctgcatgcgtccgaaccaaagctcgatcgatcgatcctcgctagtactactaggtaattaaactagctagcggtagtaagtaaagtataagtaatttttagcttccgggctagctttgggagtgttaagccggccgaccgccttgtaaccgaaccaactcctcccgtacgttcctgatatgatccgaggtcgatcgatgacgccttgtaaattcttggtcaaacccatgcacccatccatcatccatctctgccatttgcagtgttgatcaatatcacccattttcttgttcttgttgaaaaaaaaaaaaaaaaaact

SEQ ID NO: 22700 - DNA, 618 bp, Triticum aestivum
  unsure (1)..(618): unsure at all n locations
  Clone ID: PAT_TA_22700
gcgtatgctggcgacgagccggcccttggtcgcggcggcgtccgcacttcccaactccggcctgccgcgccgcacgtacactgtgcaggctatcaagccactaggcggaggaggcggcggctacgtggcatgccacagcagggcttacccgtacgctgtgtacgagtgccacatgatggagggctcgtccgaggaggcgtacgtcgtctccatccgcggcggcagcggcctccctaccgtggacatggcggcggtgtgccacttcgacacctctaattggatcccagctcacccagccttcaagatcctgggcacccaccccggcggctcgcccgtgtggccactttcttccctacgccgacctcatgttcggcgtgaagatggccgacaatgcatagaatcttaacaacaaactacgtacaagcagagatgacctaaatgtcattagcaaggaataaaaactaccgtattcaattgatcattatcaaccgtaattcgggactccccctacctccctaacctaactgaacataaagtaaaggtggcattcaaagnttcccgtaaacaaggagaccagnagatctcgntctcnggaggcatggctcataatcaaaggag

SEQ ID NO: 22701 - DNA, 422 bp, Triticum aestivum
  unsure (1)..(422): unsure at all n locations
  Clone ID: PAT_TA_22701
tgtagccacaatttgcagatcaactgatcaagtacgtacggacgagcttaatgatgaggctactcccgtgcttctgcgtctgcttggtcgtcgtcctcctcgtcggctcctccccggcggatctcctggccgggcgctgcccgctgcaccaccgtaggcagctcgaggacgtcgacagcggtggcggcctgcaggcaacggcggtggcgagcaccacggctgctgtgcggccacagcaagagatcaccgatctggtcgtctatgggacctccaagaggctcagtcctgggggatccaaccctcagcaccaccactgatcgaagggtgttcatcggtgataaggtgtccatcggcttcatgtatacttcattcantttgcgggtaagagaagaaatactattccgcaaaataaaaaaaaaaaa

SEQ ID NO: 22702 - DNA, 707 bp, Triticum aestivum
  Clone ID: PAT_TA_22702
ttcctgctcctcgaaaattgcccccgcgcccgccccccccccgccgccgccgccgcctctaacccccgcctttggccacctgcacctccccgggccagaaattccttttccgtacccgtcgattcgcgggaggcggccatggagcacggttcggtggcggattcgagcgcgtcgaccttctccatcatggaggaggatcacaccctcgccaactccgtcagatttgtcctcaaccaggacccaagggtagcattttgtggatatagcatccctcatcctgctgacaacaaagtcaacataagagttcagactacaggagatccagcaaaggatgtaatgaaagatgctttacaggacttgatggtgatgggccagcatgttagagggacttttgacaaagcagtggctgattttaaatcaaagatgcctgcagaacaaatggatgttgatttgaatcagcaatgaagttctctggaacccctgttcatcgggagcaatacaatatgtgtaactagtttatcgtcggaaagcgggttagttgcgatttctgccatttgaggtgtctatgggtcaatgtctggatattgtctttagagaagtatgtactgttaccgagttcctttgttgaacactgggatgttggagtttgttatgaatttataattaattcaatctccaagaaggtttttaaaaaaaaaaaaaaaaaa

SEQ ID NO: 22703 - DNA, 872 bp, Triticum aestivum
  Clone ID: PAT_TA_22703
tagcgtggtcgcggccgaggtacgttcaggattcgcccctatcgctcgctgcttccggtgccgcgtgtcagcgagcgcaaagctccccctcatcgccgccgccaccgccgccgccgctcaaccccatcccgccggccccgcccaggtccatggccgccaagtgggcccagaagaccgtcgtcatccctgcccagcgccgcgggtgccacctcatcacccccaagattttgagggagattcgagggcgatctctccgggttcaagtgcggcttggcgcatctgttcctgcagcacacaagtgcttccctgaccatcaatgagaactatgactctgatgtgcaggctgacaccgaaacattccttaacaaaattgtcccaaagggccgatctgctccttggaagcatactatggaaggaccggatgacatgccagcacatattaaatcatcaatgtttggttgtgctctgacaattcctataactgatggacatctcaacctgggcacttggcagggtatatggctgtgcgaacatcgcgatcatgctagtgctcgtaaaatcgtggtcaccctcaacggaatctaaacggagtattagaaacctggaggaaggaggaatgctgggcagctttaagcaccagcacggaaactcaagacatgagagctttgaacatgtcgtgtacgggtcgtcgatcttgtatgtatgaatgagtggtgcaaaatttgaataaattgggagccaacatgagtgttcaaaagatgggcgtaccctacccagttgtttgaatagaacataagagtttctcgtccatgtagctgaagaaatctgtcttttttcattataatatgaatgaagaaagaaacatgccttgc

SEQ ID NO: 22704 - DNA, 907 bp, Triticum aestivum
  unsure (1)..(907): unsure at all n locations
  Clone ID: PAT_TA_22704
ggaagccgcagtcctccttcgagcaccaccaccaccacccgcaccccgttagccctccctccccgccgcaggactccctcgccgcgcaggccatgcgcgcctccgccgcccaccgagacgcctcttctctctcctccgcctactcctcggctgcctccgcggccgccgccgctcgcaggagccacgagccctccgtctccaccccttcccctgactcttccagctatgggtacacgtccatgaagagcttgaacgaagccaagtacggattttgggggacgcttgctcggaaagcaaagtcacttattgacgaggatgggtcgccggagcagtatgattccccgacgagacagcagccgccaagagatggtacatcaccaagctatccatagacaacacttgcaacagccagcgccagagacatggaaatccgagacacctccatctcagaagaggtccgaggcattagcttcctcccttaactatggggggggctcaattgcctctgccctcgcggaaggtcggactattgtagagactaaaacagctgacattattcaggagacgcgtaaactgaatataaggcggaaaggactggtcaaaatccacaaggagaaactctcacaatttgctcacagaatttcctcaaanccactcgattacgaaaccattgaaggatctccccacttgcaaatgccattcagcaaaacaaactgctatacgtgaactgaagacgtgaagcagtttactttgcgaaggaccttgctcaactgaggacgagaataatttcnaaaaancaagacatggtgataaccagagatgatgattgatcgctacatngagaacatactaaagggcgnttnaataaaaancgtttnccagaaaanattccactaatgtattncan

SEQ ID NO: 22705 - DNA, 539 bp, Triticum aestivum
  unsure (1)..(539): unsure at all n locations
  Clone ID: PAT_TA_22705
aagtatttagcgcttttgtacctagcaacaattcagggtattgcgcgtggtccccgccgtggtgtggagcattgcaatgctcatggacacaagatcgacacccttcttgcctgtggcggacttgcaaagaactccttgtatgtccaagagcatgcagatatcatcggctgtccaataatacttcctagagagaatgagtctgtgcttttaggtgcttctgttctgggtgctgttgctgcaaagaagttttctggtattcacgatgcaatgaagtcaatgaatgcagctggaaaggttgtgcatccatcttcggatcccagggtgaagaaataccacgatgccaaatatcagatattcagatccctgtatgagcaacagctctctcatcgctcagccatggcgcaagcattgcagtaggggttacgtgaccactgagctgggtacccgcccgggccgccgctcccagtctgttgcatgttcctgaatattacattaaagaaattcatccgtaaggaacatgatcatanaaaaaaaaaaaa

SEQ ID NO: 22706 - DNA, 593 bp, Triticum aestivum
  unsure (1)..(593): unsure at all n locations
  Clone ID: PAT_TA_22706
gaaacatttcattgatttattgcaccgtatcaaagtgagacaaccgcaaatagtttcaactccctgtctctatatcataagcacattaaaatcctgataagataataatcataatgagaacaaagcatgccggacgggacaaagttacaatggcgtgcggtgtaacgagaacaagggacatgaaaatcatgatttgtaaccggcaagccgtatatcggacgttacaacacgaagttgttcagaactttctttaccagatgctccccatacaccaccttgtccgtacttggcaacgccgcccgttttctcctgggcatagctccgcaaggctcaaccacggcatcgaagtttgactcgttagaagaaggcaaccgatagcacggtaacgaggggagctattgaaaaccctatggagtgtgggctggatatattccattacaccaaacctcctgccattcaccaatgttgccacacaaaggtccaagggacgggcttggcctgtaccacccgccaagacaggttctgactcaagagcacaaatgtatcaactgggtaaaccaatgtcaanaggcctaaccgtttaancccaatcn

SEQ ID NO: 22707 - DNA, 1034 bp, Triticum aestivum
  unsure (1)..(1034): unsure at all n locations
  Clone ID: PAT_TA_22707
cataccttcctttctaccttagccaccaaggcttccattcccgtgacgaagcaaaaacctcctataaaacacagctctcccgaacacggatcaaacggctccggaaaaacacccaaaaaagcggcggaaaggggagaagggaagaacatggacgggcacgtcggccagttcttccagtcggtcagctcgatcttccgcgggagcgacaccctccccgtctgcgaccgcgacatcatcgccggttgtgagacagaggttgctgaggctgcaaatgaagaacagaagaacgacagcctcatgaggctgtcatgggcgcttgttcactctaggcagcccgaggatgtcaaccgtggcattggaatgcttgaagcttctttcggcaagtctaacagtccgctacaaacaagggagaagctctatttgttggccgttggacactacagaaatggggattacacaagaagccgtgagcttctggaaagatgcttagaggttcaacctgactggaggcaagctcttactttggaaaggctccttgaagagaaaaccaaaagagatggtatgattggcatggccattgtgaccggcgcctttggacttgtggggcttgttgctggtggaatcatagctgctgcttcatcgtccaggaagaaatgaggctccggtatgcggtgaataagatgattagatgagcaagaacttgatgtgaagttgcgtaatcttaccttggcactcttgcgaccatgcatgtgcgcacttatccttgtcctgtcctgtttccatgttggaccaaccttaatcgcactattagtaaatacgacatttcaactgtcggatcgaagnaatgtatgttaagctaatgctagatcatagactgttgcattggttcatatcattctgataatccatcttacaagcataagaggagctgtatcttatgccaacgtaagatcgatgttgacgcgaaaatttcagaagagcataagatggaaggaagagaattatttttggtgtttccacatctaataaagtta

SEQ ID NO: 22708 - DNA, 408 bp, Triticum aestivum
  Clone ID: PAT_TA_22708
gacccacgcgtccgcccacgcgtccgcacgcctgcctcatctctcggagcaggaggaggagctagcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgaggttcgcgtccaagcagtccctcacctacctcgacggcacgctgcccggagactttggtttcgaccccttggggctgtccgacccggatggcaccggcgggttcatcgagcccatgtggctagcctacggcgagatcttcaacggccggacggcgatgattgggggtgtgggcatgatcgcccc

SEQ ID NO: 22709 - DNA, 463 bp, Triticum aestivum
  Clone ID: PAT_TA_22709
cctaccacaggtcgctgcagcacctggagcaggccatcgcgcaggcgcggcgatgacaaacgcgcgcgggcggcggccggcggcccggagatcgtcgctgcacacgccttgtgctttgtgcctgtagtacgttatttagatggtgctaggaatctgtgtatgtgtaggttaagttgttacaagtgctacaacatgtcgttgttatgccagtgcatggcggctggtgatggatgttttcggggttggggaagatgaacttcggtgaacaagcttgggaaaggaatggtttggtgggaacggcaaatgatagccttcattcatatgtgtgcagtgcagtgagcaagtttcagatatccattctttttccctagagtaaaacatgtataactatttgagataatagataactggcatcccatatgggccctggcgcaatcaaaaaaaaaaaaaaaaaactcgagac

SEQ ID NO: 22710 - DNA, 1097 bp, Triticum aestivum
  Clone ID: PAT_TA_22710
gcggcccttcttctggagaatcaagagtacactgaagccctgaccctccttactggacttattggggaagtccgtggacttgatgacaagttgctccttgtggacattgaccttttggaaagcaaactccacttctctctgagaaatctgcctaaggccaaagcttcactgaccgctgcaagaacagcggcgaatgccatttatgttccaccagctcagcagggcactattgatctgcagagtggaatccttcatgcggaagagaaggactacaaaactgcttacagctacttctttgaagcattcgaggctttcaatgcactggacgacccaagagctatcttcagcttgaagtacatgctcttgtgcaagataatggtcaaccaggctgacgatgttgctggaataatctcatctaaggctagcctgaagtatgtgggtcctgatgttgatgctatgaaagctgtagctgatgcctactctaaaagatctctcaagtactttgaaaccgcccttcgtgatttcaaagcccagcttgaggaggaccctattgtccacaggcatctttcatctctgtatgataccctcctggagcagaacctgtgcaggttgattgagccctactcgagggtggagattgcgcatgttgcacagatgattgaattgccaatcgagcatgttgagaagaagctgtcacagatgatcctggacaagaaattcgcagggactctggatcagggtgcgggctgccttatcatcttcgaagacgccaagacggaggcgatcttcccagctacgctggaaacaatttcgaatgtggggaaggttgtcgagagcctttacatgaggtcagcaaagatcatggcctgaggagatgttttgttcttacccggcgtctccagttaaatcttacacttgagctctgctagtgtctcgaggacatgaaatccctgcgtgttgccattgtttcttccttgcaaattgtcttctgttagctctataaaatttctagcctcgtggacaagaagataccgttgtttctgcgtgatggaaatacagttagcacttgctgatatcaaccatttccgttctagtgc

SEQ ID NO: 22711 - DNA, 1734 bp, Triticum aestivum
  Clone ID: PAT_TA_22711
accccgccccctggtccgctctcggccctcgtccctccccatcctcctcctccaactccttctccctcccgccattgggccggccgccattgagagtttgcttcctccgctccgtgtcatctctgcaggaaatccgccatcgctcgccagggtgtactgaccatgtctgcgatgcaatcatcgtatcttcctgctaccactgagtcaattgcaatggctcaggaagctaaggatgcttcagagtccattttaatcctctaccgtgtgcttgaagacccgtcttcttcttcagatgcagttagaacaaaagaagttgccattacaaatctgacaaactatctcacaaaagagaacagagccgaggaacttaggaatctgttgacccagctcaggccatttttcgcactgattcccaaggcaaagaccgcaaagattgtgcgtggcatcattgatgccgtttcaaagatacctggaacatctgatcttcagatctcactctgcaaggagatggtggaatggacacgtgcagagaaacgtaccttcctgaggcagcgtgtagaagcaagactagcagcccttcttttggaaagtcaggagtacactgaagctcttacccttctttctggtcttatcatggaagtgaggcggctggatgacaaattgcttcttgttgacattgaccttctggagagtacactccatttctctctaaggtaccagcgaaatgccaatgcttactctgactgccgaaagaacagcagcgaatgccatttatgttccaccagttcagcatggcactattgaccagttgaatatacaccttcatgccgaagagccaaattctaactctagctacagctactttgtaagataatgggaaaggattaagataatggacgaggttgaggctattctctggtagaagtgtattcttctgttcatgatactggtgaaataagatatgtagggtgtagctgctacctactctaaaacaggtctcaagtactttgaaactgatgtcgatgatttcaaagccgcagcgggaggcgtactctacaggaccccggcatctttcttgtatgcactcctcggtgctgaagcagcacagtctgaaggttagcttatagccctgaggcaggtgtcggagatttgggcatcgttccacgggatgaatcaatccggggttgatgaagctgactcaggaggctcgtcgcagaagattctaggcgaagatagatcagtcggtacgctcgggcttcagctgcagcggtcccaagatgatcgtggtctaccaaattacccgggacactgttaccagtgtgcggagtgcctcatccacatttaagaacggctaggcagaggcgatatttccgggcgacgctctgaaacactttaaaatgtgagagaaggttttcgatagcctttacaggaggtgagcagcctttatggttccattgatttgttttggtcacctgttaaatcttacagttaagctatgctagatgttccacgacatgaaatccctgcgtattaccaattatttcttccttgcaaattgtcttgtgttggctctataaaatgtctagctcatggacaagaaaacacggttgtttctgcttgatggaaatacagttagcacttgctgataaaaaaaaaaaaaaaaaaaaaaaaaaaaaaaaaaaaaaaaaaaactctctctctctctctctctctctctctctctctctctctctc

SEQ ID NO: 22712 - DNA, 608 bp, Triticum aestivum
  unsure (1)..(608): unsure at all n locations
  Clone ID: PAT_TA_22712
ctaggcgaacatgacttggatgagtcaatagcatagtagccgtagttatctaaaaaaggcagtgtcccaggcaacaaggtaaattgttctgctgtccaatgcattgaagctatagtgcatatatgcttagtaaattgtttggatttgtccgagactaataatgaccaacttagtgaattgttaaacctgaaagtttgtgttttccatttaacatagtgaattgtttgcacaattcagttccgtgttgattgaatggacgtgacgtgatgttttctccagggaacggactgaagtggattgacatggtttctgtccatgatgcagttatgtgctattcctccttgctgcagtgttgcgcatccttgctgctgtggctgactccatgaatatgaaagctatatttacccctaagctatgagtgtcctcctaacttccttccatgagangtattgccctcagtctcgggcatccttaatacaagggatgcagcaaggttcaatgggtnatgacgttgggcaaatctgaatccgtaccacaaaccgtcctacattttaagcaaaaattcntttcttcagtatctgtgaantcaacagcgacagggcattnnc

SEQ ID NO: 22713 - DNA, 569 bp, Triticum aestivum
  Clone ID: PAT_TA_22713
ggttggattggaccccttgctcgcccgagcagaactgcccgcccggggagcgtgcccaccgtgatgggcgtggccagggcgtgcctgcagcgggacccgcccaagaggccgagcatggtggacgtgccctacaccctgtcccagggcggacgagtacttcgcggactactccggcgagagcgtgtccgtggatggcagcggcgagatcgccgcgcggtgagtcgcttgtttgtagtactgctctgctttgtagttaatcagtgagcacggacgatatagctagctggtggtaagcatttagtgtataggagtagctataataacgcggcattatgtcacgttggagctccgtgagattatcctgtgggtcaagtagtgggggcccggatacaagggactatttttagtctgactaaaaatagtctcttttagaggctaaagttccacgcgcccctgactaaagcgcggctaggacttgtcttgaggctaacatcttttagtcaccccaggcggggatatgtattagctctctctctcctcatttaattcctctccttaaaaaaaaaaaa

SEQ ID NO: 22714 - DNA, 2990 bp, Triticum aestivum
  Clone ID: PAT_TA_22714
cccgttcacgtccatcttcctcatcgtctactgcttcctgccggcgctgtcgctcttctcggggcagttcatcgtcaaggagctggacgtgaccttcctcacctacctgctggtgatcaccctgacgctgtgcatgctggcggtgctggagaccaactggtcgggcatcaacctggaggagtggtggaggaacgagcagttctggctcatcggcggcaccagcgcgcacctggccgccgtgctgcaggggctcctcaaggtgatcgccggcatcgagatctccttcacgctcacctccaagtcgggcgccgacgacgagaacgacgagttcgccgacctctacatcgtcaagtggacgtcgctcatgatcccgcccatcgtcatcatgatggtgaacctcatcgccatcgccgtcggcttcagccgcaccatctacagcgagatcccgcagtggagcaagctcctgggcggcgtcttcttcagcttctgggtgctggctcacctgtacccgttcgccaagggcctcatgggccgccggggacgcacgccgaccatcgtcttcgtctggtccggcctcctcgccatcaccatctccctgctgtgggtcgccatcaacccgccgtcgcagaactcacagatcggaggctccttccagttcccctgatcgatgaagctagcttcctcttatatgagttacataccatttgttccagcagcagcacagctagctggtggggagtaaagtaaattctgaccgttccctgtggttaaattaggtctttttttgtgttgtcggaaaacgttggatcatcatactagttccattggccatgaagaggcagcgtgaagctgctcttgacgatgcagtggagactgttaaaattggcaaagctacctggatggctgatggcacacattggcccggtacctggattcaaccctctgcggagcatactcggggagaccatgctggaataattcaggtgatgctcaaacctcctagtgatgatcccctgtatggcggtgacggtgaagaaggcagaccccttgacttcactgacatcgacatccgtctgccaatgttggtctatgtgtcccgagaaaagcgcccaggctatgaccacaacaagaaggctggtgcgatgaatgctctagtccgttcatctgctgtcatgtcaaatggacctttcatcctcaacctggactgtgatcattatgtttacaactcccaagctttccgtgaaggcatgtgcttcatgatggaccgtggtggtgaccgtattgcctatgtccagttcccccaacggtttgagggcattgatccatcagatcgctacgccaaccacaacactgtcttctttgatgtcaacatgcgtgcattggatggtctcatgggaccagtctatgtcggcactggctgtctgttccgccgtgttgcactctatggatttgaccctccacgctccacagaacacggtggctgctgcagctgttgcttcccgaagaagcgcaagatcaagagcactgtttcctcaggtacatctgaagagacacgggctctgcgcatggcagattttgatgatgaggagatgaacatgtcaacatttcccaagaggttcggtaactcaaacttcctcatcaactctatcccgattgccgagttccaagggcgcccgcttgctgatcaccctggtgtcaagaatggccgtcctcctggtgctctcactgtcccccgtgaccttctcgacgcctccacggtcgccgaggctatcagtgtcatctcatgctggtatgaagacaagacagagtggggtcagcgtgtcggatggatttacggttcagtcacagaggatgttgtcacaggctaccggatgcacaaccgtgggtggaagtcggtctactgtgtcaccaagcgcgacgccttccgcggcactgcgcccatcaacctgacggaccgcctccaccaggtgctccggtgggccaccggctcagtggagatcttcttctcccgcaacaacgcgctgctcgcgagccggaggatgaagtgtcttcagaggatcgcgtacctgaacgtgggcatctacccgttcacgtccatcttcctcatcgtctactgcttcccgccgccgccgtcgctcttctcggggcagttcatcgtcaaggagctggacgtgaccttcctcacctacctgctggtgatcaccctgacgctgtgcatgctggcggtgctggagatcaagtggtcgggcatcaacctggaggagtggtggaggaacgagcagttctggctcatcggcggcaccagcgcccacctcgccgccgtgctgcagggcctcctcaaggtcatcgccggcatcgagatctccttcacgctcacctccaagtcgggcgcggacgacgagaacgacgagtacgccgacctctacatcgtcaagtggacctcgctcatgatcccgcccatcgtcatcatgatggtcaacctcatcgccatcgccgtcggcttcagccgcaccatctacagcgagatcccgcagtggagcaagctcctgggcggcgtcttcttcagcttctgggtgctggctcacctgtacccgttcgccaagggcctcatggggcgccgcggccgcacgccgaccatcgtcttcgtctggtccggcctcctcgccatcaccatctcgctgctgtgggtggccatcaacccgccgtcgcagaactcgcagatcggaggctccttccagttcccctgatcgtacccatatatcatatatgagttacataccatttgttccagcagcagcagcggcggctagctggtggggagtaaagtaaattctgaccgttccctgtgggtatattaattaggtgtttttttcgtgttgcctggaaaatgttggatcatactagtagttcatttgttcttttgattctgttcctgagatgtttggacctggacaacatcaagtccaaaaattcagaaaaaaaacaataaa

SEQ ID NO: 22715 - DNA, 965 bp, Triticum aestivum
  Clone ID: PAT_TA_22715
acgcgtccgggcacttatctcggtgaacgacgagcattctgtcgtcgaagatggtgcacgtcgagctcgaccttgcggacgagtggtccgagtccgacgtctcggaagatgtctccgactccgaagtgggcgacggcctggactggctcgacaccgtcgagagccatgatggttcagcccggctatccgccgccttctcgaccgtcggaggcgcggcagcggcgcggaggccgaatgcgcacggcggcgtgctctcccgcccctttcagccgctctccaatcgcacgcagaagctcgcctcccacatccgggccacgcccttggaggagtgggaaggtagaatgaacgtggggatgtcaaattcggtaacgactgcaatcagggacagcataagggatacatcaattggcaaaataggaaccatgagaaggccgatcgtgctacggtggaacaggccattgacccaagaacacgcatggttttgttcaagatgttgaacagtggtgtttttaataatataaatgggctgcatttctacaggaaaagaggcaaatgtctatcatgcaacaaagatagatggccaggagctagcaatcaaaatctataaaacctctgtccttgtctttaaggatagagacagatatgttcaaggagattatcgttttagatatggttactgcaagcataatccccggaaaatggttaagacctgggctgaaaaggaaatgagaaatcttaaacgagtggcagcagctaaaattcgatgcccagcaccattgctcctgaagcttcatgtattggtgatggaattcatggggaaaggaggtggggctgctcctcgtcttaatgatgctgctttgtcggttgacacgctgcgtgaagcttactttgagattgttacgataatgaggacactttatcaaaagtgcaagctggtccatggcgatttgagtgtataacattct

SEQ ID NO: 22716 - DNA, 591 bp, Triticum aestivum
  unsure (1)..(591): unsure at all n locations
  Clone ID: PAT_TA_22716
gcacgagggtcaccttgactatttcttgnnnggtggtnnngccagagtggtggggtggtcgctttctccagggatacgttgtgctatctgacagggcaatcttgctgtcgttccggcaagctgaattcttcatcttcagttgccatagccttgcctggacccaggtcatcacccagcatataaacacctacatccctatccggggccatggtgtgtacatcaaagaagataacaccgttgacatgctttataacaacnacatatatgcntacgagctccgcaanccaggtcacgaaggagtttcggcggctcagctatcaanatgggcagctgcttgagctgcagccgcctgtcaaggttgattctgtctgtcctttctctggttatggcttcctcacgcagcttgaccgccggctcttgtgctcngtcnggattgngtcctngtggggataaatgctcatgcaactgcccacacntcctcatcancaccttcccaagtnaatcccaaaggcatcgangattttgcatcaacctgccgncggttaaacatgctgccaaacaatttgnctttggcacaaagcnttaatatgc

SEQ ID NO: 22717 - DNA, 821 bp, Triticum aestivum
  Clone ID: PAT_TA_22717
cccggccgtccgacgcagagacttacgcacgcctcctcgaggtgccgccgccggctcatccacgccggcgtccctcctccggcaaactagccgggcttgtccagtagctctagctcgtcctcttctaccccaagcctctgtgccagcagcagcaaggaagttagaagcatggagcccgaagagaaccccaaccgtccgccatcacgactggactgcataaagtacttcaatgcactatggtcctgctactcaccattccaccagatgcagaactattaccgctacggggtttttgacaactgctccagcaagtggcgcgatctcgtcgactgtctcacgctcaagacgaagtcgaaggcagaggtagaggagatgctcatggcgcgggagaaggccaggccgcacttctggacctaccggactgtcgacgaggcatcagcgaactggtggaagatgtacaagcacagggtgatgatgtcgtcgccgccaaagactgcaggttttcctgcgcctcctcccaaatctgctgcaccgaagaagcgttgattgtgcttttggtgcgctgtgcttattaccaccggtctttgttcaaacttgagttaccctgacagggtaaataattggaaccttggatggaaggataccctaatcatgttctgtaaagcatggcagccctctcggcggtcgttcgcatgctttgctctgctccagctatgatgttagctttgtgcctagttgcttattatcaggcataaatgttttggtttgagctgtggtgtgttctcattaatttttaaatgcagactagtcaatttcagtta

SEQ ID NO: 22718 - DNA, 1459 bp, Triticum aestivum
  Clone ID: PAT_TA_22718
atagaagtggactcttcctcccgcgacgctcccgtgggcgtccggggggcctaaccctagcgccgccgccggtcgctcccctcctccctcgccgccgcccgagggcgcgagcgggcaaagcccgcccgtcgcaggcggcggcggggctctctcgtctccgcgctcgaggggtacggcgcgggccggatgcctcagcccggatgcggcgcttggcgctgggcgcagcagctcgacggcgctccggcgtgggccggcgacggggcgtggcggcgatgcgacgggcagcgcggaggtggtgcgggctggaggtcggtggtggcggcagctgcatccggcggcgcgcccagatccgcctccggagccgcgggtcgcgggtgacctgggtcgcggtcggcctctcctgccatggctcgtgggcgggggggcggcgcggcagctggtggatgtgtgcgccgctgcccggtcgggcccttgcggctggtcggcgtcgtacgacacgggagatccctccggtggtcatccatggacgtggcggcgagcgctctgcttcctctgctacggccacgggccgctgccatggtctcgcgcggggccggacctatggcagggtggggcgaaaccggtggtttcggggcggggagctggttggaaggacgggagctccgttgcggagctgcccgtcgccggcccaagtggttgccggtcgtggccgtgggccattcctccccctccccccttccccatcctcatgtgttctcggttccggcgttgctcgaggcggaggtggttggccggcggtctcggaggcagtttgggtgcggattttctcaaagtctcggcctttggtgatcatcagggtggtctggaggcagagcggcggctctggcggcgggaggcacgttggtcgtgggctgaccgcgcggctcgggtgcgggcgggcagccacggtcgcttgggcggcatggctgcgggtggttggcggagcggggttgcgacggagaggttggagcaccggggttcaccacttgaccagtcccggtactggccgacggaggcggcgtccgcggacgtcgttcccctccctgcaggcttcgtcgtggtgctcccacctcctacccgtcactccgggtgaaaacttgatcttctggatcagacgatgacggctttctaaggtcatatccttcttgagggcgtcgtcttggagtccctgctttggtcgtgtccggctcatcgctcctcggttgattgttcatcttcatggtggttatcggcttatcattagggtgcttagtcgtcgttggggtgatgtgttcggtgctcggcacctttgtatctcgccttgggtgcgtgcgttgagtgtggtggtggagtgcgtttgtatcttactcgcatgtgttggcgatggtgctttatctataaagcggggggaaaccctttttctcaaaaaaaaaaagaccgc

SEQ ID NO: 22719 - DNA, 291 bp, Triticum aestivum
  Clone ID: PAT_TA_22719
acagctcacaaacgtcgcatctaacgtaggtatagaacaggggtttgggtctgctaaaggtcaataaatcttcggcgtctccaaattattcaaaccttgttcatgcctccaatggcttcttccgatcatgcttgtccttctcaagttcttttgccagatcaactcttatgacgcgaaatctctcgtgacatcctttaatattctggagttgcgttccaaacttctgggtttcaacatccttgggtatgagccatggtcatactgtccttcagttcttgacaattctccggt

SEQ ID NO: 22720 - DNA, 341 bp, Triticum aestivum
  Clone ID: PAT_TA_22720
gctgacatactgttaatggctggtggccagattctgtggaaaagagtgctcgctgatgctacagcgttgcaaccaaccatggtgtcgacgagagctctaatgtttatcgccgtttgacccccggaacatgaaggcacgccatggccatcctttgctggtgccaccgctggatatgtctcagaaacttttcgcctgtgggtttgttttcgaggaagtgtttgaagattggatgttggataaccatcttatactctttttttttttttttgcgggtgatcttccactaaagttattgcgggtgtaaatagttcgaagattatcaacgcggaataactttttgt

SEQ ID NO: 22721 - DNA, 630 bp, Triticum aestivum
  Clone ID: PAT_TA_22721
tacacctccgctgccccaccctgccgccatggtgtgattccgagacgctgagaaccccctacagcactgctgcaaggccgcgtccggtcttcccgctttccgcccctaggtttcatggttgttggctaccatactggcaacgtctgttgggctgtgcccccgctgtggcggtcgcttttcgtccttcctgtgtctccctttcctcctccttctgtagcgtcatttttcccccgcagcataaagtcccgggcttgaactgtgaactggcccatgagtaaggcaatgcatgctaagcccgatgggttacagattagggggtgctagctgatgttacagcgttgcggccatggcgccgacgagagctctaacctttaccaccgggccgttggtcgccgtctgtgatggcaggccatgcccacactctttctggtgcaaccgctggatgtctcgaaaacttttcgcctgcgggtttgttttcaagacatgtttgaggattggttgttggactaccatcttctacgaagttattgctggcgtatatttagtttgaagattgtcaacgcggaataactttttgtaatgagtttgtggaataaaaaatttatctcaataaaaaaaaaaaaaaaaaac

SEQ ID NO: 22722 - DNA, 969 bp, Triticum aestivum
  unsure (1)..(969): unsure at all n locations
  Clone ID: PAT_TA_22722
aatgcggccctgctttgtggggaatcccacgtgcctcagaaaattggaattaaatgaaggaagtttggaatatttacaggtggattcctgtacggcgttagaagaattggaagttgaaaattgtcatttgctcgtcgctatagagggcatacagtcacttggaacactcagatctttggtattgcttgtgaactcaagcatggaatctctacagctacattcgtgcacggcgctggaacgtttggaaattcagtactgcagttcgctcgtctcactagagggcttgcgatccctcgtgaacctcaagcatttgaaaatactctattcccctgccttgggttcccttaccccactggagagttatgagccaattgagggaatttcaagtcatagctatgagtctcgangtccatgatttgtctccccttaacgcgtcattctgcaagggcctcacctgcctccgaagcctaatgcttattgaattggatgcaacgaggctaacagatgagcaagagagagcgcttctgctcctcaggtccctgcaagagctctgctttgttgagtgtgaggatctcgtacatcttcctgcgggcctgcatggcctccattccctctagtcgttgaagatcataagttgtagtagcatctcagggcttccgaaggagggccttccaccttcactgggaaaaactgggagatctacgactgcagcgacgagttatcagaaggatgcagtcacttgcaacaagcaagctagaggtcgaaattgatgggtgctatgtgaactgatcgctgagtaactttccnaaggccggtttcacttcagaacctcgtcctcacgtggtcatgataacggtgttttacactcaacaatctcaacattttgttccccactcngttggggtcagaaatggggatcaagctgccggaaaagcctctaatttcgctgtcatatanaaaaaaaaaaaa

SEQ ID NO: 22723 - DNA, 462 bp, Triticum aestivum
  Clone ID: PAT_TA_22723
ctcagtgaatagtactgaagatctgacttgaccaagatacattcatagccaacccggccatgaaagctgccaggttacttctgtgggtgttggcggcttgcagcgcacatgtcgtcatctgcaacaccttcatctcgtacggaaacgagatggatcggttatcgctgcttgcattcaaggatgcaatcagtctcgatccacaacaaaccttcatgtcctggaaccatagcactcacttctgcaattggggaaggtgtcctatgcagggtcaaggctccacgtcgtgtcacttctctaaacctggacaagtcgaggtttgggtagggcacatctctccttcacttgggaaacctaacattcatgcggtctttggcccctcaacagggaacacactccgccgggggagatcccccccttgcttgggcacctggcatccgcctcccaaaacaaaaaaaaaaaaaa

SEQ ID NO: 22724 - DNA, 529 bp, Triticum aestivum
  Clone ID: PAT_TA_22724
cccacgcgtagggctttgaccggcccgccgcccaaccctgacaggacgatgaggcggaccacggcgttgctgctgcgccacggcggcggcgggatcccgcaggcgctcgccgacgtgctcgtctgccccctgtccaagaagcccctcaggtactgcgaggccagcggctccctggtcagcgacgccgtcggcatgtccttcccgatagtagatggaattccttgtctccttccgaaagacggcaagttgctcgaggaccaccagagggaatcaggacatgaaaccagctctagggattcctctgattgaatccaccttgttgtacaagccggcaacatcgttctgtatttaaaaagtaatcgagatggaagcaagagtatgtgctgtcctcaaactgtttcttgtcgccgtaaatcattgtcacgttgatttgtactgactattttgtacaatggaaataaaattattacatggtattgttcgtaaaaaaaaaaaaaaaaaaggcccctacttttcttggtgaacaact

SEQ ID NO: 22725 - DNA, 465 bp, Triticum aestivum
  unsure (1)..(465): unsure at all n locations
  Clone ID: PAT_TA_22725
ccgacctgcacctggtcacgcacgcctttcttcagtgtatttccaaaaatattgggaggcaattcttctctctcagttcaacaaaaaaattaacagcagttccacctatacacgcgtggaatgaaacttcatatgcgcgcctgccgcagatcattaaccatgtgcccaggttgtcggtcgtcctcccgccagtgcctcaccatgcctggggttgccccttctctagcacgcagctgcctgctgtgtgtgcattatgctttatgccgtgtgagcatggccgtgtgcttgcgcgtggtgtgctaagtgcgctatgcgttccttgtgtgtttgtgttatgcgtgttggtgtgcgtgcttgggtatccatccataggtaagtcctgtgcgattgctagtgctgctattgttggatgcttttccctggggcaacgtcacaatgttatttctttccccnaaaaaaaaaaaa

SEQ ID NO: 22726 - DNA, 2461 bp, Triticum aestivum
  Clone ID: PAT_TA_22726
ggccaccgccgctctgcgaccccgcattgccccacgacacgcgcgccgcggagattgcgtccctcccctcctcgctccggcaggcggcagcgcatgcccgccgcgacgggctgacggcggcgcagtcggcgatgcggttcacggcggggggctcgtcgacgcggtcgtggcagcccaagccgacggcggacaccacggacctgcgcttctggctgacctggcgggtggcggtgtgcgcgctctgggtgctctgctgcgtcgccgccgccgcctacctcatctggcgccacgagggaccccgcgcgcaccgccgccccggcgccgccaagcaggacacggcgcggcgaaggccggacgggctgctgtacgacgacgaggcgtggcgcgcgtccgcgcccgacatcaacccgcgccggctgctggcctgcgggctccgctcgttctgcgcccccttcaggctcctcgtcgtcctcgtcatctcgcgccgcgccaacgtcttctactactacaccgagtcgtcccggcctttggtgaccgacatcttcccgccttcgacgaccgcttcgatcttcgtctcctgctacgtcctcttcagccatgccgtggcggcgatgtccgacgccgagcagggtccctacgccgtccacggggctgccccgaagccgatcgtcgacggggaggacgacggcacgagggaggtcgccgggttctgggggtacctgctgcagatcatctatcagacaaatgcaggggccgtgatgcttacagactgcgtcttctggttcatcattttcccattcctcaccgtaaaagattacagcatgaattttctactgataggaatgcactcggtcaacgctgttttcctgctcggcgaagcatcgctaaatagcctgcgcttcccgtggttccggatcgcgtatttcttcctttataccgcgctatacaaagtttaccgtaggatctttcatgtgataggaatgcactcggggcccgctgttttcctggtcggcgaagcatctctaaatagcctgcgcttcccgtggttccggatcgcgtatttcttcctttatacagcgctatacgttgttttccagtggatcgtccatgcatctactccaacctggtggccctacccgttcctcgacctctcctctaatctcgcgcctctgtggtactttgcggtcgcgttcatgcaactgccctgctacctgattttcagactggtgatgaacctgaaacccccccttttctccaagcatttcccggatagcatggtcttaggatattagcatcggtgaacaaacatccatgccggtttttttccttcgaccctccacgcgaaaaaaggcggtgcgaatcggcaggaagaacaacaaccggacaatggcggcgtggcagtaaaacgggtggtgtggcagtagattgtttgcaaaaaattttttttttttatgtatttcctcaagttcatattttcaatagaaaactgtaaatatcaggttttacttccacaaatgttcagaccagcagagggtcaaaacgaaaattaacaaaacaaacatggcacgcgagctagtgttcagtagtcacctttggcatcatgcttgtgacatccgctgcagatgaggtatgcggaagatgttttattcaggaaccgtgccgctctcttcatttggcgcagcttgatccgaagatacaggtgcgtgaacagcgtcactcccttcattcgagacagcttgatctgaagatacaggtgcgtgaaccgcatcactcccttcattcgagacagcttgatctgaagatacaggtgtgttccctacatctacacttgtagcagcagccgcgagaacattttttccctcttcctggctaccagcatcaatatccatgctacaactggtattgtcctggccatctaatttggatgaatcgaccttgtcaatggctccctcattcacagtaacggtgtcaccactctgagcgttagaagtactctgttcaattgaagccccatcgttatccactcgagtgtcaggcaatggaggaattggacctacaagttctccagctacatctgcactgtccatatccatctgatctccattgatttcttttcttcctgcagcttcttcatcagtaaccttagttgtctgtgacgattcctcttcaatgtcatgattcttcctctcattttcttcctcagcagcacgatttcgagctgcagcttcctcctcctccttagcacgggtttctgcctctaatgcctccttagcacggttttctgcctctattgcctcctccttagcacgattttctgcctctaatgccgcctccttagcacgcttttctgcctctattgcctccttagcacgcttttctgcctctattgcctcctcctgtagcttaagtagcctcttgtgctcctcaagttgttcaggatctcggtcccgacccggccggc

SEQ ID NO: 22727 - DNA, 663 bp, Triticum aestivum
  unsure (1)..(663): unsure at all n locations
  Clone ID: PAT_TA_22727
cagaagtcagtgattgaaaattctactgcaataaatcataaggatcattctttgaaaggcaaggctccaatttattccaatgctgagatggaatctatatcttgcttgccgtctactagttactctgccatgtccaagttggaaaatgagacgctaattgattttgggtccggtcaaatcaaggtctacgcggattctttccacaaacatgcatttactacgctcacctactttgtgcccctcctctaggcacaagtgatcatctaccgtccattgcaatctctgtggctgggacgggacacgtggcatcatcctatccgacaggggcggcgctccaaacaatgaaatttggcttccccaagccacccctagctccntgcccgctacgcattccacctcgccccgcgtgntcccctccgcacatcctccggaagaatccttctccaccaaacaatgggggttccccctngtatgcccccaccccctcgcgcttggcgcgggccgggcggtgctcggccggcttcgtcgggaggcgatccgtccacgcgccaagtcgcggcaaccctcgccattatcaccnagacaaaaacncaatanaancaggtttccatnttaacccaaagcggantttattacnngatgatcaccatnncaccaaaaatt

SEQ ID NO: 22728 - DNA, 897 bp, Triticum aestivum
  Clone ID: PAT_TA_22728
atagatctgagaaagaagagaacatgaatctagcggacggaggtcatgtagtattcactaatagatgatagaaccacatattttggaaattccttgacaaaaaacacaagagcatcattgtttggtcaattgcaggtcaatgttggcactggccagatcaagcaggcagtggcgacactagacgaggcgtccttgcactgcaaggctgccctcgacatatgtgaaaagtttggcgagttaattcttttcctcgaatcaaacggaaatctgaaaactatcaaagagataccaaatgatgaatatttcagatgtcgacaggcatggtaagacgtgttttgggtaggttgactatgatgtgctcatcgttgactccaccaccggtgggttttcaggatggtacctcaagaatgaccagacctgtgagcacgccgtccttgcattcacccttgggagtgaagtagagcatctgctgtttaataagagccttctgatcttcgtactataaagtctggatgtgatggccattgtgcttactatcaaaactgttacttgatgagaacattctaagctaattcaagatatgtgcttcccccttgatgaattattatacatacttcagcaggaaaaccgtgtttcacctgcccggaacgttgatgcaggtgagcaggatgttaaaacttcatatatgttgttgctcatcggatataactataacatgatggtctcagtttatttttcagagttcgaaacctatattagtcatcatgagagtgagatttgtaaattccaccttgaatcagtgaacactttccctttgctgtacaatttttttgttcttatgatggtaccatgcttgctaattataagaggtacaaataaactattcctttgtttgtc

SEQ ID NO: 22729 - DNA, 739 bp, Triticum aestivum
  unsure (1)..(739): unsure at all n locations
  Clone ID: PAT_TA_22729
caaggctccaaatatgctgaataagactaaggaatttctgcagagaaggtcggagttccncatctctgatttggggttggaacccgcntacattgctcatcgccccgtaatgctctcgtacagcctggagggccggctcaggccccggtgctacgttgtgaagtttctcaaggaaaacggattgctacatcgcgaccgggactactattctgcagtcgcggtgactccgaaggtattcatggagaagttcatatgcccacacaaggaagctgcaccgcaccttgctgaagactatgcagcagcttgcagaggggaagtgccggctagattcagatttacatgaaccatgaccggcatgaaaatgggtatgttcattttgtcattcattaagagaaggaagcatagcactgctatgaacttgtccttcatcatgtccttttgggactcacagtccgtgaccggggcgtccggcgancacgggcatccctccattgctttggatttccgctcactccggtgctctctgttgcgttatggcctgtgctggctcccctgcttccttccaacctctccctccctggcaaatgaaaacagntcccatttccggcaatgaagatgatngaacctccaaaattcctttaagatgaaaacctgggctccttttcccngggaaataatttgtgtttgttgttggcaattggncacgtgttgaacatcatacactaaatagatattttng

SEQ ID NO: 22730 - DNA, 1530 bp, Triticum aestivum
  Clone ID: PAT_TA_22730
ccacctcctcggcttcgtctacctcctcctcctcgcccacggctacttcctcttcctcgtccgccgctggtacgagaaaacgacatggatgtacatttctgtccctctggtgctctatgtcggcgaaaggatgctgcgagccttgcggtcgaatgctcaccctgtcaaaatcctcaaggtgttgcttctacctgggcgggtactgacaatacaaatgtcaaagccctacggatttcgatataggagtggacaatatatctttcttcagtgcccgatgatctctccatttgaatggcatcctttctccatcacctcagctcctggagatgactacctcgctgttcacattcgcacaaacggagactggacgcaagagctcaagcgcatatttgtcgagaactacttctcgccgcacatgaacagaagaacttcattcagcgagttaggcgcggcagaacctagacccactcccgcaccaaaattgctcgttgatggtccatatggcgcgcctgcacaggatttcagaaactacgatgttctgcttctagttggccttggaattggagcaacaccgttcataagcattctaaaggacctacttaacaatattaagctagctgatgagctgatggacttggcaatggagactactcaaactagtaggtctgaagacagtgccaacagcttcagtgtctcaacagctagcagcaacaggaagagatcatatagaacaagccgcgcacatttttactgggttactcgcgaagcccatgtcgtttgaatggttcaaaggagtgatgaatgaggttgccgaaatggacaagaagggtgtcataccgttgctcggggggcggtcgtgcccccgcgccacgcgtcctgcacgaacaactctgttgtcgatggtccaagctctaaaccatgccaaacatggtgtcgacatcgtgtcgggcaccagggtgaggacacactttgccaggccaaactggagggaagtcttcaccaaaatcgcagctaagcagccgaattcaacagttggagtgttctactgtggcgcgccgacgctggccaaagaactgaagaacctgtcgcacgagatgagccacaagacgtcgacgcgcttccatttccacaaggagtacttctgatgggaagaagcattgttcttctgatctgcatagcgttaggcaccggtaaagaaggaggaattttttgcacagaaacaaagcaaactgacctctctctcttcctgatctggaactgtacatagtataaagaagaacagcctgttaggggagggtagttagtgccatttatatattattaacaaaaaagaaagtaaagcaaggctgctgtatccaaaaggagaaggaaggaggcagggtaaagagttgggttaaatttcagatatactaatatacatgtacacagtatagttttaggtagttacgtatgaaatgctagctaaagcatatttacaagggccggaggctgccattctgaatgtaaatctaaaaagcaaaaattcaggtg

SEQ ID NO: 22731 - DNA, 384 bp, Triticum aestivum
  unsure (1)..(384): unsure at all n locations
  Clone ID: PAT_TA_22731
gcaggccgacgccgtgtacagctccgccgtccagttcgatgattgatcgcgtcggatgatccatggaaggcatgcacgtccatgcatgcaaggatttgttctgccaagctacatagctgacacgttgcttgtgacgtcctgtgcgtgtcctcgtcgtgtactacctacttactccctttgtccgaaaatacttgtcatcaaaatggataaaaaaagtgtatctaaatgataaatatttccgtacgaacagagtacgagttatcatttatcgccatcttactataaatttacatttacaatgttatcatgcaaataataaaaatgtttgtaatatctactgtattatatacacaangtttactaaaaccgttcaaataaataaac

SEQ ID NO: 22732 - DNA, 1820 bp, Triticum aestivum
  Clone ID: PAT_TA_22732
cacggcgccccccggcgcccgccttcgcccctcgcttctcttccttagcttcgctctgcgccgcccctgctccgcctacgcccgcgctcgccctcgtcgtccgcctccgcctccgtctccctggccgagctcgtcgccgtcctccgtagcggctcgctcggtcgtcgtcgcagctccccccgccggaggttctccgccgtcctctgatccggcccgccgcgttcgtccccccctctcaagcaaaaacgtgtagggatggggggagaggcatacgcacactcttcgagagagaggggtgcacaaacaaaacaccaagagtaatcttgagaccctggagaagactccgggaaaaaagagacaagcacattaaaaagagatagtaaagaagaggtggcaaccgggaagattgtagaggctcgacgtcagcacatctccagatcctttttctaaaattctttctgcgcaaagagattccccccctgagactactttgctagaggcaagcacaacatctcatcatagccctcctgcttctgacagtgaccaatcgggagctccagcttaataactgaagcaacctgttcagcttgttgggtaagacggaatgacagtggttagagtggatggagctagtgaggacaaagtggtacttgaagaacccaacgaagataacagcaagacatctgaaattgagggcaaaacaaatgatggagatgctgaagagaagaaagcagtggatgaagctggaggtgaagataaagtcagcagggatgatgatgagaaaaatgatgaagctgaatcagggaccaaggatggatcatctgagcagaaggatgctgataacaaagggcagtcatcatcaccgacacctcttttctccttcaccaatctgtcaagtggccaaaatgctttcacaggactggctggaactggattttcaggctcatcattttcatttggctcgggctctaaagacagctcaaatgctcccctatttgggctaaagagtgatggctcatcattcccttctttgctcctgggtgcgggagttctgccccatcactcgccaactgcagcagacgcaccagaagaaatttgccatgtcagagggcccagttgaaaccggcgaagagaacgagaaggctgtattcactgctgactctgctatatacgagtacctcgacggcggctggaaggaaagaggaaggggtgaactgaagctgaacatcccggtatctggcggtgagagatctcggctcgtcatgagggccaagggcaactaccggctcattctgaatgcaagcctttacgacgacatgacgctgaaggacatggacaagaagggcgtgacgtttgcttgcatcaacagcatcggcgaatcaccgagtgggctcaccacatttgctctgaagttcaaggataccggcatccgggaagatttcaaggctgcagtggagacgcacaaggcgaagaaggcttcggacacgccaaagactcctgagggctccccgaaggcgtccgacgtttgaaacccaccccggtgttccgtgttttgatgtgtatgtgtcggagcaaggagccgaggcgttccttgctcttcctggagtcttataaagttaaaacatatcgtacccatgtcatatggtttctggcgtgtcctgtggctggtctggaacggtgggtggtctgttgaactttaattaaagtcataaatcttggtaaactggagaaatgggactcgtttcaggctatatgcttcttctgctatgcgatatgtagtatattcagccttgtgtgtgtctgagtcatcaccacatcac

SEQ ID NO: 22733 - DNA, 903 bp, Triticum aestivum
  Clone ID: PAT_TA_22733
tcgcggccgcggccccgcgcggcggtggccggtgcccccgacacggggctccaaggcccttcttcttgaccatcgccgcactctgaagggccgtcggcaggagaaggcggcgaggcgcggcggggttcgatgtcgatcctgtgggagaagagccgggcgtggcggtggctggtggggcggacgcgggactccaagcccttcttcttcaccttcgcggcgctctgcggcgtcgtccccggcgtcgtcggctacggcgtcatgcagctcaccagctcccgcaacgacaaactcgaggcccacctccgctccaacgcccgaccggagaccacgatgatggggcaagtcaacagggagagactggcagagtttctcggagagatacaaaggaaggagaacacaaatgacagatacgttgctgctcttaaaggcgagacgctgacaaggaagcgctatgaacgtatccagcccgtcccccagcaggctgcacaggagaatgcgaaggaccagcaagctaccaaggagagcgccaaggcaaagtgaatggcgcatgtttgatgatcggggtgggtgaaacgtgcttctactaaatgaatataaatgggctgtagctccaaaagcttcatgaattgcgaacctttttttgtgagcatcattatctactcgcctttcgtttagtcgtggcactgctccatagagaaaaacagagaaactttggtgacggtgttgaatcttgtaaatgttttacctgcgtgttacgtggtaatattctaggaaccttcacactgttcttttgatatcctggtgcgtcgttgcgtcatttatttaactcacatactaacggatccggccttacacttgttacttgaattaacccatagggaaaaaaaaaaaaaaaggccccta

SEQ ID NO: 22734 - DNA, 565 bp, Triticum aestivum
  Clone ID: PAT_TA_22734
atttatagctatggcattgttcttttggaaatgttaacacgaaaacggcctactaatgaagaattcaatgatggcttgacgccccccaagtttgggggggcatcactttcccgaaccccagaccttcttcaccccggccttgcttctggtgacgggagatcagcgtgttgatcattccccaaacttgcaagagcgcaacacatttgcactgaaggatatgtgtgctctccggctccttagacttgggcttattatgctctgcggaatcaccgaaggatcgccctgcgatgcacgatgtctacggcgaagtaactgaagtaaaagaggcgtatttctccatgggacaaccgaaggcaacgaccctacatattgaaggcaaagacccgccacgaagatgacgccgtgcttcggtcctccgcccgcagcatgtcggcatgctgctttcccttttccgtgtccgtatgcctccgggctcggcgcactgtgaccctttgcttgcttacgcgcgatccaactaaggaaagttttaaaatccttgccaagaaaacagaagacagaaaatgaa

SEQ ID NO: 22735 - DNA, 470 bp, Triticum aestivum
  Clone ID: PAT_TA_22735
cccacgcgtccgcccacgcgtccgacgaagtccaccacgcccccgcccgccccgcagccggccggcgacgatgtgcaccctggagcggcgcggccgggtcttcgtcctcaccctgacgggcgaggaccagcaccggctgggccacccgctcatcgccgccatccgctccgcgctggccgaggtcctggccgcggcccaggcccagccgcagggcccgggggcggccctggtgacggtcgccgagggccgcttcttctccaacgggctcgacatcgggtgggcgggcacctcccgcgcgcggctcggggagctcgtcgacgcgctccgccccgtcgccgccgacctgctggccctccccatgcccaccgtcgccgccgtcacgggccacgcctccaccgacggctgactcctcgcgctctgccacgactgccgggtggtgcgcgccgacccgcggcgtgctctacatgagc

SEQ ID NO: 22736 - DNA, 681 bp, Triticum aestivum
  unsure (1)..(681): unsure at all n locations
  Clone ID: PAT_TA_22736
ggatggaacgaacatttttgctatgatcaacaatgaaacaatcaattacagcagaaaggagaaaaagaatcagctcgacattttctctttaaccatggcccggagagaaaaaaggaaaaggaaggggaacccggacccactccacggccatcgtccaggcagtgcccccggccagggtataccccgaccttccattcgctcccctcacattccaacccccaaaaaatggtgccntcggcgaccagtctgctgctttgcgaagtcattggcaaccaggcgacttcgccctccggcttttcagctgaaagaatttaatcacacgctggcagcagagcttcaacagagccacctctgtgaacccaaaggatcgcaaaaagcaagaatgaagtatcctcaatcctctgtgtcacgggaaccagatggctcggggaagatctccttagattgcctcctgcgggacgaagaatgatcaccattgctcccgccggatgatttgattgtctctgaccgcttaaacatgttatcatcccttgaaggaccaatctctgacgagctatgccgccaactcccgaagaatgcagcattccacgaaccccttgaagatgttgctctcaacctggccgagctagagccattatcttctcttaccactttcaagggattctcaagtgcttttaggct

SEQ ID NO: 22737 - DNA, 185 bp, Triticum aestivum
  unsure (1)..(185): unsure at all n locations
  Clone ID: PAT_TA_22737
attttcccccacaccctgtccctgacttcctgtaaattacangcagagtagtaccagtaggattgcactcttgctgatgcaggtgagagttgtcccgacccgaaacttgtttggccggactagcgacgagttgtcgctgtaaatcctacgaggaaatacgggactttgtcgccaaaaaaaaaaaa

SEQ ID NO: 22738 - DNA, 714 bp, Triticum aestivum
  Clone ID: PAT_TA_22738
gccacatcagatgagatcctcaaggagatcgcgaggatcgacgccgccggcgtccagcgccacgcggcgagcatcaagcaaatcaccgatctcgcgaccaaggtcatcggctacacggaggctgtggcgacgaagaaatacgagaagacggtcgaggttgggcagacgtccctcaaggtctctttgctggtgctcgtcgccgctggtcatcgggtccacttcactgtgcgtgatccactacgccggaaggaccgccgtgaccgacaaggccaagaagctggtggataagaagaccgctgagatcaagatgtgcgtggaggacaagctgatgaagatcctgacagaggacgagcaggtgggcatggagcccgacaacaaggctcgcgtggctgccctgcaggagtgggaggagaggctcctcgccagggaggaggccctgaagaaggaggaggaggagttggaggggggcaaccagaacaagggtccctgattaacacaagtgtggcatcatcggcttctgcacataggatgtatcctgctaaaggttttgcgtatgttgtttcgcttgatggccttttggctgccactaatgctctctcaacttgtatgggtctaagttcggctgagttatcaaactctgatgaatggagttgtgttatcttctctccttaaaaaaaaaaaaaaaaaaaaaaaataaaaccccccccccccccc

SEQ ID NO: 22739 - DNA, 1331 bp, Triticum aestivum
  Clone ID: PAT_TA_22739
tctttttctttttttttggtgttcttcgcaagcgcaagtccagaccttcgacggtgcttcttttaacgttagaacccgtcgtacatttgaaagctcaagcccagacaatagatgttgcctgttttaaattccatgtcacccgcaaagagaacatcacggtcagcttagtgtatacctttcctgttctgttctctgccgaaagcacggtaatttcattttaacacgcgatatatatacatccaattacagttgctagcgatcaaacggaacttcctttgagggttcccaaactactgatctcctccttgatgcctgggtgtgctatcaaccttaatctcaagaaggctctcaacaggctgcctgcacatggggcatttgttggtctggaaccttaatgtctgagcacactccctgcataggcacatatgcctgcatggtagaaaacctgtattcagctggttctttcttaacaaacacagcaaattttcccgaagccttcgagtcttcagcatcatgtgccgtgttctaactcttgcttgcttggcacacccacttccactttgaatgcgagaggaaatacacgatcctccccaaccttagttagctcagattcctcaaacattgagagcttaattccagttccacttggttgcctgaactccggaccatgaccttcctttaaatgtcaccagtcgacgaggtttgagcaaattttcctttgtacccttcaggacacagtcatcaccttcttgtgcaaagaagtaaactgttatactcccgggggcgtcggcgtcgaaggagaaggcgagcaggtggccgccgtcgtcgtcgcggtccagccgcagggtatgccccttgacgttgacgccggcgctcaccgcaacggccctgtgccgctccacgtgcgtggggaacggcaccggcggcggcgcggcggcgcccgggcgccatggcgggtactggtggtagtacggcgggggcaccccgtgtagatgaggccgcggcgggggcaggttggcgcggcaggggtatgccgcgctttgactgtgcacggcgcggccgcctcaccggcaacaggtcgcttttgtgccagctccacgtgcgtggggaacaggcaccggcggcggcgcggcaggcagcccagggcagccacggcagggtactggtggtagtacaggtgggggcaccccatgcagatgaggccgcggcggtggcaggttggggcggccgctgcttccggcgttgcccatcggcgcgtcgccgtcgccgtcgcgctgcgatttaggtttttgcttgacttttagtcgagttttgccggggggtaaactgcg

SEQ ID NO: 22740 - DNA, 583 bp, Triticum aestivum
  Clone ID: PAT_TA_22740
gctcggcgacggcggcgaggccacggtcgccaacgagctgaggctgtgggacctgatgctgcacgaggtgaagctcaacatctcgccggggtcgtcgtgccattgctcggagcccgggtggttcagggtgtgcttcgccaacatgagcctgggacacgctggacgttgcactgggcgaggatgagccgcttcatggacaggtggaacaaggcgacaacgctgcaagaacatcactagaccagttcttcaaagaaacaaaaaaagatacattagacaaagtaaaagtaattttttgtggcaaatccattgccattgtgaggaagtacgtaatcgatcctggtgacacatcaattttgtatggggattttttttctctcgaatagagagatgccccccccatcttctatatggcggcgttcccaagccgtgaaatcgctctgcttggccggcttgcgtttacaatcttccaagcaataccccattacgggtacatgaagctcaagatgcccgggcctaatgggatcatcactctcgctaagtgatccggacatagcactccgcgccgaaaacaagacagccgcat

SEQ ID NO: 22741 - DNA, 1027 bp, Triticum aestivum
  unsure (1)..(1027): unsure at all n locations
  Clone ID: PAT_TA_22741
cgcccccgggctccgccccccttcccctcccccctccccccgcccctcacacagcacccaccagaccgctacgaccaagcgcggtcccagctccaaacaccctgccgggtggcgcaagtgccctcgccgcacccccgcccgccccacgccccggttcccttgcaaagcaggccgctcgcccttcttcgcgcgagcagttagaggatgatgatatggccggagaggatgagatcactgggcactggggccccgactgatcaaacgcctgcggaggagggggcaagccgaccgggaggcggccagccgctcgagaagcagaaacgcagctcacctgaatccgctacaagtacaggtatcacagctaagagttcaacactcctcactggttaggcggcttgctgatgttaatcagaaatacaatggtgctgcagttgacaatagggtattaaaagcagatgttgaaaccttgagagcaaaggtgaagatggcagaggactcggtgaagcgggtgacaggcatgagcgctctgttccctgcgggctccgacatgtcatccctcagcatgcccttcaccggctccccatcggaggccacctccgacgcggccgtcccagacgaccttagcgcttacttctcgacaagcgaggccggaggtaacaacgggtacatgcctgagatggcttcctctgcgcaagaggatgacaatttcctcaacgaggccatggataccggcaagatgggcagacctgattcgctgcatcgtgtggcgagcctggagcacctccagaagaggatgtgtggcgggccggcttcatccggatcgacctcgtaggagcagccagctccttggggccaggaagtcccaagaaattattattgggcagacatatcttggtggtggatgttgataatcctatgctatttgttctttggctgtgacctctagtgtcctcgtcgctatgtttcctgaaacacagcagatttagtaaaactgtgcgttgtcataccaaaaaaaaaaaaaagatcn

SEQ ID NO: 22742 - DNA, 795 bp, Triticum aestivum
  Clone ID: PAT_TA_22742
ctggcaacctagcagcaatggcgtcgtcgttgctgaagccacactcccactgctccgctctgccgtccgggagaagcagcggcctaaatggcggcagctgccccgcgacggtgcacctagtgcaggggccagccgggaggaggggcgacgcgctgaaggcgagggcgttcccgctggacgtggtgccgctgatggtgacgatggtggagcacgtcgacaaccagagggactgggtggtcaccaagtccatatggcatctcagcgacacggccatcaagagcttctacacgttctacgccatgttcacggtctggggcgtctgctttttcgcgaccatgaaggatccattctacgacagcgagtattacagggggcaagggggtgatggcaccgtgcactggtactacgaccggcaagaggacatcgaggcgacggcgaggggggatctgctgagggaggagctgcttgaggagatcgagcagagggtcggagggctgagggagctcgaggacgcgggaatggagggggagcttgaggaagccaagtaaccgtgagacccaagcgtatatatgcatggattggcaaaacagcttgccttcctccgctgaagttgagtgaaaagcttggactcttcagtcttcagtgtagtcccgtagaaactacacaagtacacatagcaagatcttgtggcaaattgtgcaatatacatttgtagtacaaagcaagatatacattctccactagaattggaggcacgccattccttgctatgccaatcgaaatcacagattgatc

SEQ ID NO: 22743 - DNA, 818 bp, Triticum aestivum
  Clone ID: PAT_TA_22743
ggcacgagctccctacccccccgcccctcgccgtccctgcagccacgctcccaccgctccgctcggccgccccccagcgacagcccctgccgccggcgggccgcgagcccacggccgcagccggtccggccgttctaagagatccggttcagcgaaggtgagcgccttgccgtcgctggaggtggtgccgctgatggtgacgatggtggagcacgtggacatgtcgcgggactacgtcgtgaccaagtccatctggcatctcagcgacgcagcgctcaagagcgtctataccttctacgccatgttcacggtctggggcgtctgcttcttcgcgtccatgaaggatcccttctacgacagtgacacgtacaggagcgcgggtggagatggagccgtgcactggtactaggacaggcaggaggacctggaggcgtctgcgtgggagaggggccagcggggggagcgcctggaggagattgagtaggggggggggggcctcagggagccgaaggaaggggtcgcaaagtgatggattatgctgtacgggggttacaagcagtgctctaatgtgaacatggagcgcaaagacgctcggatttatttgcagtcctcggcaaaacagcatgcctgccaccgatgaagttgagtgaatagcttgtactcttcagtcttcagtggcaaattgtgcaatatacatttgtacaaagtaagatatacattctccactagaattggaggcacgccattccttgctatgccaatcgaaatcacagatcgattaacaccaagaagcaaaaaacaaaaaaccagactaaaaa

SEQ ID NO: 22744 - DNA, 740 bp, Triticum aestivum
  Clone ID: PAT_TA_22744
agtgaaatgcccgcttcctgagccatctatactgcatgtaagccatgtgccttgtttttgaatgatggcatgtttgtattgtgttacgcatgtagtccactacaagtagcaagaaccacgagagaatatgatatcactaccacaaagacaaacatggtagcgaacttgtgtagcagaaatgcagctgcgatgacaatgccggcttttatatatacttgaaagtttgaattttcctctacatatatatatttccagcaccagatagtacaagcatattggtccccttactggctttactcgttgattgttgctaggatggaaggatatggcaagagaggatgtctacagcgggcgggaggccgaggacagacctgccggtcgtgaaggaagggtcgcagctcgagcccgacagcagcaccacaaggtcgaggtctgcggtccggaggcgcgccatactgccctccgtgagcgcccctgagcataacatcctggcgctgcttgacgagtgcgacgtgcctgagagccagcgtcctgctgaatgagcctggataccgtctcgactgtatctgtacattgctgtatcttcaatcaccgccttcaatcaccgccgtcgctacgagctgaatacagccgtgttaaactccggttgcaactatagcaacaggcttttgtgtgggttgtttctatatatatgtacacactttatatacgagtgaaaagaaatctacaggtgcatcgtc

SEQ ID NO: 22745 - DNA, 927 bp, Triticum aestivum
  Clone ID: PAT_TA_22745
cccacgcgtccgcccacgcgtgcgcaataaagtcaatttttcgggattttcgcccgatggggaaaagcggcgggagacaaaaaaacccgttttccgaagcttcgagtacagtccggttcccgccacccgcgagaaacagttttccgaagcttcgagccagggcggttggcggcagccgcggggacgatggtcgggatcttctccaggttctcttccggcgccggccaccgccgcgccaagagtgccgtggaggttgtggagacattggcgcccaacatggagaccggggagtctgacccggcagctgatcctggagatagcccgcacggcattgaggtcggcatcgagttcaagccggtggagcaccctgtggagcctgtcaaccttgaccaaccagtgaaatgcccgcttcctgagccatctatactgcatgatgggaggatatggcaagagaggatgtctacagcgggcgggaggccgaggacggacctgccggtcgtgaaggaaggattgcagctcgagcccgacagcagcaccacaaggtcgaggtctgcggtccggaggcgcgccatactgccctccgtgagcgcccctgagcataacatcctggcgctgcttgacgagtgcgacgtgcctgagagccagcgccctgctgaatgagcctggatgccgtctccactgtatctgtacattgctgtatcttccatcaccgccgtcgctacgagctgtggatacagccgtgttgaatctccggttgcaactagcaacagccttttgtgtggattgtttctatatatatgtacacactttgcatacgaagtgaaaagaaatctgcacttgcatcatcaaaaaaaaaaaaaaaaaaggcccctaaattgggttggttggattcttttgagcagcactgctgctatgtccttcccttat

SEQ ID NO: 22746 - DNA, 557 bp, Triticum aestivum
  unsure (1)..(557): unsure at all n locations
  Clone ID: PAT_TA_22746
cccgcatcgacgtggacgattgatgcctatcccgcatcctcgtcgagtcggcgaaggacgacacctgcttgaccagatgggccatgtccgggactgggctccgccggggtggtactgggaggcgctaccttccggggggcgtagcttggtgaggagccagcccgtcgttgacccgatccttgtttggtggcggtcgcgtgggccagtgacggtgccgaggcttccagacaccgcggacgtggtacgtcaccgtgtcagcgaggaggacgagctcgtccgtcgctacatggttgcgttggagggcaggttcgagaatacctagcaggttcttcagggatctcattggagctatgatcctgtgatggttccttccctttgggtgtccaccgcccgcgccgatacccgtcgggacgctacggttctagctgtacttgcgatatgtatgatagtaatcaacgtgtattagtgataatattcgacgattgaacggacacatggagattatgttgttttctaaaattgaatgcatcctanttgaatactacttaatttgcgaa

SEQ ID NO: 22747 - DNA, 552 bp, Triticum aestivum
  Clone ID: PAT_TA_22747
tggtgcaccagctgaggaagtcgtgcttcgccgcgtccatcgtcagcgtggaggacgacaagcccaaggagaagaagacaccctgccaggaggcctgcgagaaggcctggaaggacaagtacgagaaggcctgcaaggagaggtgcgagaaggcgtgcaaggagccgtgctgcgacgactgcggcgacaaggggacgccgtacggcggccacgggtaccgctgcacgccgggctgctactccagcccctgcggcctgcccagctgccactactacagctccggctacggctacggctacggcgtgcgtgcgccgcccctgggatacacctgggtacgagtagaggtcgcccggaaccggaggatgatgcgccatgcgccgcccttggagcactgtcatgggcgcgtatgtacctggactcgttgcgattttaccgtatgtgggtgtgcctgtgtgtttaataccgttagtccatatgcttcgtgtcgccaatggtggcttgttgctttgggcttctgccctgcgccctgcctggctcctctactaaaaaaaa

SEQ ID NO: 22748 - DNA, 1244 bp, Triticum aestivum
  Clone ID: PAT_TA_22748
cgtccgccgacccctggggcgcaccctcagtcgacgcctaacccgcaccctgatccggcgcaccgacccctcccaccgttccctgccctccgctctctaccgctgttccattcgcttccctcccaccgcttcctcctcctcataaagtctgccccgttcgaaaatctttgcctccagatcgtgatcctgcggcagttcttggatcgccagatcgatcggatggctgccgcggcggtggacccgatggtgcttgggctgggaacgagcggaggtgcgagcgggagcggagtggtaggaggcggtgttgggagagcaggaggagggggtgcggtgatggaaggggcgcagccggtggatctcgccaggcacccctccggcatcgtccccgtcctccagaacattgtgtcgactgttaatctggactgcaggttggatctgaaacaaattgccttacaggcccgtaatgcagagtacaacccaaagcgttttgcagcggttatcatgaggataagggaccccaagacaacagctcttatatttgcttcaggaaagatggtatgcactggagcaaagagtgaagaacactcgaagcttgctgccaggaagtatgcacgaattgtccaaaagcttggcttcccagctacattcaaggacttcaagatccagaacattgtcgcctcatgtgacgtgaaatttcccattcgtctcgagggccttgcttattcccatggtgccttctccagttatgagccagagctctttcctgggttgatttaccgtatgaaacagccaaagattgtcctccttgtatttgtctctggaaagattgttctcacgggagctaaggtgcgcgatgagatatatgctgcctttgagaacatctacccggtgctaactgagtacaggaaatctcagcaatgaggggaggatccatcagccgaagtgggagttccctgcttcttctgtacatagaaaactaaaaagatctgactgcgtctcttctctcttttaacttcttactgccaagaactaggtttagaatgccaagtactcctagaaaaagattgtattcttttcataaccgggatccgacaagcaactgtggtatgttaaaagatcatgttcatctgtaaatacatgactcaattttgctctagttctctattattgagacggttatgagtttgattgagttaaggactgaatgatgagaaaacgttctgttgttaaaaaaaaaaaaaaaa

SEQ ID NO: 22749 - DNA, 2004 bp, Triticum aestivum
  Clone ID: PAT_TA_22749
gcgaccccgggacgccgccgcatccaagaccccgtcccccatcaacatcggcatctatgggcatcacggcccatcaggcagagcctgcagggcaggggccccgtccgcagccccggacagcttgggcaaccaacgcagcggctccagcacagggcgggcgggatgcgggggctaaagacgcacgaactccgcggggaagtcgtcccggtgaacccctcagcgacaaaggctgcggcgggcccggcccgggccgtgatgcccccagtggctaccgcggaggcagcgcctgagggtaagacggcgcggacggcggcgacggcgccgttgatgaccaggcccttggcccttgcgagggtgggcagtgctgtgtgcccgggacgccgcccgccgaccccctctcccccaacccctcgccgccgccgcatccaaaacccctccccccatccacctcgtcctctaatggcatcacggcccatcaggcgaagctgctagctcgtgtctcccatccgcttcccgaatagcttgttgatctaccgcagccccccacctccgccgccgccgccatgacgaccctcaaccagttcgatctcctcggagacgtcgacaacgacgacccctcgcagctgcttgctgcggcggcggccgccgcggcaaagaaggcccaggcgaataagacggaggcagcgcctgctggaaaggcggcccagactgcggcggcggccaagttgccgaccaaatctgctcccccggcacaggctgggagggatgcgaggagcggaggcccaccatcacgtggaggatttggccgtggtgaacctggccgcggcagaggtggcggccgatacggccagaaccgtgactttggcagtgagaacacgaatggctaccagggaggttatggtggggtaggttctggagatggcgctgtagctggaggcggggatggggagagaggccctcgaccataccgtggaggcggtggtagacgtggtggttaccgcaacggtgagtttggtgatgactctgagagaccacctcggagaaactatgagcgccacagcgggactggtcgtggccaagggatgaaacgcgatggtgcaggccgtggaaactggggatcttccactgatgaaggtcttgcacaggaaactgatgaagctcttaaaattgaggacaatgctcccatcgctgagaagcagggtgagcaggatgatgctcctccaacaacagtggagaacaaagaccacaaggatggtgctgcaaaggaggaggaagagaatgaagaggataaggagatgactctagaggagtttgagaaaataagggaggaacagcggaaagcactactagcattgaagactgaagaaagaaaggttgaagttgacaaggacctgcagtctctgcagccactgtctaccaagaaagccaatgatgaggttttcattaaattgggttctgacaaggagaagaagaaggaaagtactgagcgtgatgaacgtgccaagaagtctcttagcatcaacgagttcctcaagcctgccgagggagaacggtactacggtggccgtggtcgtggaaggggccgcggtgagggccgtggagaccgcggcggtttcaggggcgggtttggaggaggataccagcgcgggcaggcggccgcgccatccatcgaagatcagtcacagttcccgaccctgggcgggaagtgaaggttgtgtgctgtgctgtcccgagcgccatcctcgttgtcttgactggtgtttgcctttaaattttgcccgacgttggattattgtgtcacggttaatcggaacaaataatgtggttttttctttcagtgtgttactcgattttgtataccggagttgatcgtcgggattaggcctctagctagttttgtaggctagctttgcgtttggttaaagatcgtattatgccttgtttcttctagctttactttgttcggaatgatgtcacacaaagcaatcatacgccttgctaaaa

SEQ ID NO: 22750 - DNA, 1174 bp, Triticum aestivum
  Clone ID: PAT_TA_22750
ctgccaggccgtgtttgtcgtggcgctctcgcccgcggtagctcgcgcgcttaccggacgtgatggtggagggctcgacgaccggggaggcggaccagaggctcatgcctcgggctctcctgcttgtcggggtccttcgtgatgcggttacccgacggtgaattcagggacaagggcctcatccttcacttcccaggactacgagcttcaggggtgaagcggccgcacgaggttgacagcgcaaagggtgggcccgccagaacccccttgctgtggaaatcagggagatggggaagtccattccatggatgatgatcatgatgatgatgcatcgtccactgagaccgtgcaagagtcctgctcccaagcaagcgcgacgagctctggaccatcttccccgtgccattctgccaagcgcgggtgctccccttcagccactaaacaagggtgggatcagcacggcatcgacgagcatgcgatcatgagaggcgcggacgattcacgtggaccactgcgcagcatcacgcgaccagaacttcgctgacgaggttatatactgtatcatccagaactggaggagcaagggacccatgacggtgaagtgatcagggacgtaattgtgccagatcttagagcaaaagtaataatcaaacactgcactgtagaagaagggcaccgaggatggtcaaggctacctcactggaggtgggttttggattgcttgatgtaatgtgaacctggtcatctttgtgcaaggagcaaaaggaacattcacgcaccgtttaggttgttctttgggcccgactgatgttgcctactcacccggtgaaatcgcctagagagttctagaatagagatcaagtctcgagtaacacctatgatggagtccaagcttgtaacttgagtagatttgtacagggcaagtttgaacacggatagttttgcagacagtagctttttcgactctggattctgaattttgtcgagactgtgttagaacacatgcgaaaggtagacagaaatagacacggaggtgtgactattttctatattttcagatctttggagaatactccctccgctccgaaatacttctggagtacgtacatgcttacaattgtaaacccaatccttgaatatatatactcctggcttcccggctaaaaaaaaaaaa

SEQ ID NO: 22751 - DNA, 1513 bp, Triticum aestivum
  unsure (1)..(1513): unsure at all n locations
  Clone ID: PAT_TA_22751
cgttgcccccgcccgctggccttgcccatgttgttgtcgtgccccggcgcatgtgtctccggtcgctacccggacgtttgccaccactcgggcctcggtacgcgaatgtggcccgaggcgccaggaaaccggagcatggccctagccattccaggaacacgcaaagagacgatcccggatctgggattcaccggcggcgcgtacaccatccagcctctgtatgctcctgctttttccttcgacaatgctgtcccccagcgcgtgtccccctgaatcccccgtgcccctgttgagcagcagcggccccaggaacagggccggcagctgcctgggccctggtcgccgtctttgtcgtcggcttctctgggttgccggcctccgtacagtggcatgcaggccaccggccgtggtcacggccgcgtggacgacacgtcttttggttgcatgcttgttacaatgcaatgccacatgcaacgacgcgtgggaatcccatggccgaatcgagtcgcggccttgccgccctgcgttgatgctgcgtgactcgaccatgctgagccccctgccccatctgccgtgcccctggggcgcctcttgctcccgctggctccttccagcatgagcggcccctcgaagacgacgaggacgacgaatcgtttccagttctcgctcgcaggagtcggcatgaaagacccgagaagcgccgggccgagctagtcatccgcctggtcctgccatgctctcacgcttctcggtattgttcctccctgcacattgagatgcaggcggggtaccgtactccttcgacggtggagtaaactgcagacagttgcgtgggcctcggaagtccatgatcacatgaaaagaagctgagaggtcaatggcagtgctagtcgccgccttgcccccttgcccccttgcccggtttctttgttcttggcaatgctgttcccccttgcatatgtgagtggcgccacggggcgcatgttgccgccactggctccttggaacatgagtggcgccacgtgggctgcaagagaagagaatggcgtgggggtatccagcacgtgggtcgacgaccaggacctggctgccggactggatcaccaggccctattgtgtctggctgaagccgcactggtgtgaagctgcgtgacccgagctggagcagaggcaggctccatcgaccgccgccctggcgtgacaccctctctctctctcagggtctgtctgcagggagctgccgctgatgatgatgacgacgaagagtttccagtcctcgctttgtgttgtcttaagattcttcaacttgaacttggtagtagtatagagtactggtatgtgtgtctgtacatacatggtagtagcagttgggtgacccccaaacttgtttattaaccgagtattatgttgttattatgttgctacaacttgagatgctgcttctgctcctgagacccgttagctttttatcatgacatatttgtgctgtgaaanaaaanannnannnnaaaaa

SEQ ID NO: 22752 - DNA, 676 bp, Triticum aestivum
  unsure (1)..(676): unsure at all n locations
  Clone ID: PAT_TA_22752
tttcttttctttgagaacacaagagcagcttcgcttgtcgtgctcgtctctgacctctggccggtcggcgcccaattgaaaatttcttttctctttgctctcctcgatcgattgactgcctcacggacggtgcccatggccatggcatcgccgtcgtggtcatcttgctgcgcctccacctccacccgtcctctgcctagcccccccgcgagcagcaagagcaggaacccatggcgggcaagcagcggcaggaggagcgccagcggagggaagaggcggcagcagctgtccatccgcgcggtggccgcaccgtcgtcggcggtggactactcggacaccgccgccggcgccggcgacgtcccctcgctgaaaatcaagctgctgagcgcggtcgccgggctgaaccggggcctcgcggcgagccagggacggaacctggcacccgggcggacgcggcggcgaggcagctccaggcggcggcaccggcccccgtggacctcgccaaggacctcgacgagctgcaggagggggggatgcaggtcgacagcagcgccttctcgtggtcgaggctcggcggcagccgcccccgcccgccccccgcccgcctcctccccatcgcccccggcctcgtgttngactcatccggcccttgcntcccgtcagaagnaatggnaaa

SEQ ID NO: 22753 - DNA, 524 bp, Triticum aestivum
  unsure (1)..(524): unsure at all n locations
  Clone ID: PAT_TA_22753
catgttacactctggagacaccagagagtaccgacgaatctaacaggagagctcttgcagacttgcacaatctgttaggcagatcagatcccaacaagatgcagcctgagacacctgctgagattcctagttcagtcacattcatccctaggaagaagtcagttgatgccatggtggtggatgagggccccagatttagtagtgcaaacccatctctcattagtgcagcagcagcagtagcctctgatggaactgaccaatgtcagatggatgaagatgaccctaaagcatcaccaccaccaccaccaccactgatgcagaccaactctaagatgaactcccggcgttacaggtcaagtagagcagatgatgagtaaagctgatantctggagcctttggtcaatggtatgtttaagaaaatttacaagtttaaaacttctcgatngatgtctacatggtgtttagccggatactttggtggcctccccgccgcccgctggtggtcccgagtttnaccatcttg

SEQ ID NO: 22754 - DNA, 252 bp, Triticum aestivum
  Clone ID: PAT_TA_22754
tccatcggcgacgacctcaactcggtctcttccagtattggcgggggagctaaatggatggtgaacaagatcaaagggaagctgcagaaagcattaccagatcttctcatagacaagttctagagcatacctgtacctgggctgacaggtgcaatgtaattacttagatatgctacattgaaatctgttgtgctatcggatcggcctattaaccaattgtgttgatgaaaactcccatccatgactttttct

SEQ ID NO: 22755 - DNA, 898 bp, Triticum aestivum
  Clone ID: PAT_TA_22755
attcggcacgagggtccccacgcgtccgcccacgcgtccgcttcctccgattccggcgatccagaccgaatccggccgattcgaggcggactgggggttcgggttcggggcggggaagaggggaggagggggagatggaccaggtgctgaacaaggtggggagctactggttcagcaagagggccagcaaggagatcgactccatcggcgacgacctcaactcggtctcttccagtattggcgggggagctaaatggatggtgaacaagatcaaaggcaagctgcagaaagcattaccagatcttctcaaagaatatgacatgccagcaggcctcttcccacgggacacaactaattacgagttcaatgaagagacaaagaagctgacagtgtacatcccgtcagcttgtgacgtcgggtacaaggactcatcggtggtgcggttcttcacctgtgtgaccggctacctcgagaagggaaagctttccgacatcgagggcatgaagaccaaggtgcttgtatggaccaaggtgacctccatcaagaccgagggctcaaaggtccatttcactgccggcatgaagaagacccgcagccgcgatgcgtatgaggttgtcagagatggcatcatcatagacaagttctagagcatacctgtacctgggctgacaggtgcaatgtaattacttagatatgctacattgaaatctgttgtgctatcggatcggcctattaaccaattgtgttgctgaaaactcccatccatgactttttctatatcttgacaatgtgtgcttgttttgctgtccccctgattcttccaccacaccagagcccccgcccgggccgcggcgccttgcttatccagttctggtttcgaaaaaaaaaaaaaaaaaaa

SEQ ID NO: 22756 - DNA, 615 bp, Triticum aestivum
  Clone ID: PAT_TA_22756
agagagagtgttcatccggaaagaaaataaaaagaagagagggagtattcgcctcagattgatcgatgggttcagagaagttccctgcccctgtggccgacctgtgcgacgcgaacgcctcactcatcctcaccggcgagctgcgcatcctggaccccgtcttccagccgtacggccagtgcaggtccttctcgggccgggtggtcaccatgcgcgtcctcgagcacaacgcgggcctgcgcgcgctcctggaggcccccggcgagggccgcgtgctggtgctcgacggcggcggcagcaagcggtgcgcgctcatcggcggcacgctggcggaggtggcccgccgcagcggctgggcgggcgccgtcgtgaacggctgcgtccgcgacgtggacgacgtcaacggctgcgccatcggcgtccgcgcgctcgccacgcaacccgcgcaagcccgggaagcgcggcgccacggagatgcacgtggacgtcgacgtcggcggcgccgtggtccgtgacggggagtgccggtaccccgacagcgacggcatcattgtctgcgacagggagatctacggttgatgtgcacatcgaccccaacgtggctcattccacaca

SEQ ID NO: 22757 - DNA, 716 bp, Triticum aestivum
  Clone ID: PAT_TA_22757
tctctggtgagcatcccgcactggaagcgttcagtgtggactgtgtcaggcctgtcattgagcgccttcagaagctcgagggtcgggttgatgagctcggcagcaagcccccagagattcccctggagaaagaacgctccctcttggattcatgggataggatcaaatgtatcgaatctgacctcgaaaggacaaagaaagttctgcaggctactgtgatgaagcaactagaaattgcagactcagtagaggaagttatcttgtcaaagctgcacaggcgaagattttgtgcataataaaccatcataactccttaacaataagcaccatggggttaattaaacttgagacaacatttggggggcaaatttggcgggacaagttatgcataagacggagccaacgagtgtcaaatgtactttaagttcagattggctcaaataatgggtgttggtcggtcatagtgaaatcactctgtttcatctgttatcttctactcactctgtaacgaaatataagacgttttttggtgtagttgacttcaataaaacgtcctacattttgttacagaggttgtaactcccaagaattgtctgtttttcatgtttgcaaagaggataatgggacggacgccataaatgtgcttcacgtatatgttatgtccgaaatatagctaggcatgtacagtgggctgatgtcaaaaaaaaagggggggg

SEQ ID NO: 22758 - DNA, 485 bp, Triticum aestivum
  Clone ID: PAT_TA_22758
ccgtccgttcccattcctttccctgccctgctcccacccacatctccacctccaccctcctcctcctccctctccatccactccaccggcgcatcgggggtgtctccgtctccgtccggccgtcgtggttttctttcttcccgggctaggacgcacgcacgcgcgacatggccgccgcagctgccgccgacgacgcggtcgccgccgacatcatctgctcgctgcgcggggccgacctggccgggtggacgccgccgtggagcaagcgcgcgaggccgatggagggtgagctgtcctggccggccgtggcgcgcgggaagcgctcgcgccgccgctctccggcgtcgtcgtcggcgacggcggcggggaaggcgaggtgcgcccggtccagcccggcgccgtggggggactacagcggcggctccgtctccctccgttccggcgcgtccaccagcggcggcgaggacggcgccttctgctcgccg

SEQ ID NO: 22759 - DNA, 966 bp, Triticum aestivum
  unsure (1)..(966): unsure at all n locations
  Clone ID: PAT_TA_22759
atcaaatcaaaccaccacaacgaaaaagcgtatggcgatggagcaggagggcaccacagcccaccagcgtcacggcggcggcaccatcaccgacgccctctccctgttcgcctcccgcctctcccaccacaggttcggagacgaggagctccgggtactggaggcggcgctctccgccggcggcgacgttgcggcgctgctcagcacgcgctcggcagcccggaaacttctgcgggagagcgtggccggggcgtgcgccgcggctgcggtcgagggggacggggcgaggctctccgtcgccgacttcttcgcgcgcgccttcgccctctcgggagatgtcgagaagctgccttgctatgagatatgaggcgctggttctgcgagaggccaaatactccgacgaccttgatctgcatgtgttccatgaagaatggttaacctttgcacaggactctcttgataatgggttctacaccaatgcttcaaggcttttgcaaatgctcttgtgcacattcaacccaagccacttggactctactaattcactctgaagaagaacagggtcattgatataagaggactccaaaccttggccaagtcattatctgcacagcgttctgttcagacgcaatccgctgaatacatgaaaaggaaaacttcaggcgttagtgaaaagtgcaatttacactcangaaaaaccgaagttaccgggcgaacttgatgtttaagctggggatcaaaacaagggacacacaaaaactacttcttagccgcaaggagaaacttanaagagtttgatttccatcattgtcaagtgtggcatcttccccaaagactgaaaagatgtcttgatnacaatccaagttattttggtacaaaagngaattcaagccttangtttcgtggtnnttccacagtagcntcaattcctagtccantactaatgagcatatcaanattanacag

SEQ ID NO: 22760 - DNA, 472 bp, Triticum aestivum
  unsure (1)..(472): unsure at all n locations
  Clone ID: PAT_TA_22760
aaaatnccaaaggtcttgcgtggttataacaaatgatgcggnctgtanctgtcagatggacatccaggtctgcttcaagctcaatcccaccccccaacggtagtgctagtgtggtaccggaattggttgacgcggttatctgctttcttagacttttgcctttctccgttagttcagtgtgccatgtatatttcgggatccactgcaaccagatctttatgctgttttgttttgcgtgtacaatctgtagtgatgatgcttttggtgctgtgtgaggtttacaggttttctgccaagttattattgcgccaaccttctttgctggcgacataacagttgccagaaatgtaatctagtcagtttgacagtttgtataaacggcgcatgttgttcttttaaaaaaaaaaaaaaaaaaaaaaaaaaaaaanctcgtgccgaattcggcacgagctcgtgccgaattcggcacgag

SEQ ID NO: 22761 - DNA, 438 bp, Triticum aestivum
  unsure (1)..(438): unsure at all n locations
  Clone ID: PAT_TA_22761
tttttctgtgtgggttgtttgattcataggatggcaaatcataggatttttttcttcagatttatttgcactagatttcataggaaaatttccatcaattccaacacatatgaaagaatcctagattttacctgcgaacaatcaaacacccttacaatcttgcagtattcaaggtgacatgccaatatattcctacgtttttcctgttcctgtgtttttgacaccctgtgaatcaacgaggccttatttgtttgtgcacagagggtcgcgtggtggccgcagattgcatcctttccttacattttaatagacctacaattcacatttcaaacaacctttttctcctttttcctctgcgattgttggtgctcagttttctttatgttgatgctgctttgcactgcgaaaaaaanaagtncgccggttcggcgcccncgc

SEQ ID NO: 22762 - DNA, 516 bp, Triticum aestivum
  Clone ID: PAT_TA_22762
ggtcagcttgcgaaggatcccaaccgccccaaggagcaaacgaacatcatcgactgggcaaagtcattggctgaccggaggaaactctctcattttatggacccccggctcaagggccaatacaactccaaacaagccctgcaggtgttgcatgtggcgctgagctgccttgctggggagcttaggagcaggccctcgatgaaggtggttctcaaggcgctcgagcagatctaggcaatgaagatctgcggatatctaaatctatgatgttgcttttgtattattgtatacactagtcatcaacccgtgctacctgcacggggctagcatttagagaacacagatattatgcattacaaaaatttaaaatctattaaataactcacaaatgagcccaagatcaccaaagaattgctaccttggtgcctgtatatgctccatgtgtcctgctatccatccatgtaaaagtatgcccctctcaatcccaaagtcactaattcccttaaaaaaaaaaaa

SEQ ID NO: 22763 - DNA, 512 bp, Triticum aestivum
  unsure (1)..(512): unsure at all n locations
  Clone ID: PAT_TA_22763
ngtangtatgtacnatntgaagtcacatgttgaacaggacacantccnccttttctgtgccgaattcggcacgaggagcntgcgattggttggcttnccgacaccatccttgcaaatcttccagccggcggcaagctggactggtggatccacccaagctggccttggcaacgaaaccatgaagctcaaggccgaggtcgaggcagtggagatggtggtttctgctgtgcaggggagggcggccggaaacaagccgctgacccgatctctcgctcgtctcaaggagctgctctacgacgccgacgatgtggtcgacgagctcgacggctacaggctcaagcaggagctcgagccggggccccggccccaaacggatggacatgctggagcgcagcaagttgagagatctagagaaaatgatgacgatgtacagagcagcggtaatagcaggttacaatccaaggaatggaatcacttcgaaatcacagagtttgaacaaaaaaaaaaaaaaa

SEQ ID NO: 22764 - DNA, 722 bp, Triticum aestivum
  Clone ID: PAT_TA_22764
aggcccctgaataaatgggcggcgccggtgggagcagcagcgccgtccgcggacgcgtgggcccgatccccatctccaatccaggacacgccatcgatggcggccaaggtgctccagctccgtagctccgacggcaaggtgctcgtcgctccggcgtgggactatcgcccggccgccgcccaagccctcccgctggagatgcgggtgccctcgcgcgccctcgagagggtgctccagtactggaccaagcacagcctggccaaggccaccggtgagtcccgggagtccctcgcccgctgggacgccgacttccagcgccgtctcgaggaagacggcctcgccaaggaggccgccgcagccgtccaagaactccgccgccacggcgtcgaccatggagggcgtccccgtcgccacgccggcacgggcgcatctggtgtcgctgctccagccaccgccacccgtgctgatcccgtccgtgcctggtgcccactcgttcaccacctcaagggtgtcgaccacggagaacctagcccggcgccgacggcgcccatcgctttccatgcctcccatattgccgtcgccgcgcgccctgggcctgccaccaccttgccggccgctgctggtgctcaacccgttggtgtccggtgcgccatccgtgcccgtggacgccagatggctgaagacgaggagtccgcttgccaccaccgcaagctcccggcttc

SEQ ID NO: 22765 - DNA, 581 bp, Triticum aestivum
  unsure (1)..(581): unsure at all n locations
  Clone ID: PAT_TA_22765
cttgaacttcagagcacaatttgctagccaatcaagctcaagaagaattccacacagctcgctcgaccccatggccaacttcgccgcccagctcaaggagcggttcctcggcctcgtcgaccgcgtcaccggctgcggccgtggtgccgcggccaaggaggaggccaccaagccggccatgaaggagcacgtggagatccgatcgagagctcccaacgtgtcaggaggatcaaggggcgggagtcaattaagcacacacactgcatgcatgctgatccgggctgaagatgtgtttgtccttgcagattcctgtgcatgttcctttcagtgcacgccatgttattaagcttgccgatcctggtggtttcaagtgtgccgctttgttccgcaatctcccccggttaattccttgggaccaaccccggtgtctctcctcctccgccgggccgggtgcgttgtgtcgagccttcattgttcctatggtgtcttcagagggagtacggattgngggggtaaaagggtattgtttggggaaaaaaaanaanaaaaaaaaccanggggggccggtaccaaatccccta

SEQ ID NO: 22766 - DNA, 617 bp, Triticum aestivum
  Clone ID: PAT_TA_22766
cgaattcggcacgaggatacagctagctaggtagaggaccgcccgcgcgtccgggaacatggcatcatctttgtgatgctcctggccatggcggccaccgtcggagcgcggtcaggagccacggcgcagccatcctgcgtccccactgcagatggcgcccctcgcatgcacgccggagcagtgcccccgtcgctcgccgccaactcgtccccggcgcttcatcgtctgcatcgtccggccagaggactgccgacgcgcccagctccggcggatcatgccccgcggtcactcgcccggccgcttcctcgtctgcctcgtccggccagaggactaccgaccacaccaactcccgtggatcatgagccgtggtcaccgccgccgcccgccatgcaagggtgattagttatgaaattgcagccgtgcctgcttctcagtacgttgctgttgatcatcacctggtcgctttagttttctgtactctgtcgtccggtctagttccagtttttgccagcgtgcaagttctagtctacattttgcttaaacatcactgtaataagttctttgtaggcctttcatctaaattcgtgtcttctcttggaaaaaaaaaaaaaaaaaaa

SEQ ID NO: 22767 - DNA, 1455 bp, Triticum aestivum
  Clone ID: PAT_TA_22767
tgaattctcagacaacatttgagaaactgaactcacaagtacaatcacacacatcagatcttgagaaatgtttcggagtaattgctttgggagcagacaacttgttaaatgagcttcagtgtagcctttcgaaacataagagcgactagcccacttcgcaaacaagcagcgggagggacacctaagagccgtggaagcgtcgcggtccatctcaaatattactgttggtttcttccattcactggatgttcatgcatctaaacttactagtattttggaagaaacacaaggtgtgcaagatcaacaacttattgatcttgagaagaaatttgaggagtgtgcagctaatgaagaaaagcaacttatagaaaaggtggcagagatgcttgcaatttccaatcgtccgcggacgcgtggggtccaaacggctgtaggtggccttcgagagagcgctgtaaacaggacaggtcagctgcagaaagaaatttcaacagcacaggacttcacctcatccgtacgggaaaagtggggcttttacatggaagaaacggagaataattacattgaagataccactgcagtcgacagtggacggtcttgcttggcagaagttctggtggaatgcaaaactaagacgggcatgggtgcccaacaatggaagaatgctgaggattctctcttcagccttggcaaaggaaatgttgaatcagtagatagtatagtcaggacggggagagaagccaaccaattgctgcgttccaaattgtctgccgcagtatcgactactctcgaagatatagatgtagcaaacaaggcccttctttcttccattgacagctcgctgaaagttgaccatgaggcgtgtgcaaacatcgtctccgttctcaccctgtgccacggggaaatgacggagttgaagggtgcgcattaccacaaggtcgtggagataaccggaaatgcggggaaatgcctagaggaagaatacctggtggatgaaccgtcgtgttcgacgccaaggaggcggcagatcgacctgccaagcgccgagtcgatcgaggagctgcggaccccggactacgacgagctcctcaggtcgttccgcgagtcgagggctgggtggaagcaggcgaacggagacacgaaacacctcccggaggcgcaagaggcggcctcgccgccgtcgtcggtcagggaggcgagggtcccccttatagccagaaattagattcgtccagaccatgtacaaaggagccgtttgtttagttttaccttttacccagttggtttgctgttgatagtgccatccatttgattaattgctattgtcggttgaggggtttgctgttcttaggctggtcaccagtgaagagtacgtgtacttactgctgcatcagtggatctaatgtaatatatatgtatttacataggcaacacagtgaagccataatatttttt

SEQ ID NO: 22768 - DNA, 586 bp, Triticum aestivum
  unsure (1)..(586): unsure at all n locations
  Clone ID: PAT_TA_22768
ggaacacactgggtcagtcatcggcgacctgaattatatggatccagtatatttgcaagaaggcctactcaccgaaaaaagtgatgtctacagttttggagttgtgatccttgaggttattagcagcaggagggccctacattctgagaataacagcttggtaaagagctttgttgaagcccatatgaaacatagaaaagcgaccgagcttttcgacaaagaaattgcaataacaaaagatttggagcttcttgacagtctagcatgtatggccatggaatgccttagccttgatgtggatcaacgaccaaccatgatggaggtagctgaacgactacacatactgagtccgtctcgtaaggcgcaagatgtttgtcaataagttatctttggacaaaatcctaaaacaggagcactgggagaggctccttgggtacaagaaaataattttaccgtgttttgcatggggggccgaatgctcctaggctgcatttgtaactgtgtttccnacggttgtgtaaccgtatgtcaaagcactacatttttcccaatggggtacccgtgttataaataatacattgtgttt

SEQ ID NO: 22769 - DNA, 821 bp, Triticum aestivum
  unsure (1)..(821): unsure at all n locations
  Clone ID: PAT_TA_22769
ccactgttccatcgtctttgcgctcggcccccttcccgccggcccgtccctcgctcggcacacaagccgcctccgcgcctcggtttccgaaacgcccccggctccaatggcgctgccctacctggaggccgtcctgtgctttatgactctcaattacatatttgagacatatcttaacatcaggcagcatagagcccttaagttaccaacattgccaaaatccctggcaaaagtaattagtcatgaaaaatttgagcaggcgagagcttatagcctggacaaaagcaatttcaattttgtacgtgaggccataactatagtaatgtgatatcgtaatactgtactataaaagttcttccttggttttggaagaaatctggagtgttagtaaccaatgttggcctgaaatgcaagaaaatgagataaatacacacccttgcattcttagcanggtgtcatgggtttgggtcaacaagatcaacaggactttgccaattctctnctatacctccgacctgtgttattgaggctccgacacggttttaacaagcaaacattcctgggctcttcatttggggacatgatcaaagggaattttgctgtccgttgtactccgcaccaccaaattgtgggctgctatcatccgtcatagtacaagaatgggagggcttacctaacaatatatctctggggttttatgtttgcactaactctcctgatgatgacaatttacccatcatgatactctcngttcaacaaatcactcctcntcccgaaggntcactcanggaagaaatagagaaatttgaagattcctcaat

SEQ ID NO: 22770 - DNA, 975 bp, Triticum aestivum
  Clone ID: PAT_TA_22770
gcgtcctcgcattcttcggccgccccgctgccctcccccggcccccgcaggccgagctttcaaatcccccgcctctgcttcttattccctccccatcgccagattttcggcgaaaggttccagtcccccacccccacccgcccgtcccttcccttcccccgccgcccgcagccccgcagcgctatctgaggcttgcgcctcggtttgggccctgaggttaggtcggtctccccaagcgggcggcaggcgccagcaggtcgggtcccgggcatcaggccgacggaaagggacgcgcaaaacccttgaacactgattcggctgcagcgcctagcaaagcatcggtcccccaaaatctgggcgaagagctacaggagcctcctcaacgtgctggcgggtggcatggcgacggaggccgccggcagcttcgcctccatcttcccgccggtgggctgcgcgcgcgtgcaagtgcagcgacccaggcagtccgtggccgtctctgcattccttaagaaattgttgatgatgttcatactgacatctgcggccaattgtttgaaaaggttgtcaaggaagcaattttgtcaggcgttgatgacaacgttgataaacgagaggcggttaggaaagcatcacagggtctaaacttgaaaaaggaggctgctatgaccatctttaataaagaagtacggaaattattcctgaactacattcagaaagcaaaagcagctgggaactgcattgaacaggcaaaagaattgaagaagttaatttcctccttgcagagacccagggagcaaatagcggatgcagaggctctactggacattacaaccaccttggtaaaatctgtgaggtcccagtcaagtgaaggaatcacaccttctgatttcgtaacagcattgctgaagaaatttgggcagcaagcaacccttgattctgagcctggctcattgcgctaggttgatattgggcttt

SEQ ID NO: 22771 - DNA, 660 bp, Triticum aestivum
  Clone ID: PAT_TA_22771
cagggacatccgcggttgtgatcatgtcatcggagaacataccttccagaatcaacatatgcctggcggaaggagcaaatgagttcttcctgaaaccagtacggctatcagacatgagcaagctcaagccccacataatgaaaagcagatgcaaggagcactgccaccaggacgaagacctgctaagcaacagcgagaccaaccccacaaacaacagcagcagcagcagcgataccattaccatcagcagcagcaaccccatggacaacagcagcggcgataccatcagcagcagcaaccccacggataacagcagcggtgatagcagcaacatccgcaaaagaaaggcggcagatgacgaaattctaaccaagacaagcagaccaaaccacaattgttagctgaaaaaagattatttgacagccaatcttttttcctttcttggttcttcatcttaatcgggtttctgacatctgatttgtatgtaaaacctatgctagctctagtaaacggatactgcttgaatccagtcagaccatgctcggtgtaacacgcctgaagttccaaataccttcaggccaatgaatcagcatagagctaacacgattgtacaaacagcttgctacacctttcacccatggaaacacatgcagccctcag

SEQ ID NO: 22772 - DNA, 798 bp, Triticum aestivum
  Clone ID: PAT_TA_22772
ctcctgcctttcctctacctcatagcaatagcatccacctcctcctcctcaggcaaaaacacgttcgctctttcttctccgatggcggtggcgatcgcggaggctcccttccatgtcttggccgtggatgacagcgtcctcgacaggaagctcatcgagaggctcctcaagacatcttctttccaagttaccaccgtggattctgggaccaaggctctcgagttcttggggctccatgacgaggacgcctccatttcttctgtccatgcagaccagctggacgtcgaggtgaacgtgaacctcatcatcactgactactgcatgcctgggatgacagggtatgatctgctcaagaagatcaaggagtcgtcgtctttcagggacatcccggttgtgatcatgtcatcggagaacataccttccagaatcaacagatgcctggaggaaggagcaaatgagttcttcctgaaaccagtacggctatcagacatgagcaagctcaagccccacataatgaaaagcagatgcaaggagcactgccaccaggacgaagacctgctaagcaacagcgagaccaaccccacaaacaacagcagcagcagcagcgataccattaccatcagcagcagcaaccccatggacaacagcagcggcgataccatcagcagcagcaaccccacggataacagcagcggtgatagcagcaacatccgcaaaagaaaggcggcagatgacgaaattctaaccaagacaagcagaccaaaccacaattgttagctgaaaaaagatatttgacag

SEQ ID NO: 22773 - DNA, 1020 bp, Triticum aestivum
  unsure (1)..(1020): unsure at all n locations
  Clone ID: PAT_TA_22773
gcccacacctcctccctctctctctctctctctctctcatgccaagcgcacacacctcctgccttaactctaccatccttgctttctcctcatagcatcctcctccatcacacaaaacacacgctctctctttcttctccgatggcggtggcgatcgcggaggctccgttccatgtcttggccgtggatgacagcgtcctcgacaggaagctcattgagaggctcctcaagacatcttctttccaagttaccaccgtggattctgggaccaaggctctcgagttcttggggctccatggcgaggacgcctccatttcttctgtccatgcggaccaactggacgtcgaggtgaacgtgaacctcatcatcaccgactactgcatgcctgggatgacagggtacgatctgctcaagaagatcaaggagtcgtcgtctttcagggacatcccggttgtgatcatgtcatcggagaacataccttccagaatcaacagatgcctggaggaaggagcaaatgagttcttcctaaaaccagtacggctatcagacatgagcaagctcaagccccacataatgaaaagcagatgcaaggagcactgccaccaggacgaagacctgctaagcaacagcgagaccaacctcacaaacaacagcagcagcagcgataccgtcaccattagcggcagtaaccccacaaacaacagcagcagcgataccatcagcagcaggtaaccccacagataacagcactggtgatagcagcaacatccgcaagagaaaggcggcagatgacgaaattttacccaagacaagcagaccaaaccacagttgttagctgaagaaagattgtttgacagtcaatcttttttcctttcttggttcttcatcttaatcaggtttctgacatctgatttgtatgtaaaacctatgctagctctagtaaacggatacggcttaatccagtcgaccatgctcggtgtacacgcctaagtcccaaatccttcaggccaanaatcagca

SEQ ID NO: 22774 - DNA, 713 bp, Triticum aestivum
  unsure (1)..(713): unsure at all n locations
  Clone ID: PAT_TA_22774
atttgattggttctttgaccctctgatggtcatcaaagatcaaatcaaagccgagaattttacagaaagaggaggaggcgtaccttcagaaacgcgtactgttgatcagcgacccgaagcgcctcaaggccactcttccgcatttgccatccctgaatgagcgaaaacaagcagaaatagatgcatttgctcggagattgcaagggatcactaagtcgatatcaaggtacccgacatccaagcgccgtttcgacgaccttgtcaaagcgctttctgaggagctggagagggcaatgggcggcagccgatctgtcagtggatcacagtttcaagaagctcagaagcggtcttgttcgaatgcttagccagagatcgatggggaagacggcaagcatccgaggaggtgatcaaagaggcgcagctcacaagcgacgctcgtgctgcgtaatattcccagaaaaggcggtgaagagaagatcgccattgtccatatgtgtttcctgagttgattttcacnaactttgtgcagagagctgactctagtgtatgggttatatattgcaaacttgcaaagctcatgttttagaaaacaaaagtcgcctcgttttttancccaaaaatgtccattnagnggattaatnacctttaccaccaaaatgggttacactgangaaaacaaaaaanaccgaggggggccgggtaccaatccccta

SEQ ID NO: 22775 - DNA, 477 bp, Triticum aestivum
  Clone ID: PAT_TA_22775
ccgtccgcccacgcgtccggcgaaggccatcgatcgccaccgaaaacctccctctatctcgtctcggctcgcctcgcccactagcccgtccgtccgtccggctgacgatgccgccgatggcgaccacgacggcgacggcgacggcgactgactccgcggcgcgccgcttcgcctcggcctgcggcgtgctcagccagtacgtcaaggcgtccggcgtccaggaacccggctatcaggcggacggggcgcagcagctgacgatcttctacggggggaggggggtggtgctcgaccgctgcacgccggccagggccgccgagctgatccggttcgccgcggcggcggcggcggcctcgcagggagcgcctgtcgtacagccgcctgccccggcgttcgtcgacatgccgatcgcgaggaaggcgtcgatgcagcggttcctgtcgaagcgcaaggacagatccgccccggccccggccc

SEQ ID NO: 22776 - DNA, 551 bp, Triticum aestivum
  unsure (1)..(551): unsure at all n locations
  Clone ID: PAT_TA_22776
cgacgggttgcggaagatggcgcgaggaaacctccttcatgggctacctcacatcgangcatgccgacgagttgtgcgatgcgtgtcttgccgggaagcagcggcgcctgccctttctagaaaaggcacgctatcgggcgcagaaacccctgggagctggttcacggggacctctgcggcccaatcaccccggcaacgccaggagggcgtcgctacatcctgctgctcgtcgacgactatagcaggttcatgtgggtgctgctcctcgcctccaaggatgaggcangagcaagccattgtcaagcagcaagcggcggcagaggtcgagggtggccaaaagctgcgcgtgctgcgcacggaccgtggcggcgagttcacgccggccacgttctacaagcactgcgacgagaaaggggtgctgtgacgcccggcgtattaagctacagtgaacctccgccaatgataatgcgtcacctcggttactgttgaanaanaatnaaaaaactcgagggggggccggtacnaatccncctatantgagcntatatccg

SEQ ID NO: 22777 - DNA, 683 bp, Triticum aestivum
  unsure (1)..(683): unsure at all n locations
  Clone ID: PAT_TA_22777
tgcgacccaccgcctaggccggcactctgccccccctagctcggaccgatttccccacccccccatggggcgcgatggagggaacgtcgctcttcgaccggcccgcccgggcaggctactgtgccggtcctaggctagaaccgtactaagagacgcgagcctggaacactaatgaggtcacggcgtagcacagctggcatcattgaaggatccctaagtagctcttgacagcaagatataagtgaagatcacaacggcagtgaagataatgatgtgaaacaactgccaagcaggatatatcaacaactttctctccaactttcctcttgaaaagtttgtgccaattttctgatatattttttcgcaagaatggcactgactcaagctttccaatgcaaaaagaatcactcaattccgagttgatatgaggagtcaaaaaattctaaaactggcctgaaaaactggaacaagctgtgttcacgaacttcggagggcaaaaagacctatttagaagccgattttgaggtgtcaaatatggaactagcttctgcaactatttagatgcggctcattgctatcttcaatttgagtattcacgaagccaaaacggactttgtatgagaaagttatgtctgttttactaaacaatgcacaanacagattccaatcctaaatcaactacg

SEQ ID NO: 22778 - DNA, 1608 bp, Triticum aestivum
  Clone ID: PAT_TA_22778
ttgccgtctgcttccacttctggtatccagtgccttgcccgcctcgccgtaatcctgccctaaaataaaaatccgtagctccagcctcgccggaatcccgcctgccggtccgccgtccattcccgcgcgccggatctgccgctcgccggacgatttccccgcgcgagatgttggtcccgtggggcggggtcgggtgctgcctcagcgccgcggcgctctatctcctcgggaggagcagcgggagggacgcggaggtgctgcgatcagtggcgaggacaggcagcctgaaggatttggctgctatcttggacactgcaagtaaagtcctgccacttgtagtggcagtttctggggcgagttagttcagatacaccacttatatgccagcaaagtggtatgagaggtgtaatagtcgaggaaacggcagagcaacacttcctgaagcacaatgatgctggatcctgggattcaagattctgctgtgatgctttctgttagcaaagaggttccatggtacctggatgatggcacggggcgtgtctatgttgttggcgctcgttctgcggcagggttaattttaactgttgccagtgaggtttttgaggagtcagggcgaacccttgtacgtggaactctagattatttacaaggactgaagatgctcggagtaaagcgaactgaaagggttcttccaactggaacttcattgactgttgttggtgaggccattaaagatgatgttggaactattcggattcagcggccacacaaaggaccattttatgcgtctccaaaaagcatcgatcaacttatcttgaatctcgggaaatgggccaagttataccaacttgcttccatgggctttgcagcttttggtgtatttcttcttgctaagcgtgcacttgatcattttctacaaagaaagcgccagcgtgaatttcacaagaaggctcgtgctgctgcagcacaaaggcaggctagggacgctgaagggggcaatggaacatcagacggagagcctaagaaggatcaattggtattagaaatatgtgtcatatgccttgaacaggagtataatgcagtttttgtgccgtgtggccacatgtgttgctgtatgaactgctcttctcacgtaacaaactgtccactctgccgacgaagaattgaccaagctgtcagaacattccgtcactgatggcactacatgatgcaaaatcctgcgcctgataacaccaggtgaacctcatctttcgaaaccacctgatacttccagttccagtcgccgtggctgccagtgtgccgatatctggaacgcggaactgagctggagcttgtgaattggagttttgctttactgacgaaaacttcaagcaatggaggctcatagtttgcggtcgacgctgcgccagttgctgatcttccttgtactttacagttgtgtacagagtgttcttgtgtagcgccttgtttctaacagcgctctgattgacagcatggatgctagtatttactggtggatcaattgattctatccaaaggaactgctatgttgtttgacattgtaaaggataatcatttcttctgatatatatcggacaccgcctcctg

SEQ ID NO: 22779 - DNA, 672 bp, Triticum aestivum
  unsure (1)..(672): unsure at all n locations
  Clone ID: PAT_TA_22779
ggactacttcgagctggtggtggtgaccaacgtcggcggcagcggggtcgtgtcccagatgtggatcaagggctccaacaccaactggctcgccatgagccgcaactggggcgccaactggcagagcaacgccttcctcaacggccagaggctctccttcangggtcaggctcgacgacggccgcgaggccaccgccagcgacgtcgcgccctccaactgggtggttcggggccacctacacttcctgggtcaacttctactagcgtctagcggatcatcgtcaaaccggtccattcgacgccactgcttcttcgtctatcattaagtatatactagcagtagtattacatcaaagcgtagggcgccctctgttgcgttccgctatagttgtgtttgggcagccgcacatccgtccgtgttttacttttaagaggcatccttcctttgcacctacacataataacctggaactaatccacaaataacaaggcaanacacaagcgcacctaataagaatgttaaagaaaacgttcggaaggaagacggcataacgggggcggatncacagcaagggggggtcaccaaccaatttttctttcggttgctgtttcagtcctttaagtatagttttgaatcaaaggtcaaataagttccttgataaaaaaaaaaaa

SEQ ID NO: 22780 - DNA, 459 bp, Triticum aestivum
  unsure (1)..(459): unsure at all n locations
  Clone ID: PAT_TA_22780
ccgggcagggtggaggcgccagttctgnttnatcgtcctcgtgaatctcgtcctcctcgggtgtactcttcgcggcttgctcgccgtttgcagggtttcagctgcatttggccggtaaatagataaaaaaaagctgcccaactttccaagtgaaaatatggaggttatttacaggagttgtttctcctgatgcatgattaatcaaaactgatggtgatatcaccatagcatagccaaactctgccagagatttacaaagcaaagggaaggcactcagcaccctatagttacctcccttgtggtatggaacatctttgagaagcgaagccaaatgagcttgctggacttgttatgtttgaatttgttggtttggttgttgaggacacctgtacgcgcagtgtaatttgtttgttcgttttttatacaaagcaaatgttcttttgttttaaaaaaaaaaaa

SEQ ID NO: 22781 - DNA, 985 bp, Triticum aestivum
  Clone ID: PAT_TA_22781
cgtccggaattatgttcaaaatggcttgctttgttgacaatggaaaaggcatgcttttcagctgtcgcattagaggagacttctgacatggtgaccagagttggaggggatttcaaagaaacattaagggcattgggtggtcttgataatatttttgatgttatggttgattgtcattcctcactggagggaattgtaaaggatacctccactctgtccttggaaacatctttgcaaagtgctgcactcctcctgaaatgtttgaaaattttagagaatgccacattcttaagtgatcagaacaagacccatttgctcagcatgagtagaaaattgagtcccagaggctctacagtttctcttgttggtgtcattatcaatattaatgaattattatcagtactgtctcgtctttcctctttggagggaattgtaatcgacacctccacaaaatccttggacatgaaggaaggaacatcttcgcaaagtgctgcgctcctcctgaaatgtttgaaaattttagagaatgccacattcttcccgaagcggcacaagtccccttcgcccagcttgggtgcttctctgagtcccagagcctccactggtgctcttgcccgtgcccttatcactcttgttggttccctgtctgctccgtccctccggccgtcttctgcctctgttgctggcaggcccggcaatggtcctgcccttgctctcatcctgggtgcaactacggtgcgtggtcatgccaaccccatgagcgcctcgagtggttggctttcgctgaccccgcattgccctgatggctcgtcctccgaattggctgctccccgtcgtcggtctgcttccgccagcggcgttggccgatctcgcagggctcgtgatcgttcccagtctacttcaagcaacagggcatcaagtggttcattaggtgcgaggcacagcaatggtcttggtcttggtctgaagcttaatataagaaagg

SEQ ID NO: 22782 - DNA, 954 bp, Triticum aestivum
  Clone ID: PAT_TA_22782
tttcaagaggcttacaaggctgccatgcactacctccaccatgatccttggtatattgaggtaaatatgaattctggtgctaactgtttggccactattcaatagtctgcaggcattctggccaggacttcagatttaaggttttagctggagatgtcgatcctgccattcgaacacatgctgccttctttagcgtctggaaaaaatatgggttcactccagaagggtttaatctggctacatccactgttcagaacggacaaaggagctacccgctgcggcctgagttgattgaaagcacatattggctattcaaggctaccagagattataggtaccttgatgttggaagggatatactagcaagccttcaatatgctgctaaatgtccttgcggctactgccacatttcagatgtggaaacccacaagcaggatgaccacatggagagttttttccttgcagaaacggtaaaatatctctggcttctttttgatttagctgtaggccctgataacattgttgaaaatgggccatataaatacatattcagcacagaaggccatttgttacctgctactcccgaaataaccttggtagatgagcattgtctttattttggagaccgtggctacggcagtggtgatggttccagtatacagcaaagtgctaactgtgcccagtttgatgaaagacggactgtttccagtcaaaattcattgtccaatgttttgttcacaacaagaggttacatcaagggagtttgtccaggattgagtcatgcacagaaacttggcatatcgtaccatgccgaagaggataacacgcagaattctagaagtcatgagcaccccgatgaatcttatgtggaccaatccagtgtccagattcaatcgagttctgtaatattgatctctcatccagccacaagcccacctgatgagccttcgaaaa

SEQ ID NO: 22783 - DNA, 653 bp, Triticum aestivum
  unsure (1)..(653): unsure at all n locations
  Clone ID: PAT_TA_22783
aggcgcgttaccccccgcgtgttgccttgccgcgcggactcgggccatcgngtctccgccgcaagccgctactccagacttgccgccagttcgagccggggacntctccgagtcctccgtcgccgccatgggcgaggacgcgctcttcgcccagctcaccaggtgaagggcatcggcgagtggactgtccacatgttcatgatcttctcgctgcaccgccccgatgtgctgccgtccggcgaccttggcgtgcgcaagggcgtgcaggagctgtacaagctcaaggcgctgcccaagccggaggagatggccgcattgtgcgagcgctggcgcccgtaccggtcggtcggcgcctggtacatgtggcgtctcctcgagagcaagggcgccgcggtgaagaaggcgaagaagggcaatgcgagctcctagctaggtatgtgtcatctgtgggtgatgctagtatgtatttgttgtactcaagctgttaactttagtagatggcaatgtggcagatggtgcctgggattaatgaagcatcatccgtgtgacattgtgacttgtgtgtcttgccttgttatcttgatggttgtatcttggtgtacttgtcctgccttgttatcaataaaattagtttcatccaaaaaaaagaaacc

SEQ ID NO: 22784 - DNA, 562 bp, Triticum aestivum
  unsure (1)..(562): unsure at all n locations
  Clone ID: PAT_TA_22784
tttgaaatgggcaaggcagagagagtgagcgctacagcagcggagaggaagaggcgattttgatcgtattccattgcgattccaagctgcacctctcctcgagcttgagttccgctccggcagacgatactaactgaagaagacatgtttccaggagtagctcatctgcattgccgtgatccgagtagttgtttcctgtctatgtttaacagtgatgtgttcttcaattagtgggtgtttatgttgttaggaagatggaggtgcatgtcagttgaaatttctagtgacatttacagtagaattacttgtgaaattaaactgtaaatcaatgtaattcaactgcaatactacggtatttacaccgtaaaaatgttactggaactcaactgtagtatttatggtgtaattgtactgtaaatctactgcaatcataccgtaaaaatctgtatttacattgaagttctactgtaaaatacactttgattatagtangaattacactgagaaaaaaaaaaaaaaaactncanggggggcccggtaccaantcgncctaaantgagnc

SEQ ID NO: 22785 - DNA, 599 bp, Triticum aestivum
  Clone ID: PAT_TA_22785
tattgattaaaattgacctattgctagaggaaggcaggaatagagaggagcagcttcaagaggaggagatgaagattatcaaagctcagacagagatctttatcttaaaagagagtttgcgcgacatgtctgaagcgaattcggactactcggcaaaactgcagaagaaggaagaagcatgcaaggttcatgaggagaaattgggctgcttgtcacaggataatcagaagctaactgagggatcggttcattacggaaagtattgcactgggagaagatgtacgagtccctggaccaaatgaagcttgacatcattttgcagctcatcttgcatgaggtcaactgcttaaggagtacaatatctgatgcccaggatgcgagacagaaagagcttgttgagaagtctcttgttgtctcacttctggagcactttggggggggggtagccgacctgcggtcggagcgcaacaccctcaagcaggaggggggggcaaagaccgaggagttgctccagctgcaggcagaaaggcaggagcttgcggagatcagcgatgagttctgggaagagatggagtctcgtgaccagatagttgatgact

SEQ ID NO: 22786 - DNA, 691 bp, Triticum aestivum
  unsure (1)..(691): unsure at all n locations
  Clone ID: PAT_TA_22786
aagcaatgaaaatcaagctcagactcagcactgcttaccagactcagagtgacggccagaccaagcgagtcaaccaatgtttggaatcgtatctcagatgcatggttttccaagagcccaagaaatggcactcctggcttcccctagcagagtggtggtacaataccacataccacaccgctactaagttcactccatttcaggctttgtacagctacccacctcccctgatcagtgaaatagccattcctgggtcctgtggacactgatgccagggacttctaggctgaaaaacagcacatgttatccactctgaaggaaaacttggcacaggcccaagggcgcatgaaaaaatatgctgacaggaagagactccagaggcaatttgaagttggggatatggtttacttgcgaaatgcaaccctacagaatggctgccttcagaattcgccaagccatgaagctcacaacaaagttctacggcccttatcgtatattgggaaaagatgggccgtgtagcttacaaactccaacttccaacgaatgtgggcatccatcctgtattccacgtgagccagttgaaaaagcacctgggccctcctgcccttcccagtccaaatctccctccttgtgggcacaagatggcagggatcaaaancgaacccttggntgtcctgggaaacccgatcgt

SEQ ID NO: 22787 - DNA, 1482 bp, Triticum aestivum
  unsure (1)..(1482): unsure at all n locations
  Clone ID: PAT_TA_22787
ggtgcattcatcccatttgctgatgactttgacatttccacagtcacaactatagttagggaagtcggtgagattggggatgttaagattatagatctgcagtgtcctatcaagagcctcatcgggaggcaagtttgcaaagtcggcagaagctctggtcacacaactgggactgtgatggcatatgcccttgagtacaatgatgagaaaggaatatgcttcttcaccgacctcctcgtcgttggtgagaaccgccaaacatttgatttggagggtgacagcggaagccttattatcctgaccagccaggatggggagaagccacgtcctattgggataatatggggtggcacagcaaaccgtgggaggataaagctcacaagtgagtatggccctgaaaactggaccacaggggttgatcttggccgccttcttgatcgtctagaacttgatcttatcataaacgacgaatcgctcaaagatgctgtgcaggagcaaagaaaagcttttgtggctgcaattacctttgctattggggaggcctctgcggtgactgttactgccccagaagccaccccagcagagaaggctgaagagatctttgagcctcttgggatccaaattcagcagctgcctcgtcatgacctgacaaacgccacaaccgaaggggagggcgcaaccaacaccccctctgacatggaagagcgtcagttcatctcgaacttcgtcggcatgtctcccgtgcgccatgaccacgatgctcgcaggagcatcgccaacctgaacaacccgtcagaggaagagctcgccatgtcgctgcacctaggtgaccgggagcccaagcggctccgtctggacccggagtccagcctggaccttgaaaaacagcctcatccggacccggaaccgagcctggacctggaggagcgacctcgtccagacccagaaatgatgagcctagacctggagaagcagcctcgcttggacccggaaccgggcctggacctggagaagcagccttgctcggacccgggaaccgggcctcgaacctggagaagcgccttccagccgacccggagccgagcatggacctggagaaatgaagcgctgatcccaatgacatttatgggatgagcatgtgggcgatcaaagtgagtagatggaagaacccctgcggttcagcaaactgaacctgcaatgttagtttatgttaactgctactattggcttcgtgggaagcatatcgtatcatatcttgtactactatggcacttgattcagcccctgtaggatgttgttgggtggtatagccccgcagttttgctgtgctcataagatttgatatacaagaatgctgaatccgaatctcctttcctgggagaagacaatgtgccccgacagatgagacccgggtcaacccttgtacatgttgctaaatgattgatcttcaatattgggctaaatntcaanaaaaaaaaaaaa

SEQ ID NO: 22788 - DNA, 675 bp, Triticum aestivum
  unsure (1)..(675): unsure at all n locations
  Clone ID: PAT_TA_22788
cctgtccgttcgctcccccctcgctatatccctcttccctcttcgtcctccgtactgggtctggttcctccggccggagctctgcgccacctagccggggagcacagcggataagctaagcttcggcggccatggggaacttttgtgtgtgcatgggcggctccgccaagtgcgccagcgcctccactcccttccaatcaaaggtgaacccgaggagcagcacctccaactccaactccaaggcgtcgcgccggagcagctccggcccggagaagccgccgcagccggcggaggcgccgacggcggcgggggaggcgcaggcggtgccgccggcgtcgctcaagtcgttcagcatggcggacctgcgggcggccaccaagaacttcggctccacgtcctacctcggggagggcgggttcgggtgcgtgtacaaggggtggatcgacgagaccacgctcgcccccgccaggcccggcgccaccaacgccatgatggtggccatcaagaagctcaagaaggagagcttccagggccaccgggagtggctcaccgaggtcacctacctcggcgacctcaccatgagaacctcgtcaagcccggcggcggctgctccgaccaaccccaaaanaaaaaaaactttttggtgtttcaaatanaataccncgcggnaagcnt

SEQ ID NO: 22789 - DNA, 678 bp, Triticum aestivum
  unsure (1)..(678): unsure at all n locations
  Clone ID: PAT_TA_22789
agctgctggacatctacgagcagcgcctggaggaggcggagtacctggccggcgacaagttcaccatcgccgacctgtcgcacctgcccaacgccgaccgcctcgccgccgacccgcgctcccgccgcatgttccagcgccgcaagaacgtcaagccgctggtgggacaaggtctcgcagcgggaggcctgggcgtacgtcaagagcctgcagcgcccgcccacgtccaacggcgccggcgccggcgccgctgccgcgcagaaccagcagcagccgcggtccggcgaggcgcgcgacggcagcagcgnacatccacaactaccagcgcgaccagtacgcccgacgcgagcgacggcggcagcaactaccagcgcagccagtacggncgagcacagcgactaccagcagagccggacgggcgacgcgcggtactgatcgacgacgatccagtgcgagcttgggcctgagacggcgctgatgcatgcctcgttctgtgttcctgtgtctgatccaagttcgtcgcaatttacttctcctgtggctgcangggtttacaagtgcaagcccacgcgcccgcccccacgtgtgtgtggtccggttcctccggttctggttggtgtttcctagcgtcccgggtacctctgggcgccnccggggtaataaaaatttgcactttct

SEQ ID NO: 22790 - DNA, 994 bp, Triticum aestivum
  Clone ID: PAT_TA_22790
gaattcggcacgaggctctgctcagctcagctggagtaaaatgtgaagggatccctgatcgagcgaacaagatctgcctcaccaatcaaagagcataggtagctgacctctgatgaaaacggataggagaggaggaggagggcactactgaaccagacaaactgtgttcagctgcctccttggtgcctgtgagctgctgctgctcacttcttcttccccggacatgaattccagccggagcctgctctcgtcgccgctcttccccacctcctctccaaacttcaggtcctccccatccccctcccgcacctcaggtacatcatctactcatacatactactctagttactacaacctccccttctttctgcatctgataggcctgaagctcatctggtttgggcagttccgatgatacatgacagcaccggcggccgggcatccaccgcctgccactactcgccatcgctggtggccgaggagcagcaagcccacagctccgtatccctcaagggcgaaaaggccttgctggagtccctgccgcccctggctttggagcagcacacagaagggaagagcctcaccggccaagatggggcggagggcgagttcgagagctatttgcggggcctgcagcgccaagtcatttaccagcaggcgtttggtgaaaagaacaactttacttgtgcaatcacttcaacttcaacgccgtcagcgaaatcagtttcaagtttggatcttaatgcaacctcggcgaccttgatgaaggaggtggcatttttagcacatggatcaggcacttcagccacccagctgaatgtaccgccaccggttacaacaagtgtggagaccaaccacctgcatgagaaactgctcagcaatgggcaagtgttcattcggtctacacggttgctcgagagaagatcgaagaaacgcaatgttcctcgagcatcaacaagcagcactgatgttgtccagtgcggtgtcgccgact

SEQ ID NO: 22791 - DNA, 200 bp, Triticum aestivum
  unsure (1)..(200): unsure at all n locations
  Clone ID: PAT_TA_22791
aggtcgtcagaggaagcccggcgaccagactccgggctggatactcgcctgccacggcttccgacgaaagcacggaggattcttcatccgagctctacaccggaaaacaggtgtggcctgcggcgccccctccgtccagccctcgctgagccctgccacgcgccgacgcttgcgcccgcctctctccggccgaaaaaaan

SEQ ID NO: 22792 - DNA, 954 bp, Triticum aestivum
  Clone ID: PAT_TA_22792
gcacgaggcccatctccaccgccaccaccacctcctcccgctcctctccatggccgactaccaccgcccctaccagcgcgacctccgtcccccgccgtcctcggccccggaccccaccatcttccacggcaatggttacttctcctccgtcgccccccaagccaacgcatacttctcctccgcgcagaaagacggcgctttccccggcgcaggcgaccggcggatcgagatctacacgacggcgcctccgcctctccccccgcctccgcgcctcgcactgcccccgcccccggggaggagggaaggtggcgtggggagcggcggcagcggagggggaggtgggggtggtggaagcgccaacatgtggtgcttcagcgacccggagatgaagcggcggcggcgggtggcgagctacaaggcctactcagttggaaggggaaagtgaagtcctcgctgcggagggccctccgcttggttcaaaggcaagtgctccgatatcttccacggctggtaacctcttctgctcggacggtgacagggtcccaagaaacctaagctcctgaaaatgtctgcattttggaatcttttgtttgaaggtaatgttcagaataattcctctaccacttaattgaatgcatttgaggttgtgattgtatattggtgagctaatggaggcttagaggaacttgcgacgggtgtgaattcatgaattgtttgtgatgtgtcgtattcgcacctctgtagatttatctgcaagcagtggtggtgattagtcatgttacccatatctgttactaataaaacacaagggctgtgtgggcaaatgtatctttttagtggttatgattatttgttgggagattggttttcaatcagattcagaaatcatggaaatacctacgttttttgtactctatcactatgaatgctgaattgtcagtggtaccattttgt

SEQ ID NO: 22793 - DNA, 802 bp, Triticum aestivum
  unsure (1)..(802): unsure at all n locations
  Clone ID: PAT_TA_22793
gcacgaggctccgtttctgcttctgctccactccactggccggccggtcgctcgtggccgcgatgatggggatttccgctttgcgctcccaccacccgctccccctgtcgaccgcgcgcccggccacggctctcccccgcgccacgtcgccgacgtcgcaccaacccagctcgctcgcgcttctacgatgccgatgccgatgccgacgcagcctcccccattcttgctgcagctcctctcctcgcgcctcactctcgccaggcgcccccgactcggctgctttcatggcattggctcccaacaatgccgcccttcgccaccgcctcatcgcccccaactccaccgccggctccggagacgccgccgccaccggaggcctgcccagcgttgttggcatcgcgcacctggcggtgtcgctgggcatcgtgctggccacggacaagtacctgaagcaggcgttcgtggcggcgtccatcaagttccccagcgccctcttcggcatgttctgcatcttctccgtgctcctcgtcctcgacaccgtcgcgccggcgctggccaaggccttcatggacttcttcgagcccgccacgctcttcatccagcgctggctgccgctcttctacgtcccctccctcgtcgtcctgcccctcgccgtcagggacgtcccggccgcctccggcctcaagatctgcctcatcacattcggtggctggttcgcctcgctcgcggtggcggngtacacggcgctcaccgtgaggaagatcgtcaagacggagctcatcgcggccgagccgatgggcaa

SEQ ID NO: 22794 - DNA, 2359 bp, Triticum aestivum
  unsure (1)..(2359): unsure at all n locations
  Clone ID: PAT_TA_22794
gcgtacgcttggaaagccccaactgatgatttagaaaacttggaattgaatttcgtaaggttggggctgggtgaagctttatgatttgattctgtagtggacgatggcttcaacaatgcttttaagctgactcgatcttcgttaggttggatggagaatgcaatgtcggatgtgacaaaaagactatccgtgctcgtgtcttcaactgctctgaggttatttaacaggctaaagctcccctttcctggatatgtccttggccatgggcctcgaggttctgggaaaactgctttgacacgggctgctgcaaaatacttcgaagaccatcaagagatactggcacacataatatatatggattgttccaaacttgcaattggcaaggctaaggagacaaggcaagcaattgaagagagcatttctgaagctttgctttattcaccttctatcatcatatttgacgatctagacaatgtaatttcagtctcttcagatcctcaagtatcccaatcgtccagttcctctgattcgttagtaagatacttgactgatatcctggacgagtacaaggataaaagtcgtaatgcatgtggatatggacctattgcactgatggcttcagttcaatcacttcagagtcttcctcaagagctgacttcatctgggagattcgatttccacgttgaactccgtgctcttgccatccctgagcgtgaagcactattgaaacatcaagttgaggagcataagttacagtgttctgaggaagttatttcagagatagcgtcgaaatgtgatggctatgatgcatatgacttgggaattctggttgatagggctgtgcacgctgctgcctctcgctttgtccttccttctgcctgtttgaactctgtaaacccaacgctggtgaaggaagacttcttgaaagcgctgcatgacttccttcctgttgccatgcgtgatcttaggaaatatgctcctgatggtaataatggtggttgggaagatgttggagggcttaatgaagcagtaactattattaaagagactcttgaattgccatcaaaatacccaaacgtctttactaaggcacctgtacggatgcggtcgaacatcctcctctatggaccacctggatgcggtaaaacacatattgtgagggttgcggctgcagcttgttctctgcggttcatttcagtcaagggccccggccgcccgggcaggtacattggttcttctgagcaatctgttcgtgacttttttgcaaaggctgctgcggcagcaccttgcttactattttttgatgaatttgactccattgcaccccaacgaggaacacatagtgcaggagtttctgatcgcgttgtcaatcagttcttaactgaactagatggtgtggaaaccttgactggagtatttgtatttgctgctacaagcaaaccacaattaattgatgcggcactcttgcgccctggaagattcgatcgtcttgtcttttgtgattttcctcgatgggatgagcgtgtagaaattctgaaagtgcactctaggacggtttcactggcaagtgatgccagtttggaagacgttgcttccttgactgaaggatttactggtgctgatctcgcggctattctaacagatgctgggttggcagcggttcatgaagttctggacagcaggcaggacggtatcccggaaagagaaccgtgtatcagcaaagaacttctcatgtctgttgctatgaaggctagaccttctacaccagctgatgataagtncggggtacccgaaggcgcctggcgaatttgtgtcgtccaggaagtccctttccacgaaaggctagagagtcgaaaggcaagaaggtgacgctggcttgactacctccttcaagattgacaacttaactacatgggacaaataaggtcacctgcatgctttgatctgcattgctcataaaaggaaatccatgcaaatacgaatttcccgaacatttgggatggacattgggttctctctgaatgcagatgtttggcctagtttctctgatgtccagatggcgcggaacaaaagaacccggccaaggctagcttattttgtactaccacaaaagaaggaagggatctgcacaaaattctgaattgagagtgaaggtgttgccatctaccgtcgatatgcgacactgtatttaccagtgtgccctagtttttctaatcgaattaagagcgtccccgcgtagggaggacacatgctaacagggggggtcctggttttggtggttcgactgttggctatgtttgttttgaggaggtaccgatccgcttccctttgtaataaagataacaaggggattttgtgt

SEQ ID NO: 22795 - DNA, 294 bp, Triticum aestivum
  Clone ID: PAT_TA_22795
ttgctgaagaaatcaaagtcttttttttttttttgctcagttctactgattatttggggcaatgtaccattctcacatttgttgccgcgttctagttatttacattcgattcattacgaaatatcttcaatgtaattcagatacttttcagtcagaaaaatgttattcacgatactgttgaacactagaggaacacttgcagttagaatttcctgcatcatgagatccaatcgtacactgaaatcaatcttagtgccaaataaagtacaactatcatttaccaaaaaaaagaaa

SEQ ID NO: 22796 - DNA, 673 bp, Triticum aestivum
  unsure (1)..(673): unsure at all n locations
  Clone ID: PAT_TA_22796
ctcgtgccgaattcggcgcggccgcctcttcgccggccggccagccagccatggcaaatgcttccctccagtccttcctcccccagcaccaccattctttcctcagcagcgccacccacgacggctcccctcccgcgctcctcaagctcaccaccaccaccgccagcaacagcatttcattcaagctcttcgccagcggctcctcctcggtgaccacaaccgccaactcgccggccccgactccggcggcgacaacctcgccgcccaccccctcgctggagctcctgggccagcagctggcggcgggggactaccggcaggccgacgagacaaccgggccctcctcatcgtcctcgccggcgaggccgcgcgccgccgagggtacgtcttcttctcggaggtccaattcatctccgtggaggacctgcgcgccgttggacgcgctctggctggagcacaacggcggaagttcgggtacacgtgcacgccggtttgggagaatcgctgccgagtnaaccgcttctcataggatcggtggagaaaaacggacacgaggtggacaatcactacaggcttccgacaatnattggaagccacgagaaacccggggcactgcctacaaagcctagggaanganctggaaatttncaccgctnangnagaagggantcaa

SEQ ID NO: 22797 - DNA, 746 bp, Triticum aestivum
  Clone ID: PAT_TA_22797
ggttccagccgccaggccctgctactatccgggtcaacagcagcctcatacaagcgggttccaaacaccaggatcataccagtacgagtatcagagtcagtcgcctgttcatacaggctggggttaaaggccaggaccatacaactaacgtagtcaaccgcacagctcatgacaactgcaggcccacatgccacgccagtaactggcgtggggcgcaatacacacccggccatcagctgaggtattaggatcatggggtgaactggcggggcgagcgcaatgcacaaggactccatcaagactaatacgtgcaatagggaatgggggtcgcaaaaggcacgagcctgttcctggtgggctggaagcagcccccatcagacctgaccagaactgttagccagcgcaaagatagcaatttgctgtttccagtggctgccaacatctatcgatttcggattcatgatgtatgtcatccttcatactttagcttgtccgcgagctgaaaaaatctattggtttcgaattcatggtgtagtgtaatccttcatacttcagttcgtcgcggaggcaacgtaacgatttcccctagaaagattttgtgcagaatgtttcgctggtgtaatgtcacttgagatgcccaaccttgcgtttccctcgtccctgatgatgactagagtgttgttgcctttatccactgaactttgctccacatgtattctccttgtgctgcatcttctcttttagag

SEQ ID NO: 22798 - DNA, 372 bp, Triticum aestivum
  Clone ID: PAT_TA_22798
gtttctgcggcgtaggggccacgtgctggagagcacgtcgcccggggccgtgtgccagttgatcgtgcaggacttgctggcgccggtctcaggtgggggcggcggcggcgagaacgtgttccgcgggatgctgacggcggtgagcgacccgaggaaagacggcagccctgccggactatgatggacatattgttcagacgtgtcaggtgtacatacattcaaacagattgttctgaacccaatgatctttctgaatgttacaaagtatttacatgtagtttgtcactcccttcaagcttcaagctaagggttgagttgtctccaaaaaaaaaaagagatgagggttgagccctatatcacaaatattctttg

SEQ ID NO: 22799 - DNA, 376 bp, Triticum aestivum
  Clone ID: PAT_TA_22799
acgggcaggcagcatctccttgggtagctccgtctagtttgaccttcttcttcttcctcctcctctttcccctgcaaattgagcgagaaaagtaaacaggagagggtaggggagctcccccggcgttgacttggcgtctgcccgcctgcctgtccggatctgtggtttcccgcggctcaacggcaggccacatgatccagcctacagtccagcaagaacacgggagggcaaattaatctgcagcaagtagtaccagccacgatctccccgagatcccgcgccattaataccgacccacaccttgcttctcctcctccccacgcatgcgctgctcgtagtgcatgcgcctaatctgccagtcgctggaccgatcgag

SEQ ID NO: 22800 - DNA, 708 bp, Triticum aestivum
  unsure (1)..(708): unsure at all n locations
  Clone ID: PAT_TA_22800
gccggtttttcacaaaacattaagatagcacaatagcaaacgtacacagctctcaaagcctcgctggaatcagcaggtatatgcatggcgtccttgggtaatagaggtgccagccgtttcatggcgctcctcaagatggctctcctcgtcgtcgtcaccaccttcattatcaacagctccgtctgccttggagctgccggccaccacaatactgcaggccctcctactgtcaaccatcgcgggtgccttggcaagtactattgccgcccgccggctggtggccaaccctaattatattagatcagggacgcagcttgctactcaccactcatcttcctttttgtatgggtgaatcgttgaataaacttattcggatcacttgggtataatacctcctctgtccgcaactgatgaagagtggcaacagatcctggtgtccagtaccaataaatgaacctatacatttgtgtccgcatattaccagtttgttacctggacttgtaatagtttgctggttattttgtaaaacagccgtttggttgatctggttatgtcttttcagggctagctaccttggtttcagcctgggtagtatgaactctgttcttggtttctttcaatcaattgaatggaaccggggtaaacccacatttgcttaaaaaagttgaataanacgtttcggaaaaaaaaaaaaaaaaaggcccctaa

SEQ ID NO: 22801 - DNA, 739 bp, Triticum aestivum
  Clone ID: PAT_TA_22801
tgccggccgggtcaggctgctggcgcccggggacagggacctcccgccggtccccctcgagaaggtgcccgaggccgcgggcctcccgcgcctcgcccccgttgcgctggccgacgccgctcggcgtcgcggccctcggcgcggcggaccccggcgacgggaaggcggtcgaagaagcggagttcaagaagctgctgacggaggtgcttggggccgtgatgctgcggctgagcggcgaacccgatcttcttctccaccagcaccgtcgtccacgagccgctgtccagctcgtccgccctgttgccgtcgccggcggtggcatcaccgccgagcgagtagcaatatgcacatgaaaggtaaatagtatgggagtgggcataaggcctctccgtaagcggtgcctgtggttgtgctttttatctgatcacgagcattcctgcgttgctatggttgattggaacctgacggaatgcagcgttgcagttcgtcaagtactctggttaatgtataagtttggaataaggctaccaagccataaagacaaattgtcaatgggaaatgttactgcgtgcgaatgcattggttgggggagatgctacgtgcgaaagcattatctgtgttctgatgtaagaatgggagaagaaacattcagctttcatttccaataataatcaggaaaagaaagtaatttttgtgtaataataatcatgaaaagaatgtcttaaaaaataaaaatatt

SEQ ID NO: 22802 - DNA, 858 bp, Triticum aestivum
  unsure (1)..(858): unsure at all n locations
  Clone ID: PAT_TA_22802
ggcacgaggtctcgagttttttttttttttttttagaagaagaaaaaagtggtgaccacgtccaacgtcggttctttttcttgttttagaacgatccccaaatatcaaaatccatatgaatattgtaataggtatatagatataatagatgctgtctgcacactgctagtgctactacagaagaagcagacaattgaaaccgtagaaaagcaaacttttgtttggaccaacagcacgagaggggaaatgtactgcaggctgaactgattcgagcacggagtcatggtcatggagtaggatcagctatctatgcggaatagagctcgggtctggaaagcctcggcgtcggaacggcgaccagcggcgtggccttcttcatgacgatgccgaacttctctgtcaggtccagcgccgctccctccggcagctcccagtcgaaggcctgcagcagcatggccacagagtatgccgtcatcctctcggcatggcgatgcccgcgcagatctcctccccgacccgaacggacgtatccaagctcgctgccggtgaagtcaacttcgccgctgtcacgtcgctcgcctgagaggcgaacctctccgggttgctcgccgcccggctccctgcgcgccccggggtccctctgatcgcccacgcgttgacgaacaccgcgggtttccnccgggaccccggggggccgcccgaccggccggggtntttccntggggccagnggcggggacccttganccgggnanccgcccgggtggccaacccggagccgttttcctttganccacccantttgcaaaanagtggcaactttgcggggagaanncccaatttcttccccaccnccatt

SEQ ID NO: 22803 - DNA, 717 bp, Triticum aestivum
  unsure (1)..(717): unsure at all n locations
  Clone ID: PAT_TA_22803
gttttttgttcaaatcaattattaccttttttgtgaggggttcaaagaaaaaaaattgacaaaccaattattattacttaaaaggataagagcatccgtttgtcttttgggccaacggccctctcttctggcctgccgcatccactctgtccaccgaatcttatcatgtctgcttccctgagctcatcttcttctcctctctctgcctccaagtcctctctgactgcgctgtctcgctagatccccggagagcaagaagagcaccaccatctgctccaacccgccgactggtagatccgttttggttcttaacagaatcaacgagagacccctccgagcacaaggctaattaccaagccctctgggtttctgttttggacccattctcatggagttggtagatctgtccaccacatcgctagctgaggcaatgtttgagaaagctcgggctacctaaaccagtctattatgtgcaccaccttgcagctcctccgatttagatcagaggttgaatttcattggtacaaaagagcgcttccacgcttcnagcacgtngggactaaactgtcaaagttggtatatgtgagcatggggaagnatcattgaatcatncangcngataaggncatcggggtacatgggaaccaagngagaggnaggttgggtgggtaactactacaagctggcaggagcangnaaacagcacttttgggtcaa

SEQ ID NO: 22804 - DNA, 1377 bp, Triticum aestivum
  unsure (1)..(1377): unsure at all n locations
  Clone ID: PAT_TA_22804
cggncgcgtgggcggccgcgtgggcggacgcgtgcaggaaaaatcactgaactatgagtgcagacctaaacagagactacgagattggcgaggagatcggccgcgggcggttcggcgtcgtccaccgctgcacgtcgcgctccaccggagaggccttcgccgtcaagtccgtcgaccgctccaacctcgccgacgacctcgaccgggagctggcggagatcgagcccaagctggcccagctcgccggcgcggggaacccgggcgtcgtgcaggtgcacgccgtctacgaggacgactcgtggacccacatggtcatggacctctgctccggcccggacctgctcgactgggtccgcctacgccgcggcgcgcccgtgccggagcccgtcgccgcggacatcgtcgcgcagctcgcccaggcgctcgcgctctgccaccgtcgcggggtcgcccaccgcgacgtcaagcctgacaacgtcgtcctggacgtcgacgacgacggtgaaaacagctccccgcgcgcgcggctcgcggacttcgggtcggccgcgtggatcggcgccgacggcggccgcgccgagggcctcgtgggcaccccccactacgtcgcgcccgaggttgtttccggcggtgactacggcgagaaggcggacgtgtggagcgcaggtgttgtcatgtacgtgctgctctccggcggcgcgctccccttcggtggcgagacggcgaaggacgtgctctcggccgtgatgcggggcagcgtcaggttccctccgaggctgttctccggcgtgtccccggccgccaaggacctcatgaggcggatgatgtgccgtgacgagtggagacgcttctccgcagagcaagtcctccgccacccgtggatcgtgagcggcggaggagcccgggcgatggagcagccaacctgaacggccgccggatccgagacacgccagagcagatcgaggcagatttagagcatgccgcccgtgggaccccggctccgcagagaagtagagatagtcggcgatcgagacgcaccggccgacgatgttaatacggtttttgtacgcaaggccgcgctgatacatacggtagtacgtatcgcgctacggcagtagatcgagtgaaccttagaagaagagcagtagcggctccgcttggacctgtgtttgtccagctttatcctttcttgtgtgcgatgctgcatgtcatgatggatgatgcagcaggagtttttgtatatattcgagcgtgcgtatgtacgtcttgtacaaactaatggagatggaataaaatgagctagcctagcttatgctttgcttccctttaaaattccaaaaaaaaaaaaaaaaaaaaaaaaagtcgacgcggccgcga

SEQ ID NO: 22805 - DNA, 485 bp, Triticum aestivum
  unsure (1)..(485): unsure at all n locations
  Clone ID: PAT_TA_22805
gcgacgaccccgagggacgcgagatcctgctgcttcgatgacccgagaggcaaggtgcaagacaataggcacgataattcaagagcaggcatttcttctcaagcatccagattcaacatagggaagaggacgctgccgcagccggcggcttgcagtgtcgcgcgccgggtactggggggccgtcccgggggggcccgatccatccaggactcccgtttttcgcttttgttctcgcccacggttcagttgggaggcctgtagcgcagaggtcttcggccgccggggccctgccgggagccccccccccgccgcccctggttgtcgtgccaacgtctgctccacgctagcagtatcacacnggaggtacaaaggggtagtcccactagttcaagaactaaacaagaatcaagattttctgttttgtttttgcccaacgattaataaggataaaaataatgcaagangtacttctatttatcccnacn

SEQ ID NO: 22806 - DNA, 1243 bp, Triticum aestivum
  Clone ID: PAT_TA_22806
cttaccccttcctccttggtttctgtcagtcacttccccctccccctctccgccccagtctctcttggtctctgtcttctcctcttcctgccccaagctagggttcgtggagtttcttgctagatctgctccctctgcgaatacttcttcttttgctttttgtttttgctggatctgctccctctgcgaatactacttcttttgctttttgtttctgctagatctgctcattttcactttgtttgtgcttactaaggtgcttctctatggttcactatggtgtttgcaggatttaccaatcgggggagtttcgttgatgacggattgccgttgctccatctcctctttttcaggcatggtttgccctgtttgtcgttgtccaggtgctccttgcgtaccatttctgcgagcggatgaagtccctgaagttttcgatgttgtcgttgacgaggattgcttcacaagggatggtccttgccctttgcctcgatttctttgtgctaattcttatttttgagtggtcatcaagtcttgcgctacaactgtttctacattgttcaaactctgctccaatagctgcatttctgtgcgctctttctttccaccgaattgaccacacctccctgttttgcgttctgcttgtgctctccttgtaccccatgacgttgtccacgtagtccgccctgttatgtacgtttcaacggaggtcaacacatgagatacaacaggattatggaccctataattaaaggaaaagggggtgtgtggtccgattgtcatttaccttgcaattaccaggaagcagcttgttctccagaaataagggcgatcggagaagaatctgtttctaaggaggaaattttaggacaagatctacatagaggtgacacgaatgcagcaaaaactgaggtcaccagcagcgtccgtggcggcggctgggaggtaggaggtcggggaagaaagaggatggaagaagacctagtgatctcagcgttaggtggatcgctttgttttgagcggagtgggttgcttagcgggtccaggccggttttgcgtttgggcttaacaaaaggcagaaacagataacgtaattttcttcagtctctccggttgtttgcctctggcgctcgtttcgactgaccttaattctggttcagtcagttttcatctgtttccttttgcatcattttgtaccaatcgactgaccacttttctgggtcagtcgattgatctgtagccgctc

SEQ ID NO: 22807 - DNA, 2725 bp, Triticum aestivum
  Clone ID: PAT_TA_22807
gcgcgcgcacacaccagctagcagccgtggttgcatccttccagggttcggcgcaggagatggaggagggcgctgccggaggaggagggggtgggggcggcggcgtcgccgtcgccggcgatcgatcgagcttcgtgatcggcctcatcgagaaccgagccaaggaggttggtgttgcggcatttgatttgagatcagcctcactgcacctatctcagtatatcgagacgagctgttcataccagaatacgaagacactactgcatttctatgatccgaatactgtaattgtgcccccaaataaaactgcggcagatggtatggttggagtttcagagctggttgataaaaattaccaagcaagcaaaaaggtcacgatggcacgtggttgctttgatgataccaagggggcggttatggtaaaaaatctgtcggctagagacccatctgcacttggtttggatacttactgcaagcagtactatctttgtcttgctgcggcctctgcaacaattaagtggatagaatcagaaaaaggtgtaattattactaaccattcactatcagttacattcaacggctcatttgaccatatgaacatcgattcaactaggtattgttttgaaacaaccgaccctcaaattctatcaatgttcaaacattagaaataattgaccctctccatactgaactgtggggtactagcaacaaaaagaaaagtctctttcagatgttgaagactacaaagactacgggagggtctagactactgagagccaacttattacaaccattaaaagatattcaaactatcaatgctcggcttgactgcttggatgagctagtgagcaacgaggaactattctttggcttgacacaaggtctccgtaaatttccaaaagaatcagataaggttctctgtcacttttgcttcaaacccaaaaaggtcacagatgaggtactgaagcctgccaatggtcgaaagagccaattgttgatatctgacattattgttctaaaaactgctctggatgcaataccattcctctccaaggttctgaagggggcgaacagttttcttcttcagaacatttatcagaccatatgtgaaaacccaaagtatgggagcatgagaaagagaatcggagaagtgattgatgaagatgttattcattcgagggctccttttgtagcctgcactcagcaatgtttcgctattaaaccagggattgatggcctacttgatgttgctcgtcgatccttctgcgatacaagcgaagagaggagtttactctgccaaatttgaagataccgtataacaatagactggggttttactttattataccgcagagggatattactgaaaagcttcctaataaatttatccaggttgttaggcatgggaagaatgtccattgctcaagctttgagctagcttcgctaaatgttaggaacaagtcggctgctgctgagtgcttcttgcgcactgaactctgtttagaaggacttattagtgagatcagagaagacattcgtatcttaacaatgctcgcagaagtattatgtcttttggacatgattgtaaattcttttgcctatacaatatctacaaagcctgttgatcgctacactagaccggagttcacaggtgatggtccaatggcaatcaatgctggacgacatcctattctggagagcttacatactgattttgttccaaataatatcttcctttccgaagcatcgaatatggttcttgtcatggggccaaatatgagtggaaaaagtacatatcttcaacagatttgtctaatagttattcttgcacaagtcggctgttatgtcccagctcaatttgcatcactgagagtggttgatcgtatatttacacgcataggcactggagataatgttgaaaacaactcgagcacgtttatgacggaaatgaaagagacagctttcatcatgcaaaatgtttcttcaaggagcttggttgtagtggatgagcttggaagagctacttcttcctctgatgggttggcaattgcatggagctgctgcgagcacctgctatccctcaaaggctacacggtgtttgcgacacacatggagggcttgtcagagctcgcaacgatgtatccaaacgtgaaggtcctccatttcgaggttgacttgaggaatggtcgcttggatttcaagttccggctgaaggatggcgtccgacgggtaccgcactatgggcttctactagccagagtggccggcctacctacttcagtgatcgacaccgcgaccagcatcacttcacgtatcacagagcaggaaatggttaggatggacgcgaactgcgtgcagtaccagccgctgaggatggcgtaccaggccgcgcaacggctcatctgcttgaagtactcaaaccaaggggacgactacatccgtgaagcattgcaggacctcaaggagagttacgctgcaggcaatttgatatgaaacaacaggagattacgtctccaggaatttgatagaggtctgtttgtaggtctatggccgcagaggatccatcagtcttattttcatctgtcactgtaattatatagtatattagtcaaaatccgacactgaaagtggcgataagggagagatcccctaacacaaagcacacccggagtcgatgttgagacgcggaataggaggaatcctccttacaattgcatatttgcgc

SEQ ID NO: 22808 - DNA, 681 bp, Triticum aestivum
  Clone ID: PAT_TA_22808
accaccaccaccgtccggcgagaggagagcagaggaggagcgagcaaccggcggcgaggcgatgcagatcttcgtgaagtcgctgaccggggggaccatgacgctcgaggtcgagagctgcacggccgtcgacagcgtcaaggccaagatccacgacaaggaaggtatccagccggaccagcagcgcctcatcttcgcggggaagcagctcgacgatggccgcaccctggccgactacagcatccacaaggagtccacgcttcacctcgcgctgcgcctcgtcggcggtggcaagggcgggtactaccccaccaggatggagcctaacctgcgcatgcttgtgtgccgcaagtgctatgcacgcctgcccctcaggtctgccaactgccgcaagaagaagtgcggccacagcaatgacatcaggcccaaggagaagctgcgcccccactaaagcgttggaaacataactaagtgacatacgatagctggattaactgggaattcaaagttcggttcgagtcttagtttcagttaaatgttgcttctggaatctagaaccctatgctcctgtatcagtttctctcgtagtactgtccaatttgctcttgcatgaatgatgagatcagatatttgaggtctactagcttgacctagtatatgatgaagtcaagtaatgctctt

SEQ ID NO: 22809 - DNA, 784 bp, Triticum aestivum
  Clone ID: PAT_TA_22809
cgtccgcccacgcgtccgcccacgcgtccgcccacgcgtccgcaccaactcacaccatcgccaccgccaccgccactgcactccggcgacccgcgaagatgcagatcttcgtcaagacgccgtcggggaagacgatcacgctcgaggtcgagggcggccacgacatcgccggcgtcaaggccaggatccacgacaaggaagatgtgccgccggatcagcagcgcctcatcttcgcagggaagcagctggaagaaggccacacgctggcggactacaacatccagaaggagtccacgcttcacctcgtgctccgcctccacggcggcaggggcggcaccggcaagggggggacctaccccaagatcgagcccaacctccttcagctcgccctcaagtacaggcagcttaagctcgtctgccgcaagtgctatgcacgccttcccgtcaggtctgccaactgccgcaagaagaaatgtggccactgcaacgagacgaggacgaagaagaagctgaaacccagggagtgaagcactgcactggccagcaagagaaagggatacccaagtgacacgcaccagctgaatttaccctaccgtctccttatattagcttcttgattgataccatagtagcttcttgattgataccatagtttaaacaccctaaatacgtattctagctgaatagtactccctatggattcctgtagcatcatggaattctgttaatgaccccctaaaacctctcgatggtgatgcagtgcttaagggatgctaattcctgc

SEQ ID NO: 22810 - DNA, 785 bp, Triticum aestivum
  Clone ID: PAT_TA_22810
cggccgctcaagccggcaggccgggcttcaaaaaccagccatccggcgagagaggagagcaaaggcgagagcgagcagcctccaaccggcggcaaggatgcagatcttcgtgaagacgccgacggggaagaccatcacggtggaggtggagagcggcggcgccgtcgacagcctcaaggccaagatccacgagaaggaaggtatccagccggaccagcagcgcctcatcttcgcggggaagcagctcggcgacggccgcaccctggccgactacaacgtcaagaaggagtccacgcttcacctcgtgctgggcctcgccggcggggacaagggctcctgctacccgcccaagatggagcctaacctgctcgcgctcgcgctcaagtacaggcagcacaggcttgtgtgccgcaagtgctatgcacgcctgcccctcaggtctgccaactgccgcaagaagaagtgcggccacagcaatgagatcaggcccaaggagaagctgcgctaccactgaagcattggaaacttgaccctgggagacatgccatagctggattaactgggagttcaaagtttggttggagtcttattagtttcttggatatgaagtttcatcctagttaaatgttgcttctgtaatctagaaccctgaaagatgctgctagtacgttgctcttgtattagtttctgccctggcactgtgcaatctgctcttgcatgaattaatggtgaaataaagtattcgaggtctacttgcatgaatgatcaaaaaaaatagtgccttt

SEQ ID NO: 22811 - DNA, 806 bp, Triticum aestivum
  Clone ID: PAT_TA_22811
cgtccgcggacgcgcgggcgggggcgtgcctcacaccaccgccaccgccacccacgctgcactccggcgacccgcgaagatgcagatcttcgtcaagacgccgtcggggaagacgatcacgctcgaggtcgagggcggccacgacatcgccgacgtcaaggccaggatccacgacaaggaagatgtgccgccggatcagcagcgcctcatcttcgcagggaagcagctggaagaaggccacacgctggcggactacaacatccagaaggagtccacgcttcacctcgtgctccacctccacggcggcaggggcggcaccggcaaggggggaacctacccgaagatcgagcccaacctccttcagctcgccctcaagtacaggcagcgtgctatgcacgccttcccctcaggtctgccaactgccgcaagaagaaatgtggccactgcaacgagacgaggaccaagaagaagctgaaacccagggacccatgaagcactgcactggccagcaagagaaagggatacccaagtgacacgcaccagctgaatttaccctaccgtctccttatattagcttcttgattgataccatagtatcttcttgttaccagtagtaccttttaagttcctgctgctgctgggttttaaacaccctaaatgcgtactctagctgaatagtactccctatggattcctgttgcgtcatgggttctggtgatgaccccctaatactctcgatggtgatgcagtgcctaaaggatgctagttacaattcctgctggtatcatcacatggggtctgttctg

SEQ ID NO: 22812 - DNA, 845 bp, Triticum aestivum
  Clone ID: PAT_TA_22812
ccgccggcgttccgcccgggtcggcacttccaccaccaccaccaccaccgcccggcgagaggagagcagaggaggagcgagcagccggcggcgaggatgatgcagatcttcgtgaagacgccgaccggggagaccgtgacgctcgaggtcgagagctgcgcggccgtcgacagcgtcaaggccaagatccacgacaaggaaggtatccagccggaccagcagcgcctcatcttcgcggggaagcagctcgacgatggccgcaccctgaccgactacagcatccacaaggagtccacgatccacctcgcgctgcgcctcgtcggcggtggcaagggcgggttctaccccaccaggatggagccctaacctgcgcatgctcgcgctcaagtacaggcagcacaggcttgtgtgccgcaagtgctatgcacgcctgcccctcaggtctgccaactgccgcaagaagaagtgcggccacagcaatgacatcaggcccaaggagaagctgcgcccccactgaagcgttggaaacataactaggtgacatgcgatagctggattaactgggaattcaaagttcggttcgagtcttagtttcagttaaatgttgcttctggaatctagaaccctatgctcttgtatcagtttctctcgtagtactgtccaatttgctcttgcatgaatgatgaaattaatcaggtatttgaggtctactagcttgaattgtatgatgaagtcaagtaatgctcaagggatcctagttacgaattcctgctgttatcatcacatggacatgggttctgttctgtggaatagagaaggagcttctccagtttacaggcaggcac

SEQ ID NO: 22813 - DNA, 1658 bp, Triticum aestivum
  Clone ID: PAT_TA_22813
aaatcagccgcccaatacgccgctccttaccctccaagcgacgcccccgtccccccctccgcgcgcgcgcgcgccaatcctgttcacgccggggcacgggaggcgcggcggcggcgaacggagaccggccggcgcgctcgcgcgggcgggcgcgcaccgatgaaccacaggttcgcgcggcgcgcccacagggtccgccgctgcggcaggcaagcctccggggacgatctgaacgacgagcggaatggatccatcaggtgggtgttctcgctgagggagctccagtcggcgacaaatagattcaattacgacaacaagatcggagaaggctcgcttgggagcttctactggggacaagtttgggatggctctcagattgctgttaaaaagttaaagaatgcaagaaatgggacagaaatggaatttgctgcagaagtggaatctttgggaagagtaaggcacaaaaaccctcctgagtttgcggggatattgtgctgatggacctgaacgcattctggtgtatgactatatgccgaactcaagtctttttgcacatctccacggaacacactcttcggagtgccttcttgactggcggcggagaagatttattgccattggttctgctcgggctattgcgtatcttcaccaccatgagacaccttcgataatccatggaagcatcaaatcgaccaatgtgttacttgattcggatttccaggcacacgttggtgactttggtcttatgaagctcatctcagatgaaatagatcatgataagataatcggtgaaaaccaacgaggctatcatgctcctgagtacgtcatgtttgggcaagcctacaacaggttgtgatgtctacagcttggggataatacttctggagctcactagtgggagaaagccagtagaaaaatcaggctcccaaaaaatgctcggggtccgaaactgggtgctcccgttggcgaaagaggggagatatgatgaaatcgcagactcaaaactcaatgacaagtattccgagtctgaactaaaaagagtggtgctgatcggactagcgtgcacgcacagagaaccagataagagaccgacgatgctcgaggttgtgtccctgctgaaaggtgaatcgaaagagatgcttctgaggcttgaaaaggaagagctgtttaggccagattcgatggctagttccgtcggaacgactccggaagggagcaccgactgcattcttaagaatgatgaaagggctggctggggcttgatgggttggtaccctggcccctaggtattggtagagtggatattcttgctgaattggagcttggtctgcatggtttggcttgactgaaatgtataggattggtttgttatttatgatgaactcctcccttttttgagagagggggagatctagagaggtgagttggctttttatagaaagtgctttttgtgtgcactgggtggaagacccgtatactcccagatgtttgggcatgcgtcatcctgttgtcactgtgttggttactctaaacaaaatttccttctgcatacaactgaatgcagatgtctggatgatcatgttctctccttcctgacaataagccctctgcagggcagtctggcaaaaaaaaaaaaaaaaaaaactcgagactagaaa

SEQ ID NO: 22814 - DNA, 783 bp, Triticum aestivum
  unsure (1)..(783): unsure at all n locations
  Clone ID: PAT_TA_22814
gccttcgctagggtcttccgggctccccgccggggggggggcgaggccccctgccgccaccgcttgaccctccgcgggaccggcaaggcggtgggcgaccggcaccccaagatcggggacggcgttctgattggcgccggggcgacgatcctgggcaacgtgttgattggcgccggggccaacatcggtgccgggtcggtggtgctcctcgacgtgccgccgaggagcaccgcggcgggggaccccgcgaggcggctcggcggcaagaagggggacgacatgcctggggagtccatggaccatccctccttcatacagcagtggtcagactacaccattttgaggcattgagcacgagcaagatgccactgtcctcctctgtaacctgcaatactaatgcccgtgctcgtccctttcttgctctttcttgaactgctgcctccgctgtcgtgctgtgagccctgccgcccgttgccgtgctcgtccccgacaccggtcctgacctgctcgccccctgtccctggtactgtgcgggatgctctcctcgttcctctagtttggcggcctacaaaaaacataacactcgcagcaacagcttggcggtcatagtcgccgttcgtacttgggacgacttagatgccgcgtgtccggacaaatgtgctgaaacttctttcttcaattcccgaattccaaagagaangggggagcttctgtacctgcctatctctccgaatatattcaagatgcagaatgactaatcatatctaaatgttattaaaaaaa

SEQ ID NO: 22815 - DNA, 932 bp, Triticum aestivum
  Clone ID: PAT_TA_22815
ctctcgcggcgcaaactagagaagcggagactgcagatcgagaatcgccggtgggagagatggagccgagaacgaggcgatccaccgcagatccggcgcgctcctcctcctcctcgccgctgtattcgcggcggccgccggcgcctccgcctccgccatcggcgacaagtgcgccgcctgcaaagccgtcgcgtctgagctagagattggaatatcaagtgagaaaccaagaaatcacttggacttgcgtaacaggttaaattcgaaaggtcagcgcgaggggaaggtcatcgattacagagtcagcgagcttcggattgtagagcttctggatgacctatgtgataagatgcaagactatacgctgcagaagttggaatcaggcgaaaaagaatgggtgaaagtaccaagctggagcagttttcaaactgataagaaagctgcagcacgagcacactccaaaaatctatccagttactgtggaaggttactggaggaaactgaggacgagcttgctgagtggataaaaacaagctcggcagaatccgcggacgtgagccaggccctttgccaggatattagcaaacactgccagtccacaagtgctacggccccggtcgacgatgaactataacagcacgtgttagctccccgtatttactcgacaaagaaaagcagatgaatgcctgagaagcgtcaaagaagaagctccagtaggatatgaggctgtgatgtcttagcgtctgcatttttacacactcgcattgttgtcttaaagagggacttgcagattttcacatatgattactgatgtattgagaacattcaaactttgaggaatttctgcatgctgaattacagttagcagcatggtatgattcgctgaactcagctgtcttcttataaaatattgaaaagccgagcgagccctt

SEQ ID NO: 22816 - DNA, 681 bp, Triticum aestivum
  unsure (1)..(681): unsure at all n locations
  Clone ID: PAT_TA_22816
ntacgaattagccccaanagggccggtttccactttggnccaaaatgttngngtgtgcnataatgtatanntnggggtcgcctnttnaantgttcgactntcatncntattntgggngcntaagaaccacttgcaantccacgttccaaagtgtaccgatgcaatngtaaatngacanttgtaaaaatgctcaaaggaaaatnataagctgacgctgtatatgatctcccattgatgaataatacgtttaggcgtatgtttacaatgaatgcattaagcggataatttgacatatcatatccagaggcaggctacgtatagatatatgaagcaggtataacgatcgcaaatagataccacctgggtatttccttctgtgtgcaaagcctgttgcctccttggttctgtctcttatgtaagtccgacaatccggctcttctggagaagctgcgctaaagcaatgtccttaaaggtaaatggaaaggttacgaagctattccgcactgctgactgagccactgctgcgcctccgcctctgcccatggtattttgagtgcgtaattgtgtacgcgtggcacgaatgctgctttgatggggcttgagcagaggccggactgatagttgcgctcttggcatgcctggtgatcctgttgcggggtgctccggnctcgcttgacggtg

SEQ ID NO: 22817 - DNA, 1237 bp, Triticum aestivum
  unsure (1)..(1237): unsure at all n locations
  Clone ID: PAT_TA_22817
caggcgtacggcacccgtacggcagttgggacttatcacatatatgctgtcttgataaccactgtgcttggtgtgccatggtatgcaatcagcctcataaaaagaacttgactagctgtgtacccaaaaatattccagatcatctacttacccaatcaaagggcttaaccaattgtaatacatcacagttcatgcatcagatcgcatgacgttatgcttaagttattacattagactaatataatttggagggatttgaatatgagcactctattgttttcagcctcgccgtcctccgcccgccgtgctctccgctcataggtcccccgcccacccgcccgtatctgacccaccagggcaccacgcctccagcctcttcttccagcttcctggtctcccgacgccgacatcagctacctgaacaaattcggcatcgacagacaaccgaaccgaatttccggtcctgcgaatgggtggtgggagctgcgatgtgtgcaaggaggcgccgtccaagtacaagtgccccacctgccgcacgccctattgctctgtgatatgctttaaaaaacacaaagttgaattctgccaaaagatagtgccccaggaagaaactaacaagccgtcgctgcaggaggaagttacgacgagctctgtgttgcttgaaaaaggaacagattatcctaatatcaaggatcagcttccctctttaagtaaaaaccctgatgaggaccagcttccctctttagcagcggacacaacatgccctgcacaatctccaaacacagtgtgccctacaaaagctcttgaagttgaggatccaagctggcttgttgaccggtattgagtctggtccttagttgagttgaagggagtcaaggatgctctcagggactctgaactgcagaaaatgatacttcaaattgatggctcttcagaaccagaaaaggaattggagaaattgatggaaggacaagcttttcaacagttcgccaataagattcttgacattattagtgcacaacaatgagcaagtatccatctgctgaagctctcccaccagagagaatggagacatccgggcaaaatgagaccagagcagctatttggagaagttaaatcatccnataagatatttctcncagcggtgttggggngtgttttgtaaaatantctttgctgcattatatggtnggaaaaaacttgaganctgacacatgntgnagggatttcgtccaan

SEQ ID NO: 22818 - DNA, 782 bp, Triticum aestivum
  unsure (1)..(782): unsure at all n locations
  Clone ID: PAT_TA_22818
cctattcggtcatgcctggcttagtttctggcgggtgggggtcggagcggggggcgcggggcccgggggtgcctgggtgggtccatcgtcccacctggccgctgtcgctgggcgtcgccgccctcccccccgtcgtcgtcgcgctatccttccaccagtcttcgaggggatggcctcggcggttgcatcgcacaggctgtttcggattggcaacagtgggttacatgtgcataatgttctcagtgacaacaccattgggaatacttcttgggatggcagtcttccatatgactggttatgacgatagcagtcccaaacgccctaataattgaaggccttcttggttcactctctgccggaatccttgtctacatggcgctcgtcgacctcatttctcttgatttcttccacaacaagatgatgtcatcatctctgaaactgaagaaggcctcttatattgcattgggtgcttggatctgcttctatgtcgatattagctctctgggcataggccatagtgaaatgtatagagggatcattctcaggttccaacatcttgcagtgcatatctatggactcatacttcccctatgtatatctgaaatgacacgttatggggaactggaaatggaatccgcccagtcccgctgttaaaaacaagaggcaagaatttgnaaaactctcccaatgagaaanaatantgtgaaaacaaatcctgcggtggcgtgattggaacttnaagtggctgaaggggggtcaaatgtaaggtgagaggtaaacct

SEQ ID NO: 22819 - DNA, 804 bp, Triticum aestivum
  unsure (1)..(804): unsure at all n locations
  Clone ID: PAT_TA_22819
attgaatccaacttatattctatctgaccaacgtatgcaaggatagcaaccacatctgccaatttgaaatcagaatgagactctgagttatacaacataatatacaacaacaaatgtaaagatgatgcaccagtgatggttttgtcccgtagctcaaatatttcttcaaactgtgggaagcacagtgggcaaattgtcgacgttatttgctgtgccgacatccagacctcggtcgtagaacttagtgtggtgacaaagtccatgtttaggtaccagaaatgtccatctggcatttctgtggggctgaacccgacgcgattgaaatcataggtcccaccggtttgtagcatgctgttgaaacggattgcctcgctgttgtacgcaattgattccatctttgttccctaaaatatttttatgaatcataaaacaatgtgcaaaaaaacatgtttttgtttccgtaaagtagatggttagtgccttacatgccgatcgagtaatatgcactgaaggtccaagtttcccatgccaatctccttgatgcgagccttccacatgaccttagcttgaataaccaacagtctgatatagtgctccattanaccnatgaaaattaagttccgtgcgtagaataaacaaaaggataagnaaataattgnaagggganataaattacagcaaggacatacatcantggccaacctancagtaaattancatatatcagttttctactattctgggtganccanaaagntaatggttgtaaattgcgggnttggcaggaaaaatttntcacggttg

SEQ ID NO: 22820 - DNA, 547 bp, Triticum aestivum
  Clone ID: PAT_TA_22820
cgtccgttttttttccccacctgtccgcaaaccctcccccaacccgcacgcatcggcacggcatctcctcgctctgccgcgccgccgccgccgccatgaagcgctccttcgacgccatggaggcgaagccggtgttcctctccaaggaggagcgccagcgcctcgcgctcgagcgccggcaggcggccgtcgccgaccagcgccgctccgcgctcgacatcctccagtcgctcccccggccccctccgccgcctcccccgtccggcgccccccgagactccttcttctcccaccgcgacccctccgaccgggacaggggggacagggaccgcgaccgggaccgggaccgggaccgggaccgccgccgcgacgacgactcccgccgggaccgagatcgggatcgcgaccgcgaccgcgacgagccttcccgccgggaccgggaccgtgaccgcgaccgcgaccgggaccgggaccgtgaccgcgaccgcgaccgggaccgggaccgggagcaccgggacagggagcgcggggagcgggacaaagacag

SEQ ID NO: 22821 - DNA, 650 bp, Triticum aestivum
  Clone ID: PAT_TA_22821
ggattcccgttcgagccacgcgtcacgcgtccgtcagtacgcgagtgcagtgtcccggcagatcgggaccgtgccgcggccggcccaatcgccatcggaggtcgccgcgcgggaggctggaccggccggccgcgggcggttccgggcagggagatctcgccgagattcggtttggggcgggaggagccgggtgcccatggcgtcggcgtcggcctccaccgacgtcgcgtcctcgcgcgaggcgagtcgccaggccgggaagaaagcgctggaggagttccgtaagaagaagaagaaggccgcgaagaaggccaccgccgctgtagtagaccaggcagcgcctgtggttcccagcgtagtggagaaccccctgccaaactccaataatggcaaccctggacagggtttggtgtctgatttggactcaagcacaccaagcacatcatctgcgccatctgcttcctatgagaatgacccaaccacttcttccagagtcaccggatttctgtcaaatggtcctgtagttgcagatgcatcagctaatgttactactgttgcccccctgcaagattctgttgatgacggagggagcaagttttatggaaacttgagcttttctgatctagttaatgggcatcacgatgattgga

SEQ ID NO: 22822 - DNA, 649 bp, Triticum aestivum
  Clone ID: PAT_TA_22822
ctcccgagtcccgacccccgtgccgcctagctttggcgacacgggggtagaaaccctagcgccgccatagtcctcaccccctcccccacctgtctcgccgccgccagagggcgcccgccggcgaagcccgggccggccccgaggaaggcggtggcggggcgctatccctggccagtctggcgcgtcgagaggggctgcatcacagcgcgtccatggagatctgccggcgcttactggagcctgggatctgtggtttgcgcgcccagatccgtgcatttcgcgtccgtggctgcgcggtggaggcgcctggccgcgtgctcgtccaacgcctggtgcgcgcgcccttggctgcgcgtcgatggggttgggcacggtcactgctgcggggatgcccaggggcggcgcggacgtgcgcgtcgtcgtcgcagggtgatgctgggggacgcgggctcccctagctggtggcctctggcctgagcggccggatctgacgggccatgtcggtcagatctggcgctatggcggccggaggtggctcggccggcgactgactccaagcggactggggtagctccctgtcgggatggtgggtctgggttggcgtggtctgggctgtgcctttgggacgctctaggcttgtgtcgccagg

SEQ ID NO: 22823 - DNA, 1180 bp, Triticum aestivum
  Clone ID: PAT_TA_22823
attcgggacgacgccccctgaagcaagcggcggagcgtccccgcggcaagggatggcggtgtgggcggagcagctgcagcgcgagctcgccggccgcggcctcgccgtcgcctccgttccagggaagggccgcggcctcgtcgccgcccgcagcttcttcccaggggaggtcattatttgccaagaaccctatgcttctacgcccaacaggatttcggttggatcgagctgcgaccactgcttcgcctccggcaacctgaggaagtgctcggtttgtcgagtagcttggtactgcgggagcgtgtgccagaaagaagaatggaagctgcatcaacttgagtgtcaagccatctcagcgctcacagaggaaaggaagaagatgcttactcctacaatccgtttgatggtgaagcttatactaagaagaaaactgcaaagcgagaaggccattccatcttcagcaacagataactacgatctagtggatgcgctggagtcccgcatcccgcccacttgacacattgattcatgataaattataaagattatgctttgtgagtgttggattgacttcgcatgaatagacatctcgaaggttgatgataatcaattggtcctctatgctcagatggccaatcttgtgcagctgattctcccttcaattgaacttgatcttaaggaaattgcacacactttttctaagttcgcctgcaatgctcataccatatgtgaccctgaactgaggccccttgggactggactgtttcctgctatatcaattattaaccacagttgtgtaccaaatgcagttttgttatttgagggtcggactgcatatgtacgcgcgttgcaacccttgagtagcaatactgaggtatcaataagttacatcgaaactgcagcaaccactttgaagagacacaatgatctcaagcagtacttcttcacctgcacatgtccccgatgtattaaggattctgaggaagatgctctcctggagggatacagatgcaaggaccaaaagtgtgatggctttctgctgcctgactcgggaaagaaggcttatacatgccagaaatgtagcatttctagagatgaagaagaggtaaagaaggtgtcgagtgaaatattactgttgtctgacaaagcttcttcgtttctttcatctggaaataatagt

SEQ ID NO: 22824 - DNA, 645 bp, Triticum aestivum
  unsure (1)..(645): unsure at all n locations
  Clone ID: PAT_TA_22824
ccacgcgtccggtacgtcgtccgactgtttcgtagctacctgaggagtgtcagccagctgctcgaagatggcacggcaaaatgctgcctcggcgctcgccgcggcgttggtcgtcggagtcttcgcacccatccttaccgtggtgcaatccatcggcgtgtgcaacgggatgctcggcgacaacctgccgtcgcgggccgacgtggtgcagttctaccagtcccagggcatcggcgccatgcgcatctacgcgccggacctcgagacgctccggtccctcgacggcaccggcatcgacctcatcatggacgtgggcaacggagacctcgccgccctcgcctccgaccctgcagccgcggccggctgggtccgggacaacgtgctcgcctacccgggcgtccgcgtcaagtacgtcgcggccggcaacgaagtggacggcgacgacacgcagaacatcctcccggccatgaagaacctcaacgacgcgctcgccgcggccggccgcggcgacgtcaaggtgtccaccgcggtcangatgagcgtgctcgcgtcctcctcgccgccctctgacggcgcgttcnnnnncgtgtacatgacggacgtggcccagctgctcaagnnactggcgcgccgctcctcgccaac

SEQ ID NO: 22825 - DNA, 550 bp, Triticum aestivum
  Clone ID: PAT_TA_22825
gattgtgcgtgtgtatgcttgtgagaggaagagtgcttgtgataaaggttagtgaaaacagtcataactggttacgagaaggagggagggttatatcgggagcatgtctgcgagagagacacctcgggagagagtgcgtgagcatgtgcgagagaccaccgatggagggtgaaactacacataaaatactgatgtacgcattgagaaaagacataaattgtatccaaacattaggatgggatcatgatatttgcaattcgcgtaaggaaaggtcattgatccatcagacatctagattctattgaatttgagcatgtctatgttattattcgacataattgatccacatagttagtattttgaactccagacaatgcatcgctttagcaatggaatataaacgtgagtataattcatgttgtgtgtgtaaagcacattatacatacgaaagttacacaatgaacattataaatagctagctaggaactagcatacatttgaattcaacttaaggtggtttaaaaaattcgaattcaacatgaagtccatt

SEQ ID NO: 22826 - DNA, 420 bp, Triticum aestivum
  unsure (1)..(420): unsure at all n locations
  Clone ID: PAT_TA_22826
ccgtgattctctttctaaagagaaaccatggaaacgaaatacacagacccatgaaccacaagagcctggtggatagggatagctgaaattcacaaaaaatttgcatgcctagtgttgtcaactgaaaagcacaagcatcaagcagtgctggcctgtgcttttgctgcaaggattaccaaactaattggaatcaagctgtagaatgatgcaaaccaaactagttgtgaatgagtgtttggtatgggctggggtgacttggatgaatggaaacataggtgcaattcacctagcagggctatacaaagacgcctgtcacctgtgtatatagatttgttttttagagtacagattttgtatttttccttgtacattcctaccttttacaaatgcatagtttagttatgcaaaaaaanaagcngg

SEQ ID NO: 22827 - DNA, 702 bp, Triticum aestivum
  Clone ID: PAT_TA_22827
gagggatcggagcgagaggtccgctgcccgctccccccccccctccccacgagctccccccaccgctggcaccgcgcccggccgccccccgccccgccctgctccgcccgcgagctcgccccagggccaccgccccgccccagcacgcggctgccgctccgcagccggccaacagaggtgccgcagtaccggcagggaagcagaaggacgccgccgccgcccgcggccgccccggcgcgggagggaacaggcgggtgctcggggacatcggcaacgtcgtccacgcccacggccgcgacggccgggtcctccggccggccggcatcaatcgcccaatcaccaggagcttcggtgcccagctcttgccgaaggcccaggccgatccatctaagaacggcgtagctgttcctccagcagagcgggccggcctgaagccggtggccaagaacgtccctgtcaagctcaagcccgccgcccctcgccctcagccggccgccaagatcgtcaccggccccggcgaaaacaggaagccatcagaggtcgccgccggttgctctgcccccaggaagaaggtcgtccacaccctcacgaccgtgctcagccatcgttccaaggaggcctcaatcgatgatatcgacaagctcgacggcgacaacgagctcgccgtcgtcgactacatcgacgacatctacagatactaca

SEQ ID NO: 22828 - DNA, 772 bp, Triticum aestivum
  unsure (1)..(772): unsure at all n locations
  Clone ID: PAT_TA_22828
gctacttgctttacctcaagctggttgaggctgaccttgggagcttcaccatagacaatggggacttcccaagcctgcgacgcctatgccttgtggtgaaaatgcccatcctccctgcagtcaaagagggagcactgccgtaccttgtctcactccagctgctctgtaaagacctctttgatctttcaggcatgaggatcgagttccatgattgtcttgaggaagttgccctcgattctatggtcagtgccagaacggcagaaatgtgggaagccgcagcgaagaagcatcccaagagaccaaaagttgtgtttctcaaaaggattgacccgaagcgaacccgcgtccgctgcgaaatacgtcgcggcggatgggccgacacgtgagaaatgcatagtcgattcccctcagtcaggttcggggagcaaacacggttccgtttctgaagaagacggttgtttcaagacccacctcgggttgcatctgagccgtccggtgctgggaacggcgcgatgcctccttctgcaagcatatgttgaagaatgatgacgacgccattgttgcgatgctccctgaaagggcgtcgttgtgcattgcagcangactgcggttttaaaaaccgancccgaccggcggcccgactggaaaatcatgaaacgatgcttgtctgggtttttaaagatcattggctttataaaccaangaatatcataaaatgggggtaactgggatnaaccttgactncatggtttgtcccctgaaaaaaaaaaaa

SEQ ID NO: 22829 - DNA, 1890 bp, Triticum aestivum
  unsure (1)..(1890): unsure at all n locations
  Clone ID: PAT_TA_22829
tccgggcctcgttgactgggcgaagccctacttggccgacccgcgaaagctcgcccgccttacggccccccacttcgcgcccccgccccacgccaaactctcccgccgggcggcgcagctgacgctgaactgccttgccggtgagcccaggatgaggccgtcgatgaaggaggtcctcgagacgctcgagcagatcgaggcactgaagagccggacaagggagacaagaggagggagcgggacgtcatccagggaccgtgcccaccgccgccccgcggcagcgctcctccggtcgcctccacccccctccggtgatccgcgccctggcgcggcacccaccaacgggcacgccacgaaggcacggtgatccccaacctgctggcggatgatctgctgctgctgatgacattctttctcttcctgtacatacaggccctcatcaagttcttcttgcccgacagcgtcctcggggagggagggttcgggagggtctacaaggggtgggtggacgagaagacgatgaaccccaccaagagcggcaccggcatggtcgtcgcggtcaagaagctcaactcggagagcatgcaggggtatgaggaatggcagtcagagataaactttctgggaaggctctcgcacccaaacctcgtcaagctgttgggctactgctgggaggacaaggaactgttgcttgtctacgagttcatggccaaagggagcttggaaaaccatcttttcagaaaaggatgtgctccactgtcatgggaactgaggctgaagatagccattggcgcagctcgaggacttgcattcttgcatgcatcagagaagcaagttatctacagggacttcaaggcttccaatattcttctagatgcaagttataatgcgaagctctccgactttgggcttgctaagcttggaccaacgggtagcaactctcatatcacgaccagggttatgggcacctacggatatgcggctccggaatacgtggccaccgggccatttgtatgtcaagagccgacgtttacggtttccgggagtcctgatgcctgggagatgctgtcccgcgcgcgcgcgcgcgaccccaaccgtcccaatgggcaacagagcctcgttgactgggcgaagccctacttggctgaccggcgaaagctcgcccgcctcatggaccctcagttcgagggccagtacaactccaaacagtcccaccaggcggcgcagctgacgctgaactgccttgccggtgagcccaggagcaggccgtcgatgaaggaggtcctcgagccgctcgagcagatcgaggcactgaagagccggacaagggaggcaagaggagggagcgggacgtcatccagggaccgcggcccacggacgctctgctgcagtgcaccaacggtcgtcgccacgtggaggcagcgatgcgcgccgtggttcgagggccaccaacggccacgccactaaggcacggtgatcccctaccggctggcggatgatctgctgctgctgatgacattcttcctcttcctgtacatatatggcctaattgaattaatttttgtctgatgttggtgttgagcttgtgtcggatcacggtgagtgtaaagtacaacaagaaagaaaatcagagatatcatgtaattgtatattgtgaacacctagaaatggcggaggcaataattcttcggtgttcctgcgccactatgattgtttgggcactttgttgggcagtagatagataccatggtttttttttgggagctgagctttgcgaggttaatcgtatggttgtcagcacatcctgggtatggatacgcatttccattgcctgggaaccgtgatggctcgaatatanatgcatatggtgaattggcaaanaaaaaaaaa

SEQ ID NO: 22830 - DNA, 649 bp, Triticum aestivum
  unsure (1)..(649): unsure at all n locations
  Clone ID: PAT_TA_22830
cngganctnagctagttgtnttnctgcgctccccaccccggactttccgagatgggtcttttccgttgcggacttcccaggggcgggggcttcgttgacgacccctggcacgcggccccggagcgcgggccgcaatgtctgtctccccgggcgacgcattcagtgatcacattcggaggatgagggcgttcgtgtcggagatgtgacgagctttcgagcgtaatgcaggacctggtggccacggcgggcgagggccagagcaaggggaggttgaagccctaatcatcaactccaagaaggtttcacaaatggccgtcgtccttcgtgctcctggccatcgcgtctattctggtcgttttgctcaagcgtgcgtagttctcaataaaactaaggagctggcagagtggttgttcggagtttagtttcgtttcagctttttgagccagacaggatttgatcttctttttctacttattagttcatcaaatggtcgattctacgcactgtacaggtcgacgttaagtcctttcaagggtttatctggtggctgtgtgttcacctggggatgaacatgttctgcatgatgtttaactggtactgctactttatttgttggagcttagtttaaaaaaaaaaaaaactcgagact

SEQ ID NO: 22831 - DNA, 741 bp, Triticum aestivum
  unsure (1)..(741): unsure at all n locations
  Clone ID: PAT_TA_22831
gaattcactangtgattcgagcggccgcccggcaggtattaacatggcttgggatgcgcgcttcaaaataattaaggggatctgcgatggtttactctttcttcatagcattcctattatccatatggatttgaagcctcaaaatatactgttggacgataacatgacgccgaaaatcgcggatttcggactttccaggctctttggccaagaacaaacacgggcgaacacacagaatgttgtggggatcatacggatacatanccccagaatacctatacagaggtgaaatctccagctcagtccagacatttacagtttaggcctattaaccatccgagactaccaaccgggcggagaaggtaccccccccccacgaacgttccatccggcaacgaaggggatgggttagttgacgtccagttccctccagaaggcgcacaagcccgggccccttttagccctcctgcccccccccaattactttatgcggcgaattggcccacctgcgttggctttatncggaanaaaactccaaccnaanatngttaaaggcccgtaaatccctgaaactggctccaacaatccaagcaacatgaacaagatctctatgntgaanaaggcacatggaaaaaaacttcccgtatacaaagganttattcgaaaaccattggtnncctccccngaactntaatttttgggngggnnccatncccaacacggnttntcacaaannnggtt

SEQ ID NO: 22832 - DNA, 542 bp, Triticum aestivum
  unsure (1)..(542): unsure at all n locations
  Clone ID: PAT_TA_22832
ctggttgtcccaanttgataaattcgggggattgtggatcaggtcattgtcacttgcttgagagcctttcgtcggaggacttgacagggagcccaagataccagatcaagaggttttaaatgtactggggggataatggcggaagaggcagtagctctttttagaaatttctatgaacaaggaaacccgaatgcaccgaagcctcacagacctgtccgagtcgaccaccggtcaccggttggtttggcggccgctcggggtcgttcgcagatctacatcctacaggtcaggcaattcaagaagattctctccactaattgattagcttgtgttaacactgaattcagccttactcaggttgcagctatctatcatctaggcatttgggttctcctttatgggaaaataaatgacgcaccttgtgtgatatgcccattgctctttaatgctattctcttgataggctgtccattgcagcgctggatcaaaaaaaaaaaaaaaaaaagggggggcccggtacccaattcgccctatagtgagtc

SEQ ID NO: 22833 - DNA, 801 bp, Triticum aestivum
  unsure (1)..(801): unsure at all n locations
  Clone ID: PAT_TA_22833
gaactcggctgaggatgacggtggcaaccctcactcaacctgaaagtctcatggaatgccatgcaagtgagtgtcggaagcgtatacatagacttgaagtagcaagtgcggaaattcgcacgagcacacaggtgcgggggcacacacctgcccaactgtgtcatccgcccaattgactcgcaatccgcaaagtccgatggatcccacatggaggacacaacaagttttaagttttaagaaactgaaactttacaattttgctagtcacatgttctataactcctgatttggcggtcgctcataccaagttcaagagtttgaaacttacctacaatttgtcattcgcaggtcctgaaatatatattttgtccggggctccatataagttacagaggttgaaacttaatgaagttttggaaactcatcaaaatggttccatttgaaagtcctcatccactagaaatacggtatgcaaacaaaacttaattgggcttttggtcaaaagatttgaaggattgaaatcaaaaccaaaggaaaaggggtgcatgncccgcactggtgcanaaatctctcagacaatgccaagaaccatgttacataaggtnacagaatcatgattcaagttgaacatgccccaataacccttacccaaaccctcttttccactgaaatntgcnttntaaaaaagngntggaagggacaaacctgccangcnccgtcttcnaantgggngacgncccggcnnttntaaaatcccggngaactaggtccnaacangggggaatttccgantttggcccc

SEQ ID NO: 22834 - DNA, 1113 bp, Triticum aestivum
  unsure (1)..(1113): unsure at all n locations
  Clone ID: PAT_TA_22834
ctcgtgccgaattcggcacgagcgttaatcctggcgggtagcgtgtccgtcttcattccccatttccggacgcgtgggcggacgcgtgggttcatggcgatttttggttaagagatctccagtcgctgatctctcgagggcgagccggtggttaagcatccgctcctcctcccccctcccccctcccgtcccctgcttccttgtcctcaagcgcgcgcagagggagaggcgaaatcgatgccatggtgatccggctgcgctgtcttctctgcttcgcttgacttcgcgccactcctcatcttcctcgtgtggatctgcgaaccctgtgtacccctcctcatcctccatccatggttggtttttgtagttccaggattttaaagtgtaattcttattggatttacactgtaactctcagtggacttgcactgttttgttgagtaaacaagatttgttaatgctataagagagacatgcattgaggaacttagcttcatcatgtttgagacaggcaggggggagagatctgcctaaatcatacttagtatgtggtgattgcaaaattgggggtgtttacctgtgcttagtcatcttcagcagagtggatcatcttcaggtttctgtcccagatcatggaggaatcgcccccttggttggcgcttattcccgtttcctctagctgttcccccctccatgttcttcccctctgcagtgcatttttgtagtggatattacactgaaaataatagtggagttattattgtaattttatagcttttcaatgtaatttttagtgctcctaatttgtcatgtcattttaggtgtgtgtgcgtaaggtgacatgcatcatcctgatcccttgccttttcctttggttttgccttagcttacatgcacatgttcaaacgtacagcttgcctgtatatttgggttttttgggcccccctgggtttttccgtcagtgcgggaaaattggggtgtggcccgttaaaaaaaaaaaaaaggggggcccggtaccaatcncctatatgagcgnatanggcgccacggcgtctttanacgtcgngacnggaaaacctgcgtaccaantaacncctgagcnaccctttccca

SEQ ID NO: 22835 - DNA, 669 bp, Triticum aestivum
  unsure (1)..(669): unsure at all n locations
  Clone ID: PAT_TA_22835
ccccctggagggtgcgatcgtgtgcctactcgtgctggggctggtcctggagcaggtgcaagtagagggcgtggactgcggcgcaaaccccttcaaagtggcctgcttcaattcttgccttctcggtcctagtacagtgttccagtgcgcagacttctgtgcttgtcgactccccgcgggcttggcctctctacgcagctccgctgacaacactgaagagatgaagctctatgtgaaacgctgcggtgatgcttgtgacagtttctgtaagggggatactctcttggcatcccttgatgactaataatgcatatgcttggtctgagatttcacaggccaaagttatgtctcaccatcgagttcaataaaacaggatcccatcgagagtatccaaaccagcgtgtcagtttgtttatgtgcttgagtgtattttctttcgttgctccaataaaagatatcatggtggatgccatgttgatgcctgcttcatgtactgccatgattgagatataataatatatgctgggtcatttatgggnccatgggggtagagcaacaacagggcttcctcgaatctaatacactggctcctctcatggactatgatgtgccatcgttattagccccactatcgccggtgcctgcaaatgggggtggccctttgcataa

SEQ ID NO: 22836 - DNA, 2092 bp, Triticum aestivum
  Clone ID: PAT_TA_22836
ggatcattgatttccttcctacatacagacatctctaacatttcgccccaatacttgttccaccctagcacccttttaagaaagagcctcccccatggcagtccaccttcaagttcaacaacaaaaacacctgaatctgccggcggggttcaggtttcacccaacggacctggaaatcatcaccttctacctagtccgcaaggttctgaagaaacccttcgacgtgatagtaatcgaggaggtggatctgaacaaatgcgagccatgggatctcccaaataatgttaatatgggggagaaggaccaatacttcttctccaagaaggacctcaagtaccccaccggggtacgcaccaaccgggccacgaacgctggatattggaaggccactggaaaggacaaggagattctccacccgccgaccatgagtctcatcggcatgaagaagactctggtcttctacaagggcagagcccccaggggggagaagacaaactggatcatgcacgagtacagactcgagatgggcaagcaacacacaccagacctacccaccgacatcgtgagagccgcctccattaatgggtcttccaaggaggagtatgttgtttgtagaatcttccataagagcaccggactgaagaaggtggtgacgccttcatattccatcccggcagccccattcatacttgtgccttctgcaagagagcccggcaaccatagccatgggaggaggccaaaagggtctggagagtgcgatcgtgtgcctactggtgctggggctggtcctggagcaggtgcaagtagagggcgtggactgcggcgcaaaccccttcaaagtggcctgcttcaactcttgccttctcggtcctagtacagtgttccagtgcgcagacttctgtgcttgtcgactccccgcgggcctggcctctgtacgcagctccgatgaaccaaacgccattgagtattgcagcttgggatgtaggtcttccgtgtgtgacaacatgatcaacacagctgacaacagtactgaagagatgaaactctatgtgaaacgctgcggtgttgcttgtgacagtttctgtaagggggatactctcttggcatcccttgatgactaataatgcatatgcttggtcttagatttcacaggtcaaagttatgtctcaccatcgtgttcaataaaacaggatcccattgagagtatccaaaccagtgtgtcagtttgtttatgtgcttgtgtgtattttctttcgttgctccaataaaagatatcatggtggatgtcatattgatgcctgcttgatgtactgccatgactgagatataataatatatgttgtatccttttcctatggagcaacaacaatgatgtgccatcgtcattagcgccactgtcgccgctgcctgcaacttttgttgtaccagatgcataacttcggggctggagcctcctatgatgggcagtgcggtccttccaatgatgaacaaccaatactatgagaatcatcaccaccagatgatggtcgccccgccacagtcatcaatgtcgttctacaacaatcagcagcagcagatgatgcatatgagtgcagagcagggcttcatggtcggggttgatcctgggagcggcacatcatctatagtgtcacatgaggatgttctaactgggacgagcaacaacattcagggaaatgctggtgcaacaatctccagtgagatctcgtccgtcaacatgggtatggatggcgtgtggaactactgatgatcaaatgatccgcgagaatatataaatgtgtttatgcacaaaataatcttccaccaaatgatcatttgatatataccaacatctatattggtttgtactaaattttattttcatcatggtcacaagagagtttgtatgcaatggcttgcttggccttcttttcttcttacattattgtgtatatgtgtactggcttgtatgtgcaccatcaactggtgtatacctagctacatttgcatgtgtttttaaatacctaacgatgtgtcatgcatgttttaaacctatgtggaataaactattttgtttaattaagaaaaaaaaaaa

SEQ ID NO: 22837 - DNA, 785 bp, Triticum aestivum
  Clone ID: PAT_TA_22837
cgtccgcgagtttctgtcttggttcggtacagcccggctgtggcacgcacggacggcagatccgatcaccagcgaggttcagatttgagggaggggaaggatgggggcttggatgtcccgggtctggtttctcatgttcccggccaaggagtacaagatcgtggtcgtggggctcgacaacgccggaaagaccacctcgctctacaagctccacctcggcgaggcggtcaccgccgcgcccaccatcggcagcaacgtcgaggaggtcgtgttcaagaatatacgcttcgaggtgtgggatctaggaggacaagaaagcctacgcacttcatgggcgacatactataggggaactcatgctgtcatcgtggtaatcgacagcaccgaccgtgctcggatcaacatcatcaaggatgagctcttccggttgattcagcatgcagaccttgacaacacggtggtccttgtgtttgcaaacaagcaggatctcaaggatgccatgtcggcggctgagatcacagacgccctgtccctccacagcataaagaaccacgactggcacatacaggcctcgtgcgcgatcactggtgagggcctctatgatgggatgggatggatagcccagaaagttgccggaaaggccacagcaagctgaccacaaaaacattgttttggtgaatttgttggaaaagggaggcaggatgggtttgtttgttcttgccatttcggtgtttatttatgttgttaaatatgtgagaactgtgtactcccaccgatctgaatat

SEQ ID NO: 22838 - DNA, 949 bp, Triticum aestivum
  Clone ID: PAT_TA_22838
cgggacgagctcttctccttgttccgtctccctttcctgcacgaagcccgtcccgtctgctctcgcgccctcgtagatccgatcacccgcgcggctcggattagcggatcggaagcgatgtgcacatgggtgtcacgggtatggtgtggcctttgatgtcccggggattgtttctcagggtccggggcgaggagtacaagatcgtggatcagtggggcttgacaaccgccggaaagaccacctcgctctacaagctccacctcggcgaggcggtcaccgccgcgcccaccatcggcagcaacgtcgaggaggtcgtgttcaagaatatacgcttcgaggtgtgggatctaggaggacaagaaagcctacgcacttcatgggcgacatactatagtggaactcatgctgtcatcgtggtaatcgacagcaccgaccgtgctcggatcaacatcatcaaggatgagctattccggttgattcaacatgcagatcttgaaaacacggtggtccttgtgtttgcgaacaagcaggatctcaaggatgccatgtcggcggctgagattacagacgccctgtccctccacagcataaagaaccacgactggcacatacaggcctcgtgtgcgatcactggtgagggcctctatgatgggatgggatggatagcccagaaagttgccggaaaggccacggcaagctgaccacaaaaacattgtgtgtttcggtgaatttgttggaaaatggaggcaggatgggtttgttgttcctgccatttcggtgtttatttatgcatactccctccgttcctttatgtatgtaaggtgtactaccttcgtttcagtttacaagtcctacgcgtatatcaattgcggaactatgaccaagacacaaacttcttaatataaattatataacaccaaaattatatcgtttgaaaattgaacatctg

SEQ ID NO: 22839 - DNA, 707 bp, Triticum aestivum
  unsure (1)..(707): unsure at all n locations
  Clone ID: PAT_TA_22839
naatnngggattgtcgggccccggggaataggaaggacccaagttcncnnaggggganaggggttttcagggatcaatnccttttnggaattnccagacggcgttaaaaccaaaattcaagggnccnggntaaccnangcgggccgcttgaangtttgagnaagtngcaatnggccccaaacccagttttgggnantagngaacccngtccttggggnaataantaggccnttgaataccttggcacagggcangggcacaataacggcacgcccaaaatacggcttaaaacgtactaggggctgccggattctttttttaatcttttcttactttcaggactccatacttcggacgacctgttcggcaattcgactgccgcacaaacgatgcaagatccagggaggcagacaagccatgccgcattatggaactcccaggtgggtctctgttacgagcagtatacctgttttgaatacaattccgcggcctgcccctgggtcaaggacatgctgaatagtccaaatacctttttgcttaatcgcactacttgtatcgttccggcttttgataaatagcctccccaataaacaatgcttagctttttggccattttttgcactcccctcttttcacatagttcttcttttgacgtgttgcacccttaactgtgggnacggaaatacccaagggttcaatacctttaa

SEQ ID NO: 22840 - DNA, 542 bp, Triticum aestivum
  unsure (1)..(542): unsure at all n locations
  Clone ID: PAT_TA_22840
gccctaccaaacattcttgggttcgccttcggtgtgattcaaatggggctttacgccctctaccgcaatgccatgcctacaccggtgcccaagcaggtggacgatgttgatgccatcaaggtgcccgagcatgtcgtcaacattgctaagcctagcccaacggctgccatcgagctcaacacacacaatcccatcgaacctgggatgccaccaccgacgaaggataacagcttagcctgcacccgcgtcgtgaccaagggggaaagttcacaaggttgagaaggcaaccctccgtcgagcaagtctaggcagtcatgcgttcatgcctaggatatatgcgtgcactttaagccatggacgggctgggggtccgagcaagagaagctttagggagaagaaatgcatgcacgttgagcttgtgatttccattaatcgacgttccattaagtgctccnancaattattttacttgggccgtatcattaatatgtccatctacnattccatgttatgggcctaatataaaattgccatttcaagga

SEQ ID NO: 22841 - DNA, 431 bp, Triticum aestivum
  Clone ID: PAT_TA_22841
gattcggcggagggttgcttccgccggcctgacgagtggcgactgttgacgagctatcactggaaaccctggcgactaccccacaggccgcttcccccggtagtgcgccgctaccagcaaccccatctccagctcctccccctcgccgtcatcggagtccggaggccaccaccatgcgaagcctccgtcgtggcggtggcgccgggcggggcttctcgtcgcctcccggctggcccgtgcgtgcgccccctcgtggcggtcagctcagcgctccgtacgtgcgtcggtgcgtctctttgtggcagatccggggcggctgtgctcccatggccaaacccgtgactcctgcgcggcgccttgcccctccgcttccttcaaaggaggcccggtgcggcgcatcctcgatctacatcatccggatccacccaccc

SEQ ID NO: 22842 - DNA, 684 bp, Triticum aestivum
  unsure (1)..(684): unsure at all n locations
  Clone ID: PAT_TA_22842
tagcgtggtcgcggccgaggtattttaagctgcactctggattttgtccgatccgtgctgcgctaaggctggggaagatcaaagaatgtgtgggggaatcacctccaggttgtctcatgttctcgtttacatcccagatgaatgatgcccgcaagcttccccttatgcaatatgtcgtttgccttgccatgaccgaagccatcaaagatttgtgttgtgctaagggacttccagagctagatgtaaggataaagtggcctaatgatctatatctgaaggggttaaaagttggtggcattctttgtacctcatcatatgagccgaaagtctacaatatttgcactggtattggtttaaatgtcgacaatgaaaagcctactacatgtttgaatgctgcactccaagaactaaaggctaattcacccaagacttaaacgagaagacatactagcatcattcttcaacaaatttgaagttctttttgggtattttctcaaatcaaggatctcanggccctcngagggagcaaatactacaactcatggcccttctcgctgggccctcgacgtcgtcgcacgggggcgccctgggcacgggccactctggggcaacccgatggcgccacgcgtgggggggcctagcccccctggccggggaccctgattcgccggtggggtggagggg

SEQ ID NO: 22843 - DNA, 983 bp, Triticum aestivum
  Clone ID: PAT_TA_22843
cgtccgccctcgccttctctcctcacagatttctccccccttattcgcccccttctcagccccattttgtcgcggtcgggtctccctccttcgtcgcgatttggtctccccacggcggcgcaggcacactggctgctggcacccgaccggcccggattgcgtccctgtttcgtcgcggattgatgactacctcacggggaccagcattgaccccggcgttcgttactggttctgtcccaaccaggaaagatgacgtccacccttgcacctgcattgatcccgggttctgctgctgcttctcacattagcagatgaactgcctccaaggaagccaaggaaattcaccgcaccctgatgcagcggctgccgcccccggttatgaggcaatcgctaagtatgaaaataaacaagtttcccgttgatacattgaacttgttcaacatttgatagagcgctgtctgcagctgtacatgaccaaaggagaggttgttaggacactttctactcgtgctagaatagaacctggccttcactactttaagtatggcacgaaacttgaagaagagaactcctgaattctttcgggcttactatataagattgaaattgaaaagacagattgtcttgttcaaccatttattgcagcaccagtataacttgatgaaatatccagcacctccgaatgttccgctggctcccatgcaaaatggaatgcatcctttgccagttaacaatctaccgatggggtatccagtacttcagcaacctctgatgcctgctcccggccagcctcacattgatccgatggtttgtggtctatccagtggtcatgtagtgaatgggatccctgcccaaggtggttatcatccaatgcgcatgaactctggaaatgacatggttgtggacaacggtgcacctgaagttgcacatgcgggcgcgctctcatctgggaggcccctcagtccctcatcagcagcatcaag

SEQ ID NO: 22844 - DNA, 517 bp, Triticum aestivum
  unsure (1)..(517): unsure at all n locations
  Clone ID: PAT_TA_22844
ggtaatggtcgtattttgggtggtaccccagtcaagtgttcctggggcaacaagcctacaccccctggtaccacctntgcccctctgccccctcctgctgctcctagccaccccgctgccaccgatcttgtagcgtatcaccgtgctattgagatgagcaagatggcttcgacccaggcattgatgcaggctcagcatctcaggcaagcagccatggggatgggtgtaggtgcgagtcaggcgatgtacgatggtactttccagaacgtcggtacctcacagcagcagcaacagcagcagcagctcatgtattattaattccagtcttggagggagctcacctttgtaatttaaccctgattttatgttttcttttctatcttcgtcgtgtctatatgcagtgtgacactatatgttggtgttgccgtctggctgtgttggtagtgcaccgaatctgtgtctgtagtgatgccagttgaccggttaatatcgaattttatgttattttccggtgtgt

SEQ ID NO: 22845 - DNA, 1618 bp, Triticum aestivum
  Clone ID: PAT_TA_22845
ctctctttctctctctcttctcgaccctccttctcgacccttccatcccctctcccaccccaccaatctaccgtcgccggaccgggcagcgggccgggccgcgcgatgctgccgcagcagagccaggccgcggcgatgatgcagcaggcggccgcgatgcagtccatgtacgcgatgccgccgccgccgcatcaccaccacctcctcggcgccgcgccgccgcagcatatctggccaattgccacctggttttgatacaagtacatgccgcagtgtatatgtcggcaatattctgtcggcaatattcgtggcacttctccgggagcttttctccgggaggttttccatgaactgatgcaagcttataagaaaacaagcttcctcgaatgggattattcctcacaaggaactcggatcagctgccctagcaactttaacacttaaccggaagcaattttttggcttaactaggaaggtaaattgggcataggctatcggactgagggaggatacaactggccatttccatatatttgttggtgatcttagccctgaggtcacggattctgcattatttgcattcttctcagcatattctcccaactgctctgatgctcgagtaatgtgggaccaaaagacgggaagatcaagaggttatggctttgtttccttcaggaatcaacaggatgcacagagtgccataaatgacttaaatggtcaatggcttgggaatcggcagattcgttgcaactgggcaacaaaaggtgccaacagtggcgaggaccagctaacatctgattcgaaaagtatagctgatgtaaataacaatttcacagaaaatgcaaagcagaaatcaaatgaagatgctcctgaaaataatccactgtacagaactgtttatgttgggaaccttgctcacgaggttactcaagacgtgcttcatcgtttcttccatgcacttggtgctggagccatcgaggaggtccgtgtccagcacggcaaaggctttggttttgtcaagtacagcaaccatgccgaaactgcccttgcaattcagacgggtaatggtcgtattttgggtggtaaaccagtcaagtgttcctggggcaacaaacctacaccccctggtaccacctctgcgcctctgccccctcctgctgctcctggccaccctgctgccgccgacctcatggcgtatcaacgtgctattgcgatgagcaagatggcttcgacccaggcattgatgcaggctcagcatctcaggcaagcagccatggggatgggtgtaggtgcgagtcaggcaatgtacgatggtactttccagaacgtcggtgcctcacagcagcagcagcagcagctcatgtactattaattccagtcttggagggagctcacctttgtaatttgacccggattttatgttttcttttctatctttgtcgtgtctatatgcagtgtgacactatatgtcggtgttgccgtctggctgtgttggtgttgccgtctggctgtgttggtagtgcaccgaatctgtgtctgtagtgatgcaagttgaccggttaatatcaaattttatgttattttctcgtatatatataggaaaaacccccttttgttt

SEQ ID NO: 22846 - DNA, 1172 bp, Triticum aestivum
  Clone ID: PAT_TA_22846
agggtattgttgccgtttcacatggttgccgaggtgtcgctgcccgtgcctgtggtctggtgaatctacaaccaacaaagattgtggagatcttgaaagaccgcccatcttggttccgtgattgtcggagtcttgaattttttacgatgcttccagctggaaacggcgggaccattgaactcgtttacatgcagatgtatgctcctaccactttagttcctgcacgtgatttttggacgctgagatacacaactacaatggaagatggaagtctcgtggtttgtgagagatctttgagtggttcaggaggtggtccaagtactgcctcagcacagcaatttgtaagggctgagatgcttcctagtggctatttagttcggccatgcgacggtgggggttcaattgtgcatatagtggatcatctggaccttgaggcttggagtgttccagaagtgcttcgcccgctctatgagtcttctagggtagttgctcagaaaatgacgactgcggcacgacgacacatcagacagagggctcaagaaactagtggggaggttgtatatgctctagggaggcaacctgctgttctgcggacatttagtcagaggctgagtagaggatttaatgatgctataagtggcttcaatgatgatggttggtctgtaatggctggagacggcattgaagatgtgattattgcttgcaactcaaaaaagattagaagcaataacactgctcccaatgcttttatcgttcctggaggtgttatatgtgctaaagcatcaatgttactgcagagtgttccaccagcagtactggttcggtttctgagggaacatcggtctgaatgggctgattataactttgatgcatattcggcttcggcgctgaaatcaagctcatgctcacttcctgggttgcgtcccatgagattttctgggagccagatcatcatgccacttgctcacacagtggagaatgaggagattctagaagttgttcgtcttgaagggcaagcgctcgatgagggtcttttatcaagagatatccacctgcttcagttttgcactggaatagacgagaaatcaatgggatcctgcttccaacttgtctttgcaccaattgatgagcttttccctgatgatgctccattaatatcttcaggcttccgt

SEQ ID NO: 22847 - DNA, 1145 bp, Triticum aestivum
  unsure (1)..(1145): unsure at all n locations
  Clone ID: PAT_TA_22847
cccgcctcctcatcctcctcacgcctccaagccaagccaagccaaggccgtcggtcttcgccgcctcctccggcggccccctcctctgcccgttcctcacgcccttgaagcgccggcctgatgcgattccgtccctcgctgtaatcaagccctagcccgcttcgattatcggctctccgtgggcaatcgagaattccgccggctatttcttctccaataacctacccaaggtatcgtttccaggagccctgcccccagagtagccaagaggccggcgtcgggggccgatttgctgctacttttgaggagttggtaccctgtcggtggcccgtcggctgcagggtcttggttcgtggagttcttttcagggcttttcttgggggggtcatgggagctttctgctcgtgtttgcaagccgattactccgaccgccatggcaaccagacttcttggtgcgtttaggaactgcatgtgcctcaggcgttttcccccgccgctgatcaacgcttacactgttttattccgagttggaacggtccactctgtttctcaagctatagaagccaccccgcttgattcatctgaaagttcattcgatacatatcgttcacctccaagaccactgccatatgatgatcctagattctcccctcctctgcgcgactgggtttgcatcaaggcatgatccttcaaagccattcaccaagaggaacaagaaccactcaagaccaaattatgatgangaaattggaacgatgatttaatccgacaagccaagtnaaaacaaactatgacacaaaaatggaaaagaagcactccgcntaatggagataatttnccccgaaaaggaatccgggaattattcaacctactttctccancctacngaagatgaagattctngcccacattcctngaagattaacttcggggancccaagntantatgcaatgccaaatcactncaacttgggtggtaccaanatgggtggaaaaatnangnatcctgtttttggnaanaaatggggttaacnanacgatntnccaaacgggggaanttaaatcccatgggaccgaaaaaaggnccaacccgaaaaaccgaaaaaccttgagnttannacagggggantttnaacggatcctaa

SEQ ID NO: 22848 - DNA, 1345 bp, Triticum aestivum
  Clone ID: PAT_TA_22848
tccttcttttttagtccactctaattttttctttttttttttttttttttagcacaatcatttttttttttatctcaagaatcgatctttttcaatcggaattaaagaattaaaacaaaaggcaatacagaaaaacataaagctacccaaatcattacacaaagaagcaaattagacacataagttgctcatccaaacattactggatgttttctgccccccggcagcagttcttgaggctcctgctgcccatcctgtgatcggcgtgaggccgcctatgttcgcagatgtaccccccgttgtgcttcgactacgcggagcacggcgttcgcggtaccccttgtccgggccacgccgtctcgggcgcgctggcccccgctggcctagggtgtggagcttgggggtgtcttcgcagtcgagggaggtcttgcaggttggagggtgaggagtttcgtagcggcgaggggggtcgcgcggtaggaggttgtcagccgcggtcggagcgggcgacgtcgcgccggggaggcattgttgtgggcccgtccaggcggcggcacggctgcgccagtgccgcagcgtggggcacatcctagtgtgctgtctgccggaccgttgcccgcagtggttgtacagcctctgcagcaagctggtgcagcgggacaagccgatggtgtggccacctgagagggcgacgacatcgacgatgttgagaccgaggcgattgaacttggtgatgatggtggggagggtgttgttgggggcagggatgtcattgtttgatcccctggatgctccgcccccagagagtccctgcggccgagtggcacgtcccagtaagggccaccaacgaggacagtagagtcacgggcggcgagggcgaggatatcggcgcaggagacagtaccggggcaggctgtctcaagggcgtccttgatcaccccttctcgctcaatgatgttggtgctgttgtcaagcagcacggacgcgtcgcaccccttgacgaagcagtcatggaaatgcagcctgacgagggaggcggccatcctggtctccctggccacggcctgcgccacaatggagtgcacgatctcctttgccttggggcacgagtggtcgtagaactgcgggaacaggccgccgtaacccgggttgccgaggacggcgccggcgaggagcagcggagacacgaggcagagcgccaccaggcagaccatggaggtcgccatggatggatgggtgtgaggtaaactacttcgctttgctgcactacggttgctagtgagcgaataacagaggagacttgttatttgtttgcttctccctccccttgtgtcgtccttttttt

SEQ ID NO: 22849 - DNA, 883 bp, Triticum aestivum
  Clone ID: PAT_TA_22849
ccccgcgtccgcccacgcgtccggcagataaggcgcgcgccactcccaccacacgcagggcgtccaagaaaaaccccatcgtcgggcatggggacagcagtgctgcccgtcgcccacaagctctcgctcgcctcccccttcctcccgcgccaccgccgggctaagtcgaagagccaggcgccggtgataccgatggaggcgcgggcggagaaggcgctggaggccatctacgtgtgctgcttcgggcaggacatggtggagccggaggacgagcggctgctgtgcaccatgctgaacgcggtgttcccgtcggtggggaggccggcggtggagaggatggtgtccaccatggccgagcaggtggcctccggcgagaggaggggccccggcgccaaggtggtgcccaaggaggtggcgcagcggcagctcaaggacctcgagttcctcaagcagaacaagctggactcgatatgattaagggctcatttttggcaggtagatccatggagaaatgagatgagaatgaattttgatgtagccacggtgcgtaggaggaaccagctgccatcgatcgtacattcatactgctgcaagcaacgcgatttacacggtcgagtccgtggctgctatctcccttattgcagcgttcttgcagtgtgacatgagtgccactagcacatcagaagcttgtaagatagcgcgagatttggctcgtgctccttgaaaagaatgttaccagttgtggcacattctcgattactaatacatgttaatgatggcatttgtaatttgtcactagcaattatgtttgctcaggcagaaaaggtagaaaatcattgctaaattagccatatgtggcatgcacatttgtgcttgaattttt

SEQ ID NO: 22850 - DNA, 1114 bp, Triticum aestivum
  unsure (1)..(1114): unsure at all n locations
  Clone ID: PAT_TA_22850
gcgcggctgctgccctcgctgctgggcgcggtggccccggcgcgcgcgccgccggcgcggcactggtgggtccccaccgtgccccaccaggcgcccgccgcccccaccacccgcccacgcgtccagatggagcccaaggacgtggatggggacagccgtgctgcccgccgcccacaagctctcgctcgcctcccccttcctcccgcgccaccgccgggcctgccgcccccccgcccagcagcactgccggcgccggcgccatggggcggtggtggcctacatggagccggactcgaaccggccggccattaacatggggcgcatcctaggggccctacccggtcgagtcctcggcggccgcctccctaatggcggcggccgcgccgtgggacatacctgccactagcacatctgcagctgctgcgacagcacgaaatttggctcgttctccttgaaaggcttgttaccatttgtggaacattctcgattactaatacatgttaatgatggcatgcgtaatttgtgactggccgttattgtcgccccggtacggaagacgaaccagctgccataaatcatgcccctgctccccacgcccttcatcatgtagtactacgagcagactatccccctaattgcggtggtcttccagtgtgatatacggggccctagtgcatcagaagcttgtaagatagcacaggttttcactcgggctccgtgcaaagactggtaccggttctggcacattctcgattactaatgcatgttaatgatggcatttgtaatttgtcactagcaattatgtttgctcagacagaaaaggtagaaaatcattgctaaattagttatatgtggcatgcacatttgtgcatgagtttttcttcaaaaaaaaggtccagattggggaaaaaagcccnggcnngttgngtaanaaaggaattggntggttccaacncattgggnccnaannncaangttggggccttcnggcnaaaaagnaaagggctnccctcggnncccaaagtngnggtccnaannaantgcccantngnnanttaaggacctttgagttcntnaagcataaaaagttgantnantttaagagggnantcct

SEQ ID NO: 22851 - DNA, 1134 bp, Triticum aestivum
  unsure (1)..(1134): unsure at all n locations
  Clone ID: PAT_TA_22851
gggataccttgcttcatcaggagaaacagaagcaagtgataatcttccaaaaaatgtctgcgggggagcattatgggagaaattgttagaatatactgctaaatcaacagaaaagatagctggagatagtagtgcgggtcgtgggcagctgtatgtgtggggaaagttgaagaactggggcgatgagtgcatgtatccaaagccagttagagatttaagcggttggaacatccgctgcatggcttctggcgacatgcaccatattattggtgcagaggattcttgcataagttggggtctttctgaatatggagagcttggttatggccctacacaaaagttctgcctccgaggagtaccgtgattaccctaacgaagaaccgtatccgtgcatcgaaccatcagaagacgctgcaaccccttctgatgggttctatgtagatgttgacttctacgcgtgggcgaacggcccggctcgtctcccgcagcctctgaacgtcctcgccgcatgccggatgacttcttgctgggttataaagttgattggccagtgaatattgtcattacagaggaggcacttaggagatatgctgaaatattctgttatcttgttcaggcccggtccgctgtctttgctctgtctgaagtatggcggtttctaaaggagttgacacagttaatcagtcgctctggccacagtagacctgatatattgaaagaattaaactctgtgatgaaagtgaggttctgcctccgaggagtaccatgattaccctagcgaagaaccgtatccgtgcatcgatccatcagaaggcgctgcaaccccttctgatgggttctttgtagacgttgacatcgacgagtagactaaggcccaggtggtaatcctgagcttgtgaaggtccatgtagtatagctaggctttccaagcctcttttattttactagttgtctgtactcagacaagttacttccgctgctggtttgtatgactgtatgacttgaatgtgggtcgtgtgacccgtatttgtatgtatgttatgtatggctctctgagcctttaaataaagtacttgtgtcgtagagtcatgttgtgatgnccttgttgtatttgcacatatcgagcatattgtg

SEQ ID NO: 22852 - DNA, 363 bp, Triticum aestivum
  unsure (1)..(363): unsure at all n locations
  Clone ID: PAT_TA_22852
tgcaggcttagcatctatatatacccgagaagattgatgttattcttgtgtgtccataactcatggacacaggtacagtccatttggtcacatccagaataaaaggtgctgttattgaagcggcaagctgcctcgatgatcagtttgattgttcagcattgctcctctcctgtgtgttgtgctattttagctgtagtttatgcttaatcactttgggctgaaatggtgtggtgtgctgtgtttatttgttgggtaatgtatgatttgattgtggggtgtcaaagntacaaataaaccgtgcttgccttttcccgaaactgcttggttcgaacactgatttgatttcccngaganagaaaaaaa

SEQ ID NO: 22853 - DNA, 666 bp, Triticum aestivum
  unsure (1)..(666): unsure at all n locations
  Clone ID: PAT_TA_22853
gtgcancggggcttgtttttataagcattgagggcggcgggaaaatgaaatatatttgaatgtttgtttttggcaagctaggtccccgttggtgacatatctgtcagatctttaatattcggcaacctattaaaagttctttattaaacaaggaaacatacatctcaaaatcggtccatgatcaaccgaattgattcacatcatatttaattgatgcaaatttgtgatttatgataacttgccagggaaaacgtatctgagatatcacatgcgtatagaatcacaatttgttgcctatgaaaggttgactttctatttctcacataaaattatttattttttcccttttatactcctgttttttaccattaacttgatgatatctttacttatgttataggtaattgaccttgcgtaaatcacatctttaattaatttaataggtaattgctaacggacaatagacaatattattattttagtataaatcatgtccaacacataattttacgatcctcatgtatatcaaacaatataattggaatatgaatcattcattcgaacacagctttgcaaaagataatattgtttattattgttcatcacaacaatctttaaaacacacatacgttacaaatgagaaacaatagtacaacaaataaagat

SEQ ID NO: 22854 - DNA, 1074 bp, Triticum aestivum
  unsure (1)..(1074): unsure at all n locations
  Clone ID: PAT_TA_22854
tttgccgagcgtgtttctacggttgaacttggtgctgctcgacttaataaagaatccggagaagttaaagagctcaaggagcaggtttctcgactgaaaacagcattacaaatgaaagattcaggatcggagcaaaacattactcgccactctgaagcattaaacacgaagatgccttctcctgttttttcaaataggcgacagggcagttgtgatttgttgcctggccaagctaacttcaggcaaccaatggaggatgtcggaaacatagaggttagacccaatcctaaattgagacaaaagaaaccaagctttgatcttcaggatttattagcatcaaatgattctccttcgtggccagatagtaattcaagggtgaattttcagatgggagaagaaagggaaacagtttgtggggactgggtagataaggttgtggtgaacaacaatcactctcttggtgattgggaaggagacaacacggctcttcctgacttcttttaccaaagataccattcaggtttgagagatgagcagcaaagacctcggttttgctcaacgaataccgatgattccgatgatattgacgttgcaacgagtgatcctccagaatcaagatgcactttgggcantcaatgttccaaagcataaacantcaatttattccaaagtgggtcaaaagataaagaaaccacaacccgaaaataagagaggctccaagatacaaggacaccaancatccccaaataccatcaagcgtccaagaaaactccaatggacaaacaattctgggaagnactttaantggtaancgatagcagangtttcatcaaaacggtaaaaccctgggacgaattnattccctaaangatggggtatttttttccnggggtttcttcaatgtttgcangaagggttcaaaanttcnaagtcangnngatggcataatccattgatngtgtcatgtggnaatntgntccacaactggggtgtaggcataacctttttatggctacaggattgtgngttttggatnctgccgtncaaaattattangaaaaaggaattttntgn

SEQ ID NO: 22855 - DNA, 785 bp, Triticum aestivum
  Clone ID: PAT_TA_22855
ctcccctccaaatcaccagttcttggccctgctcctcgccggtgcccacggctggctccatcagcggcggagcggccctcccgcagaggaggaggggagttgaggggcggcctcgtgggggcggggatccgcgacgcgaccagtgagaccgagtgcctcgggcgaccaggtgcccacgcggattccagtggggcgagcagccatggcggatgcaaagcggcggagtagcactcgggcttctggcgagggtgtcgggagtgctgacggcggcggtgcttcctggtgttcttcctcctccacatctcgcgttgggaggttgaggtcggggaacgctgggagagcgggcgtctgcagagcggcctcgatcgcctccgtcgagaccttcggcaggaggttgatgacgagtcggggcttgagcgcgtgcagagggactgcaggcggcggggaggagagccccggcagttgatcgtagcccggccggttgaagagctgcgggtcctgctcgaatagctccgcggcggagaggctgcggccggagccgtcgccgaggcatgaagacctgggtcgaggacgcgccatccggcgctcggcgtagaaagcgcgatctccatgatcgcctacacacgctggggtaggtccggcaagcatggcctccatgggcgcgtcgatccggccccctggcgccagttccgcggcatccgcgttgagtgcggatgcaacctcttggggcatgtcctggatgccttccctggccgcatccgccctgttactcggtcctggcgctc

SEQ ID NO: 22856 - DNA, 670 bp, Triticum aestivum
  unsure (1)..(670): unsure at all n locations
  Clone ID: PAT_TA_22856
ggccagtgcaatctccgtggacgacaaccgcgttggcctgctgtacaagcacgtgttcccgcccatattggctcctcacatctccttcatcggattacccttcaggacgatcccttttctagtgtttcagctccaaagcaagtgggtggctggggttctgtcgggaagacttgagctcccatcacaagaggccatgatgcgggatgtggatgcgttctactccggacatggaagctccgcggatgccccaagagacgcactcatgacctggggacaaggctatccgttggagtatgaggactggggtggcggagcgatgcgggctggggaggatggaggggtggaggagggacatgttccttgcgacgtgttaagaactggcccgtttgccccggacagctanccgggatgaatggggacgacgaacaactgttgccacaggtcatcaaggttcgccaaacatccctgcctggccgttttattgagtaacancagcactgattgttggtccaatcatgccttcttttccttttacaagggaatccccaaagatcatcaaccatagacatatcacatgattannggcattattanaaggtggcacggtcacaancctanttcaaatncaaancgtaccggataaatgtgtnatacggtcaccaagtnaacc

SEQ ID NO: 22857 - DNA, 626 bp, Triticum aestivum
  unsure (1)..(626): unsure at all n locations
  Clone ID: PAT_TA_22857
ggacccttcggcggtgagcacgagacgacggcgaacggtggagatccgaaagagggcggcttgagcgagtcgcagcggccgccacggcgccggcttctcccgccgacctcgcctgatgcgcggccgcccggaagcgatgacggcatcctgcgccgcggcgccctccacggcgacggcttctcccgccgacctcgtcggatgcgcggccgcccggagacgacgacgccatcctgcgccacggcgccctccacggcgtcatcttctcctagcacagcgaccataccctgcccatgggcaacggacatatgctcatcatcttctccggccgctcggacgccgtcagttgaagatattcttcctaaacaggttcagttgtatgccactagcttagcacatatggtgatttagcccacttcgtatgttgcaaaatttgtgtaatcattttttctagtccttcatgaattgccagaaaaaaaaacnaaaaaaaaancnaaggggggccggtaccaattcncctanangatcgtatacccgctacggcctcnttanantctgacnggaaactgggtacaactaacnctnaaaatcccttccaatgntatacaaagccacatccttcanatncn

SEQ ID NO: 22858 - DNA, 1026 bp, Triticum aestivum
  Clone ID: PAT_TA_22858
gcgccgcggggctcgcggctcgtgcggcaccgccgcctgcgccccccgcgccctgctgctccccggcgtgctcccccgcgcccgcgcccgccccggcctgctcccgctcgccggcccccggcccctcctcgtcgcgcccggggtcccccggtcctgcttcggcgcgcagtggccgctcgtgttcgccatcatctccgaggtgttcgggctcaagtactactccacgctctacaacttcggcggcatggccagccccgtggggtcctacatcctgaacgtgctggtggccgggaggctctacgacgcggaggccgacaagcagcccggcggcgggttcacggcgggaggcgggcgcgacaaggggtgcctcgcggggggcggccgcgaccgggcgtgcctgggcgtcgcgtgcttcaagcggtcgttcccgctcatctcgccggtcctccgggttcggcgcgctggtgtcgctggtgctggtgtggaggacgtggaggcttctacaagggggacatctacgcgacggttccgcgacggcgccggcgggagacacgacggccgcctgcccgtcgcccaagatcggaagccggaggcggaggagtcaaccccggtcaatgccacagcacaaaggtgagaactcagaaggctttgcaggcttgaccgggtcaactctgaagcagcaacctaacaccacgactcatgaggtggagtggtaaaaaaagaacttatactattgttactttttttttctctatagacagtgtggggatgtatcttgtgcggctgacatggcgcatattaaagggcaagagaaggacgccgtagcacggccggtagggggtcgggtgcctggtcctgcttcatgccagcgggtcactgacacacgtccatgcttgtcgcgttgcacggcaccaagtccggaacgcgtcatggaccacaacaacgccttgctcccctccaagtcaggaacgcgtcattgaccccaacaacttctagataccgtatgagtcaagtctttcttttacc

SEQ ID NO: 22859 - DNA, 582 bp, Triticum aestivum
  unsure (1)..(582): unsure at all n locations
  Clone ID: PAT_TA_22859
cacatcgctcaaagcatcgccgcttccctttctgcctcatctctcttccccacggggaatccgccattaatccccacatatcaagcttttgtgtctccgtctctcctctcatgcagcagtctgccatggattccaaggagagcgagctcagtctgcggtagtccaccatcgagcacatcaaggggagttcgcggccacggcgtgctacattcgatgacggtcagatgctgggaccggccatgaggaaggctacaaccacgggttgaaggtgctggaacaaccgctcacggtgaccggcgacggagatggtggtatttttttgctagaatgagtgtgtttgtttctgcaaccagccccaattttgctaccaccatcttcagattttgctgggaaccagcccaattttttgctacaatggctttgtttttgctggaattatcacctgtgttgctaccactatctcagtagtgctgggctacccccaattttgctaccaaagagggggggccccggtgccccaaatcgccctaattgtggaggtcgtattaacgcgcggctcactggggcggtcggttttanang

SEQ ID NO: 22860 - DNA, 1522 bp, Triticum aestivum
  Clone ID: PAT_TA_22860
tgccgctcccgtcccgccccgccgcccccccgccgccgccgacgcctgacgcgcgccgccgctccccttcccgtcgcgtccctccctccctccgcaatctcctgaaccccggttttcgaggtacgaacctgctctttcgcctccaaagatctgcggagaagcaggcgggcgggtagtgacattggagggggattcctgcttccctgctgcagatttcatcatgctttccttgaggtgttgggcgcccgcattcggtatagcgttcgagagagccgtcgttctgcgccctcgaaagttcaactccttagtggtttgcggtgccaggggtccgaggccgagatatcctcgcgtgtggaaaaccgataagagaatcggaaccgtttccaagtcgcagaagcttgtcaaatgtattaagggtttgtctaatgtaaagggggagctctgtggtcccctggagtcgtgcggggctggggaactggagttccccttgtcagctggatggtcagcactggtcacgcgtgggcctggggaggcttgcaaacgtttttttctgcttttctcgtggatggtcgatttgggtcagcggaagaccttgggcagctgtcattctctagttaaggtcgtcctcgcggctgtacgaattgaggaagcagaagagctatttcaaaagatattctcgagatatatggagggattgccacgtgtttttttcatgaaaataatctccttatattacagattggggtcatatgagaagatgtttgaggtttttgctgatatggaagagctgggtgttcgacctgatacctcgattgtcaggatgctcggtgatgtatttatgaagctagagatgctggacaaatacgaaaagttaaataggaaatatccaccgccaaaatttgaatatcgatacatcaaaggcaagcgcataaggataagggtttatccagacgatagtactgaagaagtaacaaaaagagactctgacagagatgaactggaagatgcaggaagcatgaatcttgacaatgaattgaaagaagcgccaagaacagtcctggacatgaatgtattaggcaatgcggcttctggagaccataaatttgtatagctcagaactttaatttggcgttttcatgtctgcttcatcatagcaggtaaggtaattttggctggaaagcttggtctagttttgtgtcagtaaatcttcaaatactgaactagagaatgtctgaattagtctattaagaaactgggagacatcggtacatattatgctgttggaaagcaaacaaataaaaattattttgccagtttttcaaagttcttttaagcagccaagcaaacaagtcatgaaataaatttgagaatttaatgtaaggtgtccaacatgggaattagagaatgtagaatgtaaatgattggatcaagattatgtctgcagtgtaaggtgtttgacaatggaatttgaagaatgcctgtgtttgatgtgaataagaaatttctttcagagtaaaaaaac

SEQ ID NO: 22861 - DNA, 664 bp, Triticum aestivum
  unsure (1)..(664): unsure at all n locations
  Clone ID: PAT_TA_22861
ccacgcgtccgcccgtggcgggccccgccagctggagcgcctcggccgtttcgctttcgctcgcgtgccgcccctgcctgcccccagatgcgcgttggcctgcggaggatagcgcggcggtagggcaggagtcggaggagggcgcggaggaatggggttctggatgggcctggcgatgggggtcgccgccgcgtccgcgctcatcgtcgccttcgcccgctgcgagaactcccgcggcgcgcgccgccggaagctggctgccacggttgccactttctctaaaatgacggtcgaagattcacgcaagttacttccaggtaccctgtacccatcctgggttgttttctctacgcagcagaagttaaaatggcttaatgaggagctcaacaaaatatggccctttgtgaatgaggcagcatcagaactcatcaaagcctccgttgagcctgttcttgaacaatataggccagtggtctttgctgccctcaagttctcaaaactcactcttggcactgttgcaccgcagtttactggtatttcgatcattgagagtaatgaagaaggtatcgttatggagctagagatgaattgggatgccaatccaagtatcatattggatgtaaaaactnnncnnnngnnngcattaccaatacaggtganngac

SEQ ID NO: 22862 - DNA, 1204 bp, Triticum aestivum
  unsure (1)..(1204): unsure at all n locations
  Clone ID: PAT_TA_22862
gtcgacccacgcgtccggtcaccttctggcgcatgaaggacttccccggcgtcttcccgaggatatttggccacgaagcgttcggggtggtggagagcaccggcgagcacgtggagggcttcgcggcgggggacgcggtggtgccgacgttcctggcgcagtgcagcgagtgcgcggactgcaggtcgtcccggagcaacgtgtgctccaagtaccggttcgcggtgcggccggggatgccgcgcgacggcaccacccgcttccgcgacggcgacgggaaccccatccaccacctgtcgtccgcggacgcgtggggcgagtacaccgtggtggacgtgacccaggtcgtcaaggtcgaccccgccgtgccgccggccaccgcctgcctcctcagctgcggcgccaccaccggcgtcggagcggcatggaagctggccaaggtcgagccgggatcttcggtcgctatcttcggcctcggcgccgtcggattggcggtggctgaaggcgccaggatttgtggggcgtcgaagattatcggcgtggacttgaaccccgataaagaagagctcggaaagaagtttggcgtgacacatttcatcaatccaaaagagcttggggagaaaactgtgagccaggtgatcatcgagatgaccgacggcggcgccgactactgcttcgagtgcatcgggctggcggcgctgatgaacgacgccttccagagctcccgggcgggatggggcaagacgatcatcctcggggtggggagccacggcgcccctctcaccatatcttcgctggagatcctccacgggaaatgcgtcatggggtcgctcttcggaggggtgaagcccaagcaggacattccaatcctcgccgacaagtacctgaacaaggagctggagctggacaagttcataacccacgaggttggcctcaaggacatcaacacggcgttcgacctgctgctgcaggggaagagcctcaggtgcaccatatggatggacaagtgacaatgccgcatggctgttaagtggagtttgctgctcattccagtacaaaataattgggtttcattgctgtcgcgtgtagtagtcctctttgtgccgtgcatgtgttgacttaatgtgccgatgtaacttcatccatccgtgttgaacttcattggtcatcagtactccaaccagntgtgtgaattgcaacagtt

SEQ ID NO: 22863 - DNA, 837 bp, Triticum aestivum
  unsure (1)..(837): unsure at all n locations
  Clone ID: PAT_TA_22863
gtaattgaaccggtttccgncggcnttaaaggcgccttgncggtatcnccctttgggantggtncgncccctgntaaaatttggtattagactacatttgttggcatgtgatgtgnntttttcntgnagtttnncaagtgngtctttgntacacttaaattatatgtaacttggaagacnggtggattttggacgttcaaaaacgaatcgaacattgaataccctttatatatgtcttgcggatgctatgatcaccgggtcaaaattttgaaccccccttaggtatcacacatgcccccactcgttctcttcttcggtttcatctcggggtcccgggagatcgaattggaaaggaggactagggtgggtaccaaatacgttcgtttcggcttaccggaacgtacaatatactccctcttggtccccatcagacccccccggcccggcggtcatttctatcattggaaacagcccaaacctttatctccttgcacgacacgcagttgatctctcaacatcaatcgatctcgtcaacatgtgtcggggcatgaaccgaacgggatgtcaaaactatgacgcgaagcgacacgtagtggaggcaaagtgaaactttaaatgaaccgtttgtttgtatgcatgtcggacaaattacaaccattggcaatacaagcatggccangccacatgcgaatgatactccggcggatgtcaaatgaggatgcggacgatgaccaaccggaggcacatgtcatggnaaaagttgaaggatgnataacaacgcantataactgacggcnataacnatagtgcccctgccaatntgaagngatccaacgg

SEQ ID NO: 22864 - DNA, 396 bp, Triticum aestivum
  unsure (1)..(396): unsure at all n locations
  Clone ID: PAT_TA_22864
gtggggcagacgattgggtttggcagccagccattggtggacaacagcccatacgacagtggtgcacagaagcatggatggagcttgctaggaatcggagttgcactgggtgtcaagctctgccactgtcatggccctcggtatctgatttgtgtacatgcgcttgtgcagcggcgtgatggctttgggagatttccccgaattccttattatttcctgggcgcaaataagccagggatgtgttgttgttggacccctggaccagccgtggcgcctttccttgggcgttgggcctgctgggtaggattgcatttgtaccttggagaccacgaaagtgtatttttccgattgttcaaagtgcgccccctctctgtctatcaaaanaaaaaaaaaaaa

SEQ ID NO: 22865 - DNA, 440 bp, Triticum aestivum
  Clone ID: PAT_TA_22865
cgtccgccttcctccccccctctcactcctccgcggcccgtgcgccccggtgctgcggccgtcgccgtgacgtagcatagcgtcgccgccgccgccgccgccgccgcctcaccccaacccatccgcctctcacgcgcgtcgcctccaccgtcgccgttcccgtcctacacctcaccgcgcccccgctatctcaaccccgcccgcggttttatccggttcccgagttctcccgcccccggcgaaacctatggttcggcgacaggatgcagaagctagggctctcggggcttaggggcctcgatgggttccgatctctcgctggtgccacctctacggctgggaaggccacgaaccccaagccctcgtcggatgctggaggtatcacatacgggagcttcgccaaccttaagatcacagctggtaccgatttgcgctctctc

SEQ ID NO: 22866 - DNA, 640 bp, Triticum aestivum
  unsure (1)..(640): unsure at all n locations
  Clone ID: PAT_TA_22866
attacgtgggcttccgcatacacacttactccacaacgatgtgaatagcagttgcaagctagccgcagtacagaacagtgtccataggctataacttgagtagtacaaagatgcaccgccggtgagctctccttttttttttggaaaaggaggattacccccggcctctgcatcagaacaatgcatgctggtgagctctcctgcctgctatgacttatactctgccggtcctaactttcctctgacagactccaactatcaccaggactatttatccatgtactaatggtagatgacttatgcactaggattttaactgaacaaatatattctgcaggataacctgggaagcgctaattgaatagtgaggaataacatggggaatagttactgtgcagctgagcctgggctcagaagtggattaccgggcattgatgtccctttttaaggactaggatatatgactatatgcatctactgaaataggtagttcagttcaatctccaccgtaagcagtggcgaaggggtacgttgggtgggggccacctatctgatgtcggtgtccgtaggccctgtgtgtgcctttttgggtctgtacagggccttgcgtgcttgcgcgtccgctcctcccccctgcant

SEQ ID NO: 22867 - DNA, 2634 bp, Triticum aestivum
  Clone ID: PAT_TA_22867
ctcttatccccctcttcccgccattcctccccaaaccctctcatttccctccctcctctgacccgcgtctttcctcctcgacccgccgccgccgccgccgccatggccgccgggacgaagaccgtcgactacgcggcggaaagagcgctcgccaaggacttcctcaccaacttcgccggcccgcacggcgagcccaagtaccaggaacatcctgcaagacatcgcgaaccggaagatccgcgccgtccagatcgagctggacgacctgttccactacaaggatgtggacgaggagttcctgcagagggtcaccgagaacaccaagcgctacatcggcatattcgccgaggccgtggacgagctcatgccagagcccacggagacgttcgctgttgacgaggatagagacatcttgatgacgcagcgcgtggttgaggtggctgatcgaggagctgacggcacagaccctctccagtggatgccgccggaaatcaagcggttctttgaggtatacctcaaggcattctcgaagatgacatcactcacccttaggcaagtgaaggcataccacattgggcagcttgctaacatatctgtaattataactctgagctctgatgtgaatcccttaatgcattgggcaagttatccattttcagaaaactgttgtccagagtgatgttagatgaagccctgcgcctttatgcagatgtcaaaggtactcgctctactcttgatgaccgccagcggatctggcctggatgcttatctctgaacatatactccatcctagagagatgaagcagcaatgaccaacatcatggatgtgaaatatggtcatgctcttaacctgttttcaactactgaatacagtgaggagctgacaagaaagggcctacaggaggatgcatccttgaacgcgggtcatatccaccccatgacttactttggcttcttcatcgtgcgatgatgatggaagtcaacattccatcagaaacagatgactatgatgtacgacaaggagatctattgccagtgtgaacttaataattgatgagcaagacctaattgacagattggctggtgatggtgatatctacagtaagctatcaaaatctttgacacctgcaaatatttgggcatgaaggacgtgaaaaaggctttgttggtgctactcgttggtgcacctcatcggaagcttggagatggcatgaagatcagaggagatctgcacatatgcctgatgggagatcctggtgttgcaaagagtcaacttctaaagcatattatcaatgttgctccaagaggagtgtataccacagggcgtgggagcagtggtgttggtcttactgctgctgtccagaaagatccagttacaaatgagtttgtccttgagggaggggcactggtactggcggatatgggtatctgtgcaatagatgagtttgacaagatggaagagtctgacaggacagcaattcatgaggtgatggagcagcaaacagttagcattgccaaggctggcatcaccacctctcttaatgcaagaactgcagttcttgctgctgcaaatccagcatggggaaggtatgatatgaggaggactccagctgagaacataaatcttcctccagcacttctctcacgtttcgacctcctttggttgatcctggatcgtgcggacatggaaaatgatcttgaaatggcaagacatgttgttcatgtacaccaaaatcttgaatcgccagcacttgggttcacagcacttgaaccatctgttcttagggcatacatatctgctgcaagaagagtcactccttctgttcctcgagatcttgaggaatacattgcaactgcctattcaagcattcgccaagaggaagccaagtcaaatgcgcctcattcttacacaaccattaggacacttctgagcatagtccggatttctattgccttggcaagacttcgattttcagaaactgttgcccagagcgatgttgatgaagcactacgcctgatgcagatgtcaaagtactcgctctactctgatgaccgccagcggtctggcctggatgcgatctctgacatatactccatcctgagagatgaagcagcaaggaccagcagcatggatgtgaaatatggtcatgctcttaacctgatctccagaaagggatacagtgaggctcagctgaaggagtgcctggaggagtatgcatccttgaacgtgtggcagatccacccaagcaccttcgacatccacttcatcgacgcctgatctgggaagtgaacattccatcataatcagatgattgtgatgcgcgactagggtgtctgatgcccttgtctgggatataacaagattgaaagacttcagtggtagcgtgaaatgtactagtctagtagagctgttgctatttgttcctgtgaaccatgcaggagcctttctccttcagcaatttcattggttgacactggagtgtagtaaatgtaactctgttatgtttgtttacccattagttgtacgctttccgacaatgatgaatttgtgctgctctattggtgctaaagactatttaagctgattctcatggaattgcttggaggatgaaagcttggttggcatttctggtt

SEQ ID NO: 22868 - DNA, 552 bp, Triticum aestivum
  Clone ID: PAT_TA_22868
cgtccggcttattccccggccggaacaacgcatccaagctcctctccgctccggcgacggcgacggcgacgtgccggcggttaccttcctcctcctccgtcgaccaagatccaccaacgcgcgcaccggctcctcttatttcagctacgtcacatcaccgatttcacacgcaatggatgggcaaagcagaaagcacaggattttgatggtgtccgacttcttcttcccaaactttggtggtgtggaaagccacatctattatctatcacagtgcctccttaagcttggccataaggttgttgtcatgacacatgcatatggaaaacgttctggagtacgatatgttactggtggcttgaaggtttattatgtgccgtggaggccattcctgatgcagaatacactacctacattattcatgacatttccaatcataaggacaattcttattcgtgagaggatatctgttgtgcatggacatcaggccttttcaacactgtgccacgaagcgttgatgcatgctaggacgatggggtacaaagttgtcttcac

SEQ ID NO: 22869 - DNA, 671 bp, Triticum aestivum
  unsure (1)..(671): unsure at all n locations
  Clone ID: PAT_TA_22869
ggaggagatcctcgatccataccgcgggatctattgtaccatcatatgattcaatgtttacgggtttaaagccctctgggaattcgtgatccattacttcatcagtgaagcatagggggtgtgcggcgcctctgtgccgggctatatcacgacgcagttcatacgagtcttgtctgctgtattcggcccggccggatttgcttttaagtatatccggcgtgacggtcgtcatcccgcgttggggcgcgcccccgtgatccgtagatccgatcttgcatgtcctgctttgttttccaaatacgtctcgcaggtcccgcgtgttgcccccgggccttggatactttgtttgaactggcggcggggtgcaggctgggacttccgcctcacatccccccttctcccgcccgtgatgcgcccggccgcccgcctcttccccgggatgtggtggcttgctcccctcccccgcgggggcccgtaccacctcccctttggtgaccgtgttcgcgccctccggccgcgtcctcggccccgacacgcatcctcggtccctactgtcccttgacttaccccctcctcttgctaagctttggcccccnttcccggcttaaccccgcccacggatcggaccccttaggctcacccggggctcggtccccaggatttatntancc

SEQ ID NO: 22870 - DNA, 513 bp, Triticum aestivum
  Clone ID: PAT_TA_22870
cgtccgcccacgcgccgcccacgcgtccgcggacgcgtgggcgttcctgtcggccggcagtgagctgctgctggagatcatgcgcccacgcgtgggcggcggcgtgggcctccccatcctcggcgccctccccgacgcgctcctcgtgctcgtatctggtctctctgggactaaagaaactgcacaaagtcaggtcctcatcgggatggggctgcttgctggttcgactgtctttcttctcaccctgctttggggaacttgtgttgttgttggcaaatgtgatgttacggaaaacggtgttgctattgattcaactgacactaagggcttcagcttgactggctctggcattacaactgatgtgcaaaccagctatgcagcacgaatcatggccatatctggtattccctttgtcattgctcagttcccgaaaatgttgaagactcaccatggggagcgcttagccatattgctggctctaattgcatcattttcacttgtactcgcctactg

SEQ ID NO: 22871 - DNA, 2073 bp, Triticum aestivum
  Clone ID: PAT_TA_22871
agatctgacgaggcagtggagagcgtcgagaaccctggctggtgcattgccaaagccgtggggtacctgattctcggtgctaccatttgtgccgcatttgcagacccgctcgttgatgctgtccacaacttctctaacgccacacacatcccgtccttctttgtctcgttcatcggcctcccgctggcaaccaattccagcgaggctgtctcggccatcatcttcgccagcaggaagaagcagaggacttgctcccttactttctcggaggtgtacggcggtgtgaccatgaacaacacactgtgcctgggcgtgttcttagcgctcatctacttcagggagctgacgtgggacttctcctcggaggtgctcgtcatcctgctcgtctgtgtcatcatgggcctcttcacaagcttccggaccagcttcccgctctggacctgcctggtggcgtacctgctgtaccctctgacactcgccgtcgtctacgtccttgacttcgtcttcggctggtcataggctcatgcttctgcacgcacatttgtgtttgatcctgtcgtgatttttgactcattgtaatttatatgtctagacttcgaggtgtttattgtgttcatatccatggtgtgcattgtgtatccctgaatctatctttaaggtcccatctgggtgtagcgtttctgtgtgttatatggaggatattgggagctaatgttgaagactcaccatggggagcgcttagccatattgctggctctaattgcttcattttcacttgtactcgcctactgcctgtatcaggttttccagccttgggttcagaagaggaagctcgcatacgcaaagcacaagcatgtgatctctgggatcctacagcatgcccaaaagcaagcactgggccggctacttaacgatgacggctcacctaatgaaaacgtcataagaaagctgttccacaagattgacaatgatgacagccgtaacctgtcacgagcagagctacatgcgcttattatcgggatcaactttgatgagattgactttgacaagaatgatgcagtcgataagatcatggacgactttgatacttcaggcaatgacactgtggaggaggatgagtttgtcgcgggaatgaaaacatggcttaatgaggcgaagcaaaaagtggcggctagtggtgcctactctaataagtttgtcaacgactaccatgctagaaccagggaggatcatgaccagttggtcgacagatctgacgaggcagtggagagcgtcgagaaccctggctggtgcattgccaaggctgtggggtacctgcttctcggtgctaccatttgtgccgcatttgcagacccgctcgttgatgctgtccacaacttctctaacgccacacacatcccgtccttctttgtctcgttcatcggcctcccgctggcaaccaattccagcgaggccgtctcggccatcatcttcgccagcaggaagaagcagaggacttgctccctcactttctcagaggtatacggtggtgtgaccatgaacaacacgctgtgtctgggcgtgttcttggcgctcatctacttcagggagctgacgtgggacttctcttcggaggtgctcgtcatcctgctcgtctgtgtcatcatgggcctcttcacaagcttccggaccagcttcccgctctggacctgcctggtagcgtacctgctgtaccctctgaccctcgccgtcgtctacgtcctcgacttcgtcttcggctggtcataggctcatgcttctagtctggacacacgcttgagtttgaccctgtcgtgatttttgactcattgtaatttatctgtctagacttggaggtgtttattgtgttcatatccacggtgtgcattgtgtatccatgaatctatcttaaggtctcgtctgggcgtagcgtttttgtgtgttctcttctcttcggtaatggtgtattaaacatatccggaggatactgggagctacatgctagaaataagcttgagattattaacctatttaaacaaaataaaaccccaaaaaaactcgactcgtgccgaattc

SEQ ID NO: 22872 - DNA, 527 bp, Triticum aestivum
  unsure (1)..(527): unsure at all n locations
  Clone ID: PAT_TA_22872
gccgccgcccggcccggcgccggcgcccgccgcggggccgccccgtggcgcgcgtgcggctcgtccttgacgataagaaggcatctcaattcaaggcccagccgatgttacggcgagctccgatgataaagcctctgcttcctggcaatggggtggccccctcgcccgtcctggcccacctctgaccggtgagggccgctccccagggcctgtgctgcagctcccgtgtgtccgtgcgatgcgggaccgacatagagctagaaatacagtttggcttgtgagcatactattgcagtcccctgcagattgatcataccctaccttgaagtgcctacttgtgaaagacaaaacgatgcttaagtgactcatctacggacaccttttctgcttgatgcttgtaatgcacctgtgtgtagtttcttccgcaccacgtttctcctatgtgcctgaacatgtggtgtgtaatatgacacaaatactgatatgtgtagaaggaatttgaangcggnaactnnaaaaaaaaaaaa

SEQ ID NO: 22873 - DNA, 717 bp, Triticum aestivum
  Clone ID: PAT_TA_22873
cgtccgggcaaatgtgaagctcttgcatcaatcctcagactgattcctgcaaattttcctacagaactacaacatggtagtcttgaagtaaataccatttcttttatttcacacctcattttagaaaatctttcgatatctctatcatcattctgcaagtttcatgacagtggcttcgctgtcccattcacgcagttccatacatccatgaaggagggaaatatcacagcttttagatgaggaattgaggatcctgaggaggaggaacaagtgtgtggcggggctgtgccaactctcgacgttcgacgggcgccactagatccccagcacgccaggggaaggcatggcatagtcgtgtcccaacacgtgcagggatcagtctgcatctccgtgcaatagcttcccatttgccttttatttcacacctcatgttaggaagtctttcgatatctctatcatcattctgcaagtttcatgacagtggcttcgctgtcccattcgcgcagttccatacatccatgaaggagggaaatatcacagcttttagatgaggaattgaggatcctgtggaggaggaacaagtgtgtggaggggctgtgccacctctcgacgttcgacgggcgccaccagatccccagcacgccaggggaaggcagggcatcatcggtccccagcacgccaggggagggcagggcatccccgagagaaaagcgaaaa

SEQ ID NO: 22874 - DNA, 726 bp, Triticum aestivum
  unsure (1)..(726): unsure at all n locations
  Clone ID: PAT_TA_22874
agcagattccaaaaggatagtgacaatggtccgtgataccttcgagaaggaagacctggccatagttgttgcttgtggccgtgataccataccatatgcaagctctgtaaggtgtttagctccagataatgtctttgtcattcagatacaacaccccaggtatcgccttgataggttcgatttggtggtgactcctcgccatgattactacgctttaactgcaaagggacaacaagaagtaccgcggcttttccggagatggattactccacgagaaccacccggtctgaatgtggtcctgacgtctggagcacttcaccaagcagattctgctgcactacgcgttgctgctacaaactggcatgatgaacttgctcccttgccaaagccattggtagtagtaaatattggaggaccaacaagaaactgtaattatggtgtagaccttgccaagcagttggtaagctcactgcacaatgtttcaagagacctgtggaagtgtcagaatttatttccaggagaacgccacaaaagtgtccgatcttatattgagagagtcagcacacatccaaagttcacatttggggcggtgaagaactaaccacacctanggatcttcanggccatgcttcacanacacagctcatatagcaagtangctgaacnnggaaccgncangtcntggactacatgagnggaatncanattcaaaaaccgagaacaggg

SEQ ID NO: 22875 - DNA, 482 bp, Triticum aestivum
  Clone ID: PAT_TA_22875
cgtccgcgcggacgcgtgggctctctctgtctctctctctctctctagggaggggggagctgctgttggataagagaagggaggagaagagagttagagataggcagattagcatccagattagccgtacaacccatctcgcagattctgaatctcctcgccgtactgcccatcttcttctttggttccgttttccagtgtatgatcaagtcactcactaatcaactgaagcagcatgagctcccatggtgttgttgccgtgaagccgatcgctgcgccggacaaaaccgcgcattcttatgcctgtggatccacacagtcctcagttcataagctgctggatgctaaattggaccaccttgggctgttggatgacaatctgtcatccaccagtcagtcatcagacatcaagaccgagctgatccgaacgtcgagcctgcgaagagcagcctaccattaaccttcagaggaggagccccgag

SEQ ID NO: 22876 - DNA, 635 bp, Triticum aestivum
  unsure (1)..(635): unsure at all n locations
  Clone ID: PAT_TA_22876
cccacgcgtccgcccacgcgtccgagcaccttccccttctttgctagctatcactcactccagcgctagctccgatggccgcctcctccttcctcccgctccacctcccggcctcccccaggccagccaccgtggccgcgagggcagcctcgggcgtcgcgtcgacggtgcccgccgctactacgcagacgtcgcagctggaggagaccttcggccggaagggcctgaggttcgggacggacgccacgggcgcgcccacggcggagctgagcgtgcgcaacggcagctcgctgcagctccggctcaacgacgggctggtcacgtcgtaccggcccaaggtgtcctgggagggcggggacggctgccgggagctgctgcacaccgtggccggcgccggcgcggtcaagggcggcgtggggctggtgctcaacgaggcctcctcctcgtcgtccctgctcggcgcgtcagacttgtccgtgacggacgtgggctcggcctcgtgcggcgcggtgcaggtggagctcgggtgcgccgggcgcgccgcggggccaactgngtgtctaantggnantcttaccgcnnacattgnaacgngtgatntnantaaaacnggcaancgntaactaangggcgtt

SEQ ID NO: 22877 - DNA, 672 bp, Triticum aestivum
  Clone ID: PAT_TA_22877
cctctctccacggtcctcctactactccccacccccaccacagcgacgcatcaccgcgggaagcacgcaccggcttaggcatcccaagctccctagtccccttcccaccccacacggcgagatcttggtctgatctcgctagcgcgtggtcagatccaccacacccgctcaccaagccatcgcgcggcggagacccgatgtcggcggcggtcgaggagcagatggtagtgaaagcgatccgggaggagtgcccgtgggagtccctccccaagcgtctccaagtccactctccacaccaaggacgagtggcaccgcaggattgtccattaattgcatccgaaaacgattacaatggaatacctgctttgcccgtcgagtttacagggaaggggaatactatgaagaaatgatgcgctatctccggcgcaatcttgcattatacccataccatcttgcagactatatatgccgagtattgaggatctcaccattcagttcgtgctgtcccttcctgttcgaaactatgaagaacgaacaaccatatgatagtattccaaacttcactgctgctgatgccctaaggctgactggtattggaagaaatgaatttattgatattatgaacaaatgcagatcaaagaaactaatgtggaagctgaacaaatcaatcgc

SEQ ID NO: 22878 - DNA, 1014 bp, Triticum aestivum
  Clone ID: PAT_TA_22878
cataacccatggccggtgttttccaggcgaccaccgcccgcccccgcctgcctctcgtgctcgcctgcctctccccgaccacgcgaaagctccacgtcacccgcccggccgccttgagtatggacgaggcatcggcgagcgctccgggcgccaagaaccaccgtcttcggggaacggcaagcgcgtcgtggcgaagctgctggagaggggcttcggcgtcgtcgccggcacgacggacgtgggcagggcccgcggaagcctgcctcaggaccccaacctccagctcgtcagggccgacgtgacggagggcgccgacaagctggccgaggccgtgcgcggcgtcgacgccgtcgtctgcgcgacgggcttccggcggtcctttgatccctttgctccctggaaggtggacaacctggggacagtgaaccttgtggaagcatgccgaaaggctggagttacaagattcgtgctcgtgagctccattttagtgaatggggccccgatgggccaacttctgaatccagcctacatcgtgctcaatctgttcggcttggtgctcgttgcgaagctgcaggcggagaaatacatcaggggatcaggaataaattacacaattgtgaggcctggagggctcacagaacagccgcccactgggaacattgtcatggagccagaggacactctctacgagggctccatatcgagagaccaggttgcagaagtggctgtggaagcattgttatgcccggaggagtcttcctacaaggtcgtcgagatcgtcacccgagctgatgctccaagccgccccctcaaggacatgtttgcttctattaaacagaaatgagttcttgagcctaattagatagggactagtagtaatgtgcctaatacggcgtcagtcaagtgtgttgttcttctaacttgcaagtcgcggttcatctatggatattcagaagtataaaacctcccgtgctttttcaaaaaaaaaaaaaaaaaaaaaaaaaaaaaaaaaaa

SEQ ID NO: 22879 - DNA, 611 bp, Triticum aestivum
  Clone ID: PAT_TA_22879
gcccgtattattccattttccattgaggttgagggtagcagtcgaggcagtacaattgttcaagagaagagaacttaacagcctggtgcgtgcaatgaggagctcagcacccctctgtctagttatcaccttggtggcattctacttcttggttccctccaacgctatacccctctcaagagtgcagagactggtgcccttgcaacatgccggtgagcaggtgccatgggtcaaagaaaacactcctaagccaaagatggacatggctagagtgatcctagaagatgatgcggtgaacgtcagtacaaggatggcactggagacgcaggactacgcgccctcgggcccgaacaaccaccacaagccaccgggttggaactaagctagcgcatcccgagtcacaactttcataaagttatatcggtggtttcatttagttaaccagccgtgttgtgctgatctattgtgtgatgtgatgctcacgatcttaatttacactaggatatgcttgaaagatgccaacttattttaccattgtaagagtcatgttaattgaaatatgacgatattaataaaagttgggcgtgcttaacctgaccattctatcgttt

SEQ ID NO: 22880 - DNA, 510 bp, Triticum aestivum
  Clone ID: PAT_TA_22880
gcagggttgatgcctcggaagccaagactgaaggcgacaaggaagcggccgtcgatcttaggccactgacgatggggtacctgacggaagcggacgtcgatcttaggccactgacgatggaggacctgaggcaggccaaaaatcaggtcgccgcgagcttcgccgcggagggcgctgtcatgaacgagctgaagcagtggaacgacctctacggcgaaggagggtcgaggaagaaggagcagctgacctactttttgtagaaccggaaggatggtggatgtgtcgtgttgggcaaatcgctgaagccttggcagagcatgagcatacatatgttggtgggaaaaggagagaggatttcctgtgagcaaccgtgagttaggatcttggagtgaatggactccttgagatgtgtggcagggggcattggatcatgtacgattcttttatacgaacaagtattgtagttattcattattatatatgttgtatctggtttgtgaacctgtgtgt

SEQ ID NO: 22881 - DNA, 278 bp, Triticum aestivum
  Clone ID: PAT_TA_22881
cgccgtcgcggagacccaccggtgctcgcgtgagccgccggcgctgcctgccggatgattaatatgcttcgtccgccttgtctatattaaccaggggaaaagggggaagcgaacggctgaatcgagggaaaacccgtatatgatgtggtgtactcgaccatgatccatggtgatgactgatgaatgcgtaggcgttgcatgtacaggtgtgctacttgtgaactgatatgatcggaacaccgtaataataagccccgtaaatccgtaaaaaaaaaaaa

SEQ ID NO: 22882 - DNA, 1089 bp, Triticum aestivum
  unsure (1)..(1089): unsure at all n locations
  Clone ID: PAT_TA_22882
gttcagcccgtgttgttcagnaactttgtctgggnggatccttntntaagcgcgtgcccncaccacgcaacgtcagatnccgaagcctttntggctnancgcatgccggaacancgatgtccttggntggaccaattgtncctcgcgtgtgttgacccttgcttcttgtgggtcacagtattgtctccatgttcagttgagaagtgaantcatgattgggccgttgccacttgtgcggcttagtatgatgcttgatgggcttgatgatgagcgtgatacagtgttgagtctccccagatcgtgacagtaaagataggggatttggtaggattgagccatggttcccagggtgcggcctttatggcgcgacaatggagcacttaaaaaatgagtcctgggggagagattccattgctccccaataaagagggcgggcaagatggtttgtggcgatctcctatgcccaagccacaatgtggagaagacagatggtcgtccttacagtgcaggcaaaggaagcggacaattactttaccatgaaggcattactgatggtgcctccaaggatttgtgcaatactagtaaggatcctgctgtgcgagcctatggacagattggggactgaactgcatgggaagcgcacatgttgggggaaactgcaggtgaatgttacaatgataatccaataacgggtacaagaggaatccttcccaagaataacctgtttccaaggtgatccatatcttggnaatnaaggacctttaattaatgagctggggaacaaattttggcaaggataattgtcccctggatcccctgttaagcctttaatttgacatacggtttttgatacatttctgccgtaattccantcaataaaaaaaagggggggcccggtaccantncncctaatatgatcntattacnccctcacggcgtcctttaaaactcctgacgggaaaacctgcgttaccaactaatcccctgcaanaatccccttcgcactgggtatacnaagaggcncacnattgccntccacantnccacctaatgcaatggacccccttacggcataancgnggntttgtn

SEQ ID NO: 22883 - DNA, 810 bp, Triticum aestivum
  unsure (1)..(810): unsure at all n locations
  Clone ID: PAT_TA_22883
cccacgcgtccgcccacgcgtccgcggacgcgtgggttgaggatgctctaaacgcaaccaaggctgctgttgaggaaggtattgttgttggtggagggtgcactcttttgaggctggctgctaaggttgatgccatcaaggacaccctcgataacgacgagcagaaggtcggagcagagatagtgaggagggcgctgtgctacccactcaaattgatcgccaagaatgctggtgtcaatggcagtgttgttaccgagaaggttctttctaacgacaacttcaagttcggctacaacgctgccactgggcagtacgaggacttgatggctgctggtatcatcgaccccactaaggtggtgagatgttgcctggagcatgccgcgtcggtggccaagaccttcctgacgtcggacgtcgtggtcgttgagatcaaggagcccgaggccgcgcccctcgccaaccccatggataactccggctttggatactgatgagcaacacaggccgagtttctcctgaggacgtggtttaatttttggtagcatgaaccaagttttgagagattgatgatgatgatgatggtagttttgagataagaaaaatgcaatgtgatgtgccgccagaaaggcgaaataagcagaggaacatttagcggaaatttcttgatgtaattggaacagcatacggctcttgttttacgcgcaggaatgtacgccatttcacgtctcggttctgttttttgtttcagagttgctattggtaccatgttagtgttgtgttgaacactctagttntttgattttcatcatt

SEQ ID NO: 22884 - DNA, 1560 bp, Triticum aestivum
  Clone ID: PAT_TA_22884
cgtgcgcccacgcgtccgaaacccctcacccgcacccgcagcgcccctgccctcccgaggccgcagccttatcctctccgcccctcctcgctcccgccccgctccgccaaggaaaacatggcttcaccatttggtgccacttctaccgttgggctcatggcagctccatctggcattgtatcagacaagaagccattttcactgtcatctatctcccttgccgacaggccacgacatgtgcgccttcagaggaaatgcaacttcagggtaaaagccgctaagtcgggccctcctcttcctcacccactcagatagagcgttaaggcagtatggcttcaccgttcgggggcgcctccacctgtggcctcaaggcagccgctccttccggatttgcggccaggaagcagctctccctcgtttcgcccccgttggtctcgctgccccagagggtcaggccggggagaaggtgcggtgtccgagtgaacgctgcaaaggagctgtatttcaacaaggatggctcggccaccaagaagctgcaagttggagtcaacaagcttgctgatcttgttggagttaccttgggcccaaaaggacggaatgtcgtccttgagagcaagtacgggtcccctagaattgtcaatgatggcgttacggtggcaaaagaggttgagctggaggaccctgttgaaaatattggagctaaattggtcaggcaagctgctgctaagaccaatgatttagctggtgatggaacaaccacttctgtcatccttgctcaggggatgattgctgagggtgttaaggttattgcagctggtgctaaccctgttcaaattactcgtggtattgagaaaacagcgaaagcactagtccttgaacttaagaagatgtcgaaggaggttgaagacagtgagcttgccgatgttgctgcagtcagtgctggcaacaactacgaaatcggtaacatgatagcagaggctatgagcaaggtcggacggaagggagtggttacccttgaagaggggaggagttccgagaacaatctttatgttgtggagggaatgcagtttgagcgtggttatatctctccttatttcgttactgacagcgagaaaatgaccaccgagtacgagaactgcaagctgcttttggttgacaagaaaatcaccaatgcacgggatcttatcaatgttctggaggaagccatcaggggtcaatacccaatcctgatcattgctgaggatattgagcaggaggctcttgcaacccttgttgtcaacaagctcagaggttctttgaaaatttgcgctatcaaagcccctggttttggagagcgcaagacccagtatttggatgacattgccatcctcaccggaggaactgtgatcagagacgaggttggactcacacttgacaaggcagatagtacagttcttggaacggctgcaaaggttgtccttacaaaggagtcgaccacaattgttggtgatggcagcacccaggaagaagtgactaaaagggttgcacagatcaaaaatctcattgaggcagcagagcaag

SEQ ID NO: 22885 - DNA, 2283 bp, Triticum aestivum
  Clone ID: PAT_TA_22885
ggaggctgcccccgcaccagcaccctcagccccccccgccgcgccctgcccccccgaggcccccgccgtcccccctcccccctcccccgctccgcccaggcccgcatctccaaacgaaaacatgcgtttcacaatttggggcccctgctacctttggctgcctgtcaatcccacctggaccttgtttcacgacaagaaatcttctttgtcatcatgtatctcccttggcgacttgccacgaaatgtgcgtcttcaggagaaaaagcaaatggaggagttcaacaagcaaaggatctctaacctcaaaaagaaggtcgcggatggagtcaaggaggctgcagatctggttgaagttaccttgggaattaatgttaggaatgtacgtattgggagagaaagtgacggagcccctaagtttgtcaataattgtgttacagttgaaggtggacggttaagatttgacaaggtgcctgatgaaattaattggaatttgaggttggaaagtcaagcagcagaaaaggataaacaaatttaagctggggacaaggattaatatgtcagacgggcctactactggggctcactttgctagggggttaagtgtttagggtgtgaaggtaactgcatccagttcaaacccggtttaaattaatcgtggtattgagaaaacagcgaaagcactagtccttgaacttaagaagatgacagaggaggttgagatgtttctgctttcagttgtggctgcaattacgaattcggtaacatgatggcagcggttacgagcaagcaggggcggagagcaaggtcggaccgaagggagtggttacccttgaagaggagaggagttcgtagaacaatctttatgttgtggagggaatgcagtttgaccgtggttatatctctccttatttcaatactgacagcgagaaagtgaccaccgaggacgttggttgcaaggagaattagctatacaagggaatcaatcattctcgtgaccttagccatgagctggaggaacccaacccgggtcaatacccaggacagatcattgctgaggatattgagcaggaggctcttgaaacccaggtggttctttagctaattgctttatcaaagacccccgctttttgggagagcggaagtcccaagcgctggacccagtacctggacgacaccggcatcaatcatccggaggaaactgtaatcacacacgaggttggactcacacttgacaagtcagataatacacttctaggaacggctgcaaagagtgtcctacaaaaggagtcgacaacaattgttggtgatggcagcacccaggaagaagtgactaagagggttgcacagatcaaaaatctcattgaggcagcagaacaagactacgagaaggaaaaactcaaccgagaggattgcaaagctcgccggtggtgttgctgttattcaggtgggagcacaaacagaaactgaacttaaggagaagaagttgagagttgaggatgctctaaacgcaaccaaggctttctgttgaggaaggtattgttgttggtggaggggtgcactcttttgaggctggctgctaaggttgatgccatcaaggacaccctagattccgacgagcgatagtgtggagctgggatagtgaggagggcgctgtgctacccactcaagttgatcgccaagaaatgccggtgtcaatggcagtgttgtcaccgataaggttctttctaacgacaacttcaagtttggctacaacgcttgcgactaggggaagtacgaggacttcgatggcctgctgatgatgcttaggactcccacggagggtgctgggcgttggcccctggcgcatgctcgcgtcggttggccgtagtccttcctgaaggagcccgaggcggtcgccgcgccaagcccaccgacacctccccccccgcatactgaagagccacctgtcgcgtgtttctcttgggaagcgccaggtccgagtttctgctagcgtggagcaattttttatagtttgattaatcatgatgatatagtttcgagatgatgaaggaaataaaatgcaatgggaggtaaagacagcaatgcgaaattaagcagaggagcctttagcaagaagaaaaacattaagcaaaaattaccgacaatctgcttggagtagtacgagcgtgctgggaatgttcgcaggcactctacgacatatcacatctcacgtcaaaaaaaacacaaaaaggaaccgcccgcgtgcctcgtcgccctaaaagtgagtccgtattaacgccgcgc

SEQ ID NO: 22886 - DNA, 851 bp, Triticum aestivum
  Clone ID: PAT_TA_22886
gtccggtgtgtcttctcctctccctaccgatagttggggttaatggatgttcttgctagatctgctccctctgcttattcttatccctgtggttgttcttatgcttttctaaagtgctttttgtgcttttttctgttcgcgggatttgggaatcaggggatccttggcagacggattagttctgctacatctatccccttcttcagtataggtatggtttgccctgtttgttgttgtcctggtgctccatgctttctgtttgtgccagccgatgaagtccctgaagttttcgacgtcgtccttgatgaatattgctctaggaggatgtagatctgctgctgttggtttggtggattgaaggagaaggtagctgctagcaagaatcgtctggacaagttgttcagaaacatcagaagacaaggggagatctgagctttctttcttttcccatggtggcagttgtgtgggtgtcgagcaacaaagaagaggaggcaagggagaagccctagtgagctgtacgataactggatctttagcttagcgggttcaggcctgttttctctctgggctaaagaaagagcagaagaaagaaacaaaatgttctgaggctttctttctgttgggctgactgactgacaatagttttgggtcagtcagttttctttctgggttgcaatcttttccctttgttaacattcgactgaccactttttgaggcagtcgattgatctgtagccactcccgctttgcacactagctaactgcatctgtaaataacagaataagaaactgagacaccttgtactatgaacatttgagctgtagcaaaatccaaaaaaaaaaaaaaaaaa

SEQ ID NO: 22887 - DNA, 633 bp, Triticum aestivum
  Clone ID: PAT_TA_22887
cccgtgccgccgggtgcacgatcggccagcaacaaaagcttcgaaaagcaaaagcatggccctcccgtcgccggccggaatcgccaagcccaggctccaccttctcttcaaccacaggcgcgccagctcgtcctccgtcacctgctgcagcaacaacgggcggtcgtcgtcgtctgagcccgaggactgggcggcgccgtcaggggacgccgtcgactggcgctcgttccgggcgcagctcgtcctcaaggagcagtacgcgaagagcgtcaacccggcgctcagggcgtcgtgggcgccggcggcgaagatcgcggacaagtgggcgcacccgctggtggagccggagaaggggtgcctcctgatcgcgacggggaagctggacgggtcgcacatcttcgagcgcaccgtgatcctcctgctgtcggccggggtgctcggccccgtcggcgtgatcctgaaccggccgtcgctcatgtccatcaaggaggcgcagtccctcttcgcggaggaggcggacatcgccggcaccttctccggccgcccgctcttcttcggcgggccgctggaggaatgcttcttcctgcttgggccgcggaaggccgccagtgccgccgacgacgtggtgggccg

SEQ ID NO: 22888 - DNA, 625 bp, Triticum aestivum
  unsure (1)..(625): unsure at all n locations
  Clone ID: PAT_TA_22888
cggattatggccaggatggttgggatgcggacgacgaagaaattcagagcccacccaccacccactttgcagccactgtcgacgatctaaccgacatgctagactacgactccgaagacatcgacgctatggacgacgatgccggagacgaacaggaaccagcgcccacagggcactggaaggccacctccgtcatatgacgtatacatggtggataccccaaagatttggggacggcgaaagaaacagcggaggcagttcccttaaaggaaacagcccaagcgccggcgttcggcggcgccgctctaatcctccccacagccaaaacggagatttccnggcacaggggaataataacccccaagagagtgccaaagacaatcccctccaagcaagtctccccgcgggggcctgccgaccccacctgggggggcggcggcaaacgtttggttcaggttcataccccccccctccccccgcagcccaacctagctctccgctaccgagccccctccccaggccccatcccacgtntcncanacaaacactaagaaaacacacagtnaactgttagtcncngccatnatggccantccccggcaaattaaaccaagtccccaanttc

SEQ ID NO: 22889 - DNA, 922 bp, Triticum aestivum
  unsure (1)..(922): unsure at all n locations
  Clone ID: PAT_TA_22889
gnnggntnnnttttttctctttntngaccntaccctactaaagggaacaaaagctggagctccaccgcggtggcggccgctctagaactagtggatcccccgggctgcaggaattcggcaccagctcgcgttcgccgcgcccatcctcgtccgcgcctgcgccccgaccgtgctcgccgnctnccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgacttcccagagttcctcaacctgatggcccgcaagatgaaggacaccgactcagaggaggagctcaaggaggccttcagggtgttcgacaaggaccaaaacggcttcatctctgctgctgactccgccacgtcatgacgaacctcggcgagaactcaccgacgaagaggtggacgaatgttccgtgaagccgacgtcgacggtgatggcagattaactatgatgatttgtccaaggccatgatggcaaatgacaccaacctgctccccaagacaggaggaaattttccattgcatatagtttaaatccaccctattggttcattccatttaacacctacctatctcctgcctctcgttcgttcgcatccgcatttccccagttcncaacctgttccttcccctgtgtttaagtgaactgtgccccccggngtanccattnngtntccccctttgnaaatttnacaaaatttctgggncncccacnacggnaacngggntttcnaaaaaaa

SEQ ID NO: 22890 - DNA, 536 bp, Triticum aestivum
  Clone ID: PAT_TA_22890
tgctaagatggcaccacctttcgaacctacaatatggggtgacttttttatcaactatactccggaaccactgcagtcggaggaacggttgagagagagggtcgatcaattaaagaaggtaaccagtgaactgttcgagttttgcagcgatagtgtggttggaacaatgaagctagtagatacacttgaacatctgagcatagaccatcactttgagggacatatcgccactgcattaagcaacatacacggtgctgaactcgatagctctagcctccacgatgttgctctccgatttcgcctgcttaggcagcatggactgtgggtttctccagatgaatttgacaagttcaaagaggcagatgggaccttcaacgatgagataatgagtgaccctcggggtttgctgagcttgtataatgcatcttaccttctcattcctggagaggtcgagctagaaagcgctatgttgttttcaaggcatcgccttcaggcaatggtaaatgaccttgcgtccccattagctgaacaagtca

SEQ ID NO: 22891 - DNA, 640 bp, Triticum aestivum
  unsure (1)..(640): unsure at all n locations
  Clone ID: PAT_TA_22891
tggccattttcctcctttgttctgctcatagtccttttcttctcttttggtgtacttagatacttgtgtagagatatacatcgagatggacaaccctccgagctttgttgtgctcatagtccttttcttctcttttggtgtacttagatacttgtgtagagatatacatcaagatggacaaccctccgagtacgcaggacatgtcctactatgatcatgttcagaagcgccatgaggagaaaggctgcttatatgcatgcctgtttacactgtgctgttgcttctgctgctacaagacctgcgagtgctgcatggagtccttgtgctgctgcggctaattttagctgcacatttctgctgttgcatggagatctggcaggctgggctgtactgtggaaacccatatcgtttcgcctcggtgagatgatgaacaggcatatgtgcttgttcgaataaaaactgtagttacgtctctattgtcatgtatattgttggtcgccaaaaataagagagtatgctgttggtgtgtgttgcctttgacgattgtcatgttaagtgctgtcatgttatggggataccccccgagnattaacttcatcaaancttactttaaagccccactattccatataaaagnggg

SEQ ID NO: 22892 - DNA, 666 bp, Triticum aestivum
  unsure (1)..(666): unsure at all n locations
  Clone ID: PAT_TA_22892
tggtgctcaatgcgtggttcggcatcccggaggtccccataaccgctaccactgttagagatgagcaaggagtcctggaagctgttgagcacgtgcacgaaatgttggacaaagaagtggctgccgggacgagtcctacaaacattttcgtttgtggattaagccaaggaggtgctctagccatagcaagtgttctgctctaccccaagactttaggtgggtgtgctgttttcaagtggttcagttcctctcagcaaatcatttgctgacagggtgacacctgaagccaggaaagactccggttttatggttccatggggatggcagacgggggggtactatccgaagccgggcacccgggatgcgcatttctcccaagagcttggcatggcctgccaattcaagacttatccgccccttgggccttccttggggggtgaccccctcctgcgtcgtcggcgccggacgctcggtccccccgggggccctcgagcaacgcacgcggcacgtccaccctcatcctcgtcgtcgnactacatttngggacactcangggataantccacnaacatgactaaatgnttcatcancaatcttganagntcaaaagggggccggtccattcccnaaggagncatacccccaaggcgtcttnaancgagggaa

SEQ ID NO: 22893 - DNA, 1556 bp, Triticum aestivum
  Clone ID: PAT_TA_22893
ccaagaactcgtgctccctccctggggaatcccgcatcctccctccacttgccgcacacacgggggtggtctattgtccgtcgagactctctgtttgggttccaagaagtgtgcgcgggggagacgccggagatgggttcctgcgcgtcggtccacaaggaggacgtcgagctgcccaagaagcagcagctgctcgccccctcgccgccgtccaaggacggcacccccgtcggcgacgtcctcgtcgacctcaagcgcaagatcgaggggttcggccctggcggcaggacccctgactccggtagcaaggatgagatgttcttcgagtctcaaccgtggttagattccgactgtgaggacgacttctacagcataaatggagatttcactccgtcccgcggcagcactccggtccatcaacccagggcgcagaccgtgtcgaaacttatttatctacctctgaccggatttctacagcccaacaatcaggatgctgtaccgctgcaaccatggaaagactatctggttgctttgtttttgtagccaggggacacagtttcgtccttagttgcagcagcttagaattgccaatttgaagtttcagtcttgtgtgtctctccctgttgccccgaatcaggaacttgcttcctagttactgggttttggctctaatatcgcttcatctgaaatcaactgccagccttgacttctgaattatcatctaataagtgtgcaagccagtggttttgcgacgaggtttctatctaattttaatgcggtccaatcatacttctgcctaaccgaatccgataattcttttaagaagagcagagctaaccgaacccagtttgcaggtagcaaggatgagatgttctttgagtctcaaccgtggttggattccgactgcgaggatgacttctacagtataaatggagatttcactccgtcgcgcggcagcactccagtccatcaacccagggcgcagaccgtgatgagcaacgtgtttcttcctgataacgccgcgcggagccccaactcatcggaggcttctccgaccggacggagaaaattggccgacctcctgcaagaggcgacgcggaacgacaccggagagaccgctgccgccgctgccggagaggcagacggtagcaagagcggacagcaggccgtcgccccagctgctgggaagacggtgtcggagcccagctccggctgcagcacggagccgacgcctgtgagggaagcccggacccggaaagagagggcctggtactccggccgctgctgcctgccgaccttcgtccacagcctggccctagacgacgaggggcggcagaagaccggccccggcccgtgcgccgtctgagatagggtcgacagcgcggcgtctccgagctgtatctactacgatataccactactactactacctaaacctgatccagcccctgaatcgagctaccagcccctgaatcgagctactgtaaagatggcgagagcgctgagagtgctatacatataaatatgcttgtaataatcaagcgaatagtccactc

SEQ ID NO: 22894 - DNA, 1072 bp, Triticum aestivum
  Clone ID: PAT_TA_22894
ccccccgcccgtgtccccgtggacgaccccacccaccccacccccggctccggcccccgcggccgccccggcacgcgcgcgtggtctcttcttccccgacccccccgtccgcctccagtcggcgcacgcatgcgggtgggcatgggttcttgcgcgtcggctctctaggacgccgtcgggctgcccaagaagcagcagctgctcggcctcctcgccgccgcccaaggacggcaaggccgtcgacggcgcccccgtcggcgacgtcctccgtcgacctcaagcgcaagatcgagggcttcggccccagcaggacccctgcacaccgggtagcaaggatgagatgttcttcggagtctcaaccgtggttagattcccgactgcgaggacgacttctacagtataaatggagatttcactccgtcgcgcggcagcactccggtccatcaacccagggcgcagaccgtgatgagcagcgtatttctacctgacaacgccgtgcagagtcccaattcatcggaggcttctccaactggacggagaaaattagccgatctcctgcaaagacgcgacgcggaacgacactggggagagcgccgacgccgccaccggagagtcggacggcagcaagagcggacaacaagccgttgccccagcagctgggaagtctgtgtccggagcgcagctccggctgcagcacggagccgacgccggttgagggaggcaaggagccggaaagagcgggcctggtatgctggccgctgctgcctgccgactttcgtccaccagcctggccctagactacaacgggccgcagaaaacgggcctgggccctgcgccgtttgactgacgtccgaaggtcgtcggcgcgctgcgcgcgcctgttccatctatatttttacatttctacttgtacatgtacctacccatgtatctatatactgttgcgtgggtgaatcagccgaattgccccctccggggggggcatgtcctcgaccctacccggcgcggcatattgctgcgccctgcccctagcttgataagtcgctgcgaattaaaccctgccgcccgattg

SEQ ID NO: 22895 - DNA, 637 bp, Triticum aestivum
  unsure (1)..(637): unsure at all n locations
  Clone ID: PAT_TA_22895
gaaacaagttcaattcatgtgtttttcacccgaattatccgtcattgcttgtaattggttgttacgagtccttggaactttgggacataagggagaagaatacagtgaccatcagcaacgcccatgacggcttaattgcagccctagctgcatcaaatgcatcagggttggtcgcctcagtaagtcatgataagcttgtcaagctctggaagtgagaacagggagcaaccttccttctacatcacattttacaagttggtccctgtggacatctgtcgtctggttccagccaacgttgtatgatgtagaaacagggcggttttctgccgcagataaacacatgacgagggcagctaacgaaaatgtcttcaagctatctgtgttcaagaactaacccaatttgatgtcgtcccagttgctgcacgtgcccttgggataggtttgtaactatccttgtagaatgtaccatactccgtaagtgggcctgcgcaaactcctagaagtgttggtatcattggaatgggtcacaagcacaggtgccccgccggttcccccgtttccctctgcgtgcctctcaccggcggttgcccctctgaaattttccatgactggcgntttgctccctaaaaaaaaaaaa

SEQ ID NO: 22896 - DNA, 537 bp, Triticum aestivum
  Clone ID: PAT_TA_22896
ccacaacaccaagaatgccagagcaaggaacatgtgaacgctgcggttacatttctagccagaaattatgcaaagcgtgtgtcctgctagatggactgaaccgaggcttgccaaaactaggcatagggagaaccgctaaagtcggtgctggagctgatggcagtggcgagcagcaaggcaaacgagcggagaggaggaataggtcgagtctacaaggaaaacatggcaacttggacttctgagtatcagtctgctggactggccactcagggtgtaagcaggactaggtgtggcagtatgcccgcatcatcgtcgcgcggataattgtgcgggctatgcatctgaactttagtagctgctgctggtgttgtatcatgataaaagtctgatcgatcaacagttgaattggactagctgaacttgctagctttttttttttgagtaaaagctgaacttgctagctgttggcggctgcttgtgtatttgcatgtccaagaggtgaaggccaagttataataccattagtaattatctgct

SEQ ID NO: 22897 - DNA, 375 bp, Triticum aestivum
  Clone ID: PAT_TA_22897
acggggctcgttaatagacgaggagcattccatattagtaccactcctaccaagtttgtactcctaatactattatattactagtactaccactatacaactagtagatacgtgcacggcacaacatcgtaggaacaaaaaacgggaagatcttgttttgggtgatttatctttttttcaatcaacgtagtatgaataatatgatgtggggggcacccatgaagcttatgtggcttggttgcatggctacgaaaggttagagaaaaataaatagataatgtgtttagagtgcactccactaaatagatacactttggatccattgcaacagactggcacatctatatctataccccctataaagtgtgtgaaaaa

SEQ ID NO: 22898 - DNA, 669 bp, Triticum aestivum
  unsure (1)..(669): unsure at all n locations
  Clone ID: PAT_TA_22898
ttcgttcaaaggatgaactgattcaattcatcatacaccgcgtatgatacatctatgagcacgttcagtacaatcactcctatgtttttacagcacgagaaccggcaaaacaattttacaagcgagaaaaaatgaacaactcggtccctacgatcgagccacgccactacttgacatcagttgatcgggcgatcagcctcatttcttccacattccgctgatcctccggagcacgttgccgttcttcctgggctgccgccgcgtcgtccgtccgagctccgtccgtacaggcccgcgtacttgccgccgtccaagcgactcgccgcggtccaagatcttccccgttgccgcccttgcccacagtggagcaacgccatggcggtctccggcggccttccgccactgctcggcctgcacccgcagacgcctcagctcggcctccgtctccccttcttcgccgctccgccgcggctcggcgtccgattcgctatctcnaaggggggcccgtaccaatncgcctatatgatcgtatacgcgcgctcacgggcgtcgtttanaagtctgacgggaaaacctgcgtaccaactaacgcttnagaatcccttccacngngtatacaagngccgacgntgcctcanattccactaagnaangacccccgtangcata

SEQ ID NO: 22899 - DNA, 644 bp, Triticum aestivum
  unsure (1)..(644): unsure at all n locations
  Clone ID: PAT_TA_22899
aagagtagtgagagcgcaccaccacccgctctcgtgccccgccactgcaccccggcccagcccgccagaggaggatcgcctcgcgccgctgttccttctgccctgccctttcgctgcggggctccttccctaccgcgaggaccgacggacgatcccaaggtcggagaaagtgtagcctgcaaagcttctcaaatctgggtactgtttgtagaggagtgggccttcttcagtaaagctttgggacattancttgtactagtttggatggcatccatgggtactctcatgtgttttgtggganccctggatgccaagttcaccattggatgagccactgtgggagatgttacttgtgctacaccatttgtcccctcaattgcagaagaaattggggtatcaaaatcaagcgttcttccctagcttggtcaagtgttttgtgacgccaaaccggggcatcaattttgtcctggatgcagattcaacagttcctaacactacgcgtattccccatcgtcctcnggcaacantggtcaatcaaacnatgcattacaacggcgggancanccggctgctgacanncntgggataangaacnggagnttaaaatancttngcatntcacggtaccaaanatncgtnacagn

SEQ ID NO: 22900 - DNA, 987 bp, Triticum aestivum
  Clone ID: PAT_TA_22900
cttttagttgaatcggcaggagggaccgatggagaaagacacggcggcgacggcggcgagggtgtgccggcggtgcaaggcgaagtactcgccgtcgggaaacacgccgcagtcctgcaggttccacccctcctacttcgtctgccgccgccacgacgaccagaagaggtactacgagctcaaggagggcgacccgccctacgccgccaagttctacgactgctgcggcgccgaggaccccgccgccgcaggctgcgccaccggattccacctctcctacgacgaccccgagtgattagccaaccaactactagtacgcttgcttgttcatctcctctgaagcaaacgcagtgttctgttactttgtacaatcagcagagcaaacaccctgttagtcatctggattgtgtgtataaatcagggttcagaatataatccgaccctgtagtatcagtgttcagaataaaatcgtcagaatgaattctggctgcgagcaataattcagatgaggggcgtttgcattaaataataacaaatttgcttgtcaccagatatctgaaacctgggagaaaattctctagtgaaggaattgcgtgtgtgcgcagtatagtgtgccatgaatgaaaggctaaaatcctttccttttttgtttgacaaccttggcgcagactctagccgggccgtcagatatccgtgccccgtttgggtattcatgatgttctggattcacagctaagtttgggatgtggcaagagagtttgtctgaagaagtttgaaccatgtataatatttttgcagtgaaaagtctgaaccctatacattgtctctctagtgaagaaactgcatttgcgcccagtgtagtctatcgaatgaaagaatcgagccttgctttgtgtgtgcactggtcaattcagtcattgacaaacacactcctgcaacaggggccttggtgtggcccctggcattaattattaataacaaatcaac

SEQ ID NO: 22901 - DNA, 599 bp, Triticum aestivum
  unsure (1)..(599): unsure at all n locations
  Clone ID: PAT_TA_22901
tattttctttattgacatgcacatatgaatgtttgtcaactataccatctcaacagagatcttgtatctatgaacaagctctattaattgatgcacagggatcaagaatcttatgaactgttgctttttcgctgctctttaacatcaaccagaagtccaaaatcatgatgcggggatagaatctatgaactgtttcccaacgcggcacccaacagcaatcagaagtccaaaatcttgacgcagggcaagagagtctatgaactgcttccttcttctctgccaacccagtacgtttttacagcaatcagaagtttctcaggcacgagagggccatcttcgtgatcaagtagcttggacttccatcgcattcccgtcaccgtcctcctgaccttgttcagcaccccgactttcccccgctgtatgactcccccctctgggcgcggggccccagccccctctcccccaatgtctgcctggtcccccgcgctttggcgccctttanaagtctgacgggaaacctgggttaccaactaacncttganaaaccccttccaacgggtatacaaangccgacgntgcttcaaaattccactaaggaa

SEQ ID NO: 22902 - DNA, 1840 bp, Triticum aestivum
  unsure (1)..(1840): unsure at all n locations
  Clone ID: PAT_TA_22902
ggcgagagccgctgctcctactcctccgcctgctccgtcggctggtggtggtccctgccgcctgcctcgttcgatctcggtgacgcggaggccgagatttggaaccccgggggacggctcatggcttccatggcgctcgcggaggaaagggatgccttggattcatctaggatgccgatcggcacagggctatcggtggatgttgcaatggagcccaatgaggaggggatgggtgagcatcctggaggcgctgaagctgtatggccggtcctggcgtcagatacaagaacacattggcacaaagaccgctgtccaaatccgaagccatgcccagaagtttttctccaaggtggtgcgtgaacctggtgctaaaattgagatcgagatccctccccccaggccaaagaggaaaccactgcatccatatcctcgcaagcgcgcgaactcctgcaatggggcaaacgcagcaaatgggcaatccaagcttgctcatatgtcatcttcttctggttctgaccaagagaatggttctcccgtgtcggtgatatctgcgatgcagtcggatgcttttggatcatcgatgtcaaacccgtcatctcgcagtacctccccagagtcgtcagatgaggagaacagtgttcttccaatggtgaacggaggggaaggtcaacaaacagggatagatcaaccccacaaggaagctgatcaggaaaacaaagatacgggtacctctgaagaggattcttctgatgaggtacaggtaacaagcgtgaagctgttcgggaagacggtcgtcatcccagacccgaggaaaagatgctccccggatacaggctcagggcatgaaaatggagagcaaacctcacaatcctctaacaaaggaacatcacaagccccactggctgtagagattccaacacatacaaagggagagcaaatctcacaatcctcttacaaggcaacatcaccagccccattggctgtagaggttccgacgtatacaaatggagagcaaatctcagaattctcctacaaggcaacatcacaccccccgtccgctgtagagattcaagcatacgctgcgccgccaagtgcgtgggttcttccatacaattcattcccgctccatttcggggaatcagcggaagccagaattgcccgtttgcacatgtggtggccatactatgggtttcctatggtccatccaagtggaccgagtgcagtggcacacaacggaaaagctactgatgagagcgaagctgcgaagagccctccagttgaatcaagctcggacttcgttgacaatactcaggcaacagccagcaagcagtggaaagtgcttgagtcgcttggaacagcgcaggcccctccgtcggtttctaattttcagcttaaaccaagcacgaactcggccttcgtgagagtgaagccgatcatcagcagcggagatgagccggtgagggggttcgcgccgtacaaaagatgtagagtcgaatgacgaaagcggggatcttcttccccgtttctaatttaactatgaaccctaggaggagcctgttccacatattcctttgctccggtgtattcttaggttttacttgcacatagagattggcggcggtctggcccgggaaatgcgcgttgtttcctgcttgcgccttgtaatgagcagggcacaggtggttgctgtaagtgctgtaggataaaagcaggaggttttgtagggatgccaattctctgtctctcatgttgttgatgtaaaagcaaagaatttttgtgtcactcttgttgattcctcaaaaaaaaaaaaaaaaaaaaaannnnnnnnnnnnnnnnnnnn

SEQ ID NO: 22903 - DNA, 897 bp, Triticum aestivum
  Clone ID: PAT_TA_22903
gagggcagcttctgctccacccccggctatacggcgcgccttgtccgagcgtccgcctcgttgacctcctcgcctggagccgcatcgcttctgccgcgctgggcgcggcggctagcgctactgactcctgctggcccttcccccaccactggccaccccaaccccacctttcctcttctaagacgaaaccaagggccgccactgcgtcagtcgatgggagatcgtgccccgccggccgagattcggtaaggatctgcacgcccacctgaagacctagaccaaattgcagccatggagccgtcagctaaggtagatacgcagccgaagccgcggctcatcgttcgccttggcatattcctcgcttctcaccacatactcttcagcgccttgtgctgttccgcgggcattatcgcactcctcttcctcccatcacttgcaaagaacacatacctctcggagaacgctcttatacctggctctgcaaatccattgttctccagcgaggatgtcacggaagctaacaagtttatcaaaggaattgaagctgcagctggggaatcaagaggaggaatggaaatgtcaaaattcatagtgcaacaaatgaaagatctgggtgcagaagtgtgttaccacgaattcctccctcatagcaagcattttcatcctccggagttctttacttccaatgacaaacgatttggcagttcgacccaatggcacctattccaactctggggactaatacaatgggcattatacgagcccctgggggtgatggaaaagaagctatagtattggttactccttacaatcctcagaaagttcaggcaaatgaagtattatcactcgcacttggtttctctgtcttctccctcttagtcgagctgcatggctgtc

SEQ ID NO: 22904 - DNA, 1104 bp, Triticum aestivum
  Clone ID: PAT_TA_22904
gtcgctgctgcgcgtcgggtgccgtgctcccctcttctccgaactccgaattcgcagaggctccgccgctccggccggcgaggctcgccggcgtagccagccaaggatggccgccaacttctgggcgtcgtcgcactccaagcagcttctggacccggaggacgtggacctggtgccggcggcggaccgggagcgcggcatcacgacggaggagttccgcctcgtcaagatccacatgtcctcccatatatggcggttggcgcagcaggtgaaagttagacaaagagtcatagctactgccatcacttacttcaggcgtgtctatacaagaaagagcatgagtgagtatgaccctcgtttggtagccccggcttgtttatatttagcatcaaaggtagaggagagcacagtgcaagcaaggcttctcgtcttctacataaaaaagatgtgtggaggttctgatgataagtaccgatttgaaattaaggatattcttgaaatggaaatgaagctcctggaagcgcttgactattatttagttgtttaccatccttatcgtcctcttttacatttattgcaggatgctggcgtaacagacctgacacagtttgcctggggccttatctgagagacttacataaaagacttttttctcgtacatactccctatatgattgcattatattgtatatacatatcaagttttcttaaagctaatgatacaacttcatggttagaagaacttcatgttgacatgaacattgtgaagaatatttcaatggagatactggacttctacgaaacctacaaggttgacccccaaagggggctctccgacgaaaagatcagcccgataatgaacaagctgccagcaaaggcctaaagtagatgttgttctagttaatagtaaattcttaggcctactattgcaagtgaccagcggatcaattgtgatgcatcttttcagaatgaagaaacccatgatagggaatagcttggatgcgcttgtagtagtctgtgatacttgacatttataactgctgtatttacaaaacaaaattacttcaaaaaaaaaaaaaaaaaaataccccacaaaattacttc

SEQ ID NO: 22905 - DNA, 522 bp, Triticum aestivum
  unsure (1)..(522): unsure at all n locations
  Clone ID: PAT_TA_22905
agggctccggtctcctcctctcctcatgcttccggacgctgctcccggggacagccccgcggccggatcaccgccggcggcggcggccgtcgcgaaggtgagggtgaaggtgctgttcttcgcccgcgcgcgggatctgacgggcgtcgcggagtcctccgtggaggtgccctccgggagcaccgcgggggagtgcctcggccgggtgctggcctcgttccccaagctggacgagatccgccgctccatggtgctcgcgctcaacgaggagtacgcgcccgagtccgcccccgtcgccgacggagacgagctcgccatcatcccgccgatcagcagcggctgaccgggactgcaaaatgaagaaaatgaaagagagaaagaaagaaaggtcttcctcttttcttcgatacttgtctttgcttcctgatcaatgtgcacgttgaataaataataagttgtgatgttcgctggcatttgtgttcatcaatcatgttgatgaataaatgtttngatcctgagaag

SEQ ID NO: 22906 - DNA, 992 bp, Triticum aestivum
  unsure (1)..(992): unsure at all n locations
  Clone ID: PAT_TA_22906
gcacgaggtgaagatactcaacacggtgaggcaccgcaacatcgtcaggatggcggggtactgcattcgacgcaatgtcggcatgatactctacgagtacatgccggaggggacgcttttcgagttgctgcatgagaggacgccccaggtggctctggactggacggcccggcatctcatcgccctcggcgccgccgaaggcctctcctaccttcaccatgactgtctgcccatgattgtccacagggatgtcaagtcgagcaacattttgatggatgccgagttggtgcccaagattacggactttgggatggggaaaatcgtcggcgatgaggatgcggatgcgacggtgtcggtcgtcgttggcaccctcggctacattgctccagagcaaggctactcgacaaggctgaccgagaagagcgacgtgtacagctacggggtggtgcttctggagctcctgaccaggaagatgcccgttgatcccgcgttcggggacggcgtcgacattgtgacctggatgaggtccaacctgacgtcgacgcaggcggaccatgggagcgtcatgagctgcctggaggaggagatcacgtactggcctgagcatgagcaggccaaggcgctggacctgttggacctggccgtctcgtgcacgcagacggcttgccagtcgaggccgtcgatgagggaggtggtgaacatcttgatgaggattgacgagagtatcatcanttcaagagcttcacaagtgagacagtgaacgttgcaacattgcaaacagacgtaaccgcaataccccantggagtgtgggacatccgtacaaaagttgggcgccctccgcnacggacggcaagtggtttgttcgtacccgttcaacagaangcctgancgggtccatcatattatacttgggggtattcanacgggttgactatatagtattcanttgccgangacgncaattgcactgaaaaaaaannnacccggcggg

SEQ ID NO: 22907 - DNA, 564 bp, Triticum aestivum
  unsure (1)..(564): unsure at all n locations
  Clone ID: PAT_TA_22907
gcactgccgcgccccgtcgccggtgcctcacggtgagggccagcgtctttgcccgacaaagcaggctaccatccctccattgacaatgcgcatgtccagccgttgctgcatctctttctgcccgtggatgctcgtgtgctataattgctttctccccttcctgtacatgctgctactcacctttttatctctctgatgcgttgtgttgcactactgcagctcgatctaggaggtgctggctcatgctggctggaactaggatgcaacagggttgatggatccatgccgcacgagcacctgtgctctgctttcttcttactttgtgttctaatttgctttcttcttattttaagtttgcgagatgcaaaaagaattaaaaaaatgttgtgcctggagttaatattattgctacccatgatgtacgtcatagtttctcctccaaatgtgttggtcatgtgttgatttcggtttttgtttggtcacaaaaagtatgaagctaaatgtgataacaatacccagattctaatgcacaagtacgtatcctcccgtttacatggcanaaat

SEQ ID NO: 22908 - DNA, 474 bp, Triticum aestivum
  Clone ID: PAT_TA_22908
catgaactgcgtggagagtgcagccatcgacaggccgagcatgaccgaggttgtgtcaaggctaaaagtgttgttgccaacgactccaagccggaaacagtatgcttccccgtcctccacgaagtccatgaatgatgaaatgcgaaagcagttccagctgttgatttctggagagggcaacgacgagagctccagctccttccagtctggctataccagtcggatgacacaactgccccccttatctggacggtgaaaggaaaatgcccaccgagttattgttgcgtctgcttagacaaagtttggtagtttgctcaacttgtcatgattgggttgtagataaacagaaatccagtcattttgtttccattttccgatcttgcttgttgtttggatgaggggtggtatttttgttctgcgaacttcggtctggttgttcaagtgttttcaaccaaaaaaaaaaaaaaaaaaaaa

SEQ ID NO: 22909 - DNA, 569 bp, Triticum aestivum
  Clone ID: PAT_TA_22909
cccacgcgtccgcggcgtcccttcaggcttcaacaacccttcggtagggttccggcgactccggatggccggtcgccaccgtaacccgctgccttcttccttctcccgcggcgccggtgccggaaaccacccgcaccctcctccgccccatcaccctcatctcccgccttaccacctcgacgaattccgcgagccgccgcgcctccccccgcaccacctcgatgacttccgagacccggctcgcctgccaccaggccaccccgacagcctccgcgagcatcctccgccgccgcgccaccacttggcgggccacggcggagggaccctgcccccagcatcgcacatggccgcggcgctggaggagcgtatcggcgcggagattgaggaggcgcacgcgctgctcggacagaaccagcgactctctgcgacgcacgtggcgctcttgcaggaggtctccgccgtgcggcacgagcttggccacaccgctcgagccatcggcgccgcccagcaagagggagatctccgtattcgcgaggtctatgagaggttaatgaaaatggaagcagagc

SEQ ID NO: 22910 - DNA, 1414 bp, Triticum aestivum
  Clone ID: PAT_TA_22910
gcgaagatttgataccccctgcccgactcctccccgacgtatgggatcaatagctcgtgctccgccgcggtggccgccgctctcggtccgtcggcgcccccccaaggcttcaacaagcctccggtagggctccggcgacccttcggggcgggtccggcgactccgcatggccggtcgccaccgtaacccgctgccttcttccttctcccgcggcgccggtgccggaaaccacccgcaccctcctccgccccatcaccctcatctcccgccttaccacctcgacgaattccgcgagccgccgcgcctccccccgcaccacctcgatgacttccgagacccggctcgcctgccacctggccaccccgacagcctccgcgagcatcctcctccgccgcgccaccacttcgcgggccacggcggaggggccctgccccccgcatcgcacatggccgcggcgctggaggaacgtatcggcgcggagatcgaggaggcgcacgcgctgctcggacagaaccagcgactctctgcgacgcacgtggcgctcgtgcaggaggtctccgccgtgccgcacgagcttggccacaccgctcgagccatcggcgctgcccagcaagagggagatctccgtattcgtgaggtctatgagaggttaatgaaaatggaagcggagctccgagcagtagaggagatgagagcggaacttgcacatgttcgtatggacattcaacaggctgggtgcagcaagacacacaagatttggctcgttcagcagtagagttgcagcaggtggctgcagtgaaagctgagacccaagaactcaggcatgaaacacagcatttaagatccagtattgagcttgagaagaaaggatatgcagagagttatgagcagggacaagagatgcagaagaaattggtctcagttgcttctgaagtggagaaacttcgtgctgaggttgctaatgctgagaagagatcacgagctgctgtatctgcaggcaatcaaggttacgctggaagctatggaaatcctaatgccaattatgctgcaaatccttacaatgctggatacagcatgactcaagcaaatgctactgattctggttctcagtatggggctggggcagcgcatagttcctggggcgcctacgacatgcaaagagctccaggacggagatgaataccgacatcctcctcccttttcttttattattaaatctggtcctgttagcgaagtaacaaacggagatttctggcacaacctgatttctgtgcaatgttaatttatgacgagtcagatatgccttgtgtatttgttgaccttaatctgagtgagttacacgctcaagtgtagtgcacgttacagtaatctaggttaccgcccattcggcacgagaaaaaaaaaaaaaaaaaaa

SEQ ID NO: 22911 - DNA, 626 bp, Triticum aestivum
  unsure (1)..(626): unsure at all n locations
  Clone ID: PAT_TA_22911
ctcgtgccgaattcggcacgaggcggcgctgtcgttcccggggagggggagctccttcgccggtcgctcacccccgtcccgcgcttgcctcacctcctccaatcccaagctccggactcccgctcctagcctgagggtttcatatcgtcgtaggcgactctatgtctgtgcgtgctccggcgacgttgatccggacgcctcggcggcatcaccggcggaagctagttttgatataaagctgcctagaagaagcttgcttgttcagtttacatgtaataaatgtgacgcaaggacaaaacgtttggataaacagggtgggctatgaaagaaggaacaagttttccttcaatgccgcaagggtgccaaggtgtttcacaangtttngttggacaaatccttgggcctaatttgtccgagtnatgacctaacgnagaaagaaaatggggggtgcacctgcttcgggctgacggattttngatgtgtttatttagaancaaacatgctaatttcccttttaaatcattaggttggatccttgacaaatngataattnaacctggttnacggctaaatgaacatatttcngcatttnaataactacaatacccattcatnnaggaaaaaaa

SEQ ID NO: 22912 - DNA, 689 bp, Triticum aestivum
  unsure (1)..(689): unsure at all n locations
  Clone ID: PAT_TA_22912
ncgccaagcntatcacaaccctcctcctttacccgggcttgggaccggctatgtgggacaacataggcggagttccattnatcctttatacaattattatttttaccattatctctatgaatgcatgaattcaccggtgacttcttttaatcctttgtaggatgacatacaagaggacctttgtaggaatgacatacaagaggacccgggagcgtgggtgaatatggcagtttgtgtcagctagacattttgtgtaatggagtaaaaataatgtgtcttttaggtataattttgtaaacctatatggtgtcttgtcaactgggtattttgtgtaatggagcaaacgatgaatcacctggacatgcatatatcattttgtaaacctatcaggtgcctcagtgacagaaacataaatgtttcctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaananananggggggggccgttttaagggagcaaagtttaaaaccccgggcatccaaggaaaaagtttttttatggggcacccaaaataaaataacatgggccggggtttaaaaaggggggggcgggaaaac

SEQ ID NO: 22913 - DNA, 1402 bp, Triticum aestivum
  Clone ID: PAT_TA_22913
aggacttacacgaagtgagtcaagtaccgcaccgccaccactagctagctagcaatggccacacccaccgatgaacccaccatcaccatggagacctgcggcgacgtctccgacgaccccaccatggagaccatcggtgtcctctccgatgttcccattgtgagcaaaagcctccccacaggcgccgtctccgccaatttcaaggtcactcgtggcttgtgatggaatcgcggagaacgccaagggggacgtcgaaagggagcgtctgcgccagatcatgacgggctgggaggcgaatcagtcggatgtgttaaagcccaatgctgtaactggactaggtaaaacggctgtgaacaactgggggatctatgacgggcctggctccaaggccaaactggttggccaaaacgcatggcatgcacacatgtgccggcaaatcgagcaatcggttcaccctggttgtttgtggtcgaaaggttcgaagcgtccactcttcaggttatgggagctaatgatgaggatgaggcagataatgagtgggccattgtaggtgggaccggtgaattcacaatggctcgcggtatcatccagagaagagtatatagtgtaacagacagtacaataacacatacactaactcttgcgctcatcattcaaatctactaccacgtcactgaggtcgtcccttcacctacaaagagaggaacagttggtggaaatagaggcaccctgcctcgggaaatggaaggcaaatcccaacgtcttgaaaatgtgacaatctaccatgtaggtgcagttgaagggtttcaattttcctacgttgacgaagacgggaaaatccgcaccactgatacttggggtcgagtacatcctgatcctttgcgcaagaccgaaataaagtttggcccatcagagtttgtgaaaaagatcaatggggctcagagaggaggcgagggctggctgtcaaaatttgagatcgtcaccacccacaaaacgtatggtccttttggagctgacaacggcactccaaatttcagttataccgtgccggaggacgagacggtggtgggcttcttcgcaaacactgataacattttcgtcacttcgattggtgtttataccatctaaatcattcaatattcgaccctgctgcagcctgcagttacctacatgttccttttaatcatgagagtgtttgatttcttcccgtcccgtttccgctgttccagcaataagatggcttgctaacaagggtgggtcccccttgtctatgcctattgcattgtgatctttcgtaatcaaatcggtcgtgtaacatctttctttttctctttcctttgctatgttcaatgatgttttcagagattgttttcttcggaataaaacagatcgtattgatggc

SEQ ID NO: 22914 - DNA, 741 bp, Triticum aestivum
  unsure (1)..(741): unsure at all n locations
  Clone ID: PAT_TA_22914
gcgcgtggttcccccggcaaccataaacgcgacgccccgaatctacgagagtgcgtgactgccttgttcccctcgccgcgtgcgtcacgagattctacccagctactgctacccgccgcccccctctcgccctatccacgtcaccccaccctccagcgagccgcgaccgcctccgctgggggccggagcctgtcctgtctgctgcaggcgcggtctccgcggcgtgccgcacgcgctgctccccgccaaacttgccccggtccgcgcgcagcacagatactgcaccgctctgaacccgagggcctcggcgtacaggaggtgcaactggtgcgagatggagccggcggaagcggacgcccaagcgcacaatcaagctccagagggagctagcaaaaacccagagaaacggaaaaggtcaccatgtagggagcaagaaaccggcgacgcggaggcatggcggcagcaccggagacgatgcgccactgatacgggggagaggagatagcacgcggccggatgcgccactgctaagaagtccaagagagaggctgcggagccttggtacccgtctcaaagcacccaaggtacacgaagaagccaccgctgcccccgtcgccngggcacggcaacnaaaggggaacagcggcgacaagaacccaaagtccaaccnanacgcaacgctgcctcccgtcccccgcncacggcancgaaaagggaacancggtgacaagaacccaagtc

SEQ ID NO: 22915 - DNA, 760 bp, Triticum aestivum
  unsure (1)..(760): unsure at all n locations
  Clone ID: PAT_TA_22915
tgtcaacattgggaagcgctaggcaacgcaacttagttccactattaggttactgcattgctaagaaagagaggctcttggtgtacaagtacatgcccaagggttcactctatgatcaactgcaccatggaggcagtgatagagaggctctggcatggccgttgaggctaaaaattgccattggggctggtaaagggttggcgtggcttcatcacagttgcaacccccgcattcttcaccgcaatattagctccaagtgcatactacttgatgatgactatgagcctaagatttcagattttggcctggcaaggcttatgaatccaatcgacacccacctgagcacattcgtcaatggcgagttcggcgacttgggttatgtagcttctgagtacacgcacacccttgtcgccacgccaaaaggggatgtctatagttttggtgtagtcttgcttgaactggtcaccggtgaagtgcccacgcgtgtatcaaaggccccagaaaatttcaaagggagtttggtagattggataacatacctatcaaacaactctatacttcaagatgcagtggacaagtccatgatcggaaaggacaatgacccgagctgctcaattctgaaggcgcctgtcctgcgtgcttcgctcaaaggaaagactacaagttgaagtgtacagctcgaggctgttgggagaatacatttangccctatataacgggctcgacaaggtgaaacctaanaacggatactatgtgcaaa

SEQ ID NO: 22916 - DNA, 798 bp, Triticum aestivum
  Clone ID: PAT_TA_22916
gaacgtttgccgcgggcgcacttgaaggaagcgacgcgcacgcttgggggaaaaccaggctatgaggactggagtgaacaacttcatatcttagaaacggctgagttcccagaagtagttattgatgccagattgagacatgcacaggaaattctagaagaactgctaaagccagtggatgagacacaggatatctacaagaggcaacagctcagggagctggcgatgctaaactcaaccctgagagaggacagccctcatccggggagcgtctccccattcagcaatggtggcatgaagcgtgcgaaaacaggccagtagggaaggagccacccctcatcgttaccggtattgtccaggtgccttatgtgccccccaatggggacgccatgtctccgggcaacgtttgccgcgggcgcacttgaaggaagcgacgccctgcatttcgctagacgagtcagtatgagtctgcggtctctcctgcggacaaggagaagccgctgggacagtggaagtagtagagtcctgggtcggtgggtcggcccagctttggttgctgtaaggtcctagaacattcgctttatttgttaattgactgttaaccctagtaatgtggtgctatgatggtaggtgatctccatgacagacagactagagaggcccgagtatgtgagctttcatgttttccttttcaccccctgttaggggtcggaacttcgtagtatattatcctcccctgcgcgttaggtagtactggttatgtgtaacattgggtaaggtggtttttacttgcagttc

SEQ ID NO: 22917 - DNA, 633 bp, Triticum aestivum
  Clone ID: PAT_TA_22917
acttgaggctacagttcttacgtcaaatattctgggacgtcaatgaaaaattgaaagttcttgcgacgttaacctttccagatctggcagcatttgttccgtttggacacatgcagttgcacatcgagggcctatgtcatggcaacctgtcaggagacgaagcgataaatatatcaaaaatattccagaatactttgtcaggccagacactgtcagtggaggcaagacacggtgaaagagttctatgcattcctcatggtgcaaattttattagaagtgtacgtgtgaagaatgatcttgaagagaattctgtggttgaggtttattttccaagtcgagcaagacattggaaaggattcaacaaggctcagagctattacagatcttttcagcaatatcattgaagaaccttgctttgatcagctgagaacgaaggacagcttggttatactgtggactccatcaaggatgactaccgcctgctgctgtatttgagtcagtccccaataacccgttactgcaacatgttgaacttaagatggcctgctcttccgatggatagagaattttcaccaaagggcgggcttgagtaaagtctccttgacacgggtaggccaatcgcaaggaattgtt

SEQ ID NO: 22918 - DNA, 515 bp, Triticum aestivum
  unsure (1)..(515): unsure at all n locations
  Clone ID: PAT_TA_22918
gctgtgagcaacgtcgatcgttttttcattttcctgtcttcagttcagaagtaaatattcactctgctgagatgcatagtcacatgaatgttgacttatgtaaggtattttaagagtttgttctgtatattttctatgtaatgccaggccttgtgagtttgattgcaaagttgagcttgggaatgctgtggcatgcggcatcacgagctgttcaccgtgcctccctggagaataatgcttccatattggtttccatgtttgatcctaatgccccgttgtttgcatgnttaagaagattatcctccttctattggttcccggggcttaaagaantcaattggtattatgtttccattccatagcctaatacgacaactcccggttagtttagaaggtgaaacatatgattcttcccgacaaacacatccttaagcatgatgggtcaccgtttcccaaccaaacgctggtaaacgacgcttggtaataaaacaaatggcccggtgaacctggttggc

SEQ ID NO: 22919 - DNA, 383 bp, Triticum aestivum
  Clone ID: PAT_TA_22919
gggacgacatcagccctcacgtcgattgaggttgcttaggaataggctctgcaggagaaagaactttggtcttcagtttcaaagattgtgcacttgcctgcgatacctcacgcaaaaccatcaggctttcttgtctcttagttttcaggacctaacaatttgtggatcatcattgttaataagcttatgggctgggggccgcgaaacagacatccgagagatgaaaactggttgacattgtcggtgtgtatattatttgcattgtatgtataagtggatctcatcaccaagtagtggtgatgaaatggcgcctgtgtggctgtgtactcgaaagtcgaaatgcagttccagatttcatttgaaatgtctgccttcgtgtgtgc

SEQ ID NO: 22920 - DNA, 577 bp, Triticum aestivum
  unsure (1)..(577): unsure at all n locations
  Clone ID: PAT_TA_22920
gctcgtgccttcaccgtcccgcctaccttccccgtccccgcgcccacccactccctcactctctccgccccgccgccgcccgcccgtgccttcaccgtcccactcacgccaccaccgacgccatgtacctcaccccgtcccagcaacgagagattaaaagggagaggagcaacatcaacagtgcttggtgccaattgaggctcgatcgaggaaggttcaatttcaccgaggagatgagcgcactggaccagtcaatggtggagacctgtaagcagcatcaggccgggcttccgaaggtttggtcgaagcttgagagggttcacgagagggcgcaggggcttgacgcgagggcgcgtgggcttgatgtgacagaggaggagctgaagcagcgagagactcgtgtggaaactccgtgtggaactcgccaagccgggaaagggagctggagaagtggacagatgagcttagggcttgggggctcacttangagagaagagntttggtggctgggaaaagnatatcaggacagacaactaagatgacttgcaancagnaatgtcacgagcgantcaggact

SEQ ID NO: 22921 - DNA, 771 bp, Triticum aestivum
  unsure (1)..(771): unsure at all n locations
  Clone ID: PAT_TA_22921
gggtctgtctcggccccaagatccaatttggttggatttctgctcccgagccggagcccggccggaggcgcacgaccttcnagagttgatgccacccggcgatggatcgccgagccttcaggagtaactcgtgcaacagcaagaacccggcgcctccctcctcgccctcggcggcggcgtcggcggcggtgtaccggacgtcctcngcgccggtggggggctcgcaagacaacgtcngcgagcgcaaggcgctgctgccccggcgccccgagggcggcacggcccgcaaggcctacaaggggcccaagcggcgggtgcagtggaaggacacccacgggaagaagctcgccgaggtcttggaattccagcctagtgattcaagtgactcggatgatgattatttggatacttgcatatgctcagtcatgtaaatatcgcaagggctgaatctccggtgcatcttgcgcaggtggagagtatgagtgtttaacaaagagctgtatcttaatgttatgcattgggctaacatcttgtatagaaaaaaggtcactccaacangtcnaaactactcatgtantgcaancaaaggctggcnacctaacaaaggactggngaacgaacnaacccatataatctgtttaattgcncaagcantggaanttgccttcanatttttnngatatcnccacanatnaaactanaaatggaaaaaattacccccgggnttngaacaaaaacttgcncttaangtttgntaagcaaaagcctttn

SEQ ID NO: 22922 - DNA, 2123 bp, Triticum aestivum
  Clone ID: PAT_TA_22922
gcatcatcctcgcaatctccgcccccctcccgcgagagccaaagcccccgcaaaatttactcactactctccgcaagcgcgcatctccaccgccgacgccgctatgcccgccgcgcactccctcctccacctcgcggcgcccaagtccgtcgcccccacgtccaccctctcgctggccggcgccgcccacctccgcctgctgccctcccgccggcctcagcgcctggtcgcgtcctgtagctcagcccaccctgacctcgccgccttccccaacccaaacggcctcctggtggccgagcccgctgcggcagcgcccatcgacattgacgtggccacggaggccgagctgcgggagaacgggtcccggagtacgcgccgcaccaagctcgtctgcaccgtgggccccgccacctgcggcccctcggagctggaggcgctggccgtgggggggatgaacgtcgcgcgtctcaacatgtgccatggggaccgcgagtggcaccagaaggtcatcagctccgtgcggatgctcaacgaggagaaggggtatgccgttgccgtcatgatggacaccgaggggagcgagatccacatgggggacctcggcggcgcgccagcggccaaggcagaggatggagaaatctggacattcagtgttagatcttttgaggcacctctcccagaactaactgttcatgtgaactacgaaggcttcgctgaagatgtgagagttggtgatgatcttcttgtggatggtggaatggctcggtttgaggtcgttgagaaactaggaccggatgtgaagtgccgttgcacagatcctggtttgctgttgccacgtgccaatcttacattttggcgggatggcagtgttgtccgcgcgaagaatgccatgcttccgacaattacatctaaggattggcttgacatagactttggaattgctgaaggtgtagattttattgcagtttcatttgttaagtcagctgaggttattaaccatctaaagagctacatagcagcaaggagtcgtggcaatgatatagcggtcattgcaaagatcgagagcattgactctttgacaaacttggaggagatcatccgtgcatcagatggtgccatggtagccagaggggacttaggggcacaaattcccttggagcaggtcccttcaatacaacaaaagatagttaaactgtgcaggcagctaaacaagccagtcgttgttgcttcccagcttctcgaatcgatgatcgagtatcctatacccaccagggccgaagttgctgatgtttctgaagcagtccaccaacgtgcggatgctctgatgctttctggcgagtcagcaatgggtagatatccagataaggcactcattgtcctcagtagtgttagcttaaggattgaaagatggtggagggaggagaagcaccatgagccactagaacttgaggacgtttcgtcttctttctctgacaaaatatcagaagagatctgcatttctgctgctaaaatggctaacaagttggaagtggatgccgttttcgtctacacgaagggtggccatatggcctccctgctttcacggtgccgccctgactgcccaatcttcgccttcacgaactcgacgtccgtgaggagacgactgaacctccaatggggcctcatccccttccgcctcactttctccgatgacatggagagcaacctgaaccgtactttctccctgctcaaggcgagaggcatgatcaagtccggtgacctggtgatcgccctctccgacatgctgcagtccatccaggtgatgaacgtaccataagaggcatgaatccctagctgtgctgttctggccaaaacgagacactgctgtagcgtttgcaatttattcgtgtgttcttgtatttagacggacctgagaactcaaccgcgacaataataatgtgctgcagttcctagcctgatgaactcatgtactacgtattatctaggattagtatgggaatcgcttgatctaagcttttggaatattggtttgggttgcttgtaccaagtggtacatgttaaagagaaaatggtacatgttaagtgatattttccctccggtacaccccgtgatgtgggccccc

SEQ ID NO: 22923 - DNA, 920 bp, Triticum aestivum
  unsure (1)..(920): unsure at all n locations
  Clone ID: PAT_TA_22923
acaaggacgacgagagcctgaggaggtggaaggagcagctgctcggcagcgtggatttgaactccgtgggagagacgctggagccggacgtgaagattatgagcctgtccatccagtcccccgggcggccggacatcttcctgccgctgccggtggagcccancagcggcaagggggtgtggttcaccctcaaggaaggctccccgtacaagctcaagttcaccttctccgtcagcaacaacatcgtctccggcctccgctacaccaacaccgtctggaagaccggcatcaaagttgacagcacaaaggagatgctgggcacgttcagcccgcagccggagccgtacgcgtacgtgacgccggagggagaccacgccgtccgggatgttcgcccgggggatcctactctgccaagaccaagttcctggacgacgaccggaagtgctacctgcagatcaattacaccttcgacatacgccgggagtggccgtcgtcaggctgagtccgacctgtgtggccgccgtgtagaagtgatacgtgcctgcctgcctgcctgcctgggttactactgttgccgttgaagcagatcggtctttgtttcgcttgcgttttactacctgtttttcgtggttgcccttagggctcttgtttcctgtggtgcgtccgtgcgtgcgtgtaaattggttcggtttatgtgtaatgccagtgcgtccccgtgcctgtgtgtgtgtgtgagcgctttgccagggccggttttttgaagaacgagctgtaaggttgagttcaatgtaatgcaccggggcaatgcagctgcacgcacttccgggtaatgctccgagaaagaaaggttatttgccaccaaaaaaaaaaaaccaagggggggcccggtaccaattncccnaaaggnacctnttacccnc

SEQ ID NO: 22924 - DNA, 507 bp, Triticum aestivum
  unsure (1)..(507): unsure at all n locations
  Clone ID: PAT_TA_22924
aacatagcgtggtcgcggccgaggtccgtggtaaagcgactgcgcagactggacggacctcaaagcgccctcagatgccttcctcagtgccgactgagaaggccccgacgcaatcaaaagctacgccgtcaaaaccgcagaaggccttgcccaagatcaaagtggtcattcccattgcttccggtgctgctacctctgggacttcagcttacatgaatgaagacgaggaaatggaagatgcggtcacctctaactcggctcctcccaatgtcattgaccttccagacgacgacgaggatgtgccgctgacgcctatgggaagaagaaacaggaagacgtcaactggcaaagcgcctcagtcgagccggtgacggaaccggtaatccaggaggccggcgatgccaatcggacttctgtgactttggatgtacctgcccgggggccgcgcgagcaacggggcaaaccnancgttaacttnaatctttacngaataantccaaaaggcaa

SEQ ID NO: 22925 - DNA, 748 bp, Triticum aestivum
  Clone ID: PAT_TA_22925
cggccatccccatccccattgtctctccccctcccccatcaataatatccgccccgcatccccaaccttccttcgcttctaccatctatctccctccgattcgtcgccttggccatcttcttcgcgttgggtttcaaggtcggcatgtcctcttcgcctaccgatgccatccagtgctaccttcgattctgattgagtgatcgttcaacaatgatgaagtcccatggcgttgtagtcttagatcatgactgccccatcaacgcatcatgaaatcctcaccaaaggtaatttccaggtcatgttcattcaacactactgggaaccgctgaaagttgtacaatgatgaagaccataagtgttaccaataaacaatgagtatttgaaagaagtgcttctagcatggcgggaagtcatgtaagtgtaaaggctacaaccttgattctcacaaaaagggtgccacattgagtttgcaattgcgccattgcgggcaatggagccagcttttgggtccttcccttacatagaaaaggcatgcctttgggttccttcttattttcctgaccgtcaagtttttttaataatttccagcaataaaaagattgtgctttcacacacctcttttatgtttgcgtgtttggaataattttgatcttatgttttattatgttctgtccaatgttggcatgtcctccaaagcgaaaccatcttatttgcaaaccttgaaggcatgtattgttgaatgaaatgt

SEQ ID NO: 22926 - DNA, 702 bp, Triticum aestivum
  Clone ID: PAT_TA_22926
gtcgaccagcgtcacgggaccgtgggttctcccccagctccctcgctcgctcgtcggtgtagcgtgcacatcacccagctcctcccaccgtagctggccgccttatgagctagcagctctcgccagctcggcgcagcggccgaccgggggcgacggggatagatagggatagcggaagagcaagggtcggtccgggagaggggtagaggttgaccggtcgtcgatcggttcagttgagtgggagtcatggagaccatccggtgctgcatcgcgtgcatcctgccgtgcggcgccctggacgtggtgcgcatcgtgcactccaacggccgggtggaggagatcagcgagcccgtcctcgccggcgagatcatgaaggcctaccccaagcacgtcctccggaagccgccctccacctgcccctccgacggcggcggcggcatcgtcgtgcagaagcccgtcatcctgccgcccaatgccgagctgcagaagggcaagatctacttcctcatgccggtcatggccccggcaccggacaaggccgccgccaagcccaaggcgcccgcgccccccccatccgccgccccgccggcggcgagcgggcggcggggggggtccgggtcccgcgggccgccgcccgcaccgacgctccagcggcgtccctgcagagcgcggagggcgagaaggagcggctgctggcgaacg

SEQ ID NO: 22927 - DNA, 593 bp, Triticum aestivum
  unsure (1)..(593): unsure at all n locations
  Clone ID: PAT_TA_22927
ggcgtcgcgtacccgcgcgcccacgccgtcgctgtccccgtcacagcgccgtctcagcagccccaggtgccaacgcagcagcggtcctacgctgcggtgccgcgggcggtggtggcgggcgtgacgccgcgtccagagcaccctccccgaggggttccaatagccccgcatcctcagctcaaggttaatgctgttccagctgttactccatctccggctgttactccatctctggctgttactccatctccagctgttactccatctctagttgttactccatctccagctgttaccccgtctccagcttttactccatttcctcaggagcatgtcaccacaaaggaaagagaaagtaccaaagaaaacgcttcaactgtggtgatcaatgaccgcaaagttaacgtgtttagacagtgagtcaggatccttgtatgctctttgtcgatcttggctacccaatggtgttccacatgaaattcaaccaagctttgttggtaacgttgcaccacttctccgggaactcgctgcccacttgttgctccccgatgtcccttttgcctggcttcannttgtanaattcctanggannt

SEQ ID NO: 22928 - DNA, 937 bp, Triticum aestivum
  Clone ID: PAT_TA_22928
tgtcaaacttctgggctgttatggaggatcctacaggtggacggctgggcgacgtgctgattctcggtggaagggagcgaggaggcagagagttcggcccgagggagcaattgtgcaatctctttctccaggtaagtgataccctgacaacagtttgatactattgttgtatttgattcctttcgcttcagttacaggctataactatcctgcaagatggtgggacgaatcagaagtccaccaaccgcttgcacgtgtcatgcgtgtttgtcggaacagatttgcagctacccctatcctctccatatcagagaaagatggatggtcgtatgtacaccaatctggatcaacagagcttactacgttgcattaaccatacctttgtggtcgtcaactgaaatggattatttttttcaagtattatttcatggattactgtttgctattccattacttggtggttaacgactattgttaaggaagctcatcgcttgcatcaaatcgaattgcgtgaaaaggaacatttgaagttcttgcgccttcttcttaaggattttatgattaaatatggcattgacactgagaattggattctgatccaatttgcaacagctctgaagattattgttttatgcccctggagcatcagccagatgaaggccatcgaagatcacaagggcagcttgctattgtacaggaattcaacacataagggcagcttgttacatttacagaaactcatgatgttggcaatggtaagggggcgaaatcatgaaggcacggttgggttgcaaggtgctcaaactctcatattgcgatttgcctacaactttgtttgtaggtttgtttggttgggtgtttgtagtttgtttctgtgacctgtactaaagcaaatagcagctatttgcagtccgacatacatgtgcatatacaaaac

SEQ ID NO: 22929 - DNA, 514 bp, Triticum aestivum
  Clone ID: PAT_TA_22929
cttcagcttcttctgcctggttgtccgggaagtccggcaaagcgcctcggtgcctgcccctctgccccgcagccctgctgcgcgcctcctggcatctcgcgttggcccgcccgccatcccgacaaggccccctccccacccggcctctcgcgccgtcatcgcatgctttcgagtctgtgcaagcctctgacgcggcagctgacctgtcatctcgcgctggccctcgccccactgttcctgctggccctgcagccgcttctttctggtagcactttgcgtgcgctcgtgtcccagcacggtcttgccgtcccggggatcgtggctgagcttcatcctgacagagctccccgctcactggtgcccaccttggtgcacgcatctcccagcacggacttccggacgccgggtccagggttccccctgacgcagccttggctgctccctcggctcgctcttcgggggacggcagcataaattcacgtacttcggagggctcatgtcagggaagtcccgc

SEQ ID NO: 22930 - DNA, 533 bp, Triticum aestivum
  unsure (1)..(533): unsure at all n locations
  Clone ID: PAT_TA_22930
ttttttttttttnttgttgaaatggtgctgggagccgacagagttggacgacgccggcgatgctacaaccgtcaacagtgggagctacaagcagcgatggcgagatggaaagctgtgaccatggagttgatttgctgggacggggggacgactgtggtggcggagttgcaacggtggttggtggtggagatgggaccgtgccccctgcttcatccacagggccgtcgggagctgcaatggcaacctcggccacgacggcgacctcacgcacgaagacggcgacttggtgcagcgcgcctgcacgagcaaaccgacggcgacctcgcgcgcgacgacggcgacttggtgcagcgcgcctgcacgagcaaaccgacggcaagcgcgggtcacggggcggccgacgagcgtatgttgtgcggccgtgcgggagaccggcgagtgcggatgaggtcgagcggttgcgctgggctctatcctcttcttcttttttcttttttatttagatgaacaaatgatcgtacggtctaaaaaaa

SEQ ID NO: 22931 - DNA, 1036 bp, Triticum aestivum
  unsure (1)..(1036): unsure at all n locations
  Clone ID: PAT_TA_22931
cccgagctaagctcgacctccccctcacgacgattcctagcacgcaccggaaatctcctccggcccgcagcgcatctggggcattcagcggaaagagcgctcctggactggggaggcgaggtcgcggataagcaccaatttgggcgtcggcgcttcaggatatattgagatggctggaaaaggacgctatgttccgccgcagtatgttccgttatatggtctagacactgaggaggatagtgttcctgaggtggaggagaacattgccacgcgccaaagattaagccgggatcctacacaatggtcttcaggcatttgtgcttgttttgatgatccacagagctgttgtattgggtgcgacttgcccctgctttctctttggaaaaaatgcacagttcttgggatctggaactctcgctggatcatgcactacgcattgcatgctttggggccttctgacaagtttctgctgtctgtgtactggggggcttgtattagcagttccagggtctgctgttgcttgttatgcttgtggataccgccaagcactaagaacaaagtacaaccttccggaagcaccatgcggcgatttgacgacacacttattctgccatctgtgtgcgatatgccaagagtacagggagatccgcgagagaacagacagtggcacctcttcagctcctgatgttaccccacctccggtgcagacaatggatgaactttgattgagtacagtagatgacgcaaacatatcctgactcgcaaatctttggttggcttggcatgcccttgcctgcaagggtttgtgttatcgcgcactgctcccacagctacgatgtcagactttatacagctggtgtaaagataacctgtaaactaatggacagcgtgaaaaggtgtaaccagttgttgcacaattgcagcttgtaacatttttttcttcatatatatagaattgaaatgaaaacaaaataagtgttctcctgcacatggagcttccaaannnnnaannnnnnnnnnnnnnnnnnnnnnnnnn

SEQ ID NO: 22932 - DNA, 1323 bp, Triticum aestivum
  Clone ID: PAT_TA_22932
tagcgtggtcgcggccgaggtacatggatttcagggacaccatttggatttacgtcttgttagaaatcaatggcttctattggatcctggagctgaatgcctaatgtctgaggctaatgaagacaagacttctggagattttaaagaaatgggtggcaggcttgctggggaggctgttgcattcttgaaaaagaaagtggataagcttgcaagacatggaggctgcaaagaattgaagcttagttttgttggccattccattggaaacattatcatcagaactgccttagcagaacctgcattgcagccatacttgaagaacctctacacatacatgtcgatatcagggcctcacttaggttactggtacagctcaaattctttgttcaattctggtctctggcttctaaaaaagctcaagggggcacaatgcatccatcaacttactttcagtgacgatcaagacccccagaatacctttttttataggctttgcaagtcgaagacactagagaacttcaaaaatatcatattgttatcgtcaccacaggatgggtatgtaccatatcattcagcaagaatcgagctctgcccagctgcgtcggctgataattcaaggaaaggtcaagtcttcacagaaatgctgaataattgcttggatcagatgcgtgcaccgtcgtctgaaactcgtatattcatgaggtgtgatgttaatttcgaccaatctgcccatggacggaacctgaacaccatgattggcagagcagcccacatagaattcctggagactgacatctacgctaggttcatcatgtggtccttccctgaacttttccgatgacgatgacaatgttctctccctcttatttgggatggcatgatgttccaaaccaaaccaaaccaaacctggatactgcactactgaccaagaaaggaatataaaggtttcgtcaccaagatggatagcactgtaaagttccctagcagtaacattttgccagtttgttagatttgatttgtataaatagttgatttgttcatttcgatttatagccctgtagatgtgagatgtgccgtcaggtcttgataatccaacgtcgtctggtgtggtgtattttaacgctgccagccagtttaggagggccaaacagccagtgagcttatgtcaaataagcatgacgtgtgttttattttcttttaatgatcactacatcaggcagagatcattatccggttcttgccatgtcatgttgttgatctgtaactgaatgttgaggattcattggatgacggagagtgtgcagtcaaacttgtattactttg

SEQ ID NO: 22933 - DNA, 1091 bp, Triticum aestivum
  Clone ID: PAT_TA_22933
cctccctcagcccgccccccgcctccgccgcctcccgccccccgccccccaagccggccctgcctcgccgccgtccccccctcccaccgcgagagagagaactaagaatatcttgcacgtcgacagaagcaggtgcatgtcccggccaagtagatgggtgcaagtgaagccacttaacagggagggggcggatccacggcgaaaggaagcaggggaaccggactaatttgcagtattaatatattgctagtactatatatattgttagtatgaagaactgaatttgagtgacaccgtcgtcgtgcaatataagtaaaccatgggctctgaggagcacgactgggggcacaggtgcggctcccagcaagtatttcaggaggatggggatacggatggggatgacggtggtggtggtgatgatgatgatgatgaagctcagcaacaggaagcagcaatgatggagccaccgtcagaaaatgccatgcccattgtgatggttgacactgaggcacaaccttctgagactgtgttagccgttgagcaaacaggggaagtgatccccatgatcatggacccacctgctcccacagctgggccgccacatccggcatctacaggaactggtcgcacaaggcgtccctgctatggatggatctctgaatctgagagtgactcggactacgaagaatatcttgcacttcgacagaagcaggtgcatgtcccggccaagtagatgggtgcaagtgaagccacttaacagagagggggctgatccacggcgaaaggaagcaggagaaccggactaatttgcagtattaatatattgctagtactatattgttagcatgacgaactgaatttaaatgacaccgtggctctagtatataagtaaaccatgggctctggagcagacactctggatggcaggtgtcgctcccatgaagtacgtaagaacaacatatatgggtgcttctgactatatttaggtactaatgtgctagcgtggcttccccgttgacgtttgtataaatcgcgaccttcttggcttggccttgctgaatatgtctgaatcaaaaaaaaaaaaaaaaaac

SEQ ID NO: 22934 - DNA, 615 bp, Triticum aestivum
  unsure (1)..(615): unsure at all n locations
  Clone ID: PAT_TA_22934
ggacgtacgccgctccgggaggtggcgcgaaaatgacgcaggtgacggcggtatcggccgacatcgtcctccacaacgcgtttgtcgtcaccatggacggcgccctgacggtcctccgggacggcgccatcgccgtcgtgggcgaccgcatcgccgccgtgggcccttcggcggacgtccttggcgccttccccggcgccgcgcagaccctcaacctcgcgggtcgtatcctccttcccgggtttgtgaacacccacgtgcacacgtcgcancagctggcgcgggggaatcgccgacgacgtcgacctgatgacgtgggctgcacgggaggatctgggccctacgagtctcacaatgacggagggaggactcctacgccttccacgctcctctgcggcatcgagctcatccgatctggggggagccaatcctccgcccgcatcaggtccgccgtttaagttctctgttgctgccagcttgtattgactgatgatacactatatatgtttgctcaagcctggaatccttagtttcgccacccgattgctctgcattggtggagattttacataaaacacagtnagaattgagcaatttacagtgnanaaaaaaaag

SEQ ID NO: 22935 - DNA, 683 bp, Triticum aestivum
  unsure (1)..(683): unsure at all n locations
  Clone ID: PAT_TA_22935
agcaaatacaaacagctaaaacgatctcagccttcacacacgcacatccatcgttctaggcttcgagctagttggagatggccggaggggatgacctgaagctgctcggcgcatggccaagcccgtttgttaccagggtgaagctggcgctcgcctgaaggacctgagctacgaggacgtggaggaggacctgtacaagaagagcgagcttctcctcaagtccaacccggtgcacaagaagatacccgtgctcatccacaacggcgccccggtctgcgagtccatgatcatcgtgcaatacatcgacgaagtgttcgccggctccggcccgtcccttctcccagcggacccctacgagtgcgccgttgctcgcttctggatgccctacgttgacgacaagctggtagccccatggaggcagtggttgaggggcaagacagaggaggagaaatccgagggaaagaagcaggcgttcgcggcggtggagattcttgaaggggccctgagggaatgctccaagggagggggcttcttcggcggcgacagcgtcggtctcgtcgacgttgcgctggaaggcgtgctgtcgtgatgaaagtgtcgaagggggtggnccgtgaccagatcttcgatgccgccaagaccccgctcctggcgcattgggtgggagcgcttcagcgagctcg

SEQ ID NO: 22936 - DNA, 1227 bp, Triticum aestivum
  Clone ID: PAT_TA_22936
ctcatcgcccaggcatcacggatgacactctcctcgaagtagcatcatggatgacgcatatatatgttgtccatagacactatataaacagtttatccacctctgaaacattcatcaagaacgagtgctccacaagcacaagcagctaaagcaatctcagtggtcttcaaaacacacacacacacacacacaaaacatcgatcgaggtagttagagatggccggacgagatgacctgaagctgctcggcacatggccaagcccgtttgttaccagggtgaagctggcgctcgccaccgaagggcctgagctacgaggacgtggaggaggacctgtacaagaagagcgagcttctccttcaagcccatgagctgcacaagaagataccagtgctcatccacaacggcgccccggtctgcgagtccatgatcagtctgcagtacatcgacgatgttcatcccggcaccggcccgtcccttctcccagcggacccctacgagcgcgccattgctcgcttctggatggcctacgttgacgacaagctggtagccccatggaggcagtggttgaggggcaagacagaggaggagaaatccgagggaaagaagcaggcgttcgcggcggtggagatgcttgaaggggccctgagggagtgctccaagggagggggcttcttcggcggcgacggcgtcgggctcgtcgacgttgcgctgggaggcgttctgtcgtggatgaaggtgaccgaggtgttgtccggtgacaagatcttcgatgccgccaagaccccgctcctggccgcatgggtggagcgcttcagcgagctcgacgcggccaaggccgccctgccggacgtgggcaggctgcttgagttcgccaaggcacgagaggctgccgctgcagcgtctaactgagccagcacacatccagaataattaaaatttgttatttttaaatgttgtttgttcggctgcttgatgtaataatgtagcagtaactcatgtcatccatttattcagtattgattatgtccttgagttttaaatattttgatattgagtgtaattctaaaattttaaatggttaccacatacggatgtatatagacatattttagagtgtagatacactcatttgctccgaatgtagtcacttgttgaaacatctagaaaaaccaatatttaagaacagaggaaaaaaaagtaactgatgacgtccatttattcggtgt

SEQ ID NO: 22937 - DNA, 490 bp, Triticum aestivum
  unsure (1)..(490): unsure at all n locations
  Clone ID: PAT_TA_22937
gtggccgcccccactcatcaccactcgacgaggacgatgcatcgccggagctcgtcttcaccaagatcgcgctatggacactgacgccaccgaggttggcgcctcggaggtcgacgccacgatggccacctccactcaccggtagatgaagacgcagttttagccaaccatggtgctcggcttccggagagacgccgcttaagtcggtcgtttggagatttgtcgtcgggccattcgttcacttcatcaaggtggtgccatagaagtcgacgacgccaaagcttgccgttcacaccgcttactctgtttcatcatgtccgaaggaccacgacattggtgctcgccacgattaccccgccgttaaaataaccgtcaaaccttggcccaatttgattagcccgtggatgaagtacgaaaccccggacaactcaactcccgccctttcataccgaagtctctcgnactcttaaaggaaacangcccattnatc

SEQ ID NO: 22938 - DNA, 935 bp, Triticum aestivum
  Clone ID: PAT_TA_22938
cagcgcccctggtgcttctgctgggtttaggcccgcccgtccctggcgctcgttcggtagttgcacgcctggtcctcttccgcgggcggctcgaccaggcaatgacttcttcagggggcttctagatgatacagactcaagggtggcgtattattctgctgcctttctcttgaagcggatgatgacagaggaaccagatgtctaccaacggatgcttcaaagtctcatttcaaaagctcaacagtgtaacaatgaaaaacttctggaaaacccataccttcaaatgcgcggaatattgcagttgtcaaatgatctaggagttcaatgatcaccctggtttgacatttcaatgtacaaagctttcagtgagaactggtgccatcgagatcatttttgttgcagaagaatccgtatctgaattcctctgctccaaactatgaaaagatgtttgagtggaccatgtaaattacccgcttctgccgtgcttctgaatttctttattctttattagatctgaatcaatattccatctgggggttgggtcactgtcattcgcaagacgagatggagctgagttaggatgagatggtgttgataagcatgacagctgcaattttctaatgcagcgttgagattgagccggccggcgcaactttttttgcgagaatgctcagttcaataatggtagtttgtatgtgtgttttgattcatgctcgcctttcccgtcgtaagtaacagagggatagatgtttgtgttgctagtgtaattgccatcttgaagtaaatgtggcggtggactttttgtctgacagcttaactgttccttagaactttgtaccctgggctaagtgtacatgtgtagggtgaacaaaaacagttttgtttgtccttgttcaaataacctttctgcaacaaaaaaaaaaaaaaaaaaaaaa

SEQ ID NO: 22939 - DNA, 922 bp, Triticum aestivum
  Clone ID: PAT_TA_22939
tttttttttttttcaggaagcaaccgtattttcagaaagatttaaatgactatttacagcatacactccacatggatgggtgtatattgtccagaacgattggtaaatcatcataagcagaagaactataataactgtttttctccacggtgattatccacttccacaaaggctgttttcatcccatagtgtacactagtgatagcatgctaactgctgcatttctttccagggaattgctcagcttgacttcacttcctcaatcgcacgcgctaattcatcaatcttcgcaccagtgacctcctttgcaaccttcccatccttgaaaatcttgaatgttggtacaacccttatgccaagctcctttgcaagaggcctgttgtcttgattgcaatcgagcttgaggaatacgacgtcgtggtccttctcagacatctcctggaattttggtgccataactttgcaagggccgcaccattgggtgtacatgtcgaggacgacgggcttctcccctgctgccttgacaattggccagaaggtgtccttgcagacctccgtgacctgcccggtcaccgccaccgccgctgtgggcgcttccacctcgtcggctcccgtcgtggccgtctccaagccgcccgacttcaccggagccactcccctcccgtcagagccagacaccaccatcaggctcctcttctgagaagccgccacgcaggccaggaagcggccgcaggcggcggggcggcatgaggagatggccggcgaggaggccgtgctctgcggcgaggagacggagaggcgtaacgccattggatgcaggagttttggaaggtaacgcccccaacgggtggtgtgagttggtggtgtacagagtggtgttttctctgaagcagccgcgggccatgagcgcctccggcccgag

SEQ ID NO: 22940 - DNA, 1559 bp, Triticum aestivum
  unsure (1)..(1559): unsure at all n locations
  Clone ID: PAT_TA_22940
ttcggcacgagctcaaaggcaagacacccgcaaacgaggacgaaagaccagaaacttgcatctgaacgaggcatacagtagattgaatgatttgattgaagatggacttagtgaagaatctgcttcaaagctgacttcaagcattgtctcgcttgtctcatttgatggtgaaaagatctattctcaaagcacaggaatagttgttgaaaatgatcaattcagtgcatctttcctgacatctaaagatttgattagaaaaaaatcagcttttgttcctggattacagataaaagtgtacctaccaaatagggaagtagtgaatggacttgtgcaatactacagtgcgaagtggcgtatggttgttgcgtccgctaagccctcccctcatcttgtcacagcatgtcttggtaacataatgcaagctgagtcttctagtggcttatttgctataacttgttgctataagacgggcaacttattggtcacaaccgggacgctggctagcagtccaagtggacttgaaggaatcatgcagtccacgtgccaaatctctgtggatggaagcggcggacctcttgtttcacctgatgggaatattgttgggatgaacctctgtacggaagagagtacaaccccattcataccaacagatcaaatttatgattgtttgcgcaagcttgcgatacggacctatttggagaatttcacaccattgagctccagttcagaaggtatctccagtctagataccattataggtagctcaagtgagggaagtgaaaataagaaccaggatgctaatgttgagtggtgtgacctcagtcaagaacttgcttcaaagttgtccccaagcattgtctcccttgcttcatttgatggagagacgttgcattctgaatgcacaggcatggttattgacagcgaatcgtgttctgcctcttttcttactactggaagtttgtttggatcattagatccagaactctggagcaaagtggtgatcaaagtgcgccttccaaatgacgaagtggtccatgggtggctggactattatatgtccaaaaacaatatcgctgttgtcaccacagattcattgctggtgccctactttcatcttcgcgtagcatgtctcgacaataacgtgcgagttgagtcagctgctggcgtattagctgtaaggcggtactttgactcaggcaaattagtgtacaccggagggtcactgactggtggaattcagaacaaagagcttaattcatcactcactggtggaattcaaaacaaagagcttaatttttccacatgcaaaatcaatgaggttgccagtggaggaccacttgtntgatcgtgatgggaatattgttggcatgaactactatggntggggaaaacaactccattcctaccaagtaatcttaattgttgaacaagttgnggcctgaaatatatcgggctttcaagtaaacaggatcatttgctgtacaaatgagattacaagaatcttccacacctttgtagcattgacccaaaagaactcactgacaatgaactttgatgca

SEQ ID NO: 22941 - DNA, 442 bp, Triticum aestivum
  unsure (1)..(442): unsure at all n locations
  Clone ID: PAT_TA_22941
ntcgtgccacaaagcttccttcaaccatggctctcangaggacctgggctgcgttcctgtgcgtgatcctggccacggtcgcggtcgcggcggcgcggcgcaagccctgctcgccgccagaggtgatttaagcactgtgaagcgagacagcatgacaccgtatcggaatatctaccaggcaccttcttatgcggcgccgacggggccactcccaggatatcctcctccaaagtagtctggagccttggaggcgatcgacagttgaagcacgggaatacaagtgcaagcgagtatgaataaattagttgccgagggtgtactcggtgttgatatataaacatagtgatgcactgacgctcgattgtacatcgttccattcacctctccgaataaacgccaccgaatgactctgttgttagtcgttcttttcaaaaaaaaaaaa

SEQ ID NO: 22942 - DNA, 1207 bp, Triticum aestivum
  Clone ID: PAT_TA_22942
ggcgggggccgtcaggcgccgatggaggaggttcgcaggtggagcaggccggcgacgccgagctcggctggggcctcctcggcgacgcctacgaccgctgcggcgaggtctgcgccgagtacgccaagaccttctacctcggcacacagcttatgactcctgaaaggcgcaaagccgtttgggcaatttatgtatggtgcaggagaactgatgagctagtggatggccctaactcatcttacatcacgcccaaggcgctcgatcggtgggagaagagattggaggatctcttcgaaggccgcccgtatgatatgtatgacgcagccctctcagacacggcgtcaaagtttccaattgatatccagccattcagagacatgattgaagggatgaggctcgacctttggaaatcgaggtataggaccttttgacgagctttacctctactggctactacgtcgctggcactgtcggtctcaatgacggtacccggtgatggggattgctcccggactctaaaggcctcacccagagacgcgtgttacaatgccgcactgggccttggcattgccaaccagctcacaaacatcctccggagaggtaggagaagactcgaggagggggagaatataccttccactggacgaactggcacaggcggtcctgacagaggaggacatattcagagggaaagtgacggataaatggaggaggttcatgaagggccaaatccagcgcgccaggctcttcttcgatgaggccgagaagggcgtcatgcatctggactccgcgagcagatggccggtcctggcttcgctgtggctgtacaggcagatccttgacgccatcgaggcgaacgactacaataacttcaccaagcgtgcgtacgtgggcaaggcgaagaagttcctgtcgttgccggccgcgtacgcgagggcggctctttcgccatgagcgaagcaaagcaaagcgatcccgtagatcagatgtttttcttcttctttttctttcttttgtcctgtcacctacaaagttttttgttggctgttgtatatattcagctatatgttacggtatttaggtcaagggacggatgtcgggtcccgctgtactgaaacacttgttgctaccacaccacacagtggagaatcaaaattgctccagtttaatggagaacaaaccactctttctagagagctggaccatc

SEQ ID NO: 22943 - DNA, 1383 bp, Triticum aestivum
  Clone ID: PAT_TA_22943
gcgccacgagcggcgtccggaagaacagcaacagcggaaggaccggtcagcggcgggcgaccattcgagccagctagcggcctgcttgaacggcctggtcggacagggggccgctggccggggccgacggggaacggccgggcaccgtgcggcgccaaggtcgggctcaacagcggctcctggacgcctggggagcacatgcgcctcatcccctacattcagaagtacggccacgccaactggcgcgccctgcccaagcaagcaggtttgctccggtgcgggaagagctgccggctccggtggatcaactacctccgccccgacctcaagcgcggcaacttcaccgtcgaggaggaggagaccctcatcaagctgcacaacatgctcggcgacagaaggttcaagatcgcggcgtgcctgccggggaggaccgacaacgagatcaagaacgtctggaacacgcacctcaagaagcgggtggcggccagcgccggcgagcagaagtacggcggggccaagggcaagaagaacaccacctgcgccgacgtgccggcgccgtctccgtctcgtacctcttccacaaccaccacgaccaccaccacgaccaactgctccagcggcgagtccggcgagcagagcaacaccagcaaggaactagaactagaattggagctggagaagatcgagatccccatgctggacctcggcttcgacctcgacatgctgctggacaccgtcaccaacacgcactgcccggccatctcttcggcgccgacctcgcgctgctcgtccgcgtccccgacgtgcgtggtggacgacggcgcgctgctcgacctgccggagatcgacatcgtgccggagctgtggagcatcatggacggcgaaggcggcgccggcgcctgcgccgaaacggcgcaggtcccgtggagcaatgcggcgccgtgcgacggcaagggaccagaggcgagcgccgcaacggccgacgacgaggacggaaaggagtggtggttggaagatttggaaaaggagctgggcctgtgggggcccatcgacgactaccagtaccaacaaccggacccgcaaggcttgcgcggacccgctctccgccagcgtggacgaccccgtgtcgtcctacttccaagccggccccgccagcgccacgtcaaccatccatgggcccgaagcctctgcagttctcacagacatccccatgggtctatgagatcactcggtatatataaaccgtgcgatctcttagtatagaaacaagcaccgcgatcggacggccacgactgatgctagtacacaacatatacatgtacaaactgtacaactgtacgcctgcaacaggagtacgtacgtacccagcacgaagactatacg

SEQ ID NO: 22944 - DNA, 348 bp, Triticum aestivum
  Clone ID: PAT_TA_22944
ccgcgcccgcctccaacgccgtggcggcaccgaccgccccctcgctgttcccctccggctttcggcagctctaggctagggttcgtgccctcgaccccttcttctttttcctcacggatgacaccgcttgccacttgatcgcgttgtatgtgtgcacttaggtcttccattctgtaggctgaaactggttcgtgatttgtattctcaagattaagtaatgcaagggggtctgtgtcaaactctgtcacattctagcaaatgattttctcttctgttggctgaaatcgcttcctgggtttgtatcctcaatattgataatgcaatggagcctgtgtcaaattctgttaa

SEQ ID NO: 22945 - DNA, 887 bp, Triticum aestivum
  Clone ID: PAT_TA_22945
ccgctccttctgccggcggcgtggggagggaggctgacggcgggctagaattcctactagatccagtagaccggtttccactaagagaggagtcagcagataatttggaacatccagatccggtgccgttggcgctactgccacgctgcgagatccggggaaggaagaatgcttcgccaactaggtctccacaatccacgggggaggtgaatcacgaagcacctggctggaccaaggttgaggctggggagtacaccgccctggaacaatccatccagaaatatgcagaagaacctagtaagagtgtggtgaaacctgaacttggtctgagttttgacttgtcgggtgaggcgtatgacttttacaatttgtattcgtgggtggttggctttgggatacgctatggtaagagtagattgaacgataagagcacgaagataatgcaggagatcctgtccggctgtgcggggaagccggaggtgaagaacagccggtcatgcaggtgcagtgacaagacaagtctgtatgacatgccattcggtctttttgttcgggtgaaccaccatttccagagtgttatactggtgggtgttcgcagaatttcttaggatgatgggcatacctgcaacaaacaagatcaaaagagagctatggaagttgcaattcaaaagtgtatccacacaccgtgcacagatggtgcaaaatggcacttctaaaccacgacaaaatgggatgattctgtgatgaagacttagtaggtgtcttgggagatctggcagatagattggatgcatgttggtcctttgataagtcaatccacctcaagcaagcaaattttggatgagtgcttatcatccaatgagcgtttggtcaaagaattagcaagc

SEQ ID NO: 22946 - DNA, 454 bp, Triticum aestivum
  Clone ID: PAT_TA_22946
gtacttgtcaaagcttcccgggtcgacaggttatttcaatcattattaactatatctcggcctctttaattcgtcatttcctgatatgaactatttaataacccctttattcattttctttgccggcgggcagggcttgggaaaatttcatcaacgtgactccaggcaaatggcgaaaaaatttgtattggtttcgacccaaggtaagtaattaagtagtactagctagctaccatctctttaattcttgtttcaatactattaattgtcatgcttgattaattattatctgattaaattctattctcgtaaaggccctgaagcaggcgtcggggactgaagtgtgtgcatactacgtttgcgagaacattcgcatgatggcgtccgaaaggagcaaatgtgatagacagctatgggtacgtttgccagaacactattcacaatttttacatca

SEQ ID NO: 22947 - DNA, 749 bp, Triticum aestivum
  unsure (1)..(749): unsure at all n locations
  Clone ID: PAT_TA_22947
tgttatcgattctcctcctcggcggcggaaggcgaacagcgaggaaccctaaccctaaccctaaccgcgctccgatccgatccgatccgcaaggcctgcgacgatggcggcttccctccgcgcggcggccaagaggatgctgcgcccggcggtgcatccaggggaggggcttcgcacccagcaccagcagcattccggaaccccccgtgccttggatgaaggatacaaccatgcatcgcaaatccagcagaagaaggaggagttgtacaatctcatcgccaaggctgtggcggagcccactaccacctggctggacaggcgactgctcaaggctctctccttgcaaatcaagcctagaccaaaggaccctcagtggcgcaagataattttgaccaaggtggccacccattgtacatatgctgtgggtattcttgttgcttatgtcagatgtcctcgcactgaagacggtgctaaaatagtaaggtacgatggacatcttgttactgttgagagtctgcccatgctacaaggatatcagcctgctactcctgctgagggagtgcccaagcaaatgagttgaagaagaaatgcagcttgtttttgatggagaagcaagacggatatcagttctatatattccagcactatattattatgtatgtctatgtcatgtactactggatgatctctggtatttatgatgttgctggcatggtatgaagatgatnctagtagttttctgtttgagc

SEQ ID NO: 22948 - DNA, 892 bp, Triticum aestivum
  Clone ID: PAT_TA_22948
gcacgaggaaaatgttatgcttgcttgtgattttgatctcaattttgtccatgtgtcctctggctgggaaggctctgcacctgatgcagaggtcttgcattctgccatagaatctggatttcaagttccaagaggcaaatattatttggtagatgggggttatccgaacactccttcttttcttgctccttatagcgggatcccttaccatatcgaagagcaggagcagagaagttgcccagcaagagactacaaggagttgttcaaccttcgccatgcacaactgcatggccatataaaagatgctataggtctattaaagatgagatttccagttttaaaggttgcgacatcataccggttagagactcaactgaaaattccagcagcggcagtggtgttgcataacataattcagaggcaagaagatgctgaaggaccctcagttaaccaaacaatcccaatcgatacccgtgaaagtgggaatgccgcacatggccatgttgtttcagcactcaacaatcagtgtgacacgggcggtgctttaagagacgatattgcaaagaggatgtgggcagattacgtaataaatatgtgatttttcatatttcttacgcaccgaaggtaaaaaagaggaaaggatgtacaagtcctctaaagcctttggggtttgcctagactgacacaagagaagtgggcagcctgaaggaagaatcaaatcaatggaaaacaatcctcaatttcgatgtctcatgatgcttcttgtttgaagaatgcttcgtacctgcccgggcggccgctcgatctttcctcctgaatcaagacccaagatttgtattgaagttgggattggacgtgttaatgcgggttttgactgcctaaaaaaaaaaaa

SEQ ID NO: 22949 - DNA, 926 bp, Triticum aestivum
  unsure (1)..(926): unsure at all n locations
  Clone ID: PAT_TA_22949
tggagaagatggggtgcgtgtgcacagcatggttcttccagggcttgcgtcgagcacgtcggtcgttttgtcgggccccggagaggtttacaccttgaagcatgatgttacagacatccagagcctaatgccaggactgattctggcaatacggaaggtgatacgcctgaagaacttgatttatggtctggagaagttcttgtaggaaatgatcaagtcacattcacatatcatgagaactagaggtcattttttcgaggaagagaactacagtttttgatcttccagctgttcaccataagagataaataggattaaatcaattccttggctcataatcagataagtgccaacgacaaagcggatccgagacctaagaacgcgatgcagagtttcgaaaagaatggctccatgcataagatgacacttctgatagaggtctagacaatgagcaagctgatgacaagctctcatgtgtatacctggtggcttactatactgttagaggctttttcagaatcttactcttagagataaatggtaccactctcgctgtgctgccggtccttctccagtggacctgctttgggatcaaatcagttctgtctttactcatgatcagaaagagtgccaatggcaaggcggattcgagaaccctataaacatggcgcacaattttgaaaagaatggctccaccatgcataagatgacactcctgatggtgctccagacaataagcaagcagatgacatggtctcaggggttgtacctgatgacttgctatactttcagaggtttttcagaaccacaatattggagaaaaattatatgggtccgctatggcgcggcctttctagtgtaccaacttttttgtaactctagtgtaccctttaaccggtatatctacaaccnaaagcacgcaggac

SEQ ID NO: 22950 - DNA, 523 bp, Triticum aestivum
  Clone ID: PAT_TA_22950
cccacgcgtccgaaggtctgatgtttagttggtggctgtgtggtacctatactggcattttccgtcaagaactccagaagagatatcatctcaagaactccccccgtgcaggagatgagcatgtcagagaaccgcgacgcccccgcccctgccaacccagaaaacggatcatccaacaaggccgagcttgaagcgcgcaacagcgatcacgacgccgtcgacgtcatccccctataggcccaggccaaaccaaccaaagaaagaaagaaataataaaatccaatggaattttgatataaatatgcggtgttaggatagcatgatcgagggagcgagcgaggcatgagaaagtaaagattgaccctccgtgaatttgttagtggaattgctgatcgatgttctcgtctccaatcttgaaccattaattactgtaactcaacgcggtcgttcgttcgtttatgtactgatgaaggtggtttttatgtgtacttaaagaggtactttgagcaactttgcatcgttt

SEQ ID NO: 22951 - DNA, 1250 bp, Triticum aestivum
  Clone ID: PAT_TA_22951
gtcaggccagatctggccgcctctcttcgaggagtatagcagagtcccccgggccgccgccgccgccggcgagcaatggcggtggctggccaccagtcccgctacattgagctcccgatggacgcggacgcccaccggcgaggacatccgccccggcgagctcaaccagcccgtccacgtcccccagctcgagggccggcgatgcggcgagtgcggccaggtcctcccgggcacctacgagccgcccgccgccgaggcgtggtccaccgggagcttcggttggaccgacggccccgagagcggtcgcaccgcagtgctctgtccttgcgtgctgtttgggcgcaacgttgaggccgtcagccccggagtatcccttggaccacgcgttgtgtttggcatgctatctttctgggaaggcagggcttacacttgcaatcctgacagcaatatttcatgctgttgacccaagatcagcatttcttgttggagaaggtcgggtttttagttgctggctgtgtggtacctatactggcatttgacgtcaagaactccagtaagagatatcatgtccagaagtctacttgctagccgtgtagggcccactgctgcctgcactggtgcgccaactgccaggggcaccgcgagaaggagggggccggctggaccgaccacagcgccgtggccatgaccgtcgtcaacaaccgccccccgtgcaggaaatgagcatgtcggagaaccgcgacgcccccgcccccgccaacccagaaaacggatcatccaacaaggccgagctcgaagcgcgcaacagcgatcacgacgccgtcgacgtcatccctctataggccaggcccagccaaccaaaaaaagaacaacagcgatcacgacgccgtcgacgtcatccccctataggcccaggccaaaccaaccaaagaaagaaagaaataataaaatccaatggaattttgatataaatatgcggtgttaggatagcatgatcgagggagcgagcgaggcatgagaaagtaaagattgaccctccgtgaatttgttagtggaattgctgatcgatgttctcgtctccaatcttgaaccattattactgtaactcaacgcggttgttagttcgcattatctgctgaaggtggtttttatgtgtacttaaaagaggtattttgagcaactttgcatcgttaatcgaagatcgtcgaagctaattatgttatttctgtcaaaaaaaaaaaaaaaaaaaa

SEQ ID NO: 22952 - DNA, 584 bp, Triticum aestivum
  unsure (1)..(584): unsure at all n locations
  Clone ID: PAT_TA_22952
gccatgacagagctcgaggcgcttaacctctcttacaatagcctatctgggcctttgccaacaaccgatgggttgcgcgaaattcccaggagcgttggcaggaaaccctgggatatgcggtggggaagggtgcactatggatgcaacgatgccagaagggaaaattccacgaaataatcgtcatggctggctcagtgactggcatgtgagagaatggatgggtgtcccttggggcgttctctatcagcacgatgactagctcttttgtgtcgttggctaccttgctatgctcccccaaagntaaggaattccgaatttcggcctgtgaggatagaatattgaggttanaggggggatcggcaataagtttgtaatatgaaatgtgtgcaaatttgagtgattaatgtcactaatcctgacnaagcaattgtgtggctgcctgaatcancaggaatatgccaataatgttgttgtacggagnctaaaccttttctgggaaaaattnatccttcganaactnctggttgaacctgcaatnaaaagatggcaccggttcaattnaaaaaaaggggggccggaccaat

SEQ ID NO: 22953 - DNA, 543 bp, Triticum aestivum
  unsure (1)..(543): unsure at all n locations
  Clone ID: PAT_TA_22953
acatacatacatagcatacttgggatagaaagtttatccattttgcatcttataggttgtgcacaagtgtcgtatccgcctatagagcaatcgtgatagcgtctctcttgagttgtgcaacacgagcgttttccgtggactccacatgttgtgctcattccttggttacacgaccccatttatctatccgtgtttgcgtttccgtgtgccattctattgctattggtctacttgtttcacttgcgaatttgtgattctctttcaacattattgactcttgctaacattttgcatcaaatttttgtgccactatcctcaccgagctccaccataagccttatttgtgtaggtgtgtgaaaccgacaagaattggtaccaattgtgctatttccttgtcacacattggagtgatcattgatccactttcaacttcgctcaaggtacatttggtatagttcttctctttctcccactcatatttgctccaaggggggcccgggtaaccaantcgccctaaagtgagtccgtaatangcggcgctca

SEQ ID NO: 22954 - DNA, 531 bp, Triticum aestivum
  unsure (1)..(531): unsure at all n locations
  Clone ID: PAT_TA_22954
ctcgtgccgaattcggcacgaggtcagtcagaggcagaggtcgagccgtggagtagatctcgccggctgggctcgtcccggggcgggcgcgccccgccggccgccggcgacctcctcgtcggtgagtacgtgcagcagcccggagaggtgcccaaggctggatctcgcagaacaaggacatgaggtacttgggcatggaatgggaatcacaattgttctggtggaaatgaagaatgtcctgttatttggctgctaccatcgatgttctttcagattgaacattgccatgagcgtttctctacgcaacgaatatattagattcaagcatcatgtcatgggacaccataaagacttttctgcgttgatnagtgatgtctacgggttgggttcgtgcttctgtttatcaacgtcactggaagtacatccccctaactcaaatgggggggtttccgtgccctcgtgttacacagatcctcaactatccatcttcaaatnaattgggnccccctnaattttgttaaaaaaaaaaaa

SEQ ID NO: 22955 - DNA, 1266 bp, Triticum aestivum
  Clone ID: PAT_TA_22955
cggcaggtcaagaaatcagaaaacaacaagcatggtctactgcctgtcgagactccaatttcaaacgatagtgtcatgtgcaaaccgattaaacaggcagggaggaaagaagagcatgcagaaggaggtccgaatggtatggctgtagttgatggacttgctttggcggtgcaaattctcgctaaaccggcagagtacttcaatgtggcagatgttatacaggagtcatctgaccagtggcagcaaggagatgtgcaatttgagctcaaggcccatggtggtaccgaggaccgttcaaaactaactgaaatggtgtccttgcctgacaatacttgggaaaagcatccggcaactgacagtccaaggcgctaccatgttgaggcccaaaggaatgtggggattcgctatggttacagggagagggcaggcaggggacgcttcttccacgaatcaccagctccgtctagggctcgctggatgcctaaatacatctcccatcctcagagcgatgcacaatatgatggtgtctctgaatggctgcaggattcccaccaattcttattggacaactcacagggattggacagcaaaccgattcagatagctgacagggatgctggaatggatctgcagggtggagaaggcaatgtaggcatgagcttcagagatgaaaaccccttgatatggaacgaaacagagtgggagtatcagcctctctttccagcgccacatcgcgttggccaacaacacggtaacacgagtgatgatggtcaaaggggtagaggcagacactctgagtaccgccaacaacacggtgacgcgagtggtgatggtcagaggggtagaggcagacactctgagtaccactatccggagccggtaagatctcgtgatgctacacctgacatccagcggaaccccggcggtgctgacaatcatcagtatccggcctatttaagagcgggaatgcacacggagcgcaggtactatatttgagggtcgctgttggatagctgtggtccatacaatcatcaccaatccagtcctgtaatcaatccctgaatattcttgtgagttgctgaagcgtagatagccttttgtcagctctgtttctttcttctctgggcttgcgatgatccatttacttgtaagatgctagtcctgtttatcttatggagacctttatcttgtaaagctttgtctgaagactattctacttctgatggccgaatactgcacggatcgctgtttgggtgtcacgagaag

SEQ ID NO: 22956 - DNA, 1145 bp, Triticum aestivum
  Clone ID: PAT_TA_22956
cttcctccccaaatccggcattggcgagcttccgcaatccccgaaaagttgtgacaggtcgcaatggccgtcccaagaaggtctttggatggcaggttgttctgggtgctgggccttgtttgtgccatgtatcagatattttttgttcggtcagcagcgggtcaaacagcacagttgagtgtgaatgcttcacctcagaatactcagatgattcctgagaatatgtttggcatctttttcgaggagattaaccatgctggggctggtgggttgtgggccgaacttgtaaataatagaggttttgaagctggtggtcctaatacgccttcaaacattgacccatggttgataattggagatgaatcgaacattattgttgcaaccgaccgctcatcctgttttgcaactaatccaatcgcacttcggatggaagtactttgtgaatctagtggaaatgatgtctgcccaccaggaggtgtcggtatttataatcctggcttctggggcatgaatattgaggaagcgaaggtttataaagtcagcatgtacatcaggtcatcagactccatggatctaacagtttccttgacaagttcagatggtcttcagaatctagctgcttataccatcacggctggttgggcaggttttaaagagtggacgaaggttgagtttgatctgcaatcaagtgaaagaaattccaactcaaggcttcagcttacaaccagaacaagtggcattgtttggtttgatcaagtatcacttatgccatctgatacttacatggggcatggttgtcgtaaagatcttgcgtctatgctggcaaatctaaagcctaaatttttgaaattcccaggtggaaactatgtcatgggaaactatctgtcaaatgcatttcgctggagtgaaactgttggaccctgggaggagagacctggtcattttaatgatgtttggggctactggactgatgatggacttggattctttgagttccttcaattagcagaagaccttggtgcttgcccagtttgggtggtcaatgatggggctagccgaaatgaacaagtgccatctgccacaatagctgcttttgtaaaggatgttgttgacggcattgactttgcgaggggagaccctgggac

SEQ ID NO: 22957 - DNA, 2140 bp, Triticum aestivum
  Clone ID: PAT_TA_22957
cccacgcgtccgcccacgcgtccgcggacgcgtgggtgaggagcaccggctcctcctattccccccccgcgtctcgcggccgtaaccctagcccccccgcgaagcgccatccgacggcgacggcgacgacgtcgtgggatctgatctggacctctggattgcctccgccggggtccgtgtcggtggagctgcgcccgtggttgctcgattttgtgcccgccccagcttccgattggggctaaatatccccataggctcgagtttcatcttgggagggtgaatatgctatttgtgatatccaatttttcatcacatggatgaattctgaagatttggttgtatataagtcaagacagtaagggacattgatttatttcaacaatcaatatgggggctaattgttgcatagctgccaagcagaggcctgagccatcagtagcttcagttgaagtttcggcatacaggacaagacactcgccgtcatggagcttccggtgggacaaccgcacacacatagaggatataatggaaaacgctgcactgttttccaatcacagtagtggaaacattcgtccagaactaaagagtggttccattgcaccaaccgaaggccatcccaatgaggacaatctctctgatgttttccgcggggtcaaatgtcaaaaacctgataagaagatggaagcgtccaaacgttccaaagctggtcctcaagccgttcaatctacagcgagcaattcacctcctgaggcaaagtcctgcaaatcatcagatatggtaaatgttgcttcagacataaagacatcaaagtcccttccttcaacaccacccctagtatccagaacagacccttcatcctctaggtgtcattctcttcatgtggactcattctcaatgaggaaagctcgtcgatcacctggacatcaactatgtaggcagatctcggacagcaagatcccatctctcaagtccttcagtgagagtagctatgcaggaggaaggccatcgagttccatgctctcgacctacagtaatgatccatttggaggaggatcacaacatggtggatcatcagatggatggtcaactcgcacattttctgacttagtggcctcatctcaaagagagaggtggtcagttgacagtgagctctttggctccatcagcagtaaaatagctagatcaaatgattcacatgcaactgctctctctcctgacgaagggatatgcaagctgtgttcaaagctattaaaggaacgttctacatggagtgctcatgatctgggtgtagtagctgttttattctgtggtcatgcataccatgcaaactgtttggatagtactacttgtgagagcgagaaatatgatcctccatgtcctgtatgcacccatggtgagaaaggtgcagcaaagctatttggtaagttggactcaaagattaagagcaggaaatctaaaaatgtgatgtcagatactgatatagataggatctctaagcacaagagaagtatgagggagcccaggttaggcacaagttctagcatgaaggattcatttcgtcgaccatttttaaagaggcatttttcaattggttctcgaccgccaagatcagttctggggagtgagccaacaggaaagaaaggtttctgggcaagacactggagagaatagccagctacatctcatcaacgtggaaatcattacatggtgtgagctcttgagcgagcaaggatagaagtgaagctacatatttttatgttttggtactattcattaaagcacactttgggctgaacaaatctagtgagactagaaattgtcttacacctgcaactgaggattgttgcggtctaactttattcctaggcaatgtaatagaatagaaaatgggaatagtctcccagggtggatttaagggtttaaatctgctatgttatattgttatctttccagtctcttttgtaatcgttatttgtcagttagcataatttaaagactagcatccagatagttctcttcacagaacatgagtgtttggagactgcttagaaggatttcagactgaaagatgcaggagttcgaatataaatagacatagataaatctgtctatgcatttctttttttgacattaaaaaaaa

SEQ ID NO: 22958 - DNA, 650 bp, Triticum aestivum
  unsure (1)..(650): unsure at all n locations
  Clone ID: PAT_TA_22958
tagatcatggaaccatggaaatatatgctcaccagcaaggcagcaaccccaataattttcagttacaatttcacatcattaaatacatacgtatcaatcttccctcgcaaaaaaatacatataaaattttcttttagaaaagtaaggccttcccccgctccatctcgacgaacgaagccaccaaatatacaccaggttggcatatcaaatcaggcgatgcaagaaccatgtgtcactgttctcgaaatgcgcttccacgagcaatcgatggctcatttgttgctctgtgatctgcattgtgaggaagcattgcataaaccccgatgcgggtttctccaatgtgaagaaacgatccagctctctagtatctcttccccagggccaagttgacccggatctccctgccttcgatttcgttccgttgagcgtctcgatggcctggtccatctcctccttgggtgggagtagcagacgaaagccgtaaccgcgggaccggccggtctcgccgtcgtaanagcacccgaacgccaacaagttgccgcaaacgcnggaacgcgtcgggtgaagcaaccccggggtgaccgtcacgacaaggtgcccacnaagancttgtgcncgtcccgggtanancgngccttcgnttcggctgn

SEQ ID NO: 22959 - DNA, 718 bp, Triticum aestivum
  unsure (1)..(718): unsure at all n locations
  Clone ID: PAT_TA_22959
ctanttgtttcttacntgtagcggngcanctcagcggggcgtttcnttacgantgctcacgggaacgtgcgcgttcccgtgtgtcgggggttncttgagcgcgtcagtggagacgtttggcagtccgggggcgacccggcntgcggcccgccgccgccgcccggccccggcgggacgggcggccgcgccccgccgccctggcccccccgagccagggcccggggcgcggaggcgggaggcacaggcggcgcggccgtacggggagttcgtgaaggggaagagcgcgcggaaggagtggaaggcgaggcgggaggggctcgtcgacctctgctgctccggcgtcggagcggcggcgttcgtcgggttcctggtgatgctcacgtgccggtgagcgcgcgcgcatcgactagtagtaaaggtttgctcacacgtgcgaggaatgtgaatacgtgttcgtccagtaggttacacagggacagagggtcgctgccgcaatgtaaatgtactgtagcgcagggccaagagttatcttctttgcattaattttcagaaaggggaacttgagaagataccgttgaaagttgggcagtgtgggactcccttattttgaaagcttagttgggtgaaacccttaaaaaggtctcctgggagcaaaggttttgccaagcttcaaattagaactttaaattgggtaagaaattacttcaaaaaaaaaaaa

SEQ ID NO: 22960 - DNA, 471 bp, Triticum aestivum
  Clone ID: PAT_TA_22960
tgtccaaagattagctttagcgaactgaacatgtatacaaaacctggacctaggaatacaacatagccagacatggaaaaggaaacaaatgaactcttacaagatgaaacacagcacagatctagctcttggggatgttcttgccgacaatcttcgctggcgtgatgcggagaaggttcccctgcttcccgggaatggctcccttgatcatcacaactttgagatcattgtcgatcctgacaatcttgagcttcctgatcttggtcttggttccgcccatcctcccgggcatcttcttccccttgtacacccgccctggggttgtccccgcaccgatcgaacctagggctctgtggctcttggaaccgtgagtcatcagaccacgcttgaagttgtgcctcttaattccaccttggaatccctttccgatggatttggcggagacgtcgacgaggtcgcccacgcgtccga

SEQ ID NO: 22961 - DNA, 1383 bp, Triticum aestivum
  unsure (1)..(1383): unsure at all n locations
  Clone ID: PAT_TA_22961
ggtaaaaggatcanntaggggaatggtaccgcccccccntggggtttttttgtctgtctttttttttaggagagatctgcttcgtttcggagtccaaaaggaaggtgaagaagtggttgacaacatggaggagaatgcacttgtgtccaaagattagctttagcgaactgaacatgtatacaaaacctggacctaggaatacaacatagccagacatggaaaaggaaacaaatgaactcttacaagatgaaacacagcacagatctagctcttggggatgttcttgccgacaatcttcgctggcgtgatgcggagaaggttcccctgcttcccgggaatggctcccttgatcatcacaactttgagatcattgtcgatcctgttttttatccgaagattagctttagaaaactgaacatgtatacaaaacctggacctgggaatacaacagtgccagtcatggaaaaggaaacgaatgaactcttacaaggtgaaacgcagcacagatctagctcttggggatgttcttgccgacaatcttcgcgggcgtgatgcggagaaggtttccctgcttcccaggaatggcccccttgatcatcacaactttgagatcattgtcgatcctgacaatcttgagcttcctgatcttggtcttggttccgcccatcctcccgggcatcttcttccccttgtacacccgccctggggttgtccccgcaccgatcgaacctagggctctgtggctcttggaaccgtgagtcatcagaccacgcttgaagttgtgcctcttaattccaccttggaatccctttccgatggatttggcggagacgtcgacgaggtcgccctccttgaagagctcgttgaactcgagcgcctggccggggtcgaaggcgtcgacggccaccagccggaactcctgcaggtgccgcagcggcggcgcgctggccttgccgaggtggcccagctcagggcgggtgagcttgtcctcgcgcacgccgtggtacccgacctgcacggcgtcgtagccgtcggtggcggcggtcttcacctgcgtcaccacgttgcccccctcccggaacccgaccaccgtcaccggcaccggcttcccgttttccgggtcgaagtaggtcatcatccccaccttggtcgccatcaccccgacgcccgcctcgtacgacgccgcccgcaccaccgccagcgacggcctcctacggcccaccgccgcggcgaaggacacgccgcgacggcgcggggcgaggaagcccagtgcgccgccgatgctcgcggccgccatggccatggctgatggattcgagcgagattagtgcggcggcggaggcgctcactctgctgctgctggcggtgttgttttggtttggg

SEQ ID NO: 22962 - DNA, 1273 bp, Triticum aestivum
  Clone ID: PAT_TA_22962
cacatggctcccggccagagctgcccccggcgcagtcgcacacaaggagagaggagatggctcgtgctcctctgctagcagcacttgtggtggcggtggtagtggccagctcgcttgggcatggggcttctgcagcggagcctccgggggcgcgcggcctgtcgttcgacttctaccggcggacctgcccgcgggcggagtccatcgtgcgcggcttcgtccaggacgccgtgcgcaaggacatcggcctcgccgcaggcctcctccgcctccacttccacgactgcttcgtgcagggctgcgacgcctccgtgctcctcgacggctcggccacggggccaggggagcagcaggcgccgcccaacctcaccctccgcccctcggccttcaaggccgtcaacgacatccgcgaccggctggtagcgcgagtgccgcggcgccgtcgtctcctgcgccgacagcctcgcgctcgccgcccgcgactccctgggcgccgcccgggggccccactaccgcgtgccgctcggccaccgggactgccgcccgcctggcccgccgcacggggcgctgtctgaccccccggcacccttcccgaacgtaccgtccctgcccgcccggcggcggcgccgcgggcaccctgccacacgccttcgcacaatccctggcggccacaccatcgggcgggcgcacggcgcctcgttcgaggacccccgcttccctcctcccgacctcaccctcaacccccccctcccccctaggctgaaggggacgtgccctgccaagggcaccgaccgacgcactgtgctggacgtcgcgcacgaccaacgtgttcggacgacaactactagaccagagctcggttagccggggagggtgtcgtcgtctccagaccaggacctcttcacccaatcgacatcacccggcccatcggttcgagcgctttgcaccgaagccacgcgggacttcttccgagcagttcggcgtgtccatgggcaagatgggccagatgagggtgcgcaccagcgacctgggagaggtccgccggaactgctccgcccgcaaccccggcccagccgccgccgacgagctccagtggccgtcctttgtgcagaccatcgtcgatgcagctgcagaaaggcttggctagcttgtaagcatctagacaagtggactagtagctgttaatcatgtcgaaataataaaagtgaacaaacttgatatcataataaaaaaaaaaaaaaagtaacccaactggatatcattttcagctacc

SEQ ID NO: 22963 - DNA, 790 bp, Triticum aestivum
  Clone ID: PAT_TA_22963
cccacgcgtccggtggtagatgagatccatcttcgacgatttgatggcctcttggaacgtgaaggggctcacaggtgtgttgttgctagtatcactgtgaaagcaccagttcgagaagtatggaatgcactaacagcatatgagaagttacccgagattataccaaacctggctatcagtcggattattcttcgtgataataacaaggttcgaatagtacaggagggctgcaaaggcctactttatatggttcttcatgcccgtgttgtaatggatcttcgtgagaaacgtgaacgtgagatcagctttgagcaagttgagggggatttctactcgtttaaaggaaaatggcgcctcgaacagcttggagatcagcacacactgctgaagtatatggtcgagactaagatgcataaagatacctttctctcagagtctatccttgaagaggtcatatacgaagatcttccgtcaaatttatgtgcaatccgtgattatgttgaaaaggcagaagctgagagaggtaattccataattcacttggatgggccaaccaatccagatactgttcctatgtattacacagaaggacggcagccggagcaagcatctgtacagttctcttcaacttccacaaggcaaagatcaaaagttcctggcctgcaaaaggacatcgaggtcctgaaatcagaacttggtagctttattgcaaaacatggtcagaatggtttcatgcctaagagaaaacatcttcggaccatggaagagttgatattgagaaggccataac

SEQ ID NO: 22964 - DNA, 493 bp, Triticum aestivum
  Clone ID: PAT_TA_22964
gtcgtgctccgggcaagccaactttgggtgcgtcgaaaacagctgcgcgatcaagacgtcgagctgcaagggcagcggcggcgggcaggtggactgcagccccgggatccagctcgccttctccggcaccgacaagcacgaggcagtgctcaactcgtggtacgaggtgtccaagctgaagcagtactccctcttcgggctcttctccaacctcaaggactcacttgcggggcagttcagcaacttcttctagcatgtcgtgcgtgctcggtcacggtcagtccccccggccgtcttcctcctcctcgtgcagcttcatattgcgtcgtcgcccgtgtactgtttgttgtcccgtgccgtgtaacgtttgtgaccaactgctttgtgtatcgattatcagctgctacgtacactcgttaactgttaggtatagagacaatgtaagttacgtacgaaactagtgtatttttgtaatgtataatggaatttgtgt

SEQ ID NO: 22965 - DNA, 1168 bp, Triticum aestivum
  Clone ID: PAT_TA_22965
ggcaccgaccagcacgaggcggtgctcaactcgaggaatgagctgcgcgacgcgcgacacaattcactgtccccacggcggcaaggacgccggcgacctcgagccgggcggcggacgtcctcgtcctcgccctccgtcttctgcccggggcgcctcccggcaggggcgacggcaacggcgggtacgcaccgcgcccgcctgcgacggcgagccgcggcgacgagtttacgttcgggctggcgctagatggtcgcggcgccttcctcgccgggcggcgtgtagctctccccccgcgggagcctcttcaaccgcgccaacggccgcccccttctcgggctcttcccgcccaccgccgtctagattccgcccgtcgacgttatcgcctccctccccatggccctgtcatatcctattgggctcacagtggctttttgggggaggaagtgcccttcgaggtgacgaactgtgctcgtcggtaacagctcggtcacagtcaccggcttcaccctggtgttcgagttccacaagggcacgctgcagaacctcttctggaaggcggacggctgctcatcgtgctccgggaaccctaacttcgggtgcgtcgagaacagctgcgcgatcaagacgtcgagctgcaggggaaacggcggcgggcaggtggactgcagccctgggatccagctcgccttctccggcaccgacaagcacgaggcggtgctcaactcgtggtacgaggtgtccaagctgaagcagtactccctcttcggcctcttctccaacctcaaggactcgctggcgggccagttcagcaacttcttctagcgcgtcgtgtgtgctcggttagtccccctcgtctcgagcagcttccggaggcagtcacacacgtcgtaccatagcgtcgtcacccccgtgtgctgtttgttcaaggtatcgtggtatcgtcgtgtcacttgtgtaaccaaaatgctttgtatatcgattatccagctgctatgtacactcgttaattgttaggtgtagtcgtatagagacgatgtaagctacgctacgtacgaaactagtgtattttttgtaatgtgtgtataaaaatgggatttgtgtaaaaaaaaaaaaaaaaaaacgacaagatcgtagtttgaaaaaaaaactcgagactagttgtctctct

SEQ ID NO: 22966 - DNA, 648 bp, Triticum aestivum
  Clone ID: PAT_TA_22966
ccccgcttgtccggggacccttggggcgccggccggggaacgaggcacgcaagcgtgagaaagaagcgagagacatggcggaggaggggaaggtgatcgcgatccacagccaggagcagtggagcaccaagatcgaggaggctggcagcagcacgaatctggtggtgatcgacttcactgcaacatggtgcggaccatgccgcttcatttctccaatcttagatgagattgccaagaagcttccaagtgttactttcctgaaggtggatgttgatgaaatgaagtcaattgccgaggagttcagtgttgaggccatgccgacgtttgtgctcatgaaggaaggaaaggtggtggacaaggttgtgggagctgccaaggaggagctgagcgggaagattgccaagcacagtgcaactgcatgcgctaaataaaatggcccttcaactctgaattcgagaataagatgtgtgtcagccgctgcttgctactaccgctcaactcatggataagctggcaccggtgcagatagggtacgtaatgtaatgttaaaccctgttaatcgcgcggcgcacacgtactggcgacaaactgtatgtggtgataacatcggtccacgaataaaaaagaaaccccgtgtgcccaaggttc

SEQ ID NO: 22967 - DNA, 866 bp, Triticum aestivum
  Clone ID: PAT_TA_22967
tccatcccactccccctcccccaattccaccctcccctcccgcccccccgcctaaaaatccagtcttgcttgggggccgtccctccccgcaagcggagatcctcgccgggaggggatcccgcgtcgtccagccccggcgcggcggcctctcctgtccgcgtcctccacgcgttttcctggttccggcgagggagcggaggagaggagggagcgcgcctggatgagctgcttctcctgcttcggcccggccctggaggcggagggcggcgagccggtgcccgacgccaaggacccccgcgccaaggacggcgcggtctcggatcgcgccggatcagataaattgaggctgcagggtggatcagaccctaagaataatcatctaaccatccctcgcgatgggagcagccaaaacattgccgcacagattttcactttccgtgagcttgctgctgccaccaagaacttcagacaagattgcatgttgggtgagggaggtttcggacgtgtatataaaggtcgcctggagagtgggcaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttc

SEQ ID NO: 22968 - DNA, 594 bp, Triticum aestivum
  Clone ID: PAT_TA_22968
gaagattttatacgccctctatgatcccgcccatgcgccgtgaaagctaccgccggccggccgccgccgcaacgccatgttccaactccgagcgcgtgacctctctttcctcgtgcactcaccaccctgtctccccgctccccgcgtctctcccctcttcgcccttcgccgcaacctggggcggcaccacatccgcttcaccaggccctttcgccgccgaggactacctggtcgccacctgcggcgttccccgcgcgcaagccgtcaaggcagcgaagaagatatcccacctgaagtcctcctcgaagcccgacgcggtcgtcgccttcctctccggcctcggcgtcccccgctccgacatcgccgccatcgtcgccgtcgacccgtggttcctctgcgccagcgtggagaggaccctggcgccccgagtcaccgagctgagggagctcggcctctcgcgctccgaggtcgcgcgcctcatcccgctcgccctgtgctccttccgcagcagctccctcaggggcaacctcgacttctggctctcggtcttcggctcctacgagaagctcctcaaggccctcaagatgaactccg

SEQ ID NO: 22969 - DNA, 803 bp, Triticum aestivum
  unsure (1)..(803): unsure at all n locations
  Clone ID: PAT_TA_22969
gggcgatncgagtacganggccgggggttcggccagagggtattctcaactcccggctcagccttcccttcccttccctctcctgcctccgcccactccactcagtgctccagaagctcggatggcggcccagaaggtggtgctcagggtcccgaccatgaccgacgacaaggccaagcagaaggccatcgaagcggtcgcggatatcctcacctttgattccatacttgcacttccctatcctctccttcctccacccactccactcagagctccagaagctccgatggcggcccagaaggtggtgctgagggtcccgaccatgaccgacgacaaggtgaagcagaaggctattgaagcggtcgcggacatctacggtattgattccatagttgcagatctgaaggacaataagatgatcatcataggcgagatggacactgtggcaatcgcaaagaaattaaagaaggttgggaagattgacattgtgtctgttggacctgcaaaagaagaaaagaaagaagagaagaaagaagaaaagaaagaggagaagaaagaggaaaagaaagaagagaagaaagaggagaagaaagaagagaagaaatgattcagcatacaacaccatcccatggcctttctcctgtgtgcacttgcaatagctttgactacagattgatgtttctaagagatatgactttgtaccatttatatataaagtacgtacatattagtgacgtttctttacagaaaagaatacactttgttcttccatttcttaaaaaaaaaaaaaaaaaaggccccta

SEQ ID NO: 22970 - DNA, 1498 bp, Triticum aestivum
  unsure (1)..(1498): unsure at all n locations
  Clone ID: PAT_TA_22970
ataccctgcgtcctctgtgttcgtcttcctcctcccgtggcaccgcaaccgcagtggtagtgctacagtgccaagcggcgggcgggcgtgcgggcttctcgtggcctcgacgcctcgtgtcgtctgatctgagcgagtagagcaagggggcggcagcacggaggggattcccatcgcgcgcgggggtcgctggctgcttcctcgctcgaagcgccgggcgtcagggtttaccaacaaaactttacccagctatgatgaattagccggagaataatcgatggcgactgaggtcgatcaaactttttttgcgtggtcacaaggagaaacaactgacctgggtgtttctgaaggagtttctgtatcccagacactcaatcatggttccgtgtccttcggaaggtttgaactcgagtcactatcttgcgagaagtggtctgtatttagtaatgacaaacgccatgaagagtttgttaagctcaatggtttagtagctcagaagaaggcatattttgaagagtactacaagaagatcagggaactcgccgctccgcagctgcgccggccgcagaccgcgcttcccccgcaggaccggggtcatggccccgtgtctagccggacggagctgctcccgcatgaagagcttgaaactcccacaggatctggaacaattgtgtacgattatgtggaggaagctgcacatgagaccacatctgatcagggcatgcaatgctatcatgaccatgaagatgaggacttccggaacgaacttccctcctccatgctcggttcagatgccacaatcgcccagctgtccgaccagcccgggagagatcatgcccctggtggtaatccggctgccgccagtgtggcacttgcaggtcttggtcatgaaggtattggagcagcttatgaaaatgcaagggtttctagaagaaatgccgagaaagaccccagacttagatatgcttccttgataataccaaaatcggttaaaaccgttgcaggcagcactctggaccgcacatctgttactaagacgcctgggttcagcaaaacctagcatgactacaaaccagaagactaagacgaacaatgcccgtagctccgagtgtggcatctcaagaagataaccggcgcgacacgttactccgcaggattacagaaaaagaagctcccggggttacaggtgtcaaaaggcttcctcagctgccggggctcactctatcggagagaacacccatcaacaaggcaaccgtttnagaacctgctgattctccacccaagacccttcctctggccgaaaacccctgtcacaagaagctgcacagaacaaccgcttngccacgcangccngcttcaactctgaaaaacccccnttnacaaagaattcaacaancntcggggttaaggnaangtcggccctaaagagaaaacctcgtncaaggatattcagaatctacaagaacaggttaatntggcancaaggtttgnaccagnt

SEQ ID NO: 22971 - DNA, 760 bp, Triticum aestivum
  unsure (1)..(760): unsure at all n locations
  Clone ID: PAT_TA_22971
cgccgccacaacaccaacgtgtccaacgggnccaggctggtggtgctgtcgtacggcgacgccgtggagctggtgatgcagggcaccagcatcctcggcgccgagagccacccgttccacctgcacggcttcaacttcttcgtggtcgggcaggggttcggcaacttcgaccccgccaaggacccggccaagtacaacctcgtcgaccccgtcgagcggaacaccgtcggcgtgcccgccgccgggtgggtggccatccgcttccgcgccgataatccaggggtgtggttcatgcattgccacctggaggtgcacgtcagctggggcctgaaaatggcgtgggtggtgcaggacgggagcctccccgaccagaagctgctccctccgccgtctgatcttcccaaatgttaggaagagattgcgtcttctccaatttccacaggacattcgtccgcttttgcttgctcgcttgcgtgcgtgcgtgcaaaactgcttttgcttgtgtgtggcgcgtgcgtgcggttggtgccatcaagtgctttcttagctgtgtgctctttaactttcatgtcaagtcctcatctgattaactgttgtgaggtttcttgatcagaagcaagaggcttaggactttcgttttggactgctgattagtcgccatcttttgtaacgtacgggagctgggtcatatgcccatgtgcctgtccaataatttgtaccaacatatgattcatggcaataagattgttattggttattt

SEQ ID NO: 22972 - DNA, 1498 bp, Triticum aestivum
  Clone ID: PAT_TA_22972
ccgtccccgtcgtcctcccccaacggtggctgccggacaccgacgccatagtcaccacggccctgatgttcggcggagcccccaacatcgcccacccgttcccgatcaacggccctcccgcgccgctctacaactgctccgccaccgacacgttcaagctgaaggtggagcccggcaaaggcgccctgctgcgcctgatgcacggcgcccgcatcgtcgacgccgtctgccacccggccaaccacccgctcaccgtcgtcgaggtcgacgccctctacgtcaagcccttcacccccgggaccctgcccgtctcccccggccacgccgcccccgtcgtgcgcaacaccgtccccgcccccgccgccgcctgcgtggccatccgcgcccggcccgattcccccaggggtgcgggccatgcattcccacctggaggtgcacgtctgctggggcctgaaaatggcgtgggtcgcgccgcgccgggccccccccagcccgtgccctgctccctcccccggccgatcttcccaaatgttaggaagagattgcgtcttctccaatttccacagcacatccgtccgcttttgcttgcttgcttgcgtgcgtgcgtgcacaactgcttgtgcttgtgtgtcgcgcgtgcgcgcggttggtgccattcaagtgctttcttagctgtgttctcttcaactttcatgtcaagtcctcgtctgattaactgctgtgaggtttcttgatcacaagcaagaggcttaggactttcatttccggactgctgattagtcgtctacgcggccaacttcccggccatgcccctgtcgccgttcaactacacggggacagccgccgaacaacacgcacgtggccaccgggaccaagctcctcgcgctgtcgttcaacacgtcggtggagctggtgatgcaggacacgagcatcctcggcatcgagagccacccgcttcacctgcacggcttcaacttcttcgtggtcgggcaagggttcggcaactacgacgccgtgaacgacccggacaagttcaacctcgtcgaccccgtcgagcggaacaccgtcggcgtgccggccggcgggtgggtggccattcgcttcctcgcagacaacccaggtgtatggttcatgcattgccatttggaggtgcacacaacatggggtctgagaatggcgtggcaggtgcaggacggcagcaagccgagccagaagctgccgccgccgccgtctgacatgcccaaatgctgaatggacttcatcacggctgatgcttaatttgcgccccctcattttgatttactcgccaatctgcgattgttttctcccgcgggagattttagtgtgtttagcccgttcatagctgactttcttacgattctttttccattttttgccactttctgatgaagatgttttgatacttgaataaacaatgatgtgaagaattgcacgagaaaatatcgatatatttatttttgtgagcaaaaaaaaaaaa

SEQ ID NO: 22973 - DNA, 699 bp, Triticum aestivum
  unsure (1)..(699): unsure at all n locations
  Clone ID: PAT_TA_22973
ttcggcacgaggctcagnatgccccgcccggcgacggcgaggtggccgcggccagcaccgtgcttgatgccatcgctacaaacaagaagtctgaagacaacgtgatggcaatggagtcaaacattcagtcccagcagacggaggtgacggcgacggacgagacggacagcgacgacatcgaaggcaactacagcgatgatggcgacgacgacggcgacggggatgacaagatgaagtacaccatagagttccagaagcacaaagagggcggaagcggtagcgctcctgctgccccggcgacagctgcgacggtggtgacgagttcggccccgacaggcagcaccttccttgccgttcagtaggcgcccgtgccgaaagaaaaccaggcaccagcttcctcttcggttcatgagcaccagcagcccttggcaacatcctataccatttgttgatttgtttctgtaatagcaacctcagtggtcaaaagacaaaaagaaaaccaaaccgaaataagtggctcccctctgtgatttcataagtagactggaaaacaggggaggtgctagatcaatagaaatcccaaacagcaagtcttttttataggaggcttattatagcctaaattttaccatttatgtacattgatatagcattctgaaaactggagccctctgttttgcctattttattttattttca

SEQ ID NO: 22974 - DNA, 1394 bp, Triticum aestivum
  Clone ID: PAT_TA_22974
gaattcggcacgagtctacctccaaataaagggctcgccggcggcggaagaggtgtgtggcgagcgagcgaccccggaggagcacaaacgaagatgcagagatgcgtagaggacgactgtcggcgagcggaggtgtggtgcttccagctacagcggcagcctgtggatgctggcaagagctacaaccatggcggccaggtgctggaatccgcacaaatttttgcttcaatcggcgttctgttttttgctgaaactagcgctgttctgtagtgggtttgctaccaccgttttgtattttgctggaaccagcgtcgttgggttgctgccaccgcgtttttgatttgctggaaccagccctcgactttgcatctttgctaccaccatggtggccagatgctggaacccgcacaattttttgcttccatcggtgttttggttttactgaaactagcgtcgtcttttgtattttttgctaccacccttttgtattttgctggaaccagcgttgatttttgctaccatcgcctttttgatttgctggaaccagccctcaactttgcatctttgctaccaccagtgttctggtttgctagaacaagcttcaatttttgctaccaccagggtttggtttgttgggacgccgtctaatttccgatatttttgctactaccgtttcttggtttgctggaaccagccccaatttttgctacaactgccgtttgctgcgagaccacggagttgtcgccattttcttctacagaagggcgagggagggggatgggcatcaccggtgagcaaattgagggcgaggtacggcgcgagctcgacgacggggtgctgcggccatctccaccagggttgccatggccggtaagcacggtcgcccaaggatgcggcggcgagcgtgggttgccggtgaacacgatgccgagaacgagcgtggggcggccaaggatgcgtcggcgagagcccgttgccggcgagcatgaggccgtggtcgagcgcgggcggcccaaggatgcgtccggcgagagcgggttgccggcgagcatgaggccgaggacgagcgcgggcggcgcaagtggaaggcgagcgcggcgctggggaaacttgcacgagacggtgaaatacagggacctgcgccgagggcgagatgcgtcaggaggaagatgttgcccggggcgtttccctttcccctttttttccccccgccgccagggctggtcgccgcgggcggccagccggccccggccgtgacccggtaccgccccattttgccctatcgttcgtctgccccttggattcgttctcctaaccccctttctgctccgtccaggtcttgctcccccgctgtgagagaagtactaactagtcttctcttctttcccggtgtt

SEQ ID NO: 22975 - DNA, 1077 bp, Triticum aestivum
  unsure (1)..(1077): unsure at all n locations
  Clone ID: PAT_TA_22975
cccacgcgtccggccgcgccgctggggctcgtggcaccacggattttcaaggggaaggagcaatgacggggctaggctccaggcggcgtacacttcatgggaaggtcgaaaaatagagagaccggatggaggtgctggaggcgaaggaccgcccgtcggcaagctcgagctagagacgcacagttagcgtcaccggccatcagatgcataggagcatgaggcagcgctcccgtcgctttgtggtggagctgcataggagggggaggaggctggcgatagggaaccgggccgggaggaggcaagtatgaggatcgggtgcgtcaggaagcagctctgaatatggttcccgtagatgaagataaggagaagccgcttatttcactggccaagtgagctgggagccggggtcatccctctcaccaccaatcgaacatactacttcaaccaccatgtcgagcgatataaaagggttctctgtttcattgngcaacgnnacgagactgtgccccctcttgctcctggtgcatgttgctgccctcctttcccctctgacttgacttgctttacattgtgtgaagttgtttaccttcaactttacaaagctatatcaagttcgcaactgtacttggctacacctataacatgatgcatttctcttccaagtttattgaatatatttttatggattgaatgtccaatctgggtactgttctatcactcatttaaactaccttaaatgtgttcacaaaaactccctcctggtagcctaaaaattccttttggttcaaacaacaaccctaaattaattgnctccttantccntaaaatccttaatttcaccttttatttcaagcctggaanggtnggggttaaaaattggtttttggtgccaacaaaacaanaacaaggcnatngctcctaacctttgggaancaaaaaantggnctaaaantttcanaaacaaagggngggggaanatcctttgannaaggttcaatttaaaaaacctggagnttgacccggtngggggtggctnctgggcanaaattctttgggatgnaattctnagggnaaaaa

SEQ ID NO: 22976 - DNA, 2050 bp, Triticum aestivum
  Clone ID: PAT_TA_22976
atcacgagaaagaagaaacatccaattctgtcagcagcaatggtctagacccaaaccttgatgatgcttcagatgaggaaaaatttagctgcgcagatcctgaattttttaactttgacgaacttcgagatgtaagtcagtttagacccaaccagatctgggctgtctatgatagtcatggctgcatgccaagattttatgctcgaattacaaaggtaaaaatggccccaaagtttatagtacactttgtttggctggaattggatcccacaaatgaagcagagctggcatggtcacgcgcagaactgcctgttgcttgtggacattttaagcatggaacatcagacacagctaaagaagctaatatgttttcccaaactatttcctgtgcgaaaagcaagacaaaaaactcgtatgagatatatcctaggaaaggtgaagtttgggccctgcacaagggatgggacatcggctggagttcggatgctgatagccacacagattttgagtatgaacttgttcaagttgtcacggatttcacaaccagcactagcatcattgtcgtgccacttgtaaaaataaaaggctttgttagcttatttatgcagtcgaaagaggcaactccatgtgtgatacctcaggataacacactaagattttctcattgcgtccctcatcatctcatgcgcgggactgaaagagaaggcattccagaaggagctattgaacttgatcctgcagcgcttccccttaacttggaagaggcttttgcttctgttgttctggaaagcacagtaaaaggcaagggggttcattccatgtatgccggttcatccagggggattaattctggcggggggtctgagaaggtcggggaggtgccacatgctacatgtatgaatacagggctctttacaagagcaacaaaggaagagaacaaagagcatcatactccatctactgtagaaggtgtggatgttaatgaggaatctgatggcattgtccaggatgaatttgaatgtcctgactcagaattctatgaatttacagaaataaggtcgattcagaagttcgaacctgggcagatctgggctctctatagtgatatggacaagttccccaattactatgccatcataaagaaagtcgatctcaagaataataaagtacaagtgaaatggccttgatctctgtcctcggggagaggaggagaaaagattgactggtaaagaagaccgccctcttgcctgtggaatctttacggtttccggtgaaaatgatgctattaagacttacactggtacacaatcattttctcatcctgtatgtagtagcccaactggtagagagaaagaatttgaaattattcctcttcctcgtgagatctgggccgttgacatgcgccgcggggctggatggactgcgcacgattttaaaaattgtgactatgaattggtggagatattaacccatacggactcgtccatacaagttaagctgttgagaaaggtggatggtcacaggacagtatttagaagagagccatctgtggaaacgatatgtaaggatgagtacttaaagttctctcaccagatccctcgcttccatctgacaaatgaaaaaggaggcaagcttcgaggctgtttggagctcgatcctttctcggtgccagagaggtttctcggcattgattcagtgtaagataaccctgttcatggtggctctttggatggctctcttttcggaggaattacaagactgaaggttgtgcggaagttgatcaaaccgtgtttcatgctgcccagagttctccatgtcccagtgatgttatgatgtgcttgtttactcttcctgcagccggtgcctctaagatctagttagaggcctgagatttattgcagctgctgtttttacttttggtccggttattgaactgatactcttccttcgctcgtagtttaactaaaacgtgtagtagtatggtttaaatgtgatggattctggatgggatctgcctaccccaacttgtttgggataaaagctttgttgt

SEQ ID NO: 22977 - DNA, 690 bp, Triticum aestivum
  Clone ID: PAT_TA_22977
aggattacttgtcacaaaaatgaatgtatctacaactaagatacatctagatacattcagttttcggacgagtaattccgaacggagggagtagatcgtaattagtttgccttttttgttcgtgtgtgcagcttgggagatcgaagctgaatggcggcgcgacgagctcggggctggtgttgagagtggacgcaccatagcacggttttgggcggtcatgattcaggcatgtatagtcgatgctagtaatggcttgacagaggactcgaacagactctttatatacatgttgcaaacaacatacaaatcatatgattggctcaaaatgtggaaaagaaaaccttgaaattgacatggtcagctagatctcttggcaggaatgcaccgctcctgccccttcggacatttctgtatgtttttttgcttgaatgttagtgttttctctgacctatgtatagtgtcaacaaagatcttaattaccacatggagctgcattttttggcggcatcttacatcacagtaatttacaacgaagataggtttacagtgtcttttttatagcaactataatgcataggtgcaaatattgtcgaatgcacatctgtattttgtatgcatgacagattctatcttcggtagtgttatctatctagtctgatttatacactgcattcctaagctgaaatatat

SEQ ID NO: 22978 - DNA, 1743 bp, Triticum aestivum
  Clone ID: PAT_TA_22978
tgtaacttaaatatatagtccgagtttcatcgagttatttgtcactttttaattgaatatctttttgtaactgaaaatatctatgaacttacagtgcatatctaatagggcccttcccagcgagacctaagtttaaccgaatatcttttttgtcgatcgtcgtaggtttttatgccccatgtatttaactgattatttacgtctctgtcgttgtgctggcctccaggattgctaagtaatgacctcattttctgtttgaagtacataatcagggtttggttcaagactttgcccagctagtactcaacaagccgccggtgttgcttgcatgaaagaagcaccaagaatggctgttgttcgtcgagcgtggtaccacctccgcacagtcttgcgtgggccaatacttccatgcgggtggccgtagatccctctggctgcagacgttatcgccacaaggggttgcgggggcattgatggacaggcggtgcgccgacggggcgctttggttgatggtgtcggtcaggtggtggtcccggtccttgttccggctgcgcagactctgaggattgcaatgcgggagggtgttcccaagggcggaatggggctgagcttctcctcagggatcggccgcggtgccgtcctcaccctggccgtccggcgggctgacggcgccgtctcagtccggcttcccgagcttggctccggcaggagctgcggcggcatccggcgtccagcgctgggtctcggggtgtgccctcgccttcagggagcgggccggggaggggcgcctgccgtgcgggccggctgggttggcgaggcgctcaacagcgcctccgccgaagccctcaccgaacgtgcctacgcctaccccgccgtcgtccgttggggcggcaggggtggcggccgcgctgccgaccctggccgcgagttgagcgtggttggcccgctgcgtggctccgggcgctctctgtgagaccggcggcagaggggcgccgcccaggtcgttaaaattggctttggctctggccgtgtcggggacgccgccaagcgacccgctgccggcgtgctgcggcaaggccattgctgatctcgtgcccttgcccagggcaggggctgcggctgcggccggcatggcccccatcaagccgctgttggcttcctcacttggcttccgcccctcggtcgtggccttgggctctggcccggcgccggcgttgctaccctcggcggcgtacgagatggctggccccgccacgagggcgacggccaccaagagcgccaccgtacactgctgcaccgccattgctgcttctcttgtcttgcgttggttggtttgcacactacgtaggaggagagattgtgactcagggcaatggataaaatctagatgctaagttgttttttttctgcggatttggttatcgtgaagagatgcaccaagggttaattgctacagatactgaaaactttgaaactagtgacggtgacgaccatgatcgtaatcacaagcaccgaagaccactgccatgttcctgcacttaacattttcaatcgctgcattgaaatagtatgatctattacttcacattttctgtaccatgaggacaactgtcacattgtgccaatatatgtgtagccttgaaaggtgtcctgtagtgtctggagtaaacaaaatgaggacaactgtcacattgtgccaatacattttcaatcactcacaaaatgttgaaccctcaacttctc

SEQ ID NO: 22979 - DNA, 1002 bp, Triticum aestivum
  Clone ID: PAT_TA_22979
gcaagccaggcctcctggatatgaatggagagagcgctgtaatttaatcaaaggaattcgtgagcgttttagttatctccactagaaccatattgttcacctcgacgtaaaccgacatatatactttatggaatataatatggttcctaaaatgactgactttggtatctcaagatgttttgatgaaacatggccgggttattacttcaaacgtgatgggattagtgtttcccggctaagcctctcgaaagctctcaagctctttttttcagggttcacttttatattatggattcattatcttctcatttcatgtaggggatatgttttacgagaagttcttttcgatggaattgtcgcattcaattggaacaagtacactcttagtcgtgatgtcgatcattatcgaggcactgacgaggataacgtgttattatcagatcaaccatctccgcagccgcaggagccgtcgatgctcaacggcgcggatgcggccgtcttcccctctgctgcagcagcctgctttggtccggtgatacataatcaccggggaagggtgcacaggcggtgaacagaggctactttgaatgagttcaaattcctaaaggagcagaagccatggcacttcgtcaagtcttaatccttccacagtaacactggtattaggaagatcatggtaggttaacaagatcaatgagtttagggttttgataggtcccctactggagccatagtccatgatatgaaaaaatgtgccacaaagtttgtatcttgtacttttatccatgtcaatcgttcttgtaggcactaggcacaacatgttctggtatccatggagcatgttcttgtaggcggcatatgttcggctaaatcggcagttggcttaatgggttccctgatgtaataaggatcattatatgtaatgaatcagttatgaatgaataaaagggtgcaactgcccattaccttaaaaaaataaaaaaaaaaaaaaaaaaaaaaaaa

SEQ ID NO: 22980 - DNA, 915 bp, Triticum aestivum
  Clone ID: PAT_TA_22980
ctcgtgccgaattcggcacccgcacggttccagcaatggcagctcagaccggagcagtgctcctcctcgtcggcctccttgctcttgcaaccatggccagcagcaacactgaaggcgacatcctttactcgcaaaggcaggtgtggaaggatcccaacaacgttctgacaagctgggatccgacgcttgtcaacccctgcacttggttccatgtcacctgcaacctcgacaactccgtcacccgagtgggatttggggaacgcaggcatctcaggcaccctgattcctcaactgggacaactgaagaacctgcagtacctggagctatacgggaacaatatgagtggaccaataccaacgaccctgggcaacctgacacgcctggtcagccttgattttctacgacaaccatctcaccggagtgataccttcctcgcttggggcagttgggacactgcgtttcttgaggttgcatgggaacaaactggcggggtggtataccggcgtccttggcccgtcttgacgaaccttgctcaacgcggagcttccaggagaacatgctgagcggcacggtgccgcttggagatcctctcgcttgttcttgtcggggacttgactgaactaaatgttgcggaaaaacaatctggccggcacttatcaaatcttcttaaaccaagagtggctactgtgatccaagacacgcgcaagactacactctgagtagcaggccctcctgaactcctgcaagaataaattgaataatgatttttccttctgaagttgctggcagtagttatagctacggcctgagcttttgcagaccactgttccgttaagagtccatacaaaagttgtggttgaatgcattgtagtccctttggtatcttcagaatatttcaataacttgaaaccctt

SEQ ID NO: 22981 - DNA, 1017 bp, Triticum aestivum
  unsure (1)..(1017): unsure at all n locations
  Clone ID: PAT_TA_22981
ggcccggcgcggagcagcctctcccgggctgacctctccttcctctccccctatccatccggcggcaccggacaacccgcccatcgatgccgcatccttcacccacaccccgtactactgtgaagaaaatgtgtacttgctatgtaaggagctgattagagctggacttgctgatcctgcgggcaatgacctttatcctattttcatatcaaatgaggaaaagaagattcctctctggtatcagaaagcaagtcgtactaatgatggatttgtcttgtgggattatcatgtaatctgcatccagtctaggcgaaacaaaggagatgttcttgatcttgaatgggatttggactcgagtcttcttttcccttgtccattcctccagtacgttgttgatgccattcaaccactagcatttggcgactccatctatggaagacttttccgtgtagttcatggtccagtatttcttcgatcatttgcatcagacagttgtcacatgaaggaccccctggcggatgccactgggtggcccccatggggtgtgccgatgggcgcccccgatggtggcccctttagcccgaaggtgtacatagccctgtctactaatgatgtcggagacctggaaagcgtggttaatgatgtctaccacaacgaacatggtgtggtgataaacgaaacgttgctccccatgttcttctcccnggttgcctgaatgacatccttcagaagagagctctttgagatatcttgattggcctgtccgaattttctttcgcnggtggacaacggtcgagtacttgtagtgagtgagatcttatgaactttgttaatctgcggtatcgcgcttgtctaatgatgtcgtgtcaggccgtaatattattttgaagttactattgctgtgagttactcaaatctgtaatgatgaaactattgggtcagcattgttttgatcactgaatatcaaggacccatacctaccaaactttttgattactgaaaaaaaaaaaaaaaaaa

SEQ ID NO: 22982 - DNA, 1105 bp, Triticum aestivum
  Clone ID: PAT_TA_22982
aataagaaactaaaatgggctgggctactattggatgatgtcacctgacttaaacttcgtgaagtctaagtcgactgagatttagacaaacccttgtatgtatggtactgacagatcatagcaaactgtgtctttagaaccttaagactctatttactagctgattgtaaatttggaatatatccctttctgtagttaacgatgatgagagaactttatcatgcccatgcccagtggataccaaatcaatggtcgccaaatgatagagagcaatcagtccaccggatatagcgtagcataccttctactcctctcacgatgcggccgtggcggacaaggctcctcttttgggggggtttcaatgtccatcggcagcgaaaatgggaccggacgcggcgtcggcggtggacgaggttcctcctttttgggttgttcgaccatcggtggtggcgatggcgggatcactatgctccaccacggcgggaggtgcccaaacctgacgtggaaccgaagccagagctgccacccgtgcccaagggtgaggagccaccaaagacggagctgccgccgccgccaacaggtgggatcccaccaaagccggtttcgccgcctcttcctacaggtgagcttccgcccaagccggagcccgagctgctgcccaagacagacgagccatcgaagccagagcagcctccacttccgaccggtgagattccaccgaagccagaggtcgagctgccacccaagacagaggagccaccgaagccggagctgccgccgcctccgaccggtgaccttccaccgaagccggacgtcgggctgccactgaagccagacctgccgccgctccctaccagtgagcttccaccgacggcgcagccgccactgccgaatcccgcggaaccaaaaccatgatcactcaaccaccgacgaatccatgcatggtccatgatatgtttgagtcctgtgtccattatgacgagctaccgtggcatgcctgacacccgtgatttgtttgtactacgtcgtacctgctgagctattgggagtgtttgagatcttattatgcatacatatataataaaatggattttcgttcgtgtgt

SEQ ID NO: 22983 - DNA, 1246 bp, Triticum aestivum
  unsure (1)..(1246): unsure at all n locations
  Clone ID: PAT_TA_22983
gcttccgggatcgccagcatgtcgtcgtctcttgcggtgctcctcctcggcgtgctgctgctctcccgcggcggcgtcggcaacgcggcgcggcacctggcggaggccgagtacccaccggtgccgcctaatgtcccggcgcctctgcccaagccagacgtgccgccgccgttgcccgcaccggaggtgctgccgaagccggggctgccaccgcggccctggcctcggccaggctcatcttgtaccatgcccccgccgtgcgacttcgtgccgtccgactcggctccccttgcgacgtctgcattgaggcatggcaccggcagcagatggcgtactcacccgggatatctcttttcctccctcaactagctgatgcgaacgtgacaacgaattcgcacggggcggaagtgttgccgaaaccacgggtgccaccgctgcccacacctgaggagcagcccaagccggacctgccgcctttgcccgcaccggacgtgttgccagcgccgccgttgcccgcaccggacgtgctgccgaagccggagctgcccacgcctgacgagcaggcccaagccggagctgccgccgttgcccaaaccggaggtcccagccgacggtgccggaggtgcccaaacctgacgtggaaccgaaagccgtagctgccacccgtgcccaagggtgagcagccgccgaagtcggacctgccgccgctgccaacaggtgagatcccaccaaagccggttcggccgccttttcctacaggcgagcttccgcccaagccggagcccgagctgctgcccaagacagacgacccaccgaagccagagcggccgccgcttcccgctgacgacgtgccaccgaagccagccgtcgagccgccaccgaggccaggcctaccgccactccctcccgcttcgcttccaccgaagccggcgcagcccccactgccagctcctgccgaggcaaaaccaggaccagtctcatcaagctccgaatccaaccaggcgtctgcatccgtcttagccctgtgtctcgttgcaagcgccaccgtccttgccctccatccgggcatccatccctgatcggtgctgccccctcgtcccgcacccttccatggcgcgcgtccctgcctcgccccgcatccgtgatttgtttgtactacgtacctgctgagctattgggagtgtttgagattgtatttaataaagtgganttcgtgtgtgtgtataaaaaaaaaaaaaaaaaaaaa

SEQ ID NO: 22984 - DNA, 1123 bp, Triticum aestivum
  Clone ID: PAT_TA_22984
cacacactcacgggctcacctcctctccctctcgcccatgaagtcgccaccgccgccgccgtccacgccggccgcattcggcgagctccagcgccacacagcacgcccccgagcctccccaagctccgcgcctccctcccctctgtactgattctccgctcccggcctctactgcccgctcgcaaccacacccccgtggctagggtttcgggcagtgcttcgccggcccgtctccggcggccccagatgcagatggattgcctaatgggatttccccatccaccacgctcgctgccgtcaagggcaggaaggaaccctagccagcagcacctcctcacctcggatgatgcctctgctgcaccaagataggttatttggttcatcgtcgcgcctcaagtttccaacagcgccgtggctgtacaccgtcgacttcgccggaaatccttctgcacatactctactgtccgccgaaactttgtctgacctgagttatttggctcatcttcacgcctcaagtttccgatagcgccgtggctgtacaccgccgacttcgccggaaatctgtctgcacatactctactatccgccgaaacttcgtctgacctgagaaatagatggcgacggctcagcggcgtcgtggtgaatggcgaagcttctcaaatggacggaagagaggtggtgacgcgcggctgggagacgtgcatatttaacgaaatacgattcataaggtttcatattaacaaaaaatgatggtctttgtagagtaatatgaacattttgttgattccaggacaactttattctccaatacgaatctgtaagaaaagatatgacatacatttgtgcaaattcataatgtaagctcatctcgaaactataatcttttttcaagtttgagagagaggcggggtcgagaggccagagagggaggcccacatctttgaggaaatacgattcatatggttgcatattaacaaaaatggatagtctttctaaagtaatccgaacattttgttgattccgggacaactttattctccaatatgaatttgtaagaaaagatatggcatacatttgtgtaaattgataatgtaagcacatctagaaactctattattttttc

SEQ ID NO: 22985 - DNA, 914 bp, Triticum aestivum
  unsure (1)..(914): unsure at all n locations
  Clone ID: PAT_TA_22985
ctcgtgccgaattcggcacgaggtttcaaggaggtttggaatattgtggcgcgttatatgaacgcgcgcgggagcaggtttgacaagaaaaacaaaatgttaatactaccttctgcaaccatggctgctctacccttagcagaacgtgctattctcgttaaacccattccattcttcgaccatttgcaagctctcttcagcgattgcctagttgatggtgcctctatgacagacctgcttacagatgctgacttaaatgatgatcagatggaaacccaggatccgttgaacatgatggttgttcatgcagacacaggggacccacacgaggcaggcttggacaaagttgttttggggggtgaagatgagtgtcatgaggttgcagttattagcgccgttggtacagtaccatgtgaagttatgtcaggcactagtgcaccatctgctgaaccatcaggatcggctgagagcacaatagctgctctcaaacccagcttgaagcagtgcaagatagtcaagcaaagcaaaagcaaatctaaagccacaggctgttgcgctacatgatagcaggaaaccagacgcgttcaacaggaacttaatggggatccatgacagactcgctaaaccaacacggacagcaccaccactgtcagacccaaatgctcctctgtggggacatgctaaaggaaattccgttgacacctgctgataggctgtcangttgggattttcttcgttgtgccggcccctgaagtcctgcgaaggttgccatccgtatgggtttggtgcaccgggacgcatgggccctcaaagcgtgggtggcccggggtaccgccagccggggccccgactgctgtttctcggccgatgccttgggggcaaccctnggnaggccctttataangntttnaatt

SEQ ID NO: 22986 - DNA, 802 bp, Triticum aestivum
  unsure (1)..(802): unsure at all n locations
  Clone ID: PAT_TA_22986
tcgcgatctagaaccaaacgcgagcagagagcgcaacacgaagatggcgacgatgtccctcgccgcggcctcacccctcaccgcctccactccccggggcctcgccgtgcccgcgccccgcgcgccgccattcctcgtcccccgcgcatttggcgcgccggcgacgcggttcgcggggctggcggcggcgccgcggccgtcggggaggggtgacgcggcggtggtgaggatggcgaagagggagcaggagctggaggagattcgggccatggagacggagaatctggagcaggaggtggtggacctcaagggggagctcttcctgctgcgcctcaagcgctccgcgcgccaggagttcaagtccagcgagttcggccgcatgcgcaagagggttgctcgtctgctgactgtgagaagagaaagggaaattgaacaaggaatcaacaaaaggaattctaggaagcttgacaggaaatggaaactgggtattgtggttggaccaccaccatctctaagggagaagaaggaggaggagtagaaaacagcaaaaacaggcaatttgcacaagtcatttcaccccttataatggtttgttttgtaatccagagtacagctttcaagtccttgctgttaaaaccagaacttatgttaccatttttgcgtgtaaatctcagttttatttgaaatttctgctacttctttccgtgtttactgtatatggtcttctataattgacatatgaaactatacgtgtaagaagattatgctaaaaaaaaaaaaaactaagtagccctccgtntag

SEQ ID NO: 22987 - DNA, 613 bp, Triticum aestivum
  Clone ID: PAT_TA_22987
gagcggtgaaaaccctagccaatcctctctcgtccccgcgcctccattatcctccctccacgctatcctcccgcgcctccctcatagccccggcgcggcgccgcctccaccacctcctcctctctctgcttgcctcctctctcgctcaagaaggcggaccgagcggcggcggcatattgtccgtagatggagaaggcggacacgagcggcggcgccatcttgtccgcggatggcagacgtgtttcttgccgccgccgctgctcctctccctcgcctcctctgcgacgcttactcctcttctcttctcccgctccagtcatggcggtggcggccgggccaggcagggcggcggcggccgggaacggagaagcggccgggctgggagagcgtcctcgtcgccttcaacctccccacgcgagagagacattagtctgcaattgtactcaatgaacgatagcagttttgtttgcaaatagagaggaaaaagtagggacggtgaagccttgggttacatgacaaatgcaaaaaacttttcaaacaggtgtgcctgcaatggaacattggatttcagcaatattattggttctgcatacaaggatactatcaaatggag

SEQ ID NO: 22988 - DNA, 826 bp, Triticum aestivum
  Clone ID: PAT_TA_22988
gtccaaccctcgcccctccgcctgcgctgctgggcactccctcctctcccaggccgccgccctcgacacgccgccagggtgccatcgacacgtcagggataggcagtggtggagcgcagcccgagcccagcagcagtccactcctaacccgaagcaagagcgagcagcggattggatcaagggagccctcgcggccacgccactggcgcctggatttgctagccgtcgcctggatccgccctagccgccgcctcgagtcacctccatcgttgatgtgggtcaaccccaccgctgccgccaggaatcccatcccggcaagggggcttgtccttcggtggtggtcatccgccgtttgagattggagggagactaggagaccctggcggaatcgagcctgctagcggaggctccagggatgctgggtgatagggcccattccatgccccggttgtgctgctgggattttcaggatgagccttcctatccaaaattatcggataaattcaacatatctgtggaaatctagttttctgcagattcagacgactctgaatgttgttccataactgatgactcaaaatgattatacactgaaaccgaagcctttggaaaatgaaacagaaaccttacttgagagcaggtagaggcgtggagccaatggtgatgttgttgttgcctgctcttctaaactactgcttgttcatcgtttgctgttttgcgtatcaaggaaggtaactactcaaagcagttggcaaggcaagcattcgatggagctcaagcgttgatcttgaaggaaggtaactactcaaaggtatgcacctattca

SEQ ID NO: 22989 - DNA, 432 bp, Triticum aestivum
  unsure (1)..(432): unsure at all n locations
  Clone ID: PAT_TA_22989
cacgannnntcnntccatggattaagtgnncannncangngatccagaannntgcgaccaagagagtactccgtntgacnnncatanngntgnncatgcacatcccannngacannnnccgtatnnnatcgatcaatgaattaagtcaacattacacgtatctacaagaatgcgaccaagagagtcgatgggcatgccctcgtccggcccctgcacgcgccggaggagggcttgccctccccctcgcggtcgctccggcgcatctttgccgtcccccgcaggctcgccgccgttctcgggtcgtgctcactcggtgcatgcctcgtgcgctttccgtgtacggcctttgggatgtccttcggcggcctctcgtgggcccttccgcctgctctcttggtcgcgtccctctggatacatagtaatgttcactta

SEQ ID NO: 22990 - DNA, 640 bp, Triticum aestivum
  unsure (1)..(640): unsure at all n locations
  Clone ID: PAT_TA_22990
nnnnngattagcgtggtcgcggccgaggtacttgctggaagcgctcaagaacgggaaggacgacggcaagtctggcctgaggcagcatgggttgcaccatgtggatggtagccaggccgtgaaagtcctgagaagccggaagtccggtggataatcttgctagtagaacacgttgctgagacctgtaggtgacagacaaggaagaagctgatcttgccgtgccggtgcagactgtcctgatgtcctccttccaggaagcacaatgggaacccaatcaaccctgatgaccgacttgactgacaacaccaccatcttctgcagaaaaagatgcacacacaaactaaagcaaaactccacccacggctcgtgctgcatttcaagatcaacctgtgcccgcaccctgcttccaggaaggtgtttgataaagcatgaggcaaacaactttcttactggatttgacacgtcatcctgtgacaaactggagacaatgacaacacgacgggatgacatatctccgccatctgtccgtgtacctccccgcgcccccgcttactgacctgattacatccaanctaacacaaccgcaaacataatgattgttaanaccctactcactgatgaaattcntcagctactactt

SEQ ID NO: 22991 - DNA, 1961 bp, Triticum aestivum
  Clone ID: PAT_TA_22991
ctccttcttcctctctctctctctctctccctgctctccctgctctctctctctctctctctctctcttgcgcacacaagaaaaaaaatcaagatggttgacacactgagtgaagagaagatcattggatacttcaagaacaagagcatcctcatcactggatcaacaggctttcttggaaagatactagtggagaagctactgagcgttcaacctgatctaaattggatccatgacccggtgcgagcggtgcttcctccgccagctaaacatcgcgtggggcctgaggtgcgagggcaggagttgtacgggcttctgggggagcagcacggggcctgccttcaatctttggtctgtaaaaagagagtcccagtcgccggcgaagcagtgacaccctcattcggtgccgacagcgccaacgttgtagaacgtcggctcgtcgcaggagctcgaggtcatcgtcaatggcgccgccaccaccaacttctacgaaaggtacgaggtggccctggacgtgaacgtggtgggcgtgaagcacatgtgcaacttcgccaagatgtgccccaacctcgaggtgctcctccacgtctccacggcgtatgttgccggcgagaagcacggtctcgtgctcgagagccccttcagggacggcgacgatcgctgcgcgatctaggaacccatctcgagatcgaccccgagctgaatctggccaaggaccttataaagcagcttgaggccgacgacgagttgcttcccaagtcccaaaggaaggccatgaaggacctcggcgtcaccagggcccggcacttagggtggccgaacacttacgtgttcaccaactcaatgggggagatggtgctggtccagctgaagggtccacatgacttgcctgttgtcatcgtccgtcccagcatcatcaccagggtccaaaacgacccactgcctggatggatcgaaggcaccaggacgatcgacactatcatgatcgggtacgcgaagcagaacctgacatacttcttggcggacctcaacctcaccatggatgtgatgcccggcgacatggtggtgaatgcgatgatggctgccatcgtggcgcacagctcgtccttattggagaagacacagtcacatcccgagccacacgcaccggcggtgtaccacgtgagctcgtcgcggcgtaacccggcgccgtacaatgtgctgcacgaggctgggtttcggtacttcacggagcaccctcgggtgggccctgacggccgcacggtgcgcacccataagatgacattcctcagcagcatggcttccttccacctctttatgatgctcaggtaccgcctcctccttgagctcctccacctgctctccgtcctctgttgtggcctcttcggcctcgacaccctctaccacgaccaagcacgcaagtacaggttcgtgatgcacctggtggatctgtatgggcccttcgcgctgttcaagggctgcttcgatgacgtcaacctaaacaagctcaggctcgccatgaccagcaaccatggaagcctctttaatttcgaccccaagaccattgactgggacgattacttctacagcgtccacatccccggggtcctaaagcacatgctcaactgaaatatccatgcaccgaaaatttaggcgttgccttaataattaaataatcgtacgttgtaagaaatatcctcccaaattgggttctaaccgttaaataatctgtgtgaaagagggaaatgtgtctgtcgcttgatagtgcaggcatcaacttgcatatgcttcttgaagaacaaggaatgctacatcatgtagtttcgttctggctcgtgctgtattgccaattatgactagtattggttgataacaatttcttgttcagtcacatattgtaccttgactagtattgattgttaattataatttcttttcaagagaaaaaaaaaaaaaaaaaa

SEQ ID NO: 22992 - DNA, 648 bp, Triticum aestivum
  Clone ID: PAT_TA_22992
atcgtgtcatcttcttcttcctctttccgaggggaagggctcggatcccgtgcgccacttcgccattgacaacaatctatccgcgattcaaacaagaaacagcagcagcgacaccagcaatcgactccgcgagaaccagcaagggggaggatgaaatccttcaagaaggaattcaccctggaggagagggcgaatgagtcggccgccatgatcgccaagtaccccggcaggatccccgtgattgttgaaaggttttcaaggagtaatcttccagaaatggagaagaggaagtacctggttccttgtgacatgccagttgggcagttcattttcatcctgcgctccaggttacatctgtctccagggacggcgcttttcgtgtttgtgcgcgacaccttgccccagaccgctaacctgatgggtagcgtgtatgattcgtacaaagataagcaggatggcttcctctacatgtgttacagcagcgaagaaaaccttggggtgacatctgccgaacgcaatttgggggtacgccaaccccccaatgtacatacgtgacacaaccccttggtgaatgttaactcgcccaccccgccattcccttcagttcactccgctgcccggccggtatgccccgggaaaaaaaaaaaa

SEQ ID NO: 22993 - DNA, 1436 bp, Triticum aestivum
  unsure (1)..(1436): unsure at all n locations
  Clone ID: PAT_TA_22993
cgccggggaccgagcgggggcgcctcctctactccctccccactcccgccgatgctctctgcagctccccctccgacctccgcctcctcctcttcttccccggcacaggtgaagtgttcagctatgcttctcgttgaccagtcgcgcttgagctgaatcgatcttgctgtgaagcgcttgactgtttcagtgaaagtatacaggacctcgaagcaatgatctcatccatcagcctacttgacagttcccaccagctcattcacaaactctacagaaaatgctggccaagtaactcaaatgccaaactgaacatgcattcaaccgcaaaatctgggggtaagagcatgaggctgaagatggcacttctgaagccccatgcaactgacttcaagaggaaccaccaagcccacgaggaagacaatgtgttctacaaattagtttataggctccctgaaagccttagctgtctgtacgccagtcagaaccagtaagaaagaagaaacagcagaagcaaggactgtgcctagtaaccggtttggtgtgatcttggagtgggagggagttgttggggaagatcatgatcctgacctggagccccgagcgtgggacgtactatcacttgaagaggcaaagtcttttcctccggatgaaatgctgaaggaagttgaggaaatgagaactgatcaggcggataaaaatttangtgggcggtcgtcagatgcaatggagggtgcaacctcagcagcgcgcttggaggctctgggcctgttcctccgggccacggtctacctgctgcgccccgggggtcttgactccttgaacgcccttgtgccttctgaccggccaagggcagctgcggctgctcgcccaaaaatgtacctggaagaaggcttacaagctgttggcctgcaaggctatttcgatgtcgtagtggcggcggaggacttccgccgagggaaacccgagggcgacatgtttgaggttgcagcagagcagcttggtcttgagcctgatgcctgtcttgtgatgggtagctcaaacttgacgacagagtcttgcgcataccgcttgggatgaggtgtgtggcggttgcaagccggcaccctgcctatgaactccatgcagcaaaccatgttgtgagatggctcgatcagctctctgttgctgacctgcagaggctcgccaatggcgaggttcttgggcgcaggggcagacggtctgacatggacatggagattgtgatcgaggagtgatgtttctgcaggcacttatctgctactaatatataaccatgctgtaacttcagtactgcattacaacattttgtaacggaccaagtagtgtaacagatcagcgttcacctcttggtttcttgtaatgcataantgaaactagtctagcttagatgctttcaatcatcagaaaggagtttgaag

SEQ ID NO: 22994 - DNA, 496 bp, Triticum aestivum
  Clone ID: PAT_TA_22994
gatgagcaccagaggatcacaggattggaggacagagtcaggcgggcagggagcggggactgggagtcttttcttccctcgagggaacaacaccccttgcagaacctggaccttgaggggctccggtcacggcaacctgtcagtttgcccggctgcagtccggttgaaccagcgtccagggcattctaccgtcaaaatagcctttgcgctgctttcgtacacccactctagccatgtcttcccctagacatgtgaggaggagcaagcaggaggacaaggagcagcacgcctctatcatctacttttcactttacaaaatcgaaagtagaataccgtgcaaagtaagatctatcttttgatgtttctaagtttccaagcatttcagtgttgattttatattgtgaagttaccaatccttctccatatatgtagttgtgggggctcgtcccccatgcggcacgcgaagctataagtattgatcaagcataaatattca

SEQ ID NO: 22995 - DNA, 1237 bp, Triticum aestivum
  Clone ID: PAT_TA_22995
cggtgctgcctgacagccagtcttcaggcccgccagacgcacacccccccccagacgtcctcgaacctgacaccaaggcatctcgcccacggcgccacccgcgcctcccggaaccccgccccccggccctcagggatggctgccgcaaggccctcaggcgcacgagcgcccagcgtcgccccccagcccctccgaccggaaccccaatcaccgcgccgacatccacacccccacagcatgaattcccgtccctttaccctctaccccgcccccgggagcagccttcgccccacgcccgccgcgatcaggggcctcgcgtttttttttttttttttttttagtaactaaattatctttattataaaggctcgccagaagtacaaagcaccccaaacataataaaatattacatcaaggtctatggaccaccaaacgaactgttcataccggagcacagttggcccgatcttattgatgactgccaggaagtcttcatgcatatgagatgcagtcgtcgccgtcgaagcccttgaaccagacaccaaataatctcgccgacgtgtacacacacacgacaagaaacccctaacctcgccgctccgagaaggagccggcaggaatctacgcagcacgagcgacgagctcgaggagcccgcaagaccgaccgtgaccgcaatcacagggaccacacacagagtgggtcattatttattacaatctttttactgtatatacggccatatggggcggccttagatagatactagcagcaagcagcggaagagaagaagacatgacggagcagaaatacgtagaaagtacgtagtactggtattgcggcaatacatagtattgtctctgctgctggctgctgctatacggtacgctcagtgagcatggcttgcggcaaggtggggcgcgtggccatgggcgtcatgccgcatgcttccctccgcgcacgtgcctttcttgaggtagacgcacggagcacctgcctgcttgctgggcgccgattgtcgaggagattgctcgtccacagccttgttgaggtgggtgctccggcggtcgtcgccggccggcgcctgggaatccatcgcctattagctcaactgctcctcctcctcctcctcctcctcgagctcttcgccctaggcccgggcgtgcgacggctgcagctgctcctcctgctcgggcaccttcctctccaccgccggctccatggcgcgcctcgtgcggc

SEQ ID NO: 22996 - DNA, 516 bp, Triticum aestivum
  unsure (1)..(516): unsure at all n locations
  Clone ID: PAT_TA_22996
aagcaatcaagcgcccgatccgagcttagcaagctagagacgccacccgtcgctgatccatggcctccgccgcgagaacctacgaagtagtccacttcgctgccgacgaggcggccccgccggaaaccttccacgtcatgcggctgcagcggctgcgcctccgtncgcgcggccacgggctgcctccacccaatcaccgaggaggaggactcccgatgccgacgacgcccaagtccccgccggctcgcccagcacccacggcagcaagcagcaggagcacgagaccggcggtccttgccccaagccttcgataggccggccctcagggacccctcgattagttagacacgccgagtanttgattaataaagtnactaacgggactaacgaagcccgttgtcctctggtatcnaagtgtcatggtatgtactcccgtacaattcatgcatgctcctgttagttagtccatcgatgtaatgaantcntgggtgttaacaaatttgcaatcaatcntca

SEQ ID NO: 22997 - DNA, 540 bp, Triticum aestivum
  unsure (1)..(540): unsure at all n locations
  Clone ID: PAT_TA_22997
ttttttttttttttacactgtcaaaatgcacttgccattaatttttgtatgtaaatgcaccttgtccagtagcccatttacagtagcgagctaaatgcaactagtcgcacttggtggtgctaatttggaataaaattgaccgatttaaacccacatttagaacacaaaaaaggtactgtagagattaattggcctggcggctggcctaactccagttaccagtnaaaacagatacgccaacgaacaagctcctgcaaggagggacagtcatgccctgtcttgcctgccgaaccctgaggacgacgaagacccgccgccggcgccggcgtcgccgtagccgtacccgccttgcccgcccgtcatcatcggggggtgatcccgcggatgttggtaccctgccgccggcggggccccgtacggggcccgccccttcatccgcgcgctctctcccgggggggccggtaccattccccaaangnncgtatacccccccaatggctntttaaactctgacgggaaaactggtaccaactaacnctt

SEQ ID NO: 22998 - DNA, 751 bp, Triticum aestivum
  Clone ID: PAT_TA_22998
attcacggcgagccttctgtccgctgctcccgcgtgggttcgcgagcgacctacctcacgcagcgcggcgcgtcgcttccttcacggcggcggggggcgagcatgcaggcggtggcgggcatccggcgggggctgaccatagacccggccggggaggaggaggcgccggcgcagcggttcgggcggctggtccgggagagccccgtggtcatcttcgcgcgccgcggctgctacatggcgcacgtcatgaagagcctcctcgcggccgtcggcgcgcacgccaccgtcatcgagctggagggccccgccgaggagcgcgcggcggtggaggccggcggccacgcggccgtgccggcgctcttcgtgggcggcgcgccggtgggcggcctggagggcctcatggggctccacctcagcggcctcctcgtcccacgcctccgagaggtcggcgccctccgcgcctagctaccagccgccggatcctctactccccgtctccggcgactctctcgcacgtgcgcgcgcatgcttcgtctccgtctccgtctccgtctccgtctccgtgtatgtacatatgaagggaaccatgagctctgtaattccaagactatcaagggtgtggagtgagaaacaacaggataaataagctgtaccgcacgagtaagaagacaacgagatgaactctagcctagcgggggtgtcgtgacaaaaaaggctggacctaaatgtgattattactttacttaggagt

SEQ ID NO: 22999 - DNA, 1497 bp, Triticum aestivum
  unsure (1)..(1497): unsure at all n locations
  Clone ID: PAT_TA_22999
agccagcttggaaaaaggggattttttttaaagcaatttaatttgggtaaaccaaggttttttcagtttcaacgtttttaaaacacgggcagtttatttaattttaggtgccccaataaaaaagtttttagttggaatgaaggggtagttaaatttggttcttttaaaagggcccccctttttttttttttttttttttttttttttttttttttttttttttttttggttttttttttttttttttttttttttttttttttttttttttttttttttttttttttttttttaaacaagtgggcaagcaaagagggattttttttcaaacagctaagttgctgatgatgtctgtgaaactcaacacaactggagtagtcctaagtaaggtaataatcacatttaggtccaacctttttggtcacaacaccgtcgatagagttcatctcgttgtctttcccacccgtgcggtacagcttatttatcctgttgtttctcactccactcccttgatagtcttgaaattacaaagcgtcatggtttcgcatatgtacatgcacggagtcgaagacgaagatgaagcgtgcacgcactcgtgcaagagagtcgccggagatggggaggaggaggcgccggcgcagcggttccttcccggtgggcggccggcgtcggctagttttgttgcaagcagtggccgtgctgatctaccccagcgaaactctacacaacctcggcgagtagctcccaagcagagtaataatcacatttaggtccagccgtctttgtcacaacacccccgctagagttccatcctacggattgtcttcccacccgtccggtacagcttagtggtcatcttggcgctccccgcccacccttggtagtccggaaagaacagcctccttggggccgtcggcgtgcacgtcaccgtcaacggacagggggacgcagcctaggagcgcgcgtcggaggaagacgccggcgacgaggccgagcaggcgctctacctccggggtaggctccggtggggcggccatggagggcctcttgggcgctccacctctagccggcctcctccgtcccacttctccgagaggtcggagccctccgcgcctagctaccagctgctggatcctctcctccccatctccggcgactctcttgcacgtgtgtgtgcacgcttcgtcttcgtcttccgtctccgtgtatgtacatatggaaaccatgagctttgtaatttcaaagactatcaagggtgtggagtagagaaacaacaggataaataagctgtgaccgcacgggtgggccaaagacaacgagatgagccctagacggcggtgttcgtgccaaaacaggtgggacctaaatgtgattattaccttacttaaggactactccagctgtgttgagtttcgcagacatcatcagcaacttagctgtttggaaacatcatctttgccacttctagactctcccgcctgttgagtgagnnncaac

SEQ ID NO: 23000 - DNA, 458 bp, Triticum aestivum
  Clone ID: PAT_TA_23000
cgaattcgcggccgcgtcgacgctatccaagactcgcaaagatagtctgctctgctacactgacccaagaccccagcaaactttctcaacttgagctgcatcatcctctgctgttgaatagtgggaagaagcgttaccgaattcctacaaagctggagtcctacaagctgatctgtacatcaaacataaagccgctgtgcctcattgttcttctccaagagctgcgtggggagaagtgcttgggtttttaccaaatctgtagatgatagtcacagactaagcactttactggggatttttccgatgacttgccctttaagtttaagtgaatcttcaagtttgcagcgtgaatctactcgaaggaagacgttggcagccttcaaggaagggaaaatagatgttctcattggctcagatataagggcccgaggggggcggattgagtcgacgcggccgcg

SEQ ID NO: 23001 - DNA, 327 bp, Triticum aestivum
  Clone ID: PAT_TA_23001
ccgacgccttctgcgccgccggccaggacagccgggccacgtccgaggagaagacccgccgcaagtaatcgaggcacgcactttgattaattagccgccccctcccctcccctctaattcttgttattatcatttcttttcttcttcttctttttgtgtcacatacgagtaatatatgtttgttgtttttttgggaacaataattgtaacaagaaagaaaggctccttcgatcaaaagtgtaacaatcaatcgtgacggcatgattgatcgcctcgaaaagaaaatgaaatagtagaggttaatttacacttaaaaaaaaaaaaaaa

SEQ ID NO: 23002 - DNA, 914 bp, Triticum aestivum
  Clone ID: PAT_TA_23002
gcagaatctgtggtgatccacattctgttatgaggtttgcattcattgagttctctggtgaaggtattatatcttcacatgctacatttatgttttcagcagtcaattgatggtttgatacatggtacattttttacagagggctctagagctcagcttaaccttggtggcacaatgcttgggttctacccccccagagtcgaccccggtgaagccacgtttaaatcgggtaatccaaaatttcttcctgcgacggagcatgagattgttatgggcatacggacctgaccatcacctaatatagccgcgatccagtgaaaccatgatgtttaggcttagtttgaagcactgtgggggcgattttttcctttaaccatcccttttgcgaaactgttggaaagggactggctgaatcagacccttgagagtcagcatctcgcagacaaatctgtgatggatggagcaaccattagaaaaacctgccattcggagtaatttctgtggcaaaaacatgtttccttgttaccaaatcggctggtatcaaaatcaaagcgaaggctacacactggattgttgacgggaaggctgcctgaccatcacctatagcttccgcgatccagtgaaactatgatgtttctgcttagatccttgcaacggaagagcgttttcttcctttaattatcccttctgagaaactgttggaaagggactggctgaatcagacccttgagagtcttgagagtcccgcatctcgcagacaaatctgtgatggatggagcaaccagtagaaaaacctgccattcagagtaatttctgtggctaaaacattgtttccttgttatctcattggctgttattaccatcaaaacgaatgatattttaacggcttgacgtgccgatcgataaaaaaaaaa

SEQ ID NO: 23003 - DNA, 978 bp, Triticum aestivum
  Clone ID: PAT_TA_23003
ccgaggtcaccgctcgtcggcaaaaccgccctgacgaccgacctgaaccctaaccttccaatgccagccggcggggctcgatcttcaggctgccggggcagctggactgccggcctcagcgagggccccttctggaaggtccgcgcgttcgaggcccccttggagacaggggacttcgaccgcgcccgcgtggagcccagggacttcgacaccaagcgcgtgcaccccaagttcctccacaccaacgcgacctcccacaagtgggcgttcggagctatagctgaacttcttgacaaagcagttgacgaggatttgcaacggagccacatttgtaaaagtggataaaagcatcaatttaaaagacagtaggccaatgctggttttccaagacgatggaggaggaatggatcctgaaggtgtacggcaatgaatgagtttaggattctcatccgagaaatcaaagacgacaattacaatgtatggaagtggctttaagacgagcacaatgagactagttgctgatggaatagtttttactcgtacagttcggcggagttatgcttccctgaggagaacaatgcaggatgacatagtcgtccccatgctcgagtttgaagtccgagatgcccacatactccctttccctttcccagcacaccacaatgggccttggggccttgggtcactacgtgactgggccccttgctcgtcgatggtacttctgcggccccccttcgcggctatggatgtcctgctaccgcagttcaaggatattgagagccatggaactaaggtggtgatatatgatctatggatgaatgatgatggccttttagaacttgacttcgatgatgatgatgaggacatattacttagagatcaagctaaagctactgcggggacgacaaagatccaaaaagaaattattgagcaacatatatcccacagactcagattctctttgcgagcgtatacttc

SEQ ID NO: 23004 - DNA, 747 bp, Triticum aestivum
  unsure (1)..(747): unsure at all n locations
  Clone ID: PAT_TA_23004
ttgcttttacttctttggtgtaccctgcactgatcctaggatacatgggtcaagctgcctatttaaccaaacaccatgacttcgactcaagctaccaaattggatactacatctcagttccagaggctgtgaggtggccggtgctggtgctggcgatcatggcgtcggtggtcggaagccaagcgatcatcagcggcaccttctccatcatcaaccagagtcaggccctgagctgcttcccgcgggtgaaggtcgtgcacacatcggcgaaggtccatggccagatctacatcccggagatcaactggatgctcatggtgctctgcatcgccgtcaccgtcgggttccgcgacaccaagcacatggggaacgcgtcggggctggcggtgatcacggtgatgctggtcaccacgtgcctcacgtcgctggtcatgatgctgtgctggcaccggccgccggcgctggcgctcgccttcttcgtcttcttcggatccatcgaggcgctctacttctcggcatcactcaccaagttccttgacggcgcgtgggtgccgctcctcctcgcgctcatcctcgtcgccgtcatgttcgtgtggcaccacaccaccgtcaagaagtacgagttcgacctccacaacaaggtcaccatggagtggctcctcgcgctctgcgacaggctcggcatggtccgcgtccccggcatcggcctcgtctacaccgacctcacctncggcgtgcccggcaact

SEQ ID NO: 23005 - DNA, 1007 bp, Triticum aestivum
  unsure (1)..(1007): unsure at all n locations
  Clone ID: PAT_TA_23005
ggccgcccgaggaaaagaggtctatcccttcgaggcgccgcaagcagctgtcaagagcagaactatggcgatgccgtaggaggggggcgacgggattcgaatctctagcagatccaatcgactgatttccattgccggatctcgccgcggccgaatacttgctgcgcgacgaagtaaatcaatctctgttgtgcgcggtcgctcaatccagcaatagtggtgccggcgagacggcggtaacagtacaagaagaatttgaccacagtttcaaaaggggtgccctgtcgaattcagagcagtcaacagacaaagacgatggacacgcacctgactcgtcgagcaggtttcagttgccagaggtcaccatctgtcaacagttagtgaacggcgaagcaagccaaactttggtatgcacagccgctgaatccggcatcggtgatgtgggtgatccaccgcccacaatacaagtagacatcaacagcacttgcaatggaatggccctgtcccttccgacctcagaacaatcgacaggcaaagacgatcctcaagcacctggctggaccaaaaggtatacaattgtggatgtgtgtttctgtttcaaggatatgacaattttgagtgggctgtatatttacattcctccaaatttcactgagaagtactgattttcctgtaaagtagtacaaggctgctgctagacatcgatacgttgtgttttgtgattacacactactagaaaccaaaaaaaactgtttctagaataacatgtagctgtatgatgcagggtacgtgtagggcacacacctatttatattcctccaaaagttgttctgcatatcgtcgagaaaatagctgtggagacaattttccttagtttgtttatttccacattctgttgttgagggccaaaaaatagaaatttgtgtaataaaacctgttgaaggtacactgctatctgttgtacttgttaacttgccaacatgttgtacgncttgnaatnaggctac

SEQ ID NO: 23006 - DNA, 650 bp, Triticum aestivum
  Clone ID: PAT_TA_23006
gccccctcccacgcgtccgtcccttgctcgcgaggcgcgccccagctcgatcccacgcccggcgaggaggaggagcgctagggtacagggtttgggggcgaggccatggaggaggggggagacgcatccctggaggcgcggcccggcgtcctgctcgtcggcgcccccggcgtgggcaagcgaaccatcctctcccggttgattgggacggaagtgccggacacatccgacttgtcctcaggtgtgctctgtcaggggtggaaaattgacaccaagtactactctgctgatatttccatttggacaacacatcttgaggaagggttttctctcggctcgctccctcatctggaccagttggctgctctcattatggtcttcgatatgaatgatgaaccgtccttacttacgctccgaaactgggttggtaatattgatgttcagaggtttgaagttctgctgtgcataggaaataaagcagatctcttgtgcctggccattgcgcatgtggaatacaggaggcgcatgtgcaaaagattggcgagtcaagtagtgatccaccctgaatatttggattttgggataaatgaaaatgtgggttgtggggtgttttctcagggggaaccacaaatagaggtcagcgactccac

SEQ ID NO: 23007 - DNA, 531 bp, Triticum aestivum
  unsure (1)..(531): unsure at all n locations
  Clone ID: PAT_TA_23007
gagaagctcgagctcttggactgctgctctataactgatgctggtatgaatttcattattcaggctccttgcttgaggagtctcacactccgccaactgcaataaagtaacagacaatgggatggctgagctggcacgttcacagaagttggagtcactgaccgtgataggctgccgccggatctctctgaagggtgtgcgaggggctgccaaaacagttcgctactctgcagagttgaaagcctagagagtttaaaagcaataacatgaacataaaatgacccctgtcgcctgaacccagtatttggctataatttgtgttcactacatatcagcaaaagttttgaaaacgcaaaactatgaaagcaaactcccgaggcaaggtcacctgcaatttccaattggttcanatgttcnaacttgttttggcctaagattttgcaaattctggcgtaccctaagacanacttcaatttgtaccattgcattnccctgccgnatnnattctcctcnttatcctaanactcagng

SEQ ID NO: 23008 - DNA, 1017 bp, Triticum aestivum
  Clone ID: PAT_TA_23008
cagaaggagaagtttctgtattaacagcctgcacagggctgctattgggaaggtacagggtgttaatacagaaggagaagtttctgccctcaaaaaggcagtttgtcttaaggcctgccgagaattacatgctgtcggcgctctaacagattatctgttaccagaatttggttttccatgtgaagaagaacccgacattgttgttgagaaataccaacacgagcagcctgagtactttccagaggaatttgtgtacaattggttatacttttctcgtcttggaatatattattgctacaagatttcagtagaagggtgcttgaaaacaacttattgtccaaatgatatacttctagctgtgaaatgtgatttgggaccagactttgtctctacctcactaaaattgtttggtgagcaagacaatgctagtgttgccatgaaatatgtgggaaacattcatttgaatcaagaacaggtagttatggcaagaagatttcagactagcattctttctttgcttattaataaagaccattctgaggtcattaatgctgtcaaatactcccatgagatgcaagtgtccactggaattgtctatctactgctacccttggtttctggcaaagttgattggtgcagtatcaagttcttcgacctcgcaagtatatgatgcccagtaacaaggatatcagacattgccattcttgtaaacaagttgatttactgcaaacaaaagatggtcctctgtgcagatgcatgcttcaaaattccattgtttgtacccctcacaatagcaaattctatgctgttaatggggtccttgccttggattccgacgcgcggctccaccttcgtgatggcagagcccttacctacataaactatttcgatactaggcatggactcagtctaacacatgaaaatcaacccctgttggcagccaggaatcctgttgaagtgcggaatttcctccagaagcgccattataaaaaaaaaaaaaaaaaaactcgagactag

SEQ ID NO: 23009 - DNA, 1420 bp, Triticum aestivum
  Clone ID: PAT_TA_23009
ccacgcgccccttcccccccccgtcccctcccctcctcctccccctccacccgccgccaccctctcctccggccagatcgccctgtcgctccgtctcgattcctttcgtctgccaaggcagacccgcctcggtccctctcctccgcccagatcttcccatcccgctccatctccttcgccgaggacgacatccctctcctccggcaaggtcgccgccgcagctcctcgccctcgtcaatcccttctcatccactgcgaatcttttgccggatccgtccccccttccccgcctctgctgcaggtcgctcctgtggcaaccgccctgcagaccccgaacctccaaggccaatgacccagttccaccctcctcacgctgcttcgcgcgggagtccgtgttaggacttaaactccgccacagcgcaccgtccaccgtcattacgacttgttatgtgttgctcatgagttgaagattctttgccggtaacttgattggcatatgtgcaaaagcccaatgttaggcagcgtcaaaacgcccgctacctcactgccacagttcatgaagtgcgacaagcgaaccgtgttgtggaggttgatgaaatgtggcgtgccagggagaagcaacttgaacttgagtcttaagctgaaaggatgaagtaaagagcgtggtgactctagaggggagaaacgcaaaggtgactcgagaaatatgagttccagctcaaagattgaagaaggaactgcttataatagttcttactcagaccaggatgatggtctaggggatgatgaagttgaaaagtttctgcattcaagggtaaagcgaggaagaggtgccgttggctctaggatggatgaacctggtccatacctaaaggcttcatcgcattgtcgagacaaagaacctagcccggatatacgtttggaagaaaaatgggaacaccgagtgcaaggtccggagaggccactgtttttgagatccaagtctcttgatgattgttggcatgggaaaacattggatgataagccatctagctcttgtgaaccacacaggaagaaggaaaataaaaaggagaggagatcggagaaaaaagagagaaaggagagaaaagacaagaagaaggccaagcatcgccaccgccaccaccatcacaaaagccgaagaagggagtgatgtgccccattactgaactacaatttgtacacaagaaagggttctgttactgaaagatgctgctacatgctgctattacttgttcgctgggaacctgtgttgtaactaaaactccgccagcgcgcacaagggggatacggttggcactgtgccccgtgtttaaacatgttatgtgttgctcgagttgaactttctttgcctataacatgattggcatctgatgagagtgataaaaaaaaaaaaaaaaaa

SEQ ID NO: 23010 - DNA, 754 bp, Triticum aestivum
  Clone ID: PAT_TA_23010
gaagattggctttatgaagaaggtgatgatgagactgaagcagtttacactagtaaactcgaggagctaaaaaagcttgtagatcccattgaatatcgttgtaaagatgaggaagccagagctgaagctacaagggagcttctgaagcgcattgttgaccatagaatggctgccaagtcattatctgcgcctgaacgagatgctattgacaatgagtgcactaaagttgagctgtggctggagggagagctccgcaactacaggagcccttgcccaaggatgttgaccctgtagtttgggctcatgaaatcaagaaaaaggaagaggagctggacatgtcatgtagcaaaatagtaactagcagggcacgggggcatgacaacgatgatggatgctagcaggttcagatcaaatgcataaatcagatagagatattagaccttgctgaggattccctgcagaatggccaagggcaagtttgacattttgtagaaatataccggtcgtacgggtatccttctaacccttgccatacgatcaactccgtaccacaactggcccgccaattgggttgcctggcatctcaagtacaactgaacgtgcaagttttcaactagccaatgattggttgatacatgggtgttctttttcttcgtaatcagataaaggttgtcgtctgctttagtttgatgtgaacgaacaagatgagaaatggaagcaaatttgtgtgcaatgtaaaaaaaaaaaaaaaaag

SEQ ID NO: 23011 - DNA, 578 bp, Triticum aestivum
  unsure (1)..(578): unsure at all n locations
  Clone ID: PAT_TA_23011
ctcgtgccgaattcggcacgcggactgcttctccgtcttgaagaatcaggaagggcggtcgcgttgccgattgaaggtcctcgtgctgcgtcgtggggtgacttcacgctgtgcgactgcagttggccgccgccttccggtgtctcgccgggaggaacggcagcgtggaaagggcggccaagtcgtaggcttcgcgccgcgcgccgtcccgcaaggagccgggccaggatgggtgctggccgccgccgtcttcgccgaccaccgcgtcgtgagcggctgcggagcgtggagatgtgccgggcggcgccgtgatgcgggggccgtggccggtagccgccaggagccacggatgcgtgcagaggcgctggggccgaacacggattcgcctcgccgcgtcgtccgcttggtccaaggggccgaaggccaacgtttcattaaccccggggcgcgcctctcggcggcgcggtccgggcccgtccccncttcccttccccccggtcccccctgtcgcgactgnaattcgccttctcccnttcttctngcccncnaagggatcctttccgtacaaaaaaaaaaaa

SEQ ID NO: 23012 - DNA, 1169 bp, Triticum aestivum
  unsure (1)..(1169): unsure at all n locations
  Clone ID: PAT_TA_23012
gcaaataaacccacgggaaaaactccgacggaaattgagaaaccctagcgatgctccagatacgcctgagcaagatcggctcgtcggactctggggccgcggcctctggcgcggcggctggggcgtccggtggcgccccggcgaagtccgccgccgcggcggctggcggtgccccggagtcggtgactgtcgcttgccccgaccacctggtcatcgcagacctcgccgtggcgaagagcctcggcgccgtcacaaactccgccatcgctgcgacgcgcgccatcggccgccgctcccgccgccccctcggcgagcgcgtccacatctgctcccgctgcgagttccccatcgccatttacggccgcctcattccttgcgaacatgctttctgtttagcctgtgcaagaagtgattccagctgctatctttgtgatgagcgcattcagaagattcagactgtgaaaatgatggaagggatttttatctgcgctgcacctatgtgccctcaagtctttccttaagaaagctggatttatgtctcatgttcctgcagctcatgcaaatctcctccaaactaacacggagaaggaagaacgtaatgaaccagatgctcctaacatctcccgtgcttctggaggagatgctcaaaggcaatctcaaatgcctgaggcctcgaccgcacgtgctcctccaaggcggggtgtttcacccacatcaagttctcacatgcaagagcgtgaagaccggtctcggtaccaccagtccagggagagggagcacaccccactaaggccccctatgctaagcaaaccgccatcattccatggtcgccactatccaccaggtgatactcggtccgaaaacaacacacctcaaggatttgaccgtccctacagctgggcccatgatggtacacctgggtgcaactccacttcgccaagaacccgaccatggtactcaaagacaagcagcaagtgatgcctaattcacctttcatgttctctcccaatgcatcctcatcaagcaaaacttcnatgatgccacatgaatatgaaccagcctttaatccccaacgcatcattcagctaccctgtccaacaagatgggatcccgcagtacttgattgcccctttccagnatgcaaccgccaaatnccgttnaattaaggt

SEQ ID NO: 23013 - DNA, 625 bp, Triticum aestivum
  unsure (1)..(625): unsure at all n locations
  Clone ID: PAT_TA_23013
cncagggctcntggntggtcgangggcntccttgggcntctgtgncggccgggcatactaatatancatgggngctggtggnatctaaatcgccgnccgatttcttgggtgggaagatgacagggtcgccacggcagcaagtgatggcctatgtcgccctgttcctaggtgcgctctccatgtcatcgcttgcagtttgggcctgaaccggtttaatcagatggaggtagcggacgacgcctacgtcccaacatactgcctgtgatacatgtacataactaatgcatgtgcctgtgttcatatgattgcatacatacatcagataacgtgcccttgtttttgatgggcatgagagaacagcgccggtggaaacgcctgagcattgcctctgtatatatgtgtatactcctgctaaatcaccacaagcactgttgctttggggagatgtataacgacaacagtggctttcctcccaaaaaaaaaaaattgcatgtgcgccaggggcggcccccttcccgtggcgccctataggggggggcccggtacccaattcgncccaatantgagtccnaataacgcgcgctcaacggggcctccgttttanaacctccntgaannggggaaa

SEQ ID NO: 23014 - DNA, 527 bp, Triticum aestivum
  unsure (1)..(527): unsure at all n locations
  Clone ID: PAT_TA_23014
gcctcgtgccgaatcggcacgaggactcctttgcttttactggtaagttctaaactgcggctgctgctgctgctgctacgctcttcctcttttctcctctcgcccgcccgcccgtgctcccgccgttggttccgcaccgctagctagcttccttgctcgcgagggcaccgcccgtgagccgtgattcggggatttggatccgcgcggaccttggatttccccttgtttataggccggtcgagcggtgcctggtacaggccttgggattcggcctggatcggcgcagatctggaggcacatgaagcggcggcgccggcggggtgagcatacgaggatgtgaagcaagttgtagagggagagggaacggattcagcgatggggtgcttgggtggtgatggcgactccggggcgctgaatcctggaggcacctgttggcgccggaggagaatggaggacctgggccgttggngccctcnccaacgggggcccaaaacctgtgtttaacccccccaaagggccggggctca

SEQ ID NO: 23015 - DNA, 387 bp, Triticum aestivum
  Clone ID: PAT_TA_23015
gtggaaggagatcgccgtccgtgccacgacccgacctggtggcagatcgttggccaaccttgagcttctactcaagaataccgttggatcgtccttctcccgccgcggtgcaaacagatctagtgcccgggattgaccgcaatccgtaagtagtactagaggatatcaatttgtgggcatttagagttcaaaaaaggtatgatttggaccggctctacaagctctaggtttgaaaaacatacttttctcttcccggaatcatatgattgtggagacactacacatgcagcgttttctcatgttgtttctcccaataaatggttatgtgcggtttgttctgagcaacgatttatcgacaatctcttccgttcaaaaaaaaaaaaaaaa

SEQ ID NO: 23016 - DNA, 542 bp, Triticum aestivum
  unsure (1)..(542): unsure at all n locations
  Clone ID: PAT_TA_23016
gcacgaggcccctgaacaccacgagaggtcacggagaacagaggagcggcggcggcggcagggccggagatgtcgccctacaacttcacgtacgtcctcatcggcgactcaggtgtcggcaagacatgcctgctggtgcagttcctccacaaggagttccaccccgtccttgagctcaacctcgacaccgagcgcggggacaggatgatcaccatcgacaacaaagcccgccaagctcctgatttgggacacgccaggccgagacgcattcagatcgctgactacaccactctacgacgtggctgtcggtgctctcttggtttatgacatcaccaggagggagacttttaaccctctccccttctggcgtctcgatgctacgagggatgcgcccccccccgggacgataatgctgattgggaacaaatgcgatctatctcacagccgtgcagtgagctatgaggaaggcgagcagtttgcaaaggaccatggccttctcttcatggaggcatctgcaaaaactgcacagaatgttgtggann

SEQ ID NO: 23017 - DNA, 551 bp, Triticum aestivum
  Clone ID: PAT_TA_23017
ggcacatctcatctctctccctctccccttcttctccaccaccggccgccgccacggccaggccggcgtggtggtgcgccacccagcacctccacccgctccacttcaccaccgctccacccagcacatccagcagcaccgcacatatccaccacccgccgctgcaccatccatccaccaacaccaccatcgccatctcgcgcgcactaccagaccctggtctggtgcctcgcgcgactctgccttctgctgctgctccgtcttctcctttacctgctgctgctctgcttccacgccttgctgctgctccctcctactgctccctaaacttgtttgctgctgcttcccctctcctagcgcctcaacctgctgcttcttcttccccaaactctgctactactcccccttttcctctcccttcacctgctgcgatctctctctctcccacatctttgctgctgcccctgctgaaccctcttctctccttgctgctctttctcttctccctcaacgcctgctgctgcttcctctcaacgcccctgctacttctt

SEQ ID NO: 23018 - DNA, 1162 bp, Triticum aestivum
  Clone ID: PAT_TA_23018
cctccagggggggaggcgcggcggcccgtcgcggggcccgatgggacgcggcggcggcgaggcctagcctccacccggccagccccggcgggacgaggaggagaaagccggcctgctgaaaagtgaatccgattccacgcccatccccccctcaacccgccactttctgtagtaacattcctgcctccctccctctcgctctcggcctcggctttgcttattattccttccacctgcctccccttcgtgccctggaagtggaagggtacgaagagggccgaccgatcgtcgtcttcgtcgctgccggcagggcggatgtcggaccgggagctcccaccgccgctgcgatcaatcagaattacaggggacgggaggtgcctgttccggtccgtcgcctacggggcctgcataaggagaggcaagcagtcgccgagcgacagcgtccagaaggaactcgccgacgagcttcgagcaaaggttgcagatgagttcatcaagcgaagaggagataccgaatggttcctcgaaggcaatttcgagagctatgtgcgcaagatgaggaagcctcacgcctggggaggagaacctgagctgctcatgtgctcacatgttcttgggatgcccatcaccgtccacatgtacaccaagggcgccgataaccccaggatcatagcagaatatggtcaggagtatggcaaggacaacccggtccgtgttctttacgacggttatgggcactacgacgcgctgcagccatctcttgtaagaacacaaccaagactgagaggagcgtagctaaccggagaatgacgcggtcgcgctatgtaagcttcttctactacttcttctactactacaacactgcaacttggtttcgttcgagttggcagatcgcggtatagcacatatggaagtccagcccgggttcgctgctctgtcgttcgatcttcttcgaggctgatgtataaataagcttcgcgtgtgtaactcctgatccagtcagggaatttaactgcataaacttacactgcgttcagcttaaaatggagtgttttgtgtaaattctggaatattttactctgaaagcttgctgatggacatttgattcgctgacaattgcttcgaagcaactgaattctcacggcaaatgcgaatacaatct

SEQ ID NO: 23019 - DNA, 621 bp, Triticum aestivum
  unsure (1)..(621): unsure at all n locations
  Clone ID: PAT_TA_23019
gcacggccgacgcccctgtgtactccgttgcgaccaggccttcttccacccccgtcatcctccggccgccaccgcccacccccacccgccatggcctccacctccacctccctctccctcgccttctgccctctcttccgcccaaccccccagccccaatcccaaccgcggcacctcgaccccaaatttcccaaacccctgcgccttagcctcgcgcctgcgctctcctgcgccgcccccctcgccgccgtccccgacggcgttgccatagacgacatcatagagaaggactggtccttcctcaacgcctccggctcccacctcccccgcgcgctcgccgcgggggccgctctcgccggcgtcgcgcgtgctggccgcgacgcccaccgcgtccttcgtgagcgccctcctctccgaatccccgtgcgagctcctggatcgcggcgcacgagtcccggttcatgctgggcgggacaagtggaggaccacgaccaggtgaggtgcttccatttgaaggaaggggagggggcaaggcaggcgcgtagtggaagcctcgcgggggggtgcgcgcgttcccgggggtggggtgccccggccccggatgggncctcccanagnggg

SEQ ID NO: 23020 - DNA, 1191 bp, Triticum aestivum
  Clone ID: PAT_TA_23020
ctttttcagcttcgttggaccgagagctggccattttcatccagccctctctctagcttggctgccgtactactatccccccatgcggccgccgccggcgccgcgagggcgtgtcctgctgcttctgattaccgtgtgtgctgaagcatctgacgcgcttgcgtcgggcagcaggagccgttcttgctcaccttccctccccttgaaatctgaagcagaaagaactcaagctcactcagggggttcgtctgatctgcaaagcccagctatacatcgccctagcttgcagatcgcaagctagatcgcaatggagaaccaccagctgccctacaccacccagccgccggcaacgggcgcgtccggaggagccccggtgcctggcgtgcctgggccgccgccggtgccacaccaccacctgctccagcagcagcaggcccagctgcaggcgttctgggcgtaccagcggcaggaggcggagcgcgcatcggcgtccgacttcaagaaccaccagctgccgctggcgcggatcaagaagatcatgaaggctgacgaagacgtgcgcatgatctccgcggaggcgcccgtgctcttcgccaaggcctgcgagctctttattctcgaagctcaccattccgcttcctggctgcacgccgaggaggaacaagccccggacgcagcagcgcaaggacacgaccgctgccagctcgcgcaccgacgtcgtcgacttcctcgtcgacattgtgccgcgcgaggaggccaagtaggagcccggcagcgcagccctcgggtttgccaccggaggggttggtgcggccggtgggggcccccccgctgggctgccgtactactatccgccgatggggcagccggcggcaccgatgatgccggcctggcatgttccggcgtgggaaccggcgtggcagcaaggcggggcggacgtggaccagggtgccgggagcttcggcgaggaagggcaagggtacacggggggccatggtggctcagctggtttccctcctgggcctccaagctccgagtgatcgatgccagagctgtatgcgcgcattgtatactcaatgctatttaccacggcgcgcaatgtaattgtaattgtgcaagtatatggcatgtcttgcgttaattaaggactaacaacaagcagttatttatcccttttggaaaaaaaaaaaa

SEQ ID NO: 23021 - DNA, 583 bp, Triticum aestivum
  Clone ID: PAT_TA_23021
tcggcaccccctcgctacctccgccgctcctcgccggcgacatcggtgagcgtacggacccgcccgtggccccgagatacaaattccgccatccccggaggtcacctttcatcaccatccgagttctgtggtgccttaaattggtgaaatcgatacacggctattggaaactttagagtttagtctcatcatattcatgagtcatcaaaagcgtgaagccagttctagcaatgaagattgggcatcaaaacgcccaaaaggtgctgccacttctactgaaaaggattgtcaagtagagactgctagttctcaagaaacgaatggtgaaaagagagacacctctcaaaagggaagcaacttgccgctagacccatgcatctcggatgagaaatccgcaaccatcttggaagttccaagtcagcaagagatgatactaactagtgttgaagccgatgctgcagaagacaagggctgcaggcatacaatggaggatgcctgggtggtgcttcctgatgctagcatgggatctcctggaaatttgagatctgcacattttgcaatatatgatgggcatggtggccgc

SEQ ID NO: 23022 - DNA, 949 bp, Triticum aestivum
  unsure (1)..(949): unsure at all n locations
  Clone ID: PAT_TA_23022
nnaagggngaatttgggcccggagttcgcattgntccccggccncccaatggcggccggcggggaatttggattagcgttgttcgcggcccgaggttgaaaantttgcacttgagattggattttggttcaaccattggaggctttttnatcaggagttatagtgacatgctcaaggagatttctttgtgggacaacgaaanatttggaagatatttatgactcaggatatggtgcagcttgcttgaagatatcatgtcaacaaatatttgccaagtgccatccaaaaatgttagcacggcgagcaacaagcgaatgaaggtaagctcatgcacctcgacgatggatggcccaacaacctccggcagccatgtgcctgcttctggaggggccttggggagctcttcccatgacagaggagcagctcccactagggagatctcctttggcgatcaaaggatcgtcccgactggagctgagaagcctgccgcaaggatcgacagcgagacgctcgcgctaaacagggatagcgcgatgcagcggtacaaagagaagaggaagaatcgcaggtacgagaagcacatccggtatgagtcccggaagctgagggcggatacccggaagcgggtgaaaggccgttttgtcaagtcgaatgaagcgctcagtgccggcagcaatggcggatgagcgagctagccttcttccttgctcgcagcacggagatggcatcctgcgccgcacctacgcatgatgccgtgcattgctcagctattttttgtgtctcatcgttttcagcatcctgatccagagattcatttcacggtgtgtttcttttgtaagagacctccccttttctcctcagaacacataaatagccagcttaattttacagtatggtatatacggtnnnnnnnnnnaaannnnnnnnnnnnnnnnnnnnnnnnnaaaaa

SEQ ID NO: 23023 - DNA, 2164 bp, Triticum aestivum
  Clone ID: PAT_TA_23023
cccacccgtccgcgtccgcctgctcgcccctgcgcgccctccccgctcttcgctttctgcctccgctttgctcgccgccctctccctcttggatcgatccggccttcgccggccatgaattgcgccggggtcgcccgctgcgcttgctggaggccagcaggatgcagcgctctcttcttgctcttcgctatctagctccaccttgctcgttgtcctctccctcttggatcgatccggccttcgccggcgatgaattgcgccggggtcgccgatgggttgccggcaggcgagccggatgccggccttgtcggccagccacggaggaggtgctgcctgtagcgtagctgagctatagtgctcggtcgatctgctgcttctcgggggcgaggaagaggaatagccgaggcttggcagccagctctcgaggacagcacaaggcggagccagttaatttccggtgacgcacaccatggatccccagacatttgtgaggctctcggtcgggcagcttggcctgaggctccccggcgcaagcgccagaaaggcttgccactgcgagatccggctccgaggcttcccggttcagatagctgcggtgcctctggaaaattcttcagagttgcaacattgatccgcacgcgaacgcggccgtgttctccctggacgagcccggtctcaaggcgctgccgacgtcgaggtggttccgagccccggagccgccgtacctcgagatcgttgtgtacgtgagcaggcgcgacggcggcgggcactgcgtcgggttgaagcggcggctggtcggggcggtcagggtggacgtcgggccggagtggcgcgacgggaagcctgtgctgcttcgccatggctggacgggcatcggcagggcggcggagctgcacgtgagagtgcgggtggaggctgaccctcggtacgtgttccggttcgaggacgaggtcgcgctgaacccgcaggtggtccagctccatggcggcgccagccagcccatctttagctgcaagttcatccgcgacgtgaggcgggcgtcgcagccggatcatttgggcgggcagtactggtcgagctccggaagcggcgtggagaaggagacggacatggcggggaggaggagggagaggaagggctggaaggtggcgatccacgacctgtccggctccgccgtggccgcggcgttcatggccacgccgttcgtgccggcgacgggctgcgacacggtggcgcggtccaacccaggcgcgtggctcatcgtccgcgccgacacgacggggtcgtcggagagctggcagccgtggggccggctggaggcgtggcgggagtgcgctgcgccggcgggcggcaaggacgccgtgtgccttcggctgcatctcctcccggagcggcgggacgcgtgcgtcctcgtgtccgagacgcctctgagctgcgataagggcggggagttctccatcgacatggacagacagtcggtcctcccggaggacgcggtggcgtcggagacgccgtcggcatcgtcgtactgcgcggcgagcatgggggagtcgtgcgcgggcggcgggttcgtgatgagctgcagcgtgcagggcgaggcggcgacgagcagcaggccgccgctggtgcacctcgccgcgcggcacgtcatgtgcatggaagacgcagccatgttcctcgcgctcgcggccgccgtcgacctcagcgtcaaggcgtgccggccattccggagcaagacggcgccggccaagaagaagccggctggtggctcctcttcccccgatcccctggagctcgacacgtagattagctagagctagcagtcctcactcctcagtcaagcatcagatcatccatggtcactctgtaaatccacttgtttcgaccaaacttgttgaaaactctaccagttttttctaggtctaacctgtagacacgatgacgattcaatcacgcccccacacgacgaggcacagaggacccaggtcaactccaacacacgacccgggcgaacgtcaattttgtatggattttgtatatttaggtcgggtagggagctgtgtccggcatttgtatatttgcgctgggtttccggcatttgtacatttgcactggccgtgcgcccaactgactaatggattttcgtctggccgcgtaaaaaaaa

SEQ ID NO: 23024 - DNA, 555 bp, Triticum aestivum
  Clone ID: PAT_TA_23024
ggctctgtccttgaggtggatgtggcgcgccttgcttgttcttcttcctccaaggacgctcttgcaccgttcagccgcaggatcaagaatctgtccggggaggagctggtcggagctgcggcgtcgcctcgtcgcagactagtgttgcacggcttccccggcggcgccgaggcgttcgagctcgtcgcgaggttctgctacggcggcggcggcggagtgacggtcaccgcggccaacgcctgcgcggtgcggtgcgcggcacagtacatggagatgggggactcgcccgcggcgacggcagcgtccaccgccccgagtttggtgaaggtggcggataaggcgctggaggatatgccgcactggccgtggcattgcgtggtggatgccgtgaagcagtgccagagcctcttcccgctcgccgaatccaccggggtgttcgacaaggtcgtcggcgcgctgctggctcagatggccatccctgccccaggcgacgccaccccgacgagctcctcgccggagagctcggcgttccgcttctcctgcgataccaagtgc

SEQ ID NO: 23025 - DNA, 745 bp, Triticum aestivum
  unsure (1)..(745): unsure at all n locations
  Clone ID: PAT_TA_23025
ccaccgcagatgatggagggggaggaggaggttccgtcggtcactgcgtcaccggcaccgtcgtactgcgcgagccccgacgtgaacaccaaggcggacaacttcatcgaacgcttccgcgccgggctgaagctggagaagatcaactcgtaccgggagaagctgcagatccaagaaggctcgaccgtgaccatggcggaggaggacggggagttcatgatcattgggtccctcttcgaagatgacgatgacgatatgtcgttgccggagacgccggcaaccgccaccgcgggcgcggccgctgttgccgtcggcttctaaattcgaattctgcttccgacttccgaggtgttgcattgacgcttggagaaaacagagagaaaagcgaataaaaaattgaaaacaaacaaaaagaaaaagaaacttatttcgggtattgggttatttgcggtattttccatgagatttggttcacttttcttgtccattttttgggtagtttaggagaattgacagtgagattgggttattgattgcttgtggagaggatgaattcagtgttgaggttattactctaattgaagagagtgatatagggagctttatgcgcatgttttaaaatgggccaagaaagctcggcgaggtgatgcaaattcatgtgtctacagtctatatactactgtatatcntagaaagtgaaagagcttacaattaattantttgaatcatcaanaaaaaaaaaaaa

SEQ ID NO: 23026 - DNA, 760 bp, Triticum aestivum
  Clone ID: PAT_TA_23026
gtcgcggccccggtgcccgtgatcgggtaccccaccgacgtgcagcacgtcgggcacatcggctgggacggcatcaacaaggtgggcggcatgggcgtgggcgtgggcatggccggcgccttctccctgccctcctcccgccccccccgccagctcgccgccgccgccggccccgccgccgcctcccccccccgcctcctcatccaccaacaccacggcggtccaccgtacaggagagaggcgccggagaagaaagcagcgaggacaaaggcgagaaccacggcggcggcgtcaggggtcgtcacggcgggggtgcagcggctgctcagagggatcaagaccttcttcgcgatgtacgacggcgaggaggaggacgaggaggaggatagggagatcgtgatcgggtaccccaccgacgtgcagcacgtcgggcacatcggctgggacgggatcaacaaggtgggcggcatggtcggcgccttctcgctgccctcctccctctccctccgccagctcgagatcgccatggaccccggcgccgccaccaccacctgcatcaactgacctgactctcctgccattgccatgccccttgagctcgagaaaccaccatcactagtgctagtaaaaaaaaagtttgagatgactggtctcatcttttagttcttccacgtgcttgctgatgattgataattaccttgtcatttggtaaaatcttttcttttttaactttggacgagataagaagcatatgcatagg

SEQ ID NO: 23027 - DNA, 579 bp, Triticum aestivum
  Clone ID: PAT_TA_23027
atggaccccacgtcggcggccttcgacaacgcctactaccggatgctgcagagcggccgcgggctgctgtcctccgcgaggtgctgctgacgcaccccaagacgcggcggttcgtggcgctgtacgcggcgcggcaggacgccttcttcagggcgttcgtgagctccatgctgaggatgagcgcgctcaaccagcccggcgaggtccgagcaaactgccggcgacacaactgaagcaagcagtggatcccctcctcctccctcctctgtctctgccacataactgtatttcgttctgattaattccggtacgtagtaactgtgtgtaactgtggccggcaatctacagacattctagttgaaaaagggcctacaagggaatatcttgtttccttcaaataatacttctagacatttttcacaagcttatattactcaagaaagttaagagtaaaagagaggtgtgtggtagaaaatggttggtctattgtaaactacatgtggagaaagtgcaagaccatattagccacattcagaatagtaatcacaactatttgggccaaaaaaaaaaaaaaaaaaa

SEQ ID NO: 23028 - DNA, 633 bp, Triticum aestivum
  unsure (1)..(633): unsure at all n locations
  Clone ID: PAT_TA_23028
ngnagntttgntacnccaagctcgaaattaaccctactaaagggaacaaaagctggagctccaccgcggtggcggccgctctagaactagtggatcccccgggctgcaggaattcggcaccagacacagtgcccaaaatgtgactacgacccctacagtctgtcagtccccaaaccaccaccctactccattctcctccgccctccgcctcaatttctgtagcgtaggaggaacatgggatactgtcatggttcagctcgtgctttctccggcggcggttcgttcgttgcttggctcgtcgtcgccggcctgtgtgccggcgattctgttggtcgctgccgctgtcaggtgagctcaaattgaccggttctcagatctggtttttggttttgcagttcttctctcctgctggttgcggttgcggacacaacacatgcgttacggcggcttgnaaagttggacgaatccagatctgaatcgccaagctccatagcatcgttttggttcccgtcatgcggcgtcccaggcgcgcgaaggagccaaattataccaggtcaaagccctggatccgtgcacggtgcgaccttggaaactaaagcgaccactatgagcatcaagacgatgaagtactcg

SEQ ID NO: 23029 - DNA, 778 bp, Triticum aestivum
  unsure (1)..(778): unsure at all n locations
  Clone ID: PAT_TA_23029
ggaagagggataagggggtcaagatggcggttgactacgggagcagggaggagaggtggagcctggccggcgccacggcgctcgtcaccggcggcagcaaaggaattggacatgccatggtggaggagcttgctgggtttggggcgagggtgcacacctgctcccggaacgcggcggagctggaggagtgccgccggcggtgggaggagaagaacctgcaggtcaccgtctccgtctgtgatgtttccatacgtggcagcagggaaaagcttatggagacggtccgagaaaccttcaatggcaagctggatatactagtgaacaatgcggggcaattgttattcaagcccactgctgaatgtacggcggaggaatactccaatctgatgaccaccaacttggagtccagcttccgctcaacccaatcccccccctcttctctcacacccctctatatggccgggggcggcgccggcctcttcttgtcctcgcccgctgccgcatgtgccgcggcggaatactcgaatctgatgaccaccaacttgggagtcgagcttccatctcaagccaactcgcacgccctcttctcatacacgcttctattgccggaggaggcagcatcatcaacatgtcctctaatgggaggtcaattggctttgcangtccgtaatttatgctatcacaaaagnacttctaantcaaaaaactcttacattatggaacgagggagtacatacntctgtgcaacaactacaaatacacctccgttgaacggcaa

SEQ ID NO: 23030 - DNA, 538 bp, Triticum aestivum
  unsure (1)..(538): unsure at all n locations
  Clone ID: PAT_TA_23030
ttgtngtaaaattnggttaccttnttttcccaagtggncaaantaagaaggcaaggggtcgcctgttggaacatcnaagtattctttggganatggttcgttttaccaaanctcctccatgatcatgagggcagcaccaacaggattggccgngaaggggttgctcctccatatgtcgcagntggggaantaantgggaaattgagnggacttaggtccaggtttcttccaggcttttgaataggcttgaggcagcttgcagctaggagcagcactacttacaggcaggaggtagcacaggccgatacatcctgcccgacgacacgcagtttcttcccagtttctggacttcagatcatgctttgtgtaaacttcaggttcaagatgtacagtataagtgggaagatgattcatacgtagacttgatacagtaataccgcgccccttttggtctgtgcttgttgtaatatttgggctcacctgcggaagtaaagtctcgtccacttgttacgatttctgaacgcaaaaaaaaaaaaac

SEQ ID NO: 23031 - DNA, 660 bp, Triticum aestivum
  unsure (1)..(660): unsure at all n locations
  Clone ID: PAT_TA_23031
gcatatatatattgataccaaggaggaaaatgttacatggggacaaacatcaccaagaaataggccggtatgacagtcatctcaaagtttcacggcggccggagccgtcactgattccctcctggctttcttcagggtctcaactaaacctgccaaggaagtgtcggcgtccatacgcgccacgtcactggacgacctatcggagtcgtccctcctcctctttttgcatttgggcatgaggttatgtgccacgtcagcgggtgacgtgtcggtgtcgtcgagcagctgccgtatttcgtcgaacaagacgtgggtcttctaccttgaggtagttcttgggcgagcaccttgaagggcccgaagcggcagtaggacatctcgatgtgcatgtccatcctcccgcggcgggtcagcgctgggtccagcatgtcgaacccgttggtggtgaagacgatgaaccgctcgccgccgctcggccgacaaaagccgtcaacaaactgancaaaacggaaacgtcacctgctgcgtcaaccttgttgggggtcaacggtccaaaactgcccggngcctctgcgnnacttcggttcggnagtcactcatgctcattccatacatatgactnccttgcccataaaattcgacncgnttttctangctagg

SEQ ID NO: 23032 - DNA, 1031 bp, Triticum aestivum
  Clone ID: PAT_TA_23032
cggcaccagattacctcttacactgtgtatcacaagcttatcccagttgagcaaaattcttacacattgtttcagtcgcttcttgcccgtggcggtccgatcgcgttggtggatccggtgtgccctctgcctagccgagacgaccctacacctgctcgcggttgtcgactcttgaggcgccgtgctgaggtcgccccggccccggcgctgccgcgtctcctgccgcccctccccctggccggggtgctcgccgtgttgtcctcccggcctaggttcctcctccccggtacggttgcgcttggatccctgcccgttcgctccctcggccacgccgtttccaggtcttgcgagtgcggcctgcggctctgggtggcgtgtgatgctcaagaaagatttcacgaggctgacaatgaagatgatgctggagaaaatggtagcgacgacgagcctggtgaaatgggagatgggcagctatgtgtcatatgcttaaggaaaagaaggcgggcagcttttgttccttgtggtcatcttgtctgctgttgcaactgcgcgaaaagggtggaactcatggatgaaccattgtgccctgtgtgtaggcaagacatccaatacatgctcagggtttatgactcttaaggctccttgctgatatggcccaagcaccggcaaagtggcggctccaactgtccatcctcctgtcctgggtgctctccgtttttcgttcctagtttaggttactgctgcctggaaagtatgtgaatataggactgtgctaaccctcagaaactagattaccagtacttgctagtttagtctgtgaatatgggattatgtatcatcttagatgaccccgtgaactttggcccggaatttaaggattgccaagttttttgttggtgttgcatggatacgcctagggatgtaagtggacgcgtccgtgaagtgtacgaacgcccgcattcttggtttttgtattagctcgatttttaaagcgacatcaattaatttaaaaaaaaaaaaaaagggcggcc

SEQ ID NO: 23033 - DNA, 517 bp, Triticum aestivum
  unsure (1)..(517): unsure at all n locations
  Clone ID: PAT_TA_23033
ngtgacggtgccgcagtgggcagacccagccggaccaacgccaagtacatagaggacgtgtggcacgtcggtgtgcgcgtgaaaggggcggtgacgaaggaggagctgaccaggtgcgtgagggaggtgatggacgacggcaagggataccggacgaatgcttgcaagctggagccacaaggccaagaaggccatgagtgctcatggcagctcagacaccaacatcacccacttcctttccaaacttcgactcggcaaatagatccatccacaaatcatcaaacgatggattctaagtttatatcccttttcttcagtgtttgtctttgttcttgtgtatcttcgacgtagctttctttaggtttgtttttgtgtatcctcaacctggcttgttatttcaccatcattctcagaattaaataaaatccctttcttcttttaaccagcgcaaaaaaaaaaaaaaaaaaaaaactcgagggggggcccggtacccaattcgccctatagtgagtctatt

SEQ ID NO: 23034 - DNA, 765 bp, Triticum aestivum
  unsure (1)..(765): unsure at all n locations
  Clone ID: PAT_TA_23034
ccctcttccaccgccgggagtcgcctcgggccccgcctatcgccgcgtgacaccctacccgcccctgaccaccggaaaccacgcgcaccttgccgtccctcgcgtgctagcccgcccttcgccgtgcagcggacccagccaccacgcagatcatgccgcccctgcaaacctgatcgctgatccagtcgagggggcggccggatccagccgaccacgacccccggcaaggcatgggaagcggcgtgcacggggcggcctcctgctcccggccgatgtagtcgttgtctgcgccgccgtcctacagtgcgatggggatccaccgtcgcggcgctcatgacgttcggcaccgccacctccgggccgttcaagacggaggctcctggatggtgctggcccggccccctgcgccgcgcctcgaggggagggggcgggcgctcgccggatggcttcgcatcaatccaactacactgctagtccccgttcagggatcctgaagaaaatacatgttgttttggcatgtctcacatcctacagtaacgatcccctgcaagccctgagccgccggtgttccgtccacaaatctgcgagggatgtaaaagcggctgtggcatcttgtcaagctgcccatcaaatgtaagcctattatgttgtccttcagtagcagttcgacaaaaaaactgcagcaattctacatgggaaactatgatanttcaaggcctgctacnaagttcgttgcctggttggaagnccaagagtaaanaaatt

SEQ ID NO: 23035 - DNA, 588 bp, Triticum aestivum
  unsure (1)..(588): unsure at all n locations
  Clone ID: PAT_TA_23035
gagaaatttggtctccataaagatgtatattttgacaagggctgtggtacatctaggcctgggttacgtgcaagcagttcatgccagcctgagcacctttccccaatcaaggatgacccttgggtaacttcagtgccttttgtacctcttgttgagtttcccaacagtgcatcaccttcaaatagtccatatgacccacttgctgacagtatggaccctcccaaagttgagagtggcaatattctcaagtcctccaacatatcctgcagcatttcaagtcagcacactgctgggaatggtgttatagatggagatatcaacaaatcattgatttatgctgataagttggcaaggaatatgtcggcaaaagggtcaaatgagtttgcaggcttggttgcacctggtaaggaacgctctagtctggatggcgatactttggtgaaagcttttgaaagaaccaaagatggagcaattgacgagaaaacgaaggattatttccgtatccattgggcagaacatgtgnnnnngttgctgaaacctatttggnannnnnnnnnnctgagtaaagatgctcataaactgatagta

SEQ ID NO: 23036 - DNA, 801 bp, Triticum aestivum
  unsure (1)..(801): unsure at all n locations
  Clone ID: PAT_TA_23036
gtttgggtactggagataacagtcgctgtagcttatgaatcatcgatttcaggtccagaaaactcagtgttatggaatgaatcaatgggagtggcagagggaagaagcacatatcttggtgcagcccccattgtacattgcctggaaaattacaaaccacatgtcgtcattacttctcgggttgctgatgctgcactattcttagcacctatggtctacgaattgggttggaattggaatgactttgagaagttggcacaaggaacattagctagccatcttctggaatgtggttgtcaactcaccggaggatatttcatgcaccctggagatgcatatcgagatttttcttttgagcagcttcgggatttgtctcttccatatgctgaagtgagttacaaaggagaagtttgtgttggcaaggcaaagggtagcggaggtcttctgagctatagcacttgtgcagaacagcttctgtatgaagttggagaccctgcaaactacatcactcctgatctggttgtagatttcagtgatgtgcagttccatcaaatatcacaagacaaggttcactgtaaaggagcaaaaccatctgatcttcgtcggcccgagaaactcctccaattgtttcctactccaaatggatggaaaggctggggagagatatcatacggnggacaagagtgttaaggcgcgctcagcagcagatacctagttaggtcatggatgaacgaaagatatcccggcatcgaagaagaaattatcgcatatgttatgggatatgatagctttgaagctaat

SEQ ID NO: 23037 - DNA, 1412 bp, Triticum aestivum
  Clone ID: PAT_TA_23037
cttccagctcgcatgcataacaacttcgccctccagaggggccccgggctctgtagctcccgaatgatctggtgacggtgcactgcgtcttgtctgttgtgtacgcaactggtagtgctccttgccagccctttatcaattctactgatccgccagttcatctaatatcacaccctcctgatcgccgcacacgacctatcggatcgggaccgaaccgctgggaggagctccgacatgtgtggcgagggtgaggaggatgcctccacggagcagaattcacagataggtcgcacgtgagtctaaggtacgcgggggccggacggtgcctactctgatattctatgagagagtcatgcccccaagctgaagaggatttgatcgcctggcgtagcggttactagcgggtcatagccaattgacgttggatggaggggcttccctagtaccaggaacgggcggatgtgatccttcgggagcacaggccgctttacccgaacgggcctgccggtgggggcgttgaggagtccgttgcgctttatacaaatgctccggccggggggcggtggcatcagcactggacgaaagaacgaactaactctgcagaagttgctgattgatagggaaaacatcttctggcaagccaatgcgaagaactcagccattcctggttcacagaatctgtctacaaatgccaataagaagaataggtacacgggaagttgtgcggcgggcattcaacaacacttggaatacaaagctggacgaaccagcacctcctgtatctgctccagctccatccgggtcggagatcgccctgtaccgtgtggcccacagcagagccggtgacaagggaaacgacctgaatctgtccatcatccctcatttcccggacgacattggccggctcaggacagtgatcactcctgagtgggtgaagggctctctctcgcccctgcttgatcgttcgtcgttccagacgacggagtgattgagcgtcgaaacaatctgctcgagcgtgtcttggttgagatttatgatgtcccgggcatcagctcattgaacattgtggtgaggaatatcctcgatggcggcgtgaactgctccagaagggtggaccggcacggcaagaccctgtcagatatcatcctgtgccggaaagtcatcttgcctccgtagtgactgactgttgagagatcaccggcacccaatgtggagggagggatgtctagaatcatcaagtgttgttgcgtaaaaaatagaaaggccgacgtgataataagactggtgaagagaacaataatgcctgttgtatgaaacaaacaaaccatatatgtatgctcttattaatcgattggcatcattggccagtttaaaaaaaaaaaaaaaaaaaaaaaataaaaaagaaaaaaaaa

SEQ ID NO: 23038 - DNA, 532 bp, Triticum aestivum
  unsure (1)..(532): unsure at all n locations
  Clone ID: PAT_TA_23038
gtgcctcccaatctgccttcaaaacccgagggtggggggaccatacaaaaaccaaagggccattcagagcttgatcacaaggaacctttaacggaagctccaaaggttcaagtgtctcccagtctgccttcaaaacccgagtgtcgggggaccatccaaaaaccgaagggccattcagggcttgattactcgaaatgggacaaagttgaggatgattcgagtgaagatgacgaggatgatgaggaagatgacttgcctcggtataaattcaatcgcgcggccgcccgggcgcgtaccgtgaagtgaatgggattcatcaataaataagtttacgtccatggtctgtggatagccgtttgccagcatccctactaactttggtcccatctgttcggttacatccttgacatacttggatgaagtgttgccgattgggtgtttggttaactcaagctcaccggcgggtgaagacataagtaccgcggccccgacccccttggttccgggttnnggaacttacccaaggaaanaa

SEQ ID NO: 23039 - DNA, 1031 bp, Triticum aestivum
  Clone ID: PAT_TA_23039
taccgcggccgccgccgagcttgcaagccgttcatgttcgctatccatcgccaacatctctgttctcttccccagattatccagctggaggacgacccttacaacaaccgaacgcctgagccattggaccgcagagtcgcggaaccgagcggcgcctgggagcgctgctcccatgtccgctcagcgcctgtgctgccaggggacccttgcgtccgctcacgagcacggctagaagtaatcagccagggcttcaagaagatactgttccttcggttgcacttctccaaggtcgtgaatgcccactccgtcaggcagcccgagtgggaggggtccccgaacttgatccagaagtcgggcctcatctcaacgctcatcagcacgcacttctccacggcggtccagaagccgatgccccgccctgccgacgtgaacatcaactcggcgatgtaccccggggtcccaccggccccccgtgcagcccccaaagcttctcaagtttgtggacacgttcggagatggtgcgtgggcccgcaggacttgccggggtactgggtggtgtcggggcgcccaagctgcacctcgagaggggcaagatatccctgcggggtgcggtactcgctcctgacggccatgctgcccgacgacgaggattacgcgcttgatgacgagttctaggatcccctagaaaacaatcggaatgaaacgacgcctgtcgtcatcccttcatttgttatgtgcggctgaccgtgagggcgcgggcgggcgaaagatttagagttttcgttgcgtccgtgctcttgttgttggtttctgttgtatgcaattgtgggtttttcgcagtaatgagtgctgtgtcctgaaatggagggagaaaaggaaaatttgttgtttgtggcgtggacttgagttgaataggttaggtgacagatccaattatttgtatatatacaagatgcaacagggaaactgttttgattttgcattgtcaaaagattcagctgtgttctaggaaaaaaaaaaaaaaaaaaaaa

SEQ ID NO: 23040 - DNA, 858 bp, Triticum aestivum
  Clone ID: PAT_TA_23040
cgtccgaaaaggcggatctagggtttgctcggccttcgttcttcttgggccgagccccaatcctgcaccgcccgcctcgagttggatctccgcccgccggcccccctccgcctccgcttttgggttcccgcagataatctcgtataggatggcgtccgcaaatggcaatgaaaatgctatggtgcatgaaagtgaaatggttgttgatgatgagatgatccatggcaatgaaatggttcacagtggcgagatgatccatgagcatgatatggttcaagggaatgagatggttcatggtgacgagatggtggaagggagggggatggtccatgatgatgagatgatccatggtaatgagatgattcaagttagtgacatgatccatggtcatgaaatggttcaagtgaatgacatggtcaatggtgatgagatggcccatggtcacgaattggtcagtgctgaggtgaccccaccaaccatatcaagacgccggagaaagaagtcattagtatgggagcactttactattgaacctgttcctggggagaggggatgccaacgtgcatgctgcaacctatgcaaggcaacctttgcatacagttctggcacaaagatagcaggtactagccatctcaagaggcacatcacgcttggctcttgccctatgataaaaagccaagagaggaagctggcaatgagttcaattggaggagtgactgacaacgatggtgagggtaccgtagaacgtccttctaagaggcgttacagatatactggctttgcaaatgctacatttgatcaagaccgtagcagctcacattctgccaagcttatcattttgcatgactacccacttca

SEQ ID NO: 23041 - DNA, 1116 bp, Triticum aestivum
  Clone ID: PAT_TA_23041
caccacattggagacatgtgatgataactacaatgagtcgccttctgcagaagactggaagaagttggaagctgcctgcaactatttgaaatttctgtatgattctgcacatagcatcatggctgcggcaaatccaacttctaacttatttttccatgaggcgtggaaacttcagctggaactgtcaaatgccataacccatgaagatccagttttcagtagcatcgccaaagaaatgcatgagaggtttgacaagtactggaaggattgcaaccttgttctagccattggtgttgtcatggaccctcgtttcaagatgaaacttgtagaattcagttattctaaaatctatggtgtggaggcagcaaagtatgttaaggtggtggatgatgctcttcatgacctttacaaggattatgttgcacagcccctgcccctgacgccagcctatggcgcaccaggggaagttaataaaaatgggcctgccaatgcgaataacaacgcagtaactccaccttctactggggatggactccttgactttgacatgtatctttcagagatagcaataagccagccctccaagtctgagctggagcagtacctggaagaagccctgacgcctcgcatccaagactttgaaatcgtggactggtggaagctcaacaccctgaagtttccaacactggcgaagatggcccgtgatatcttggccatccccatgtccatggtgagcagcggctgctccatatttgcagcggcaacgacaggaagccggatgcttgatgactatagaagctcactgcgccctgaaatcgtggaggcacttttctgctccaaagactggcttcagtatgctccgccgcctcctccagaagcgcagggttctgtagcggtgaagatggagtgattggtcccttagtccttagttggtagccttcacaagaaggctgcttggttggtgttgagcttagtttgtgcctagcgctctcgatcatagaatgttactgatgatgttcgagctatccattagatgtaatgagtactcttgattattcttgtcgaattcagattctgggcccgtgacatacttgcagggtgaggctgtcgccagtg

SEQ ID NO: 23042 - DNA, 2727 bp, Triticum aestivum
  Clone ID: PAT_TA_23042
gccctcccccgcctcgctccccccccgcccaaaccagctcttgattctcacactgcgcctcgctcggccttgctcctccttgggccgagccgttgcttgggcactccgctcgccctcccgatcttcctccccctctcgctctccctcacttttgggacttccagcatggctgatgaaactggcaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacacagggtgacgaattgctccaagggaataagaaggccatcactgaggtggccactcctccaaccacgaggcggcggagaaagaagtccctggtgtgggagcactacactattgaagatgctgctcgagcggccactcgggcttgctgcaaaacttgcgagcaaaccttcgggtacagctctggtgcaaaaatccctgggaatagccacctcaaaagggacatcaccttcaatacctggacttagatcaatgtgagagtgcatcaacccagcactcaaaatctgaccgagagcagtgccgggaggagtgtctagctgcgcgcttccaagagtttgacattctctactggtggaagctcaacatgcaaaagtatccgacgctctcaaagatggcgcgggacatcttggccatcccagtgtccatggtgaccggcggcacctctatattttctgcaggaacaggatgccacgtgctcgacgactacagaagctcgctccgtccggaaatcgtggaggcgctcgtctgtgcgaaggactggcttccgaattcgaccgccgcaccggaggccctgccgggctctgggcttctcaagatggactaggctctcttcctttgctgaagcatgcatatatatcttctggtgccttggagtggtcctttaaccgtagtcgtattttaggcagagtttgtggactggctgcgatcgatcgatttcattggaatctgtcctagaatgtaatttgtcgtgtagaactctgttaactccaggtttatgctgttatgtccaccaccccttccttgtgttgtaatatgtgaccagagatgttatctgacgttgattgggatgtgtttggctctgcaaccaagaataactacctgcttgagggtcagctatttgttgtgaggtgctatgcccatatcctggatgcggctgcacaagatgtcattgctttaatccacggtgtcatctacagcatccgtgaaagcataaagttcataaaagcttctcctagtcgtgaggaaaagtttgctgagattgctctgcagctggagatccccagtacgaagaccctttgtctggatgttacaacccagtggaacacaacctatctgatgctcttggctgccttggattataggcaggctttcattacactagaaacagttgatgacaactacaatgaagcaccttcagctgaggactggaaaaaaattgaggctgcctgcaattacttgaggctgctgtatgactcggctcatagcatcatggcagcaggaaacccaacctcaaacattttcttccatgaagcttggaaactgcagctagagctgggaaatggttcagcacacgaagatccaattttcagtagcatcgccaaagacatgtatgagaggtttgacaaatactggaaagattgcaaccttgtgttagctgttgctgttgtgatggatccacgttttaagatgaagcttgttgagttcagttactcaaagatttacggcgttgaggctgcgaagtatgttaaggtggtaaatgattcggtgcatgaccttttcaaggattatgtcgcacagccgctccccttaacaccgacctatgctgaacaagggaaaactgataatgctactgccaatgggaacaacacccaagcaactcaaccttcagctggtgatggccttcaagactttgatatatatctttccgagattgccacaacccagccctcaaaatctgagctagagcagtacctggacgagtctctcactcctcgcatccaagagtttgacattctcaactggtggaagctcaacatgcagaagtatccgacgctctcaaagatggcgcgggacatcttggccatcccggtgtccatggtgaccggcggaacctctatattttccgcaggaacagggtgccacgtgctcgacgactacagaagctcgctccgtccggagatcgtggaagcgctcgtctgtgcgaaggactggcttctgaattcgaccgccgcgccggaggcggcgccgggctctgggcttctcaagatggactaggctcgcttcctttgctgaagcatgcatatatgtcttctggcgcctgtgagtggtctttttaactgtagtcgtgttttaggcagagtttgtggactggctgcgatcgatgatttcattggatctgtcctagaatgtaatttgccgtgtagaactctgttaactcctccatgctgttatgtccaccccttccttgtgttgtaatatgtgaccagagatgttatctgacgttgtttgggatgtgtatgtgcaagcaacgtaatgtgccagcaggtatccagtagttgtgcttcgtactcttgattattcttgtcgaattcagattctgggcccgtgacatacttgcaggg

SEQ ID NO: 23043 - DNA, 964 bp, Triticum aestivum
  unsure (1)..(964): unsure at all n locations
  Clone ID: PAT_TA_23043
gcgccattgctggcagcagcgagggnagagaaaactctgcaaggnaagggtgcccaggatgcaggctggacgagatcaacaagagcaagaccggcatcccctacctcaacttcttctacgtgtgggtcgtctgtctctgcgccgctctaccgatccagtcactgtttccctatctatacttcatgattagggacttggaagtcgcaaagcaagagcaagacattgggttctatgctggttttgttggggctgcttatttccttggaagaaccatcagtgctgtgccatggggcatttttgctgacaaatatgggaggaagccttgcattgttatcagtatcctctcagtgatcgtatttaacacccttttcggccttagcacgacttactggatggcaattgtaactagggggctactttgggctactctgtggtatattaggaccaatcaaggcctatgcttcagaagtctgcagaaaagagcaccaagcactaggaatttctcttgttacatcttcacgagcaatagctcttgttattggaccagccattggaggatttcttgcacagcctgcaaagaagtacccgaatcttttctctgaggaatccatatttggaaggtttccatacttcctcccttgcttcgtcatatcggttctagcggcaggagcatgtcttgcatgcatttggctgccggaaactctgcacatgtaccatgatgacaaagtggaagctattgaggaaatggaggcgcaagttgctgattcgacctcagaagacaggaaagctaaacaatctggatcatgcagaatggcatccacaaagaacctgctaaagaactggcagttgatgtcagcaataaccctctactgtgtgttttctctccatgatacagcttatcttgagatattttcactctgggctgtgagcagcagaaaataccggggactgagttttacatctc

SEQ ID NO: 23044 - DNA, 1293 bp, Triticum aestivum
  Clone ID: PAT_TA_23044
ggtgccttgctcctgttgttttgaggggctgggtttggttccttttcctccactcccccagccctcctcgccccgcctttccccaacccatccctccttctctctccctctctcgtgtatgtgcgtgtgtgtgtgggtgtgttggttttgagcaatcttctcgccggactcttctcctagcttggcgcgatccgcccgcaagacgccgggagcaagcaaggaacgtacgtacacgccgtgtcgtcgtcggcttgtgctctctagactgggttggacaggcttggactggtcggtgtgtggcggagctcaacgacgacaaacaagcagttggaagaaatgagacaacaaccctcttagcctcctccccggccctctcctccgccccctctcctccacttctatcccctcggtttcaagcaagagacgaagctagcagggagagagtgagcgaaggggggaagaagaaggagcactgccaatccaagaacaatccggagttggtgtgacgacctaggttgggagccgatggcatcgaattcatcggcagcggcggcggcggcgttcttcgggatgagggatggggaccagcaagaccaagatgaagccgctgatatcacagcagcagcagcagcaccaccaccaccaccagcagcaccacctggcagcggtggcacttcccggcgcggggagccccgggccggccgcgccgccgagggcgtccggctggcgaccacggccacgacggccaagagccgcggcgcgcccccgctgccgccgcccggcgcccaccccgagaagaagcgccatctgccgggcaacccagatcccgacgcggaggtgatcgcgctgtcgccgcagaccctgatggcgaccaaccggttcgtgtgcgaggtgtgcagcaaggggttccagcgggagcagaacctgcagctgcaccgtcgcggccacaacctgccgtggaagctccggcagcggagcggcaaggaggtgcgcaagcgggtgtacgtgtgcccggagtcgagctgcgtgcaccacgacccctcccgcgccctcggcgacctcaccggcatcaagaagcacttctgccgcaagcacggcgagaagaagtggaagtgcgaaaagtgctccaagaagtacgccgtgcagtccgactggaaggcgcacaccaagacctgcggctcccgcgagtaccgctgcgactgcggcaccctcttctccaggagggacagcttcatcacccaccgcgccttctgcgacgcgctggcagaggagagcgccaaggcgcgcgcgccg

SEQ ID NO: 23045 - DNA, 704 bp, Triticum aestivum
  unsure (1)..(704): unsure at all n locations
  Clone ID: PAT_TA_23045
gtacttcctccggcaggccggcctcgcgcagaagaagcgccgctcccgccgcttcctcctcgtcgagagaaatggcgacaggggagccaccgagcgccgtcacaggctgaaacccgatgtcaccagctctgtagacgcgatgggattaacattcccagctctttccctgggcgccagccggccgaggccggacgccgcgctaccgccgtgcctgactctgatgccgagctgctccgtcgccgtcgtcggcgccgagccgcgcaccgaagctccctccttccctgggcctgggtgtcacatgcaaatcctcctccggcaggcgcctgacctgggagctaaagatctcgtccgacggccgccccggaagaccgaccagcaggccggcgccgccgccggctcgtcgccgccttttttcgggaacatcaaggtcacctagagcgaagcaaaagacaacccaaccgaaacgcgcgggatgaatttgccgttnacgtccgcgacacnacgaccaacgaacaaggaactttgcaagggcggctgcagctcttgctantaatcaaantgctgtttgctgnacggataagaatcanacgnnatcataacatcgttnnacatanaggcanttnnggcaatttcntnaataaaaganggccatntacacttntnaaaggaanaacctngngcctttttccccggggaagnggntn

SEQ ID NO: 23046 - DNA, 527 bp, Triticum aestivum
  Clone ID: PAT_TA_23046
agcagccaaggcggtaagcagaaagtggagctaaaggtttcaaagatcattgtgattggggagagtgatcccacatcttttcctatacagaagaaacgagcatcaagagaatttctgaggactgtggcacatctccgtcctcggacaaacacttttggtgcagtggcaagagtaagaaatgctctggcatatgcaactcataaattttttcaagacagtggatttatttgggtatcaagccctattattactgcctcagattgtgaaggagcgggggagcagttctatgtcactactttgctttcaaatagtgctgaaggaggctgcctagtcaacagcattccttcgaaggatggaagggtcgattggtcacaggatttcttctgcaaaccagcatttctaacggtgtctggacaactgaatggcgaaacatatgcttcagctctatctgatatttacacatttggtcccacatttagggctgaaaattcaaacacttcaaggcatttggctgaattttggatgat

SEQ ID NO: 23047 - DNA, 905 bp, Triticum aestivum
  unsure (1)..(905): unsure at all n locations
  Clone ID: PAT_TA_23047
cgcacgctcgggcagtcacccacttcggcaccacccatggcgtgccacctcgtcgccgcctgcgtcccgcgcctcgccgtcgtgtcatcctccgcctccggggaccccgtccgccgtatccggcggcgcgcgccggggtcgcgttcccagaaggcccccacggcggctccgccccagccgtccgtcgcggaggtgcggcgcgccatcggggccgccgacgacccgtccgcctccgggagggacaagcagtccggtttcatggagctcctcgcctccacgccgatcgggcagccggagagcgacgcagagcgccgaatccgtgaggccgccgagtgggtggtcgacaacaccgaggcgcgcgcacaggaagggcaaaagtctatcttggtgctatgcatgaagatctttcctctgtggctgttcctcatgcttactgcccttggagttataaatttaccatttgatattcccggtctggatatggatgatctcctaatgtaaagtgttagattgtttcttctcccagctatatgagccgcggatacttgaaaagaaaaaccagtgatagatattgttcacagcactattgaagttgcttgtttcgtaaggtatgaataaactgtatgaccttttctattctttgccttattgcaattggaaaatttttntttgncccttaatntacaaantngggaaacnttngnanntaaaaaaaaaanctaaaaaaaaaacttggaagggtccnttttaaaaagcngcccgngggcccnaatgnatttttccaacccgggntgggntaccnannntnaanggtnccccaatttgccccttataggnaggctcttttaanaatnnnttggcccggcttttntacaangnctnannnntggaaaaaccttgggcct

SEQ ID NO: 23048 - DNA, 635 bp, Triticum aestivum
  Clone ID: PAT_TA_23048
ggagaaacttatttggaaattcttcttccttccttcattcgtttcattgtgcccgcccagtccggctccggagtccccaagaacaagaagaggaacaaggagtagagcacattgatccaaggaggagagatacaaatggcgtcagcctgcttcttcgcccgttgcgtctccgtccccgcgcacctcctggccatccccacgcccctcgccatcaccacccgcaggtataccgaagaagagggaggaacttcatttggaaactctcctccgttccttcccctcattctgcccagtccggctccggagtccccaagaacaagaagaggaacaaggaggaggagaacacatcgatccaaacgaacgccgcgatcgagacgattgagagataaaatggcgtcggcctgcttcttcgcccgctgcgtctccctccctgcgcgcctcctcgctcaccccacgcccctcgccatcacctcctgcaggctgcggcggctcggcgccgagggagcaaggccggtgtgcgccgccgggaggatgctcggctccgtcagatacggcaccggagcggcgttgggccccaaggaagcgggtgccgaggtggccgccgtgccgccgtcggtgcccgtgcgcgtcgccta

SEQ ID NO: 23049 - DNA, 975 bp, Triticum aestivum
  unsure (1)..(975): unsure at all n locations
  Clone ID: PAT_TA_23049
agcgcttgggnctatngctcnttgggantggtccggcccctgtttnangtgcgcgtcacccgatttcccgacgntgtgatttttgtgaatcntnagcattaccgcttcttcacgntgcttagngcggttctccggatttgtgngtttcagatattgaacccacgttcttncatngttcagtgatgtncgttgtcgggcaattcngtcagangccgccacnggccgttgtgcttaatgtcgtgacgcggtttggagaagatatcccagtcactcccattggaccggaggacaccaagntgtaggatcaatgtcgatggacattgcaactctgcgaccgcggactgaggntttgcggaaagcaacaactcggcgaaggcgggttcggcgcggtgtataagggtactctgccagatggcaaagagatagcagtgaagagactgtccaagagctcgacgcaaggtgtggaggagctgaagaacgagctcgtgcttgtggcgaagctcaagcacaagaatctcgccaggcttgtcggcgtatgcctagagcatcaggagcggctgctcttctcccagtcaggccccccccggtgccccgtcccgatcttgttcgggtccaggctcccttgacacctatgatcagaaactcagaattgcaacacatatactatttctaaacttatgaggacgaacaacagacatgggagaaacgggggaacttgactgggagaagaggcagaggttatacgcgggatcgctcgaggctgcatactccatgaagatcccactcaaggcgtccatccgcgnttcaaagcaacaactgctctcgacccgatatgacccaagtctcggcttggctcccaagnctcggcnagcagancagggtacaacgtgnatcgnaatatggtantgcgccgagtactgtctggaacactcgtaaacggcgtgtcacntcgggcaggtcgaaattnaagaagan

SEQ ID NO: 23050 - DNA, 655 bp, Triticum aestivum
  unsure (1)..(655): unsure at all n locations
  Clone ID: PAT_TA_23050
gaaaccttcaccaacatggcaacatcgaccatgggcgccgccgcggccgatctcgaggcgcgtcagctccgcatcctacgtcgcgtcgaagaccttgagctcgctgcccagcagcaccgtctcggggccctctctctctccgaccccgaagcggaggtggaggcgggggacaccgaggagcggctctcggccctcctggctgcgcgcggcgtgcacgacttcgccttccggcgtgttccagctgactactacgaccgccctctcgaggagcgccgcgacctcctcgccgccgattcagtcgcccagctttgcaagagcatagtgatggtgaataccaaagctgctgcagatgtagttgactgcagtaacccaaagaattctaaatattatgttgttattgttcagtatatggcacggcttaatgctgaaaacatcaagaacttcctgtataccctaaacgagagccagatacccaaaaagagatttaacatgaggcccccaccaggagcggcgtccctcgggctgtctcggggggtgccctctggggtggcatgcattgcggtgtcatcggtcatcccgctcatcttggtgggagcctccgccgtgggggatgtacttttccggatnggcctaaattcaatgntnaccattnngg

SEQ ID NO: 23051 - DNA, 620 bp, Triticum aestivum
  unsure (1)..(620): unsure at all n locations
  Clone ID: PAT_TA_23051
attgcgccaagtgtgacggtggtacgggcgaccgctgcacaacatggacatacaccgctccgtatgcactgccgccgtcgtgctactattattatcattttccagcttcccaaagccgtccgccggctccgccgctagagccgagctcgtcacgtggaagtgcgacaacggcacgtactacggtgagaactccacctaccagtccaacgtccgcagccttcttgcgtccctcgccgcgaacgcctcccgctcgttattcccggtgggattcgccaccgccgtcgtcggcgcaagccccgacatggtgtggggtctggggctctgccgcggggacaccaccaacggcaccgagtgcgcgtctcctgcctggactcgcgccggagtcccttcggaagggcaagggctcggggctctcatcttcgcgtccctgctcctcgctaccgctcgggacgtcccgcaaccnganaccggaagtgnagtctgggaacaanaacaatccntgccccnaaaaacggcggtntaaccctcnnacaaccttnggccttccaatgggnggtnaaacanncaagnaccccgggctggcccaaaaggttcgacaccanaagntnggcaagttaagc

SEQ ID NO: 23052 - DNA, 775 bp, Triticum aestivum
  unsure (1)..(775): unsure at all n locations
  Clone ID: PAT_TA_23052
ctccgacctcggctccgacctcgcgctcagcaccccgatgccctcctcgccctcctcctccgccgcctccgtcgacgcccctccgcctccggagcccccgcacgccccctactccccgtctcgcgccggcctttctcccccgccgccggaggtgtactcctcgtaccatcccgaggacgcgcacctaccgtacgcgcccccgccgccgccggcccgccatgagctccccgacgacatcgggttcggcttccaccccccgccatcgctggtgcgagccagcgagtttctctgggaggaccgcccgtcttcatcgacggcctcctcctcctttctccctgacgccgcaacaaggtacaggcagctgcttgagcagacaggaagccggtggctccgctctaggcccaccgggcggtttagatcggaccttccaccgctcagctccgaggctcaacccctgggggcatcatgatgcagcagtgccggtgccacatcatgagacgacattgatgtcgttgggtgatgatacggtatccggcaatggagtggaagtaggtgcctcaaaaggagtcngagggagcggggcaagacgtcncanatttgagtgcacatagctttgagatggccgnganaccgggggcattntggnggcactttcttcngggctgcntanacnaaggctaanttacccaacannaggatgccancgcaaggcaagtgacgggggatacnnccatcatggaanggatctgtcaaatcanaaagtgngttaagaaga

SEQ ID NO: 23053 - DNA, 835 bp, Triticum aestivum
  Clone ID: PAT_TA_23053
gcccctcccccgcctccccccgccgctcctccgggtgcggcttccgtcccgccaggcatcggagcaggtaagtcagcaacgcaacaatggaagaagggaaagacaagaataacaccaccgagaaggggctgttctcaaacatgatgcatggttatccacctcatggaggatacggataccctcctcaaggttacccgccaccgggggtcccctaccctcctcccggggcgtatcctcctccaccacaatatgggtaccctcagcccggtggctacccacctcacggtggcatatccccccgtcggctaccctggctacgggggtaggcacggaggccatggctacggcggcgggcacatgggctacggaggcgcctacggcggcggcagcaatgctctcgggcacaaccacgcaggccacggctacggccattatgggcacggaggccatggctacggacaccacgctcccggacactaccacggcgggcacggctgggggcaccatggccatggatatcaccaccaccaccaccacggcaagcacggttacggcaagttcaagaagtgcaggtgatttgcgtctgcacacggtgattgcgcctcatcaactatcttaagtaagcttggttccagaaatacccccgcggctgggaagagcgctagcatgtctcccgtgagactgcgatgatgcaatgctcctgtactgttactggatacaccacataatttggtgctccagagctaataaggcctgctaataagtagcggaatctcataccagtcatttgcggcagttcaggcgggcgaaaaaagaaaaaaaaaaaaaaaaaaaa

SEQ ID NO: 23054 - DNA, 479 bp, Triticum aestivum
  Clone ID: PAT_TA_23054
ttgcttgctgctctggttgccgtggaaccccaagcagagctagctagctaacccaaggcttgcatcatgcctcgtgaccaagttgacttaagtccagggcagctgcataagctagccgatttgatccatcgacaagaagtccagaagcttcaagagctcgagttcgagtcttatgcagagcaagaaaagtagctcagtgacgccaaagacgcccgtgatatggtgtaccacatccttgatagtacacaggagatgatagcgcaggccgaggcgccgatgacgacgcaaccaagcaagatattgccaaggatgtgtatgggtattgcaccatggccatcggaacatccctcaaattcgtccgtagttacaacacccggggtcacctaccttgacaagctcaagaccacagtgacgatttcatcaagcagctaaagtggttgatgcaacaccccccgcggggagctggcgctgcctcttgc

SEQ ID NO: 23055 - DNA, 570 bp, Triticum aestivum
  unsure (1)..(570): unsure at all n locations
  Clone ID: PAT_TA_23055
caaggagatcgccaacaaggtcggcttcgtctaccagctcaacatctcgccccggacgcgtggggtcgacgaggagatcttcgtcgtggacctcaagaagggcgccgtctccacagggaagtacgaggggacgccggacgcggccttcaccttcaccgacgacgacttcctcgccatcgccagcggcaagctgaacccgcagatggcgtttatcaggggtaagctgaagatcaaggggagcataagcgccgcgcagaagttcacgccggacatcttccccaagccgtccaagttgtagaagaccggattgccgtgcctttgccccgttgatcggttaataaaagagtctagttgtgttcgcgatggcaatttggtgtgaccagagtgagagggattgttgctggcaacagagtttgttcacctagaaccaccacacgaacagccgaagtttcagtgtctggagtgaaattcgttttctttggttgagaacgaaggagaacgctaggtacgatgtgtaatgtgacgatgataaaggtttttcgatggatcaccgtttactcttaaanaaaa

SEQ ID NO: 23056 - DNA, 854 bp, Triticum aestivum
  unsure (1)..(854): unsure at all n locations
  Clone ID: PAT_TA_23056
gctcgaggcnncggccgggtcgcggaaaaaaaaaaaaaaaaaaaaaaaaaaaaaaaaaaaaaaagccaccctagccccagccgaggcgactcccgtacctgcacgtctcccctcccctccccggtggttggagccattagagggcgaggagcatcatctcctacagtcccaagatcccaaccccatctccagcctgccccctcccccagtccccaaatccgtagtcccgcgcgccgcgatggaggcgagcaagctcaaggcggccaggctcctggagcagatgagcgcccacctcgccaccgacgccggcaaggagatcgccaacaaggtcggcttcgtctaccagctcaacatctcgcccaagaagatgggcgtggacgaggagatcttcgtcgtggacctcaagaagggcgccgtctccacagggaagtacgaggggacgccggacgcggccttcaccttcaccgacgacgacttcctcgccatcgccagcggcaagctgaacccgcagatggcgtttataaggggcaagctgaagatcaaggggagcatcagcgccgcgcagaagttcacgccggacatcttccccaagccgtccaagttgtagaacgccggattgccgtgccttgccccagtgatcggttaataaaagagtcagttatgctcgcgatggcaatttggtgtgaccagagtgtaagagagtttgtttacctagaaccaccacaagaacaacagaagtttcagtgtctggagtgaaattcgttttctttggttgagaaggagaccactaggtacgaacgatgtgtactgtggcgatgatgataggctttctcgatggatcaccgtttactgat

SEQ ID NO: 23057 - DNA, 954 bp, Triticum aestivum
  Clone ID: PAT_TA_23057
agctcccccgaccagcccgagccgacgcccgtaccagccccgcacgccccccctcccccgccctcggagtcattatagagggcgaggagcaccatcatctcctacagtcccaagatcccaaccccatctcccgcctgcccacccctcccccctcccctgccctcgacccgcccgccgcgctggaggcgagcgagccgagggaggccagggccctcgagcagctgaggccccacctcgccccctcctccgcccctcccttcccctgttccccaatcttgctccccgtccgccgcgatcgaggcgagcaagctcaaggcggccgggctcctggagcagatgagcgcgcacctcgccaccgacgccggcaaggagattgccaacaaggtcggcttcgtctaccagctcaacctctcgcccaagaagatgggcgtggacgaggagatgttcgtcgtggacctcaagaagggcgccgtctccacagggaagtacgaggggaccccggacgcggccttcaccttcaccgacgacgacttcctcgccatcgccagtggcaagctgaacccgcagatggcgttcatccggggtaagctgaagatcaaggggagcatcagcgccgcgcagaagttcacgccggacatcttccccaagccgtccaagttgtagaaggccggattgccatcccgtgcatcaaaagagtttagttgtacaaggctgaagatcaacggttaataaaagagtctagttgtgttcgcggtggcaatttggtgggattgttactgggaaggagtttgtttacctagaactaccacacgaacagcagaggtttcagtcagtgtctcgagtgaaattcgttttctttggttgagaaggagaacactaggtacgaatcgatgtgtattgtgacgatgatgataagctttctcgatggatcactgtttactgttaaaaaaaaaa

SEQ ID NO: 23058 - DNA, 594 bp, Triticum aestivum
  unsure (1)..(594): unsure at all n locations
  Clone ID: PAT_TA_23058
ttttttttttttttttttttagtgaaagttgtataaatagacacataagatcggggtacttacatacaagatttattccattattggtttgaacaaaaaacggagggcggcagcagcggaaagccggaaacacaaaaaggagaataaggaaaaaacaagaaagacatgccgtgccacacgcagccaacgtctggataaggaagcaagagcagccgaggtcatggttcgacttgactgtatgctgtcaactgaaacaacagtgtaaaaacgaattcttacaagcaccaccccaaatcttttgagacttcacctgcacatgaccacagcatcatcttcaggtttcaagcaatttccgatgcctaacaccatcagcatcatcttcatcttcagtggaaagagagcatccaaacacatcagccagaacacggaggacagaaatatcatcttcatgaagcactgcanggcttgagaagactgacgcactcgtcgtactgcgggatatcctgagacgcatgttgcatgatggatatacgttgtccgacaaactggctaccgggtcaaattctcctgttcactcgttacatgggtccccng

SEQ ID NO: 23059 - DNA, 857 bp, Triticum aestivum
  unsure (1)..(857): unsure at all n locations
  Clone ID: PAT_TA_23059
tcgcggccgcgtcgactataatgaaagatatatcccaaggttggagaggatcccagtatctgttttgaactcaatatctgatgagcatccaatgccctatatctacatgtctcgcctgaaatacccccctaactatcagccagctcctccagcaggctgtgcttgtgtaggcgggtgctcagactccaaactgtgtgcctgtgtagtgaagaatggtggggagatccctttcaatgataaaggctgtatcatagcagcaaaacctcttgtttatgagtgtggaccttcttgcaagtgtcctcctacatgtcataacagagtcggccagaaaggcatcaaatttcggctgcaagtcttcaagaccaaatcgatgggttggggtgtgaaaactctcaactatataccatctggaagcttcgtctgtgaatacattggggaagtgctggatgatgaagaagcacagaaaaggatgactgatgagtacctatttgctatagggcataattattatgatgaatccctttgggagggcctatcaagatctataccctcgcttcagaatggccgggtaaagatgaagaaactggtttgctgttgatgcgtcaaagatggggaacttgctaaatttttaatcatagctgcaccccaactctatgcacaaaagttctctatgtcatgatgacaagatgccctcatacatgtccttgcctgcgaagattccactggccagactatatacactccactagccttggatggctcatgatgggactcggacacaaggcgtgggccgcgtgtggcccgtgttgtatccgggtcctgggccgtacgtagcctggtgctcccaacntcangca

SEQ ID NO: 23060 - DNA, 1185 bp, Triticum aestivum
  unsure (1)..(1185): unsure at all n locations
  Clone ID: PAT_TA_23060
cctcccgctccccgtcggccggcggcgccgccggcgccccggcgcgccgggcgcggccggcggcggggccctccacggcgcgcccggccaggacgggcccgccgtcgtggcccggctgccgcgccggggggagccgcgccccgagccgcacccgcaccaggtgggccacccccggccgccccgccgccgccccctgcgggccctccccctgcgccgcaccatcatcatgtgggtcacgtccggtgcccacgcccacctcaacttcgggcagtcccattacgccgggtacttcgccaaccgcacgacggtagtgggggggaataccccggtggagcagagccaggacgacgagatgaagaagttcatggccaggccggaggaggtgctgctgcagagcctcccctcgcagatgcaggccatcaaggtgatggcgacgctggacatcctctcctcgcactcccccgacgaggaatacatgggagagtacgccgagccggcgtggctggcagagcccatggtgaaggcggcattcgagaagttcagtggcaggctcaaggaggtggagggcaccatcgaccagcgaaacaacaacccggagaacaagaacaggtgtggcgccggcatcgtgccgtacgagctgctcaaaccgttctcagaaccaggggtcactgggaggggcatccccaacagcatctccatctgactgtggccccaggacaagatatcactgcatgtaggattaggaataagatgtgcaccatgtacgcacccagcagcgattgctcccgtcccgtgcatgacaggggccgggagaggcatctactagtgtgttcccgctattgtatgccgtgaattagtagtactaataaggtcctttgcgccctgtcctcagtnnnattacaattnactgnccgncgntttacaacgtcgngactgggaaaaaacctggtnttacccaactttantcgctttgnagnacattcccctttttgccaggttggcgtaaanancgnaaaaaggnccggcnncnancngccntttccaaaagnttgngccancctttaaatngnnaaangggaaatcccantttttaagggggataatggggntaaaacanccggantntaantggnngggggatttnaaaatnncantnccaaggtttntttaaggcccnttanccct

SEQ ID NO: 23061 - DNA, 777 bp, Triticum aestivum
  Clone ID: PAT_TA_23061
gcccatttccccttttttggcatacacttcccaattcgagctcgcacacacggagagagagagagggagatgtgtcactcgccgtcgggatcacgcgcgacggcgcggtcgggcagggtggaggaattcgccgacgcggcaacggaggaaggcggcgagtccaaactctccgcgctcctctacgacgtgtcgcagcaggtccaggacagcctccagagcatgctgaagatgacgggcgagatcgagcagtgcagtgacgagatcgaggtggagatcgagcaggccaaggagggcgtggctgacaagtacagggtgctcgaggaggagaaggaaaggttccagaaggtggccctcgcggcgctcaacatcctgagcggtggcatctgaagcctgcaccaccttaataccaacaaagacaatcctgataactgccccgctctgtagaccaccgttcatgtgcaagcctagcaatgaaccgccagttgtactcctccatatgtgactgttgccagttgtcaggtcgtcacagtgttagccaccattcttttgcttggcctgtcagccactcggatcaaagtgtggtggcagtagcaatagtagtacgagtttgctcaggctggcttttccatagcagaaaagcctccccttggacggggcagcatgcgcctccctggtgcttgacacaaaaatcattatccgaaattactgttaattcagagagactatgctgttacagacaggagagcagagaaattatctattcaaagagcattatgc

SEQ ID NO: 23062 - DNA, 453 bp, Triticum aestivum
  Clone ID: PAT_TA_23062
ctcgtgccggccgcttggactcatctgacgactgctctgctcccgatcccatggcggcggcggcgccggcgggcgagccggaggtgatccgggacaaggcggcgatgcgggcgtggtcgcggcgccaacgcgccgagggcaagacggtggtgctcgtgcccaccatgggcttcctccacgagggccacctctcgctcgtctccgccgcggcggccgtgcccggccccgtcgccgtcgtcgtctccatctacgtcaaccccaagccatgttcgcccccaccgaggacctcgccacctacccctccgacctcgccggggacctccgcaagctcgcctccaccgggcgccgtccacgccgtcttcaaccccccagacctctaccaccgcggcgccgctgtctctggccgccccgccgagggttcccgccggcgccgctgcctcttccctgcctggg

SEQ ID NO: 23063 - DNA, 758 bp, Triticum aestivum
  Clone ID: PAT_TA_23063
gcacgagggaggatcgaacccatctcccgacctcctccttccctcgacccccacctctcgaacccgctcgcaggccctctcccgatcccatctcactcacagtcctcccgccgccgcctttctaccccactttcccggcgccagcttgttagatcccggcgccagcttcagggaaacgatcgcgcctcgactcccctcccctcccatcccctcctccgccgcctttctaccccactttcccggcgccagcttgtcagatccgggcgccagcttcagccacgatattcaactactgggtgtgttaaattctcgaggatgatgaatcgtcagtttgcgaatatgatagtacacaattaccccaagggagtttattccctgcgccggatcaacctcatggagcatctcttctacccttcaacagaagctgccgaaaaagcagaagtgaataagaagggatggttatccaccatgttgaaagggagccccaagcagcgtctgcccaagacgaacatcaacttctcatcactgcctaacatggccgacttaacggccaggcatttcttctccctgctgagagggcatggggagggctctgtcatgttcgtcagccctaacgtccacacgatgatgtacgacactagcacggacttcgcctttggcatgccccaagccaacttcggtacgcagtgcgcctcgcccgccctgtccgtcgcccggcgggcctctgaagtctagcaaaggaaagggaggaatccttg

SEQ ID NO: 23064 - DNA, 903 bp, Triticum aestivum
  unsure (1)..(903): unsure at all n locations
  Clone ID: PAT_TA_23064
ttnnagcggccgcccgggcaggtactaagggaggcaagaatcgaccctccaatccagacactgtcaagttcaccggcaagaactccttcgacatctaatctcgtacttgtcgaggggtagtttgtataaacttttgcataggagtggtgcaagggaggttctggatgagagacgccgcttgaacatggcattcgatgtggcgaagggaatgaattatctacatagacgtagccctcctattgttcaccgtgatttgaaatctccaaatcttcttgtcgacaagaagtatactgtgaaggtatgcgactttgggctttcgcgactaaaagccaacacctacctgtcctcgaaatctttggcaggaacacctgaatggatggcgcctgaagtgcttcgagatgagccatccaatgagaagtctgatgtgtacagcggccccgtcctcccgtgggaacttatgacattacagcaaccatggtgtaacctgaatcctgcccaggtagttgctgctgttggctttaaaggaagaagacttgaaattccgaaggatttgaatcctcaagtagctgcattaatcgaatcctgctgggcaaatgagccatggcgggaggccctcatttgctaatatcatggaaactctggaggcctttaattaacaaggcccgggtgccgcattgatccgctcagacccgtagcatttcaaactgccttccctgagcagccctcagggctgccgtccgcgtggcgcgggcggcttagttttttgggggttttaggccgttgatggttggctcttccatccccaccatgatccgggtccctgattaacgtcggcacctggccggtacccctcaaantaaagtaccccgcaanccctcccaagggcttaaagnacgtccaaga

SEQ ID NO: 23065 - DNA, 567 bp, Triticum aestivum
  unsure (1)..(567): unsure at all n locations
  Clone ID: PAT_TA_23065
gcctcctccactcctcgtttctgtcgctcagcggcgccggatttggggtgccatcgggaggacaacagcgagcatgagaggtagcgaccagatcggcatccggcacagaagagggctagcccgcccgtgccgccggccaggttgtggctggggcggggaggggaagcagccgtgcccgggggagttcatccccggcgcccgcatcgtcgtcgtcgaccttgcccacacggcaggtcgccgctgctggccgaggtcgccgaggtcgccgaggtcaacaccgcccccgccggcctgcagcacatccttctcgtatgcccttcctcccctttgtcgatcttganatgtgttgatttgattgggctgttcgattcaatgcttccgagagaggaagatgcgaatggtgggacgttcaatggcctaacagatcatctccccgaccnccgccggtatggangccgggctcagnagctccacgcgtcaagtgccccgcggggttatggggacacccgcgctgacaagggtccgcgacccaaccgtaattaacttttccnattaattnncctattt

SEQ ID NO: 23066 - DNA, 545 bp, Triticum aestivum
  unsure (1)..(545): unsure at all n locations
  Clone ID: PAT_TA_23066
ccgtatccaaaatagctcagctcagcgctgctcgccactgaactcggctggactggtgacactgctgcacagctgccacgccatggctcccctgctcttcaaggacatgaggagcctctcgtgctcgtcgccggcgtccaccgccatatgccccagcctggagcgccagcccatcttccgcccccagaaggccggcgccagcccgctcttccaggtccccgccgagcccagagcccacaggcaggacggcaggaaagggcagcaagcaccaccaccaccaccgggctggcgttgccaatggcgagctcgccagcccggccgggtcgacaaggttcctgctcagcggctgtgccgccgtcgacgagattcaagaggtcgccacggctgcggccgcgcctccggccgctgccccgggtggtggtgattcagaaaggaaggacccgtgctgctgctgatggtaggacacaccacaacaccaggacagnggtggtatgaagttcctgcctgcaagctgcgccggaagtgaagacactgcaagatgaagt

SEQ ID NO: 23067 - DNA, 596 bp, Triticum aestivum
  unsure (1)..(596): unsure at all n locations
  Clone ID: PAT_TA_23067
ctgactcgcagcaccttctggagcctctaaaccacgtacgctgccggccgccggcgatctcctcctcggcggaagccgcaggacggaccagataagcggagcggcgcactgcagtggagaaggcagagcgccccatcgctcgacccccttgacagatcgttcgctggctgggagcttctcaactttttgttccgtgtggacaatggctgagacccctgttagcgccgttcttaggaacgtcggcactcttgcagttcaaggagactactttcttatgcggggtcacccttggaagtggacttccttgaaagatgaccggatgcggctgcagggctacctcaagagacgccggagagcaaacgaagatctgggaaatgcaagtgctgctatcttggatgagcaagattaaggatgctgcatatgaggcgggtaatgttattgaaccgcggattacatgaagaagagaacatgatcaagaagaaagctcatggggtgcaattcaaaggatgctcggtaccgatgactgataccntcataaatggggtgaaatagcgggtgagggccacgattgttatgctaaacatgacatatgcttn

SEQ ID NO: 23068 - DNA, 624 bp, Triticum aestivum
  Clone ID: PAT_TA_23068
gaacgtgccacccgtccgcccccgcctgcgtgccccgccgctcgccctccccgcgctgccgccggtgttcgtccgtcgccggggcccgaggggtggggcctctcgtggccgtggcgccgccccgcacgcggtccccccccaggtgccgcctcctgcgtgctcgggttcctcccctcctccccctgctgctgcttaatggccgggttcctggccctattaggtggggctgcggtagtcagaacccaaacggctgcacaggtctgccccctccagagtgtccaggctgtggatagcagcaggtctcactccgaagcatatgcccacgccgatggcatctcaggatgttgtgtatcgttctacaatagttgattttgtttctgtatggtataagagagatatgaaggtcacaatcttttccttacttacggatgtttaaggaaaacaaggatagctgaatataagacacaattcatcggtatgagcttgcgttgcaaatactaccactccgtcccataatgtaagacgtttttgcaaagacttttttttacagactaacatagcttataaaaacgtcttacattatgagacggagggagtataagacatttacaatgactaaaaaaa

SEQ ID NO: 23069 - DNA, 1431 bp, Triticum aestivum
  unsure (1)..(1431): unsure at all n locations
  Clone ID: PAT_TA_23069
agctcgagttttttttttttttttttgaatggaacgacaaatcatatcatataatcaatcgtctcagccaaaatcatcccctaaaaaaaaagtgacatcaaaaagtaacacttgctcacgagttaaaaaggcaacatttaaatagctaaagaccacatgtgttgtcctggtgactagtacatatgattcaacaactatctttccatcacaaaaggatggccttcatgcaccatcggttttggactcgacagctaagttgcttgagcctctaagagaaaaccaattaggttatccgtctcctgttgcttcttttgccaggcttcattcttctcttgaaggcgtcttcttcacaagcttcccatttttccctattggttcctctgcatctcttcaaatgttgtcacttgtgcttgaagcctcgcggctaactcctctcggtgcctatcacttgcatctctcgcctctccatccttctcttcaattcttacttcaattctgtgctaattaagtagaggtccaaaatctcctggatcttgatgcataacccatgctagaaaggaaggtgctatgggtgctttcttcctttagaactccagccacaattgttgtatccgatattgcctactcaccttctgattgtgcttcccttttcttttccatcgcattcggcttgctcataccaccagtaaagcaaacttcatatgatggattacaaagaagatagtttagctgctttgattgggtctgtaggtctcattccccccggtggagaatgcttatggatcagttggaccagtggagcatgcttatgagtcttggccttgtagtgtaatcatgttatcagattggctagatgtgcctatcatgtcttgagaaccttgcctcccggaatcagtgtcaggcgagttgctatccttagaagttaggtgaggtgatgtgtttgttggatttggtgcagactattcttgatggtttgtaggttcaaccgactcagttgttgtggtagcttggaccccagttattcttgaggtagcttgatgcacttgtttttaaacttgacacctttttttgtttttggcttggnagacccttcaggtgccatgtnttgggtatgacttgtaaaattgaaactttgaattcctcaccaatataactctggatctcactttctctctttcgtctatgtcacctcagtgcttttctcccccaaatcccttcgctgtatccgagagttgtcgccggtcgctgtaatcagtggggaaaggcttgcgggcgggttgatgcggtggatccgagatccgctcgtggggcggcctccttcaatccgtcgttgccggtcgctgcaatcaggggggatagagcggagtgctcgcggggccggtcgccgtcgccggtcgctgcaattagggggagatccgagctcgaaccggc

SEQ ID NO: 23070 - DNA, 624 bp, Triticum aestivum
  Clone ID: PAT_TA_23070
cgtcaacggatccaatccaccaaagatggcctgagcccctcgaagcgcgtggacgcggcgctccggcgggcgccggcgttcgccgccgcctgcgacgccgccttcgaccgctgcctcgccgacgcccagcacgccttctccggcgtccgcccctaccagctcgcggacgcgtccgagcacctccactcggccctgcggggctccctccctatcgtccgccgctgggtgccctcgccgccgccgcgcgtgcgcgtagactctgcgctacgcgtctctggcttggaaggcgctgccgagctctcgcgggatcagttcggggagttcgcggccgagctgttcagggaggccgtgctcgccggcgcggccgaggcggcgctcgtccgtgccccggccggcgcggccgggatcctcggggtggccatcgtctcccgcgccggcgccggcgcggctgggaagttggtcgctgtctacaccgccggcgtcgccgccgctgtttacctcagcttgggctaggcctttgttaagctgtaaatctgcacaataaactgcttgtactactctgatgtaatctgaagagatgtttcttgcgtagtatggtcagtgtaaatacagtgtaagagagat

SEQ ID NO: 23071 - DNA, 752 bp, Triticum aestivum
  unsure (1)..(752): unsure at all n locations
  Clone ID: PAT_TA_23071
gccaagctgcaactgctgcccgaactgatgctgcgaaggatgctattctcaccgctgaggaatcaaggaaggctgcccatcatacaactgctcaagaagatggccttggacagcctaaaagtgggtcggcaccagagcagaaccaaggagatgcaagcataagtgagagaagtgatcatgcaagtcaaaagacagaacatgatggtcaaaaggtcgagataaaaggtcctgtgcattccgaatctctgaccaatctgccttttgagttctaccactattatcatggaagtagctatgacctggggacactcattgaggtacgcagaatgtgggattcttttatcagacctggaggaagccgtatacctggccactgggttcagccaccccctccagctaatgatgtatgggcatcatatttggtgcagcccaagtaagtgctattgggttctgacaatggttcttctgcccatccattagaagctttgaaggtacttgggttacttcaatttctttatgtcaactagtgatgtgaaaagattataccggatacagtgattacattgtcagacaaaaattatctcagtgattgctcattgctggtctgtagaccttctttgatgaatgctcgattgtcctgtggctttggcatggactatcgagtttaagttgctgtcaactgtgaagttctttnacacttatatccttaagatcngacccacctgtcagtttctctgggatttgnatttcga

SEQ ID NO: 23072 - DNA, 2779 bp, Triticum aestivum
  Clone ID: PAT_TA_23072
gctgcctggagaaggacatggagatgatggagttcggcgaccagacggagatcggcgagcgcgggatcaacctcagcggcggccagaagcagcgcatccagctcgcccgcgcagtctaccaggactgcgacatctacctcctcgacgacgtcttcagcgccgtcgacgcgcacaccggcagcgagatcttcaaggaatgtgttagaggtgctctgaagggcaagagtgtggtacttgtgacccaccaagtcgatttcttgcacaacgctgacatcatatatgtgatgaaggagggcacgatagtgcaatccggcaagtacgacgagctcatccagcgcggctccgactttgcggcgctcgtcgcggcgcacaacagctccatggagctcgtggagggcgcggcgccggtgtccgatgagaagggggagacgccggccatctcccggcagccgtccagaaagggcagtggcagaaggccgtcgagcggggaggcgcacggggtggtggcggagaaggcgtcggcgcggctgatcaaggaggaggagcgcgcgagcgggcacgtgagcctggccgtgtacaagcagtacatgacggaggcgtgggggtggtggggcgtggcgctggtggtggccgtgtccgtggcgtggcaggggtccgtgctggccagcgactactggctcgcctacgagaccgacgccgagaacgccgcgtcgttccggccggcgctgttcatcgaggtgtacgccatcatcgccgtcgcgtcggtggtgctggtgtcggggcgctccttcctggtggcattcatcggcctccagaccgccaactccttcttcaagcagatcctcaacagcatcctccacgcgcccatgtccttcttcgacaccaccccgtccggaaggatactgagcagggcgtcgtccgaccagaccaacgtcgacctcttcctgcccttcttcgtgtggctcagcgtctccatgtacatcaccgtcatcagcgtgctggtcgtcacgtgcgaggtggcgtggccgtctgtcatcgccatcatccctctgctcatactcaacctgtggtaccggggttactaccttgcgacgtcgagggagctgacgcggctcgagtccatcaccaaggctccggtgatccaccacttctcggaaacggtgcagggtgtcatgaccatcaggtgcttcaggaagggcgatggcttcttccaggagaacctcaaccgggtcaattctagcctgaggatggacttccacaacaatggcgccaacgagtggctcggtttccggctagagctggccgggagctttgttctttgcttcactgccttgctcatggtcactctgcccaaaagcttcatccagccagaatttgttggtctatcgctctcgtatggtctatccctcaactcagtcttgttctgggccgtatggatgagttgcttcatcgagaacaaaatggtgtccgtagagaggataaagcagttcgtaaacatcccgtgtgaggcggagtggaggatcaaggactgtctacctgttgcaaactggccaacaagaggcgatatcgaagtcattgatctcaaggttaggtaccggcataacactccactagtgctcaagggcatcacactaagcatacacggaggggagaagatcggagttgttggtaggactggcagtgggaaatcaacactaatccaggccttgttcagaatagtggagccttctgaagggaagatcatcatcgacggcgtcgacatctgcaccttaggactccatgatctgaggtctcggttcggtatcatccctcaagagcccgtgctcttcgaaggtacgatccgaagcaacattgacccgctcgaggagtactctgatgttgaaatttggcaggccttggaccgttgtcagctgaaggaagctgtgacatcaaaacctgaaaagcttgacgcatcagttgtcgacaacggcgagaactggagcgtgggacagcggcaactgctttgtctgggccgggtgatgctgaaacacagtaaaatactgttcgtttacgaggccactgcttgggtacggcgagaactggagcgtgggacagcggcaactgctctgcctaggccggctgatgctgaaaccaagaacaatactctccatggatcagccctcttggacggtggattcccaaaccgatgctgtgattcagaggattatccgggaagactttgccgagtgtaccatcatcaaccgtcgctctttggagcattggttcaagagtacgcaaaccggtcgtctgacatgtagccgatgagaggaatggcctgaccgcccttccacgctgatcgaaagaccgtcgctctttggagcattggtacaagagtacgcgaaccggtcgtctgacatgtagccaatgagagggaatggccaattttctgcttcaagacttgggagggattcagggatggagatttctccaggagatgggatgagcaacctgcactcgtactctgaacaccaaggcctcaaaaatatgtcaccggcggtgattgatgttgagaaaggtcaaggagaagccagtgtgagataggcatatatgatccgcgtagattgattccaagatttcattcaacccattaagctggagtttttctgtcactggtatgagctgaggatgatgtatgatgtaatgtacccgcaattgtttcaatggcgacagtggcgtagctaggatttcaaaccagggtgagctgataataattgatgagttcaatttatcaaaaaaaaaa

SEQ ID NO: 23073 - DNA, 739 bp, Triticum aestivum
  Clone ID: PAT_TA_23073
cccaaggccaacgccgaggcattcgaaaacgggtggttccattcccgcgggcggggcgtccccccccccggcggccacatcgaggtgaaggaccgagccaaggacatcatcatttccggcggggagaacatcagcagcctggaggtggagaaggcggtgtacctgcacccggcggtgctggaggcgtccgtcgtggcgcgggccgacgagcagtggggggagtcgccatgcgcctttgtcacgctcaaggacggcgtggacggctccgacgaagcagcaatggctgctaacgtgatcaagttctgccgcgagcgcctgcccggctactgggtccccaagtccgtggtgttcgggccgctgcccaagacggcgacgggtaagatcaagaagcatgagctgagagctaaggccaaggagctgggcccggtccggaagagcaggatgtgagctaggctaaaactccttgtgccctcgtccactccagagctgtcgtttggcgtcggtgtactgtattcttaggacaccacactgtattttgttatatcacctggcttctgtacgaactaaggtgcttgctgaattgtttcttactggctgcttatcgtgtatatgccgtatgtacttattagagtgttgtaagtcttctggaaggcagagacgcactgatttttcatggtgttggtgaaaactgaaaattaggccgggcaactactgtacaaagacaatcctgctaaaaaac

SEQ ID NO: 23074 - DNA, 598 bp, Triticum aestivum
  unsure (1)..(598): unsure at all n locations
  Clone ID: PAT_TA_23074
acgacctccggtcccggttcatcggcgcggaactcccacaggctacgcgacctctgctgcgacctgcaggcgcagcggaacgccacgtcgctgctcaaatgcctgctcttcgccctacctgcgctcctcgtcctggctgccggcgtgctcctcgtgctacgcttcgccgtcaccccgcaggtcaaggcctacgtcgaggacgcccgtctcatcagcttcgtcctcgtggacacacgacctgcctcggcggcgaccacagggccgtctttcctctacaacgtgtccatctcggtcgccctgacagttcgtaacaccaatggagctatgggcatcaaagtacacaaagcccctcgtggccacttcctcttccacgaccggcgtctgtacaacgttaccgtggcggacgaggggcacaagcacaagccgctcaagaggaagtgcccctcctccagaccggccggggagacccccgtgcgtggtccacccgggggggggcgaggagttcatgtaacagaatgcgacgggggtgggcaaagtggagatcccctctccggacnggttatctcggnatngcaacaagngcctgctggaantaant

SEQ ID NO: 23075 - DNA, 1733 bp, Triticum aestivum
  Clone ID: PAT_TA_23075
gcacggccccttggctcaagcccgcccttcccctctccctcccgctctcccctcccatccccgaagcacttgcggcggcggcggcggcggcagccatggacgtcaacgaggaggccatggcggccaacaagcgcgccttcctcgatttcctcgaccaagacgtcgggaagggggtgtacatgcaggccgtgcgcgacatggtgcagagcaagcgccaccggctcaccatcggcatggacgacctccgcaaccacaacctcgacctcgcccgcagggtgatacggagccccggggagttcatgcagccggagtcgaaccccgaggcggaggtcgtcattcaccctgatcccaaggttgtcaaggatgaggagcgtgtgatcgtgggttttactggccgggttggcatccacagggtcacggccagggaacttatgtcctccttcatcgcaagcatactcggagccgtaagtatcgtatctaatggctctgcggtaaggaagcagattgttagaagttttcactactgacctgcaaccgcgacttttatttctcgtgaatacagggtcctctcatgttttgaatgccttcctactggttcaggttaagcagactgagaaacaaaaagccaagttagaggccagtgcggatggtgataatgaagatgggcctggaggtgcaagcggtggcaatgcagacgtgcatggaagctctggcaacgacccaatggatgtggatggaggctcaggcaatgcatcaaatgatcaggatgtttcttcacagagaatggaagcatttgaggcgattcttggacagcatgtgctggcaaaccatgttgatcaaatgtccattgatgaagttgagcaaacagtcaatagggatgcagatgttgcttactccagaggccacgtagagttctgctgggagaggatgcaagatgccaaaagcatagtctgaagggacggcattgttcgcatcatctagtcagaacaaagctttgactcgtctatctactgcccatgcaaagatgaaactgagacatgaggttcttaaaattgatgtcgaggctgcactgcaagttctgaattttgcaatattccataaggaattgactgacatggaagaccgtgagcagagggagactgaaaaacaacaaactgaacaagatgcaggtgcaggtggtgataatgtagatgggcccggaggtgcaagcggtggcaatgcagacgtgcatggaagctctgacgacccaatggatgtggatggaggctcaggcaatgcatcaaatgatcaggatgtttcttcacagagaatggaagcatttgaggcgattcttggacagcatgtgctggcaaaccatgttgatcaaatgtccattgatgaagttgagcaaacagtcaacagagatgcagctgttgcttacactaggggccaagtagagttcatcctggagaggatgcaagatgcaaacaggataatgataagggatggcgttgttcgcatcatctaatcacaacatggattggcgttggacaagctgattgtggcatgcgttgtcctgatctgttctccgctttctctgaattcctggagaggctttgctgaaactctgcatgtgtggccgagctgtctgttgatgtacttcctatcttatttttatcagtgaggtttaaattgatggtactatttattcatgtaatgtactgtctgacctagtgctatttagtctcaaaaaa

SEQ ID NO: 23076 - DNA, 423 bp, Triticum aestivum
  Clone ID: PAT_TA_23076
gcatcatcaaaccgaccagctgccatgctgcctatgagtcattttttaggagcaatgtcagggactcgacatccatttggacctccgaatcaggaccggccgcgtcacgagcctcttgtgttatcaagtgttccttgcacgaccactcgagagcctccgttccttctcgggccatcgcaggagtccccccttcgatcccttcagttgaccttaccggccgagatgatctttcaagaggaggcaatgctaaagcatcggctaagttcaactcaggagaccacctcgatgccagatttgggagcggtacggctgactcgggtctgagggcggaatcgaagtaacttcgcgatcaaaatggacagatgacttggaatttctggaacatttgctcattggagtgctccatttaggcagacaggcaat

SEQ ID NO: 23077 - DNA, 877 bp, Triticum aestivum
  unsure (1)..(877): unsure at all n locations
  Clone ID: PAT_TA_23077
gaggcaggaaacacctgcagcaagggctcctcgcgtccggccctgttccagctcgtcgcatctaccccacgtcactttgccccttagcaccgccagcggctccttcacgagccgcttgtgctagcaagtctgcctcgtgccactccgcaaacccctccggtgccagtctggccatcgtagtagtcctcccgtcactcccttcttttgtaagcatttttttacggattttagcagtcggatgcttggagtatgatccagctgcttgctcttccattcagctctacttcaccagcagggcttgagaccagacatcctgttaggcaggaaacacctgcagagagggctggtcatttcgatgcatgttcaatctggaaaaatcaatcacaagacatgacgccaaacaatccggaaagcgttctgtttgcgcctcactttcgtagatttgggagcggtacggctgactcgggtctgagggcggaatcgaagtaacttcgcgatcaaaatggacagatgacttggaatttctggaacatttgctcattggagtgctccatttaggcagacaggcaatagggtagtaagtggtgatcgccaagatagtaatggttttcatcagatgcaacttgtctaatactagcagtagcagttatattatatatcagccagactgcattcttgatatgaaatcaagaaatgctgatcatgtgaatatgtagcgtgaacgccatccccgaacccgcaatgaactcaaaccgccctcgggtactgatgggtgtgcgccttggtgctgctggtcttcatcagatgaaacctgtctaatactagcagtagcagttatgtatcagccagactgcattctnatanaaatcaaagaaat

SEQ ID NO: 23078 - DNA, 621 bp, Triticum aestivum
  unsure (1)..(621): unsure at all n locations
  Clone ID: PAT_TA_23078
caggccgccgggcgctcgagtcctgcctctccgggaagcgcctcgaccagtcgccgtcgccgtcgcgggcggtcaggcgccccgcgctagtcatgtccagctccgggaagcgcctcgaccagtcgccctcgccctcgcgcccggtgctggccatgtcccgctccagcaaccgcctggaccagccgcccggccgcccggtgctggccatgtcccgctccagcaaccgcctcgaccactccgccggcgtcgtcctccgtccccgacgccggccaaggggccggcgctccgtcatgtccggctccaagcaagcggctgggagcagtcgctcgcgtccccgtcgccgtcgcccaaagccgggcgccgcggcgccgcccgtnctggtgctctccaaactccgggcaagcggatggacaaagcggggcggaagaantactttaacaangtgacgggccgaccaacgacacggactcaactcgccgcgcaacgcggggactcnangccttcgccaattatcccgnaatcacgtcaaattacggnacgggcaagattcacancaagtggggaatccccccctgttcaagcaccaggtcggcgcgcctgtatnccctanaaggtacactn

SEQ ID NO: 23079 - DNA, 571 bp, Triticum aestivum
  unsure (1)..(571): unsure at all n locations
  Clone ID: PAT_TA_23079
gcacgagggggagaatggaggccaagatcgcggcccccgcgctgctctcactcgtcgcactcaccctgctcgcgcacacgctcctcctccaccgtccgcgcgccaccgcctggttcctctccgccgttgacaccttccggttcgacggccgccgcctcgtcgagctcgtcacccggagaaacatgatcctcctctgcaacgccatcctcctggtcatcctcagggacgccgggctcctcgctgctccagctcggccacgaagctccgacgccgtaacggccggtggagctgcctgctccagctccgaggcacggcctcagcccaagagtcggcggatcagtgcggcggctggcgcgaccggcgacgacgaaggtcggctagaagcgtgaacatcgaggcgccgagacggccatggcgcgagcatggcgcgggaagccgctgacgagagcgacccagagagaatatgccgcgctcagcagcgtccccccgcggcccaagcgcggccacggagctcccaccacggacccaatgatggcaggggggtgctccagctcngnnncacnnnntcagc

SEQ ID NO: 23080 - DNA, 455 bp, Triticum aestivum
  Clone ID: PAT_TA_23080
cgcatcagcagcggcagaagaagattggattggatagcgcaggcgagggcgagccctcaccgtcgtcaccgccgatgaggaacccgcccggccggcacctcctgcgcgtcgccacccgcgccgtgcgctcctcgtccgggttcggcggcgcctccacgtccgccacgtcccccggcgccgcctcgtccgggggccgcccgcgcagccgaggcggcggcggcggcggcatgctcctgcgggccacgtccccgcccccgccctccgccgtcgcggccgccgcctgccgggagtcccgcacgctgcgccgcgacggggaggacgactgggaggaggtcgtcgtcgccgcggtcgacggggcggctccgggcgccggcgacgcggaggtggacagcgactacagggtcgtgttctggtccccgcccaccggggacgaagtccgcgccgtcttttctagc

SEQ ID NO: 23081 - DNA, 642 bp, Triticum aestivum
  unsure (1)..(642): unsure at all n locations
  Clone ID: PAT_TA_23081
ctcgtgccgaattcggcacgaggttaactgaaaaaattgggcggatccctctccccccccccctctcctgcacctcttcctctttgctttcggcgttgaagcacgagcgcccaaagatccaaatcatgatgtccggcggcggctccctgccattgcgcctctgtagcgacgtggggttgtacctctgtggatcgacgatatggccgcataggagaggaccatcggcctttacagctcaaggatccaaggcctatttgtagccaggtagcagtcctgcagcagtgaagcgatacaaactttgacatgccccatgcctgaatttcgagaaacctcaaatggacaatgcaatagaatgtgtaacgtttaaagatatatgaatctctgctgcttttcaagtagcagtgttgctccgctgtagattgtatatgatggcatgtgtcctcctcatttatacatttgtttggtcaagcttcngtttcaaaccgtgcataacacctgagaaaataacaantgtgctctgtacaattgttgaacatgctgatgccatacngactttcnaaaatgaaaattcagtattatctcnanattgaaancaaagttaactagtantaatnntgganataattttataaaaaaaaaaaa

SEQ ID NO: 23082 - DNA, 749 bp, Triticum aestivum
  Clone ID: PAT_TA_23082
gttgcctctgggcattccgcccgcccgccccggcgggtctccgcttttgtcctttcttgtttttttggggaggccttctttcactagtctccagtttttttttttcttttgaagtacaatccaaatttattaatacatttgaaatcaatacaataccaacataccaacttaagtcagtgaacaaatccaccaaaggaagtacaaactataaacatgcaatagattgatacatatttctgttccacctcttaacttcttacatactattagagtcttcagtatacgtatcacctcgttcttcttcttcatccatccacacgagaggattaaaatatatatgtgaatcctgaattcaccgctgagaataatttggaaccttgcctaacaaactaggttggcttgttttgttgtgtgctgcttgataccttcagcggcggtgtggaatgcttgtagctttagctgctgcaccagtagaagatgcctctgccggctgtgcaggtgcgttatgtggtgtcacaactttcttcctggcgtcagaatttttcagtccaggcacatctttagtatgcatcacatcgtcagaaggcgatgctgagccacctggtggtgcaacatacgttggacggtcatctgaattagttttcagtagaggcacgcccttggtggacatgttgtttggacttggagaggccttgattcttaactgggcgtctgcaccgccccccggcgacccctggtctagagcgccc

SEQ ID NO: 23083 - DNA, 534 bp, Triticum aestivum
  unsure (1)..(534): unsure at all n locations
  Clone ID: PAT_TA_23083
acaatatgtaatgaagctggtaagagctgcaattacaagctatcaaaatgatctatagaagcaacaacttatgcggatatatccctgcaaaaaacaaaaacaaaacttatacggatatatgtttgatcaaggacctatgatactatatcttcttccatattgctctactgttgttgtacatttataattgcatccttcatatcaacagtatgctacgataattgtatcctcataccaacagtagctacgatatcaacagtatgttataattgtacccttcataccaacagtatgctacgataataacaccgcctagtctctttggccaccttagttgtcctacaataaccttttgggattatatgatccctgtattgcagttgtaacatttattacaantngggaagtagttcatgggtccgggccttaaaagtgatgatgacgaacaagagttgccccttgaatgtgtatcccccagtctggatggcaggggggccgattccgacatgatctngtcaaaancacctcacacca

SEQ ID NO: 23084 - DNA, 1230 bp, Triticum aestivum
  unsure (1)..(1230): unsure at all n locations
  Clone ID: PAT_TA_23084
catccatgttcccttttaatatccaacagcatgaaagcaacttttcattacatccgaacaggcaagaccagtttagcaacttctcattacatccagacaggcaagatcaatttgtagcttctcaggcaactgcaaataactcagctcctagcatgcagaatcagccagtanccgctccttatatgggacacggncaacacagctacactctaggttcacaggcattgcctgcatttaatggacataatttcagtggcgctggtcaagttccgcaggatcgcccaacgcctttctatgctgggcaagagtcaggcaaccgttgacatgtccaatcctaaccaagagagtgggtactcacagcatgcaaaacacacatagtttccancctgttgctccaaatatgcaagctcacagtcaagccttgcaggggctatctggagtgcctagccaagataccggtaccaaagcatanagnacgcacacaatttcnagcctgttgctcctccatatatgcaaagccggggtcaaacttgcaaggtttatcgatattgccaagctccangctcaagctgatatgcctggtgctccccctgttcctcctaatgaggaagaaatccgccgttcattaacatctctggnggnaaccctcataatgcagcctggnncagttgcnggactacaattgcccaagctattctgaatccgagcntgatgggcantttgtcaagctgttgaacccaatcagtgggcttgggcacagcancaacaggnaggaacgaaccaactcnccgcggtctgaacancaagctcccancanacatgccgggacatctacggnagttggtagtagtaatgggaaaaaccancgccccagtccgtcggtcagaccgntgcanatcagtnntntcgcgcacagctgcagaaaatnataaagtngaagcaangcnagatagcgattgggaacaaatggngacangaatanaangggaacaaggaggngtcaaagngctgaaangttcaaaccncnccccanactttgangggncngccaacctccctggaaganggcanctngcngggnggtcanaaaacatctnnaaaaggctcacaantnccancacggcgaanaaccccacnanagagaagttgtgttatgtctccccaaggaaanctncaactttcagganttcgggntatnnaagggtcaccccncggcaaatgngaaccgcc

SEQ ID NO: 23085 - DNA, 2194 bp, Triticum aestivum
  Clone ID: PAT_TA_23085
cttgtcttcagggtttcacgaacacgctgcaagcttacgacgcagaattgtccaccgagatcggcaggaactttgaagtagacaagatcctagatttagtgttctcagtgtacataccaaaataccaactggatagactgctaagcatcttcagctttttaaaacagtgtttcacttcacctgcggacacggtactctacacggcgcttcttaaactggagcagtcagtattacgctattatgttgtcaatgcctggcgatccccttgcccggactaagccctcctattcggtaccgcagccggcgctcctcccgcgctggcgccccgcgcttggactgctgggtcccccgggccgcaggttttcggccccagcttggatccacagttccgtatgtatttttccaaagaatggtcagatactttggttctttcatttcggaacttcttaagtgggatattcaatggtactcgaatcccagctcttatgaagattagcactgaaaagaatatgatcaagtgcctcaagagtgacataaagcaactgaataacaaattgtcagagctgcaagcattgttagaggtcaaggaagttgaactatccctgctgagaaggaatgatcatagtattaattccggacacaagaatttactcaagattactacagctggttcctccgttgggggacaagctttctcaggagtctatgaagaatcctcaacttcaaggtcaactgttcagggtgtccattcacagactgtgagttcagcaaaatcaagagctgagaaattgtgtgattcttctcggatgagcaatgcagaaaatgagcagattttggtgacagaggaagactttcctgaagtgaaggtggattttcaggtcattcataaataagtagctgtcgattttctgcttctggatcaaatattgctagttcttcgactgatggcacagtgagaatctggacatacgactcatcaacaccatcatcaaaaaatgccactatatactgtggggctgaagtcagcgcactttcttgggaatgcagatctgaccgcttgctgctcataggcacagctaatggaggcattaaagcttggaatgctgatgcaaagagagttgtttgtgacctcagtacatccaaggacttcccaagtgtgcttgatttgaagtgtagccctgtagatcctgtgttcgtctctgcagctgcatcgagacggcatgggtcaactatatttgacagaacaggatttgcctccttgacagtatggcatatgaaaacatggaagcctctgacagtcctccctcttggcgaggatccacctgctattacttcactttgcttcaatcacaatgggaagatcttggcagcctctgcaacagatggcatgattcacatgtttgacatgtctgctggtctacaaatcactggatggcctgcccatgattcccctgtcagctcagttctttttgggccagctgaaacaagcatcttcagtttaggctcagatggaaagatatttgagtggagcttgcacaatcaaggtcagattatttggtcaagagattgcagtaggttttgcaaccctgagagctttaacaaacgcatgcatgaggtagcgttggattctaatggcaagaggcttcttgctacgtcgggtttggttcgggctccaatataccaggtgcagggccatgagagagggttgaggacacttcctcatactgcacctataacaagtgtggactggcaccccacgcggccaatctatgttaccggttctgaagaccactctgtccgcgtcacgtccattctatgatgttctacgtcgagcagtttgcccttgagattttgttgattgtccgatgcgaccagaggtgctgctccgtggagtgacctccaagagatgaaccagttccatggatcctcatgatattcctgattatctcatccagatagatccttttgcgttggaaaactgggtcatgtttgtgtttgtagacttggcgagccggtgaaactatgttgtaaaaacgggtgaaaacatctgttatctctttacatggtaggagctttacggcaggtttctcccattctcatgaaaaggcaattagggatcaagccatgcctggcaccgtttttttatgatgtactgctggtttttgaaggaaaaattatgtgttgctgtttgatt

SEQ ID NO: 23086 - DNA, 581 bp, Triticum aestivum
  unsure (1)..(581): unsure at all n locations
  Clone ID: PAT_TA_23086
gccgacatcgcgcacctgccgccctccgccgccgccgccgccccggacctgcccaagcaggtccgccccgccggccagaacaagaagggcggcgggcacgcccgcgtccaccaccaccacgcctccgccgccgacaaggaggcggccaagaagcaccaccacctcgacatcaacaccctcaggggccataccgactgcgtcaccgcgctcgacttctccagcgacgcctgcaacctagccaccgtatgcgcggatggggttgtgagagtattcaggatcgatgatgcatcaagcaagacttttaagattctcaaagataaacttgcctgctgggggcaatcccaactgccatccgcttactcaagaagggtcatcatccgtttgttgtgggaacaaaagcgctgttaagtcntccctctaatggtatctgatgttgggnntcctcccaactgggggaaacaaacagcaaggcaacttctccccctgagattaatgggaccacaaaaaatcacggcaaggatcgngctgaactntcggaatccnncaacaanggangnatggagcaaaaanatnctgccgaa

SEQ ID NO: 23087 - DNA, 674 bp, Triticum aestivum
  unsure (1)..(674): unsure at all n locations
  Clone ID: PAT_TA_23087
gacatagatgaactatgtggaaaggatgatgcatggtggggagtcagaggttacatgcgtgacaatttcaaccatagcaatgaggccatctcacacaaagagcatttccagaacagcaggcttgttgagtctgtgttggatctgtattgggaactacctcctgttgctggtccgtccttaactcaccagacaagatatgacccagcccgcgcatccgatcccatcattgaagatggacgccgtggcttgtttcaaagaattggcctgagtagattggacgcttcagtgttcaacggttacactcagatggcatacgttcagatatcaggcacaatgctcagaagagaggatgattgaaggctttgtttcacggggcttaattttacgctaactgaacagccatctgttggtaggtttttgtataaggtttgcacatggtcttggttcttattactttaattcagtataacttgtggcactttgcagaggttataaaaccaatgcaagttctcgttttgtttccctgagatatttctaggtagaacacacctgattatagatgtgagagtttcttgcccgcataatatggtggaaagagtttattttctgagtggtattctgtagcctaatcttattaatgctgtggtcataaacaaatacaacctnnaaggagc

SEQ ID NO: 23088 - DNA, 653 bp, Triticum aestivum
  unsure (1)..(653): unsure at all n locations
  Clone ID: PAT_TA_23088
acacatgcaccaccatccggcaaaaccacccagaaatggctcccgtactgtggtgctccccggccgagcagagattgtacattgtgatctgaagccaacaaatgtcctacttgacgatgatatgaatgcttatttgggagactccggcattgcaagcctcaatcggacattcaaagcttaagtccacctcaaactggggctaaaaggggaacaattagggtacatagctcctaagagtaatgctcaaagtgggccaggcatccatccatggggattgttttacagtttttgggataataccccctgggagatgctcaattgggcaaaaagaccgacagaccctatgtttgtgagaatgaatccacatgggttactttngtggagaaggactacccagattaagattatacatattattgatgcaccctgcctnggagaatgcaaggctatatccaagcgaacattgggacaagaatccggatatgatccattttttcacccagccaatccccttcccggtcattcaancccaagggaatcntgacatnngagaattaccataantgcatcaatnnnactcttcatnngcaacaacgagncaatcatgcntcctaantggntaaaggtcaccagattcagttaangggttagtt

SEQ ID NO: 23089 - DNA, 631 bp, Triticum aestivum
  unsure (1)..(631): unsure at all n locations
  Clone ID: PAT_TA_23089
gacggtgggggagaacaacgagaaggggaagaccgagctccgggctagctccgccgagccagaagcttcgaagagcaccttctaccccttcttcatgagcagcgtcgtcgcgggcttggttccccccttctccgacttcttctatgtcgtcctccgccattacaggttgcaggcccttcatctccatcccaactccgtccttttcttgtcgatctttgccttctactgtgaggcgtatgtcggggtgatgccgtccgtggctctgctgcgccacttcttcctcctcccgaatcaaacgacggtcatacctctggggtgcgccaacttcatcgcaagccgggcaaggccaacacgatctccaaaggctgggaaagaaggccgagggcttcaggagtaaagtgggtcatgatgggatgcaaagtgtggtccacccgcggttgacccgccccggacggacctacccccaatccggcctccccgtggcctccgcgcgcaggcctactggggccggggcatgaggcggcggctcggccaaccgaagggggaactacggggcatgcccnaggagtccnaagctcctggncccaggnccaancccttgtgacctnaggccaagnaactccttatcaag

SEQ ID NO: 23090 - DNA, 1095 bp, Triticum aestivum
  unsure (1)..(1095): unsure at all n locations
  Clone ID: PAT_TA_23090
tcggcacgagttttgcaggccgaataattttgattatctttgaatgtgaaatacacatgcatgaaaatacattatgatgattccaaatattttacactgctgtaactactatacactatatattgagacaatgatgggcaagccgaactatctgtttaagtgccctcaaatggggaacaggagccgaaaaagtataacaagagatagaatctcccctctgccccgaacacatgaaatgaacataactatcacaacaaaacataggttacacacaaatggcactatactcccaggtggaaaaatgctggcggggccttgttccctcccctccgccccccgcacttcgttatggcttcccgcttgccccgcgcggtccctttcgccccgggccgcttctccccggccctctccccggggttgacggacccccccccgtttaccgccactggtgcccgcggcgggggctcccccggtgcccaacttggcgtccccccccgattttcctccgttgtgtgccaacctcggttgcaacgccctggtggctccctggggcctcgagcggcgcccccttgggctccccggtacnccgggccttggggcgccgcctctaagcgggcggatccccggggacaaacgcttgggggattntcacagnctcccngagccacacactttgaacagctggaacacattgactggngaaacgaaaganattgggctttgtcgatcacaaatttgaaagaaagtnccatggttagttacaacttagtntacggaccaattggtccaacnccactaactgtccaacaaccannaatnggttccngttggcaactgtgatatggtccccccccccctgatggngggcttctccccaaccagcggagtgattgtatctaggnagcannattccaccaccgggggtggagtcgttctcancacagacttgtgnacccttggtgtaaaaagnccccctggtatactngagnggtaggngggagaaggacatccattcacagcttcccagaagaaccacggtgcgatgnttctcttgggtttgctacaacaccccgggcnacaagcangaattccccc

SEQ ID NO: 23091 - DNA, 680 bp, Triticum aestivum
  unsure (1)..(680): unsure at all n locations
  Clone ID: PAT_TA_23091
ttagaatnttggttaaggattatgtgatcttgggcaatgctaaattatggatcantantttataacttttttttggcanagaattttttgcattgggaaaaagaaggggatattgtatatattnggagggtattggatatatattatgnatttgatgtntttcttggntatcttaaaatataaggttaatacttcaaagttgctgagttgaggaagagagggttgaatcaaaaaggattccttttttggaagttccatttttatcagggaggacaatatgaatattataccttgttccattaaaaacactcaaggggttatacgatatatcgggtgtagaagtaggccaacacttctattggcaaataggaggtttccaaattcatgcccaagtactcatcacttcttgggtcgtaattactatcttgctaggttcagttgtcatagctgttcggaatccacaaaccatcccgaccgacggtcagaatttttttgaatatgtccttgagtttattcgagacttgagcaaaactcagattggagaagaatatggtccctgggttccctttattggaactatgttcctttttatttttgtttcgaattggtcgggtgctcttttaccttggaaaattatagagtaacccatggggaattacaacgccaacnaatgatataat

SEQ ID NO: 23092 - DNA, 621 bp, Triticum aestivum
  unsure (1)..(621): unsure at all n locations
  Clone ID: PAT_TA_23092
ccacgagacacgcactagagtctacactctacagcatacatcgtcgggtcggccatcgatggaggaactcaagccggagttcacaaaggacggctccgtcgacctccgcggccggccggtcgtcgccgcccggaccggccgctggaaggcctgctccttcctaagtcgggtacgaggcgttcgagcggatggcgttctacggcgtggcgtcgaacctgggtggtgtacctgacgacgcagatgcggcaaggagacggtgccgtccgtgcgcagcgtcaacaactgggacgggcacagtgtggatgacgcccatcgcccggagcctacgtcgccgacgccttcctcggccgcttccgggccttcaccgtctcctccctcatctactctcgggcatggttctgataaccctggcctctccctgaagccgctgcacccgcaatgcacggcgggcggcgactgccccccgcgaccgggagcagtcccttcctgtacgcggggctctaaacatggcatcgcccgggtggacaacccaaattcgacttcggccgataatcactggaccccggaaccaagtaaggctcttctcaacgggggtgtcaccctnccggggctctcagtctc

SEQ ID NO: 23093 - DNA, 2158 bp, Triticum aestivum
  unsure (1)..(2158): unsure at all n locations
  Clone ID: PAT_TA_23093
ccaaaacgcccccagcatggttcacatatgcacgaacggcgaggtcgagcgcgctcgagcgggctttggtggttcgtatgtgtgtgttttctggcgactgcctccttcttgcaccccacctagttcaactgtgccagcatgggcgcttatggctatcagtctgccaacgctcctgcatttggctcattgtggtcagccgccgtcacgtggtgacatcgggccgggacgcggaagggccactccggaacggttgggcaggtgggtgcttgttatagcattctggtcaccgtcaggttggcacattctgggtccagtgagtgacaggtggcgcgttcgtcgaggtgtaggccgggttccagggactcgccgttgacaatttgccaccagtacgagctgagacaaacatgctaaaccttgccttgggattttcagcatgcatctttctttggtgtgtcgggcgcgttcaccttcaagcccaccaatgtgtttagaactactcctactggacatcattgtcgaaccaatgttttaaaactactgggcaacattgtcaaggttggaattttcggacaaagtgcgctctggtgatgaaacctagcttgttcatcattaataaagtataataaagtagaggctgcgatctatttacagggtggagccatacttcctgtaggccgtcctattaagcatgttggtgaagcaagtctacatgatgatttatcactaattgtctcactagatgaaaatggtaaagctgaacgtgtcctattcgaagatgctggggatgggtacgggttcacacaggggaactaccttttgacatattatgttgcccaagtccactcatcagtggtttctgtgaaagttctgaaaaccgaaggatcctggaacagaccaaatcgtaactctaagataagtatattacccggtggccgtgctatgataagttcacaccgtgtcgatggccaagaactacatattacgatgcccgcccggtcccgcggccccaacgcgcgcccaacgcgtgcacccacgctcaccccacctttgcgcgcaatcccccccagtcctgctcgcgacgaaccctgcacccgggaaggtgctgaactctcaaaaatacctattgatttgaagagcggggactggttgcttaaggttgtaccatggattggtggtcgtattatttcaatgacccatgcgcccgctgattcccagtggcttcatagcaggattgaaataaatggttatgaagaatacagcgggactgaatataggtctgctgggtgcacagaagagtacaaagtcgttaggaggtatcttgagcactcaggagaggaggaatctatttctttggaaggtgatattgggggtggtcttgttcttcagcgccacatatccattttgaaagacaacccaaagattgttcagattaactctagcattcaagcaagaagtgttggagctggctctggtgggttttcaaggttggtatgtttgcgagttcatcctactttcacccttctccacccaactgaggtggttgttgcttttacggccatcaatggctcaaagcaagagttctttccagaatctggagaagtgacattagagggagacctccggccaaacggggaatggatgctagtggacaaatgtgcaggggtgagcttggtaaatacttttgatcccagtcaggttagcaaatgcttggtacattggggaacaggtgatttgaacatggagctttggtcggaggaaagaccagtttccaaggacacgccgttgacaatttgccaccagtacgagctgaggcaaacatgctaaatcttgccttgggatttccaggatgcatcttgctctgtgcgccgaaactcatttctttggtgtctcggcgtcacctagcaccaatgtgtttagaactactcctactggacatcagtgtcgaaccaatgtttttaaaactactgggcaacattgtcgaggttggaacttttggacaaagtgtggtctggtgctgaaacctaagcttgttcatcgtcaataaagcataataaagtagaggctgcgatctcacttgttttgcgctttttttcccttcnnnnnnnnnnnnnnnnnnnnnnnnnnnnnnnnnnnnnnnnnnnnnnnnnnnnnnnnnnnn

SEQ ID NO: 23094 - DNA, 764 bp, Triticum aestivum
  unsure (1)..(764): unsure at all n locations
  Clone ID: PAT_TA_23094
ctcgtgccgaattcggcacccgtctgtacttgccgatttaaccatggctcctgctgcgaccatccgaggtgccgcccgcgcgctgctcgtcgtggcggtgctggtgctggccgcgcggggcgcgagcgcggcgctctcgtgctccacggtgtacaacacgctgatgccgtgcctcgggtacgtgcagtcaggcggggtggtcccgcgggcgtgctgcggggggatcaagaagctggtgtccacggcgcgctccacccccgaccgccgcagcatctgcacctgcctcaagaacgtcggctccggcgccgcgggcgggccgtacgtcagccgtgccgcggggctgccgggaaagtgcaaagtcccgctgccctttaactgcaactcgaattgatgccggaaggctacgcaaggacgtgtttcgactgggacttctcaaccattcccgagccatacagatgcaagtactactatatatatgttgcatgcgatcgaaggagccaaccgttcaacgttaccctgcagatgcagtatatatatatatatatatatatatatatatacatgcgtgtgtaacgaataattatctagctgtgttatgtgaggcaattaatgtattaatatggaccgcaccctccctgtgcagacagaaataaaatacagttttgctaagtctcagtctactgagacttcgttaaaaaaaaaaaaaaaaaaaaagccggaccggtacccaattcgccctaaaagngagtcgtattacccgcggc

SEQ ID NO: 23095 - DNA, 618 bp, Triticum aestivum
  Clone ID: PAT_TA_23095
gggctgaggaattcggcacgaccactgcaaccaccccccctcgtccccctgtgggtggccatggccgccagactccctctcgccgcgtgcatcgtcgccttccatctctgcctcctcctcttgcagtcctccgcgctccgccggctctccgaagcggcggagagctcgctagtccgccatggcgtcggcatgaggcccgcctaccacttcctgcccgccaagaactggcagaacgatccgaacgggccgatgtaccacaatggcgtgtaccacatgttctaccagtacaatccgctgggcgcaatgtggcagcccggcaacctctcatggggtcactccgtctcccgcgacctcgtgaactgggatgcccttgacactgcgctcgaccccaccgcccccttcgactataatggctgttggtcaggctccgccacaatcctcccaggcggcatcccggccttgctgtacaccggccgcatcgacgccgacaaggaggtgcaggtgcaaaatgttgccttccccaagaaccctgccgacccgctcctccgcgagtgggtcaagcctgcctacaaccccgtcataccactcccagccgacgtccctggagacaacttccgc

SEQ ID NO: 23096 - DNA, 1320 bp, Triticum aestivum
  Clone ID: PAT_TA_23096
gccggccgtctcgcgcacattcttgctcgtcgtttcctccgtctctctctcccagccgctctccctcccctcctggtcctggagccgcgactcttctgaaccctaaaccgcagatcccggcgcagcaggagcgagatttcctccagcaagcaagcatgagtcgccacccgagcaccaagtgggcgcagaggctggacaaggtttacctgacgattgagctgcccgacgccaaggatgtgaagctcaacttgaggcctgatggccatttcaacttctcggcaaaggcccctgctgatggcatgcagtatgagcttgaccttgagctctttgatgctgtcagtgttgaggagagccaagcggctgttgccccgagggctatatgctaccttgtcaagaaagctgaggccaagtggtggcctaggctgctcaagaaggaaggcaggccgcctgtgttcctccaaggttgactgggataaatggcaagatgaggatgatgaagaagctggatttggtgactttggtgatatggacttctcgaagctggacatgtgagggggtgatgacgatgatgatgatgagattgaggaggatgatgatgaaagaaaatgtggttgacagtgctaacaaaggtgaggtaagatgctgaagacagagccggggagcgaaggggaggggaagctccatcagctgctggtggaggaggcaaagccataaatttggaggcgatgcattggatcttttcaacttagcatggtaataagttcgttttctagaggcgaggtggaatttggggtgtgcccgtggatttgggttggagagggggttgttggattgtttttggcccggggctatctgtagtgtacattgttattctgcaccttttgtttactagtaaattgtatgtgctttgcacgtcacttaaatatataaaagcatgggaaaaaacattagaatatgtatttcctttcctagaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaacaaacaaaaaaaaaaaataaaaaaaaaaagggggcgatcttcaatagagtgacccgacttttaacaacgggggggcaggtaaacaacttgcgggaagggaaaaaaatatggcgtaccccacatcacacctttttccagcagaggcaattggaaaacaggtggcggacccaaaaaaaatgccaacagaaaaaaaccctctttggaaagggggaccctcactgaagaagggcaccccccccgcccggcg

SEQ ID NO: 23097 - DNA, 943 bp, Triticum aestivum
  Clone ID: PAT_TA_23097
gctccgcccccgcgtccgccccccccacccgggccgcctcgcacccacgcgtccgacatcactgagagagcaaggagcagagagagaagggaaaacaatggcgggagaaggagacatcaagctgctcggcatggtggtgagcccattcgtggtccgtgtgcgaatggcactgcacatgaagggcgtgagctatgagtacatcgagcaggacctcttcaacaagagcgagctcctcctcaggtccaacccggtgaacaagaaggtgccggtgctcatccacggcggcaagcccatctgcgagtcgctcgtcatcatgcagtacgccgacgaggtgtggagcggcaagggcgcctccatcctccccgccgacccgcacgagcgcgcagtcgctcgcttttgggccgcctatgtcgacgacaagatgttccctgcttacatcgacatcatgaaagcggcgacggaggaagcaagagcggagaaggccaaggaggcgcttgtggggttagcgaacctggaagaggccttcgcccaatgctcaaaagggaagcctttcttcgccggcgactccgtcgggtacctcgacctcgccgtcggatgcaacctgttctggctcgaggcgatacgcaagatgtttggggtgacgttctttgacgtgggcaagaccccgctcctggccgcgtgggcggagcggttcgcgggaaccgagatggcgagggaggtggtgccggacgccgacagcgccgtggtgtttgccaagaagcttcaggctcggtttggctctaacacgtctgccaagtagagtagcagtgtacgttttctttttccggatagtagtgtacggtttcattatcgaattatctcggaaactctttgtaataaatgaggcagatcatggacaatggcataatttttttttaaaaaaaaaaaaaaaaaaaaaaaaaaa

SEQ ID NO: 23098 - DNA, 510 bp, Triticum aestivum
  unsure (1)..(510): unsure at all n locations
  Clone ID: PAT_TA_23098
ccacctaatcagcctccccccgcatcaacaaaaactttattccctgcccgcatagacactccgacgaggcgccaccaataataaagtcggcgctgggctcagcgctcctcctctcttctttctttccccaattcatccagctcctccaccggtgccaattcggcagctgcctagctgtgatacatactcctaccgttgccttttcctttccccggcgggcggcgcggcgatggagcgggcggaggcggaggtggggatggccggcaacggcgacgccgccgtccacacgccccactccgcgccgccgacggcgccgtcggcgcgcgtgtcgatctgggagtcggtgcgcgcgtgcggggtgtggggccgggacgtcgacaaggccgagctgcggcgccgcgtcgtcatgccgctctacgcgcggagggccgtggccgccgccgtcgccgagaaggacgaggccgccggcgtggcggccgcggcggcggcgagggacgagccggggggccn

SEQ ID NO: 23099 - DNA, 496 bp, Triticum aestivum
  unsure (1)..(496): unsure at all n locations
  Clone ID: PAT_TA_23099
cgacggcttccggttcgagacgatccccgacgggctcccccgttccgagcacgacgccacgcaggacatctgggcgctctgcgaggccacgcgccgggcgtgtcctgcccnacctcagggagctcgtcgagcggctcgggaggacggagggggtcccgccggtcacctgcgtcgtcgccgacggcgccatggggttcgcggtgcacgcggccaaggacatggggctgccggcctacctcttcttcacccccagcgcctgcggcttcctggtgctacctcaacttcgatcagcttgtcaagcgaaggatacctgccattcaagagatgaagagctgcttcaccaacgggtacctggacacccccgtggactggttcactggcatgatcagtaacctccgcctacctgacttcccgacgttcatccgcaccactgaccctgacgatgtgatgctgaccatcaacatcaaccattgcctcctccccgcccccgccgctg

SEQ ID NO: 23100 - DNA, 691 bp, Triticum aestivum
  unsure (1)..(691): unsure at all n locations
  Clone ID: PAT_TA_23100
accccatgctgtgttcgagctcgtctccaatggaaccgtgaatgatattcttcacggcggcaacaatgcgcccctaaagttggacgtgcgtctaagtattgttgcagaatcagcacaagggctagcttatctgcattcacaagctcgtatcaaaatcctgcatggtgatgttaaaccggcaaatatactcctggatgaaaactgtatgccaaagattgcaggctttggcatatcaaggttgattataggagataaggaatacactggacgcatcatcggtgacatgaattatatggatccaatatacctgcaagaaggcctgctaaccttgaaaagtgatgtctacagttttggagttgtgatcttggaggtcatcagtaggaagaaggccatttattctgataatcacggcctagtgaggagtttccttgaagttcacaaagaagggaagaaagcaaccgagctgtttgacaaagatattgcagtaacaacaggagatttggaaattctcaactgtcttgcagagattgctgttgaatgtataaccttgatgtggatcaaaggccacgatgacgattcgcggagcgcctctcatactgaancatcccgtgtgccgcaagctgttaacgctataaaattgatcagcatattgtggtgcgaacacatcaagcctggataagaaaantgcntc

SEQ ID NO: 23101 - DNA, 782 bp, Triticum aestivum
  Clone ID: PAT_TA_23101
aaactttggaagaagagctcagcgtagacgactgggagtagagagcttcagacgaggagatggcctgctggttgggggcagcctacagagtggcggcagcgggggtcttgcggtctgagcggcaacgactcagccttcctcaagcgctgacggcggcgaagagggccggcgtcttggagcagcaaccagaggaagcagcccgcagcgttcgcgctggccaagggtgtgtggctagcccaactactgctaaggtgatagataaccaaacggatagtgaagtcgcaatggggtacacgatgacccaaatctgtgataggtttattgagttcttcatgcatgagaagccagaaacaaaggactggagaaaaatattggttttcagagaggagtggcgaagatacagaccacacttctacaagcgttgccaagtgcgtatagatgtggaaactgacacttctgtgaagcaaaagttgattgtactcgctagaaaagtaaagaagatcgatgatgaaatagagacgcacatggaactcttcacagagctcagagagaatcccactgatatcaacgctattgtcgcgagacgacgaaaggatttcactggggacttcttccgcaatctcaattttcttgtaaatgcttacaacggccttgatgagcgagatgcaattgccaggcttggggccaagtgtctatctgcaattcatgcatatgattgcacactccagcagttggacattgattctgctcaatcaaagtttgatgatatattgaattcttct

SEQ ID NO: 23102 - DNA, 1188 bp, Triticum aestivum
  Clone ID: PAT_TA_23102
gcccgccgggccgggccacccaagattcaaagaatccaatccagtccaatccatcttctctttgccactcttctccgccggagctgctgccaaagtctctgtctttctctgtgtccgtccagtagatgagcatggcggcgacggcggccacggccacggcctggccctccacctcctcctccgtcctcgcccctcgcacccgccaccacgccacccgcagcccccgcgccctccgctccggcttacttcgccgcgcccgctgccctcgccgcccccaccgacccccgatcccccgtcaccgtctccgtgcgcgcggcctgggacggccccctctcctcggagcgcctcatcatgcggggctgtgacgtgaaggtgacgaagaagcccaaggagcacagcgaggacacagtggggcgcgcggagtaccacaacgctcctgagctgcggtagctggacgtgcgcctctccacccgcgtcggcgacctcagcaagggccccaagctctcccgctgcgaggtcacgctctttcacgcgcctctacggcgtcgtgagcccagagagatccgagcttgcatcctgcgccaccaaagacgccgccgccgcggtcgttaagcgcaagctgaggaagatcaaggagaaggagaccgacgtgcgccacctcaagggcaccaaggagtggcaggcctccgggctgtccgacgtggaagacgagtcggaggcagaggagctggaggatgacgacgatgacgagctcgtggaggtcatcggcgccgaggacgaggagaccgtgctcaccaaggttgtgcgcaccaaggtgttcgagatggcgccgctgacggtggatgaggcgctggagcagctggagaacgtcgaccacgacttctacgccttcaggaacgagcagacaggggaggtgaacatcctgtacaagaggaaggagggagggttcgggctcatcatccccaagcaggacggccatgtcgacaaggccaccgtcaacgccaaggagaaggagcaccccgtcgccggctgacgtctcctctccatgacaccaagtggatcactagctgtagctgcattagtcggtctgttttttccctgatgataataatggtggtgggtgtcttatgaagcaagtgtcaacaagtgctggtgtcttacgcacaaacccaagaatccacacccagg

SEQ ID NO: 23103 - DNA, 647 bp, Triticum aestivum
  unsure (1)..(647): unsure at all n locations
  Clone ID: PAT_TA_23103
ctcggccccgagccggctagcagctacgtggccgccggacggcgaggacaagcaactgagcaaggtataggtaggtagatcagtcgggcaagatgtcggtgccggtggcgtaccaggggaacacgtcggcggcggtggccgactggctgaacaagggcgacaacgcgtggcagctgacggcgtccacgctggtgggcctcatgagcgtgccgggcatggtggtgctgtacggcggcgtggtgaagaagaagtgggcggtcaactccgcccttcatggcgctctaccccttccccgccgtctgggtttttgctggctcctctggggcctacaaatctccttccggccacgagctgtccccttctcggggcaaggcccgcccggcgctccacaagcttctccctcggccgcgctccctccccggaaacgcgaataccgcgcccacgggcgctccatacggcatggtggacctattcccaatggcacgtctctattcaatgcgtcccccggcagcaacccgccgccgtcctcggcccctggccctgaactcccgcggcctccgcntcccccctcgttctctcccatcgggggcctccctcttggngggcatctcgcggtggggcaaacacgtnccgttacccctaggnng

SEQ ID NO: 23104 - DNA, 695 bp, Triticum aestivum
  Clone ID: PAT_TA_23104
cttaaaaaaaagaggtctccgtcagacgagccgcgccccccatagaaatctcgccgcccctcccctcctcctcctcctccgccgccgccgccgccgtcttctgtctgccccattcatcctgctaggcacatcagggcttccagaattgattcgcgttcggtgggtcttagctagaggtaaaatttggaattggaggcatacgggatctgattccgctgctgcagtcaggatactcgactagtgcctcgcccggttaatttggcgaggacgatgaatcgtgagttcgccaacgtcatagtgcgcggatcaacctcaagcagtaaattttactcgctgctccgggtcaacctcaagcagcacctcttccaccgctcagcagcagcagcagaaaaggcgaggccatcgacgatcccgagcttggagcctctgcccgagcacaagatcaacttctcgacgccgccaaacacggagggcacaacggacttgcacttcttctccctgctgaaagggcaggcagagggccgtgtcatgttcgccgacccttgcgccaatcccgtgatgtacgacattgacatggacgcccgtcgttgccatgccggagactaacttctgcaaacagagggactcaatctccttgtccatgaccaggcctgggagccaagacgacgagcagcactatgtcttgagcaaagaac

SEQ ID NO: 23105 - DNA, 639 bp, Triticum aestivum
  unsure (1)..(639): unsure at all n locations
  Clone ID: PAT_TA_23105
cacgtacggaaatctaagagcatgtcgtcgtccaggagcagctcaccggcgatgcaacagatgcttgcgctgatggcactgtttcttctcctctccggcggcgtccatgcgcaggtggtgccagcggtgatctcgttcggcgactcgaccatcgacgtcggcaacaacaactacctccccggcgccgtcttcaaggccaactacgcgccctacggggaagaacttccggcgccacagggccaccggcaggttctccgacggcaagatcgtcaccgacatcaccgctgaaacactcggcttccgagggctacgcgccgccgtacctcaacccactggcgtcggggaaaaactcctcaaccggcgccaactttggtccgccgcgtccagctactcccgacgacacggcggcattttatgatgccacgcctcctcgcagcacgcctctaccacgaggcgtnggggtcaaaactggcggcgtggccgggcngcggaagcccacatcctcnccgangccttactcgtaacacgggacgggactcatcaaaatacacanaagctcctgtcgccgtanantcacgtanggactccctcgaactcccgntcncacanttaagntgggcccgggttgntanaaanccc

SEQ ID NO: 23106 - DNA, 902 bp, Triticum aestivum
  Clone ID: PAT_TA_23106
cgcccaggcgacaaggccgcaccgtgtgccggtgccacgccagtgacgccaccccacctcggccctgcacaactagctaggcgagcagccgcccgcgcgccccggcggcgccccgcccccccccctccgtcgcggcgcgctcggccgcgctcccgcaggtgcccgccgcctcgctctccatccccctcaccacgcgggcgcctctgctccgcctcctccgccgccgccgcggcctagccctctccgccgcgccgcccagactccccgtctgctccgcgcctcctcgccaccgccgcggcgcgctcttcctcggacccggaggtgcaggtggaagacagagaagtggagtggggagcagaaccatgtcggcttccatatattcgacaaaggtggacgccgaatcggcaatgaccacgaatggaagagatgtggagctgctaccattcgtgaatgacaaacatggaggtgtcattattgagatgaccaccccgatggatcctcaagttttttcagcttccttgaaatctttattgtcgaaatggagggagcagggaataagaggtgtctggataaaattgccaatcagccttgccaaccttattcaatcagcagtagaggaaggattctggtaccatcatgcagaggaaacttacctaatgcttgcgtactggctcccgaacacgcctcatacattgcctgtgaatgctactcaccgtgtgggcgttggagcttttgtaatgaatgacaaaagagaggtattggttgtacaggaaaaaagcggtgtacttaaggggcttggtatatggaaattcccaactggagttgttgaaccaggggaagatataaacattggagttgtaagagaagtaaaagaagagactggggttgatgcagaattcgtt

SEQ ID NO: 23107 - DNA, 512 bp, Triticum aestivum
  unsure (1)..(512): unsure at all n locations
  Clone ID: PAT_TA_23107
ntcgcgtgttttttttttttttttttggctaaatattcagttaaagaccattccaaggctccttttcgccatgcataaactaaaccaacaactaagataagcacgaaaatcaaagcttcgataaaaacggatacacccaatacgtcgaaactcattgcccaagggtatagaaagacggtttccacatcaaaaacaacaaaaacgagcgcaaacatataatagcgtattcggaattgtacccaagcccctcccatgggttctatacccgattcataactagaaagcttctctggtccttcactaaccggggctaaaagtcctgaaatcgaaaaatgcccaaaaataggnataaggncntgctcttattaagaaatgtcccaaaanataataatatttcnttaaggaangaaancanaaanggtcctccccnattnantggggggaaaaggcngggnccttaatttttgncaagtncaattccaancnatgggncgattttncccannaacntt

SEQ ID NO: 23108 - DNA, 526 bp, Triticum aestivum
  unsure (1)..(526): unsure at all n locations
  Clone ID: PAT_TA_23108
cagcactgcagcaggcgctccactgtttcggcgtcgccgtctataaagctctctaccttgaaggcgcttctgggctttgtttggacagcggaacatgagccttgcaagcttgagcgggaaggatccaaatccttccagcgctccgtcggcgctccgaagcataacgaggtccgtcgacagaaacggccataagtacccggatggcaatgctgggtatgaaatggttcctgcaaaggagcagaatcctgatccatcacgcattgcaaccctctcgaacaggatggtgtcgttccctagcttcatctcggacagcgggaccatgaccataagcactccgggtggggcgccccccnggccgcgccgccggggcatctcgtccgcggctatcaacggcttccggantnaacatacccggggctggggatatctccataaaggctctacaacgggaacggcagcatttggggcanaagncggttcaacgggcgntaaacggaaaagttantcnattccnacgnantctaca

SEQ ID NO: 23109 - DNA, 629 bp, Triticum aestivum
  unsure (1)..(629): unsure at all n locations
  Clone ID: PAT_TA_23109
ggacgcgcacgcgnccgcggacgcgtgggcggacgcgtgggctcggccagaatagcttgagctgcaaccatggagctcacggcctggccaccgctcctcttgctcatcactctctcactctcgctcgcagcttcgctcctcttcttgctcagcagccgccacggcgtcgagaagaaggcgaccggtaaggagctccccccgggcccgccggcgctagtcttcctggctaagttcctagcgctccggcgatccatcttccaccttgagccgctcctccgcgagctgcacgcgcgctacggccccgtcatctccatccgcctcttccgcgccctcgtcttcgtctccgaccgccgcctcgcccaccgcgttctcgtccagggcggcgccacctttgccgaccgcccgaggctcttcgagccggggctcctcttcacctccggctcccgcaacatcaacgccgcgccctacgggccttactggcgccttgtccgccgcaacctcgcctccgaggcgctgcacccggcctgcgtcagccagttcgcgcccgccaggcgccggatgcgcgacgtgctcgtacgcgacctcagcgcgcgcggcgccggcggcgaccccgtcgaggtgaggacgcc

SEQ ID NO: 23110 - DNA, 550 bp, Triticum aestivum
  Clone ID: PAT_TA_23110
aaaaaaagatttacacatagctattccagtactgagaatatttccaacatagaaacagcaatatcttacaccaaccatagagttacatattcacatctcttgagatataattccatagaatttacatacatgaatagtcaacaaaaatagaggtgcaacatttaacaacacaagtgcatcaactaaatattcgcaatgtgagacctcattttctataatattttgttgcaagcttctcttcaaggttaccctgcagtggacataattgaactgtttgttcaagaagaatatgtagaatttcttgccttggattgataacctgaacttgttgttgcagcctccttgttgtactggtaaccttccttggtaaccttaattaagagcaaaggctctagcatctcctgtagatcacgaatcctgcattttctcctaatcaagatgaacttgacaatgaccagttcaactctgtttccttcctcctaagaagtgattttttgagtcctgtaactgggaagatataatcaaattatctaacacaacctttataaag

SEQ ID NO: 23111 - DNA, 508 bp, Triticum aestivum
  unsure (1)..(508): unsure at all n locations
  Clone ID: PAT_TA_23111
gctccggtgagctactccatcaccgagcacagcacgtcacgggcggcctcctccctctcgttctgtccttcatgcacggtccatcttgaccctcccaaggaatgtccatccctgcagcgacccatcaccaggtacgcccctcttgaagcctagtgccgccgcacgatgcgttgtcatgcaaagtgccttcacacaccgatccgccccaaggacgaggcccccgacgattcgcctacgccccaggctgcagtccaacttctccgccattgggcatgacatgaaccaccacaccgctctgctgaattaaccagtgggtctttattgcttgtgcaagcaaccactanggagctgatgtgtgtgtcgctgggaagatgttggagcgtnggaggcgaccattacaagactgttgcaaactgccggaccgtcggaccgcccgcggtgctctgcacgggctgctccatnccgatatggctgctgcggtaatgcgttataacctaactttgtgttg

SEQ ID NO: 23112 - DNA, 613 bp, Triticum aestivum
  Clone ID: PAT_TA_23112
tccatcttcggcgccggggccggggtcctcgtcgacctcctcgcccccgcccataccgccgccaaggagttccgcgtcgacgggtccttcccgaggcgctgctgccgcgtggtggcggtggcctcctccgtcggcggcgaggtggaggagggggaggatcaggagacggtggtggcggaggtgcgcaggaaggtggacgagggcgcgcacgtggtgctgggccgggacgtgttcgtgctgtgggtgcgcgccggcttcgacgccgccttcgccatggggatcgtgctcgtgctcggccgcatcaccggggacgagctcgacggcgtcctcggcgaggagctgctcctcgaggccacctcgccggtgtagtaggccctgctggagctctgtccctctcttttttggcttacgcaggcagggtcgtcgcttggtctgtgatgcgcatctcgcggacctcctggctggcattgttgcctggcaagcaaagcttggatcgagattgtagctttgagtgaacatggacactgcactgcttgattattgcattagttttgatcattatataagtattatctggaattattaaacacggtgtttcgggagtcttctatac

SEQ ID NO: 23113 - DNA, 1447 bp, Triticum aestivum
  unsure (1)..(1447): unsure at all n locations
  Clone ID: PAT_TA_23113
cccacgcgtccgcactcggctgcggctccgcgccccctcctcctccccctcaccggccgtgtccccgcaccgcccaccaatccaactccgaatcgtcctccccccaccccgaggtcgccggtcgccgcagcgcggcagaagccggcggagaggctaaccgaagcggcagacgggtttgatccgggaaagcatgagcctggcctcccgcgccccccggcgtcgagctcgaatcgggagataggaattcgcggaggcggcgatgtcctcctcgcaggcgctggaggggaaatccgcgggcgctgggagggcgcaggaggagcggccttccagggcctgggggctcctcgtcttcggcctcgtcggcgccgccaccgcgaccctcgccgttggccacgttcgtaaaagtgttgattggttctacactcaagctgaataaggtgcagacaacatcttcttggaggaagacaagtaaaagctccaccggtggaacttttagtgacgatgctaggagaagatattatcaacgtatgcagcaggaatttgaggatgaacaggaaaaagatcaaagaataaggcacatgcaaagtgttttcaaccgagaaacaaacaaattcaggaaaagttatgaaagttggaaggagaatgggcccccaggtggatataattacatcccgcgggatgactggtattggcagtcagatacgcctaactcggaaaataaaaataggcggacttatactccggcaggacctaggggttatcctatgtcgcatcattacaccgttcttggtcttgatagatcacgagggactccatacacagatgcagaagtaaagagtgcttttagaacaaaagcaatggaggtccaccctgatcaaaatcaagataatagagagactgctgaagaagagttcaaggaggttgtcaaatcttatgaggcgataaagctggagaggaaaaataatgcaagttgatgcgtttgtctattggagctcccagtgaagacttgcgccagtttgttacagccccggtgtacgcaattagcaggccatgccatcaggtggatgacgaacaaaaaatttctctggctgttgcggccttgcggttctgtagcgcaattttatacatgagtttgttggtgggagcacacgtccctgatgtagtagaagtaggatattgtcgacaaagatacaaaagatgtgtttctatagctagtgacttgaccataaactggttaaggagccaacatttttgttgccacctgaggaatatgcatcccagtgctgtacacctgatggttggtgtctaattgggtggaaactgaacaactgattgaaaataaaagttattggtacataacagggtgtttattatttcatcgagcggttcangcacgttgtaaaattgtactccctttgttcataaatataagatgttttgtattttc

SEQ ID NO: 23114 - DNA, 715 bp, Triticum aestivum
  Clone ID: PAT_TA_23114
acactatcgatcacacgcaccaagaaacgagacagattaagaaaacacgcggaggcagagagaatcaaatggcgttcagcgaggcgcaggaggagctggtcctgcgctcatggaaagccatgaagccggactccgaatccatcgctctcaagttcttcctcaggatcttcgagatcgcgccggcggccaagccgatgttcccgttcctgcgcgacgccggcgaggacgcgccgctcgagagccacccgaagctcaaggcgcacgccgtgaccgtcttcgtcatggcctgcgagtcggccacgcagctgcgcaagaccggcgacgtcaaggtgagggaggccacgctgaggcgcctcggcgccacccacgtcagggccggcgtcgccgacgcgcacttcgaggtggtgaagacggcgctgctggacaccatcgagggcgccgtccccgagatgtggacgccggagatgaaggccgcctgggaggaggcctacgaccagctcgccgccgccatcaaggaggagatgaagcttgctgcggcggcttgatggcacgcatggactctgctttcatgagctctctgttgtgatatgtcatgtgtgtgctgtaccgtaagcgctgccataacgacaagtgaggcagccaaaaaaatcactgttttatataatcccgattatcaatatattaattccttcggtttatttcatactctagaaaa

SEQ ID NO: 23115 - DNA, 710 bp, Triticum aestivum
  unsure (1)..(710): unsure at all n locations
  Clone ID: PAT_TA_23115
gatcctcccgcgtaccaagccaccgaccaacatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaaggtcgcaagcaagtgcgccgacgccgccaagatggccggttcgccctccgccactctgcctcctcgtctccggcgcgagcgcggagggggggcgcccaagaggctgacttcgacgaaattccaaagcaagacctacatggaggtgaaagggtaccggaaccgcgaacaattgcccgaccatcgacggggggtccatcctcccctttaaaggcggaatttcaaatgaagaatttgcctggagccactccttacgttaaggccaaggaatcaaaaaacaaccgccgccttcaaaaaacaactaatacccttaactaaactttacaaatgcaacgccggccgggggcgcgccggtccccaaattccggacccgacggaatcaatancggcgtaacgtcanctcccgagggaacaatgccttctcttactcaagaantctcctacgaaacccaaantttaaggcctttcccngcaattaaagggtnnttccacaaaggcttggggccaagggnaaaacntggnaccccgg

SEQ ID NO: 23116 - DNA, 639 bp, Triticum aestivum
  Clone ID: PAT_TA_23116
gagttctcttgtgttttttttttgttttctttgtgaccttttatttctccattccttcaattcaataataatcacgaaagcatacactatcgatggatcgcatgacccgggagctaaaacattctacagctcaatggcgatcctgtgaaccctttccttgggcaatggcatggactcgagctcgaggatcaccatgccggaggaggcgtcgtaggagaactccggccggggctgaccccagcgtgcaactcctcggccggaccgacgagtaggcgccgaacctcccgcgccctcgcacttccatgctcaccagcccgaccgcctcctcgccgtcggcaaggaggctgtaggtcaggccttccaccgccgcgccgccgttgaacatgtccacgaggcccaccggcgcgaacctgaacccggccgccaaatccttgatcggcgacacggtgagcacgtcgtgctccaaggaccttgagggacacgggcagcgccgcgccgtcggggagcaccacgaggtcgccggcgccgtggcggtacacggcgcagtcgccgccccacccggcgccgccgtccgtggccgcctcggcgatgaggtggacgtcgcggccccggccgccgccggcccgcgcgccggcgccg

SEQ ID NO: 23117 - DNA, 451 bp, Triticum aestivum
  unsure (1)..(451): unsure at all n locations
  Clone ID: PAT_TA_23117
accccggcgtgcacgctcttccccgcctcggctcctttcactgcaagcttctctcctcttcggccatctcctccgctccacgatcgaatgggctcggcttcagatggtagcagggagcacctgctggacgtgggcggcctcgccgccggcgggcccaagatacgggtgcgcgggctgcggcggcgggcggaggcgagcggcgaggagatcctgcgcggggtggacctggacgtgccgcgcgggtgggtgatgggcgtcatccggccccagcggcagcggcaatccacgctgctccgcgcgctcaacgctctggggaacccgccccgggcgccgttaacctcgaacgggccgaatctgcngatggacttctccgctccgccgcaagtcngatctcttccaactccccgcattttcnacggaccgtggcanaaactnccgtaacgggcanaan

SEQ ID NO: 23118 - DNA, 592 bp, Triticum aestivum
  unsure (1)..(592): unsure at all n locations
  Clone ID: PAT_TA_23118
gtcgccgccgccactccaccccccaccgcgggatcctcccaaatccccttctcacccaaccagcattcctcgatcgcctcctcccgagccacctctcccgttcatcccatcgtagcaacaactcccgtgccccagttctttcccccaagcagcaaccaggagcacgagatccttcttccacgcccgggccaccaagtcgctcgacgggcccgagccgaagctcgcctccgccggccactggcagcaactgctgcacccctcgcgccccgtgacctcctccttccctgaagaccagcagccgggcgcccctcgcagagagccgccatgggacgccaagcgcagttcctccgcgcccttgcaccctgcccggaccgcctgctcgcgctcggcccgctgctgcaccaaacctccgttgccgccgtctcttcgtcaggacgtgaaatgcccgagcatccttttcggtcgcccgtcgtccaccaaccgagtgggtcgatnnggcttctcaagtcggcgcgccaanacacctagacaattcggtcggctacnccggtcatcattccaancgccataacccggccttgtgaccaacggn

SEQ ID NO: 23119 - DNA, 1292 bp, Triticum aestivum
  Clone ID: PAT_TA_23119
gcttttgtctcctggtgattagttcgaatggccgtgtgaagtaatagagctttctatcgttgcttcctcatccttctccgccttctattctcacatttgttaatgaaaaaataaccctacattctcactttgttaatgaaaaaaaataaagggattacaagcactgctctgtgcaagaaatgggtgtatgtgttctaatttagttgcttggcctgccagcctatctttcctggatgcttactttcttacatgttgcacgtcatgttacagtttcgccggcctgtctcggctcatgttaggcaccatgtcacggtgtctaactatttatgcacaacatggtgacatggtgtcttctccccgtcgcgccgccgccccgtggtccccccctcctcctccgtttcgccggcctccctccacttctcgtctcaccttggccaccgtgtctcaccccgtgtcccgaccacatcgacgtggtggcccgtggcggctccggcggctgcagccgcgtggcaattaattaattctcattcaacgtaatttacttctccccctttatgtatcatggatggatatacatggtggttggctgttattatcgaagcaagagttactgatgatgactacatttgagctggtttgccgcttacaaatcgttcacagcggtccccgtcacccaaaccacgagaaacaagtgcttcggtcctaggggtgaccttggataccttgggcagaccacgcatgcaagcgatctcctcgagcggcgactgcctgggtccctcccttctaccccttctactccctttaccaaagctgcgggtaccgccgaaaggttggaaaaacggtgacatgagtaccttgagtacagacagcatgactaggacggccacgaccccgatgtgtcggtttcgttacttgctatacgtggatgtcgtggaggtgtggctgctctgtctgctcacgtgtttgacggttctggttttcagttgtgctcttaagcataattctgcatctacaactatcgtccctcttggcagtgttcagaggtccttggcaatagaagagaaatctttagattggatgatgtatttgagttgttaaataatgctcatgccaattaggtaagtttagaatatatttttgtttatctataatttgagcttcattcaatgagcaaagtttgataatttttatctgtcatcatatccgcactagcttactcgctcttttgaacattgttttttttcaattgaaaaccgatctaagtttgtctaaaaaaaaaaaaaaaaaaaaaa

SEQ ID NO: 23120 - DNA, 410 bp, Triticum aestivum
  unsure (1)..(410): unsure at all n locations
  Clone ID: PAT_TA_23120
cccacgcgtccgatagcccaaaggcatcgtcgcgcattgcaagtccggtcagggccagcaggtgctgcggccttaccccggagcgcccacctggcttcgaagcctcctctgacgccacgcctgctgctgtgacggccccaactccgttgagtgatgttcatagtgcgcccaacatcacagtcattccaccggtacctacactggcagctctgaagatccgaacgccgtcacgcctcgccggtcctctgctgtcttcatcgtgtgcggacgcgggcgaagaccgtgagctacctccaggtctcgattcctattatacgccgacaacgtcgccgcttgcacgcgactttgaggtgtcgaaagactggccggagaccttaacgccgctcttcgcggntggctcgccggnacgt

SEQ ID NO: 23121 - DNA, 764 bp, Triticum aestivum
  Clone ID: PAT_TA_23121
gtgcttttcatgaggatagcatgatccgtgttgctatacgtaccttgacacttaatgtctatcatgttggagatgaatctgttaacagatttgtttcgcgtgtgccactgtcagattatttctctgacatggtcaaacattttcagaagcaatgcatcgacttggataagttggtcgtgcgttctgcacggaatgcagaacctgtgctaatggcctccattgaagatgcaattgtgcaaattgaagatgccctgtattatttcagtgatgttatgtcttctggcatccctgatctaggaaattttatcactgaaaatatcctgcaacttttggtattccggattgtactcccatcattgcaaaggcagcgcactgatttatggataagtgtgagtacttccatgtatttgctttgctgcatacttcacatttttaaggacaaagatatggcaagcactgttgctgctgctcttttccatcagcctgattgccctgataggaaacaaggaacacccaatggttgtacctctgagcatgatcatggcatatctgagaaccaggtcagcaacacctctgcggaagatcaatcgaatgcagacaagccaacgtcttcgtcttctgcacatttgcagtgtttgcctgatcatccatcagcaagtgatttctgccaaggcaacacactgagggaacacttgctatcatatatcacaggtgggagatggttcccaagctttgggttctttgtgcttatttgctacattatt

SEQ ID NO: 23122 - DNA, 823 bp, Triticum aestivum
  Clone ID: PAT_TA_23122
cccagcgtccgccaagagcgaacagcagagcaccaattcctcccggctccccaagaacagcggcgagcgtcgccaggcagcagcggcgacggttgacggcgacggcggcaccagcaccggtgcggcacaagcgtcggcggcagcacagattgtcattgtattgttcaagacttgtcttatctgaaccgtagactgaaataactctgggcgtcattttatgcaagaagaggtggagataggggtagcgttttcaaggaggttgacaaggaggaggacatgccatgcatgggagatgagggcttcctcctcgaggaccacttgggattaacgctcgaccatctgcacgcattattgctaagtcttttagcagaaccaaagacatgacctggagacctgatctatttagtgatagtatggcggctagtggaattgaaactggtacaaaattgtacatttcaaacttggactatcgtgtttccaatgaggatataaaggagctgttttcagaagttggtcatttgaaacgctttgctgttcactttgatggttatggtcgccaaaatggcacagcggaagtggtgtttacaaggaggagtgatgcaattgctgcattgaaacgttcagataatgttctgcttgatggaaaatctatgaactttgagggaaaaaaaaaatgacctggggtttgtctatgacacctcgtataaatgttgccggggcatccaatggtagagctacagaacgggttgttatgacgcctgaaacggtcggcggggggggggggttcagcactaaggcctttgagtaatcccaccaccagatt

SEQ ID NO: 23123 - DNA, 729 bp, Triticum aestivum
  unsure (1)..(729): unsure at all n locations
  Clone ID: PAT_TA_23123
atttaactgtagccccagagtaagaccatggtcggctaggagctcaggaggtagcatacgtccacacccctacccgttcaccggcaatgacgaagctgaggtattctcggtttcttctttccggccatattttcctcgtcctttcagtgatttgggcgctggccacggccgacgtaccggcaggccagcgtcccgccggttgcccggcgacgtgcggcgacgtcgacatcccgttcccgtacggcgtcggcaagcagtgcgcgttgcacgacggctttaacctcaactgcacgaccgtggaaggcgtcgagatgcctcttgcggggaatatccaaggtgattaagatctccttggccaacgccacggccacgttgaataccacggcgatctcgtggaagtgctatcacccagccactggcgctatgaactccgagaaaggatggttgaacctcaccgatcaccttattggatatcggaggtggataatacagttatcgtcatcgggatgcaatactctcgcttatatcaggagtctgctgttagtactttcttacaacccttctatcctacaagctgaccgggtttccttatactgtgttgagtataaaggttatttancaaacgttaggatacatagattaatggaaccttaacttgtcnccaatatgataagttcnccaactggntccaaatnaaattttgggaaaanaanttttttaanggggggg

SEQ ID NO: 23124 - DNA, 629 bp, Triticum aestivum
  Clone ID: PAT_TA_23124
ctcctccaacgtggacctgtaccgctccgccgccgcgagctggcgcgacaccatccaggtggggttcgggcctacgcgggccgacacggagcgcatcccgccggtgtgccgctcggagatcgtcgagtgggaagcgcacaccaccgcggtggcccgcgcagtgatggcactgctctccgaggggctcgggctcagcgaggcggctctggaggaggcctcgtgcctggaggggaaggtcatggtctgccattactacccggtgtgcccggagcctgagcgcaccatgggattagtcccgcacaccgaccccggcgtgctcacagtccttgcacaggatggcgtaggtggcctgcaggtgaagcacaccaacgaggacggggagagctactgggttgacgcgaagcctgtacccggcgcgcttgtgatcaatgttggagacctcttgcagataatgtcgaacgataaatacacgagcgtcgaccacagggtggtgatgaattcgcgtgaagaagccagagtttcgatcgtcttcttcaatcctgggaagcgaggggattctgttttttatgaaccgctcagactcgtttcttcagaaaacccagcaaagtacaggagtttcacgatgtctg

SEQ ID NO: 23125 - DNA, 619 bp, Triticum aestivum
  unsure (1)..(619): unsure at all n locations
  Clone ID: PAT_TA_23125
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaacttctactgggtacatggacaactgtttgggactgatggacttaccatcttgatcgttacaaaggacgatgctatcacatccgacctgttgctggggaaagacagccaatgggttctgttatgtancttatccattagacctatttgaaaaggtccgttactaacatgttacttccattgtaggtacttatttggttcaaacctactgctcacttggaggtctacgatccccctacttatcaaaattcaaggccgctcatggtaccaattgaaagagatattgacaatatgcctccttatgggatgtcataaacaaatgggatacccaaaataggaaactgtagatgtcactggggactattacaagtgtgaactaaccaacatttgcccggaaaccttgcttgcacatt

SEQ ID NO: 23126 - DNA, 591 bp, Triticum aestivum
  Clone ID: PAT_TA_23126
gaggaattcggcacgaggacgggtcgctgattgtctccgcgtgcggttttgcctccccgtcgcggacctggggttcttgttcactccaggcagtggacgccgccgtcagcgccggtgagcgtggtcgcgtatgtcaacctggagtcgtcggacagaaagatcgtcgggaacttcgccacgtttgagtcggccgttctcggggtggccaacaccagccagctgcaagcgctgcgccgatcccggccgaggcccgcgaagcccagtattccgggtcctccgcctcccacaggatccttgatgattgagcatgacaaggcactaggactgtgggccatgaagttaccttctgctgacacagtggttgtgaagagaacactagcaaaagtgacagagcatcccgagggccttccttgtgcggatgaaacctcagattttgagaagcataggaaggagttctggtcctctatcaaacctgcgcatttcggtgtgaagatcggcagtcgttccatcctgggccttgtgtggtgcctgtcgactgcaattttcgtcggcattcttgcgggtttctccttcggcaggtctctcttgcta

SEQ ID NO: 23127 - DNA, 843 bp, Triticum aestivum
  unsure (1)..(843): unsure at all n locations
  Clone ID: PAT_TA_23127
gccttcgctcaccccttttacttccggctagctagctcactgtcactgatctgaccggccgctctatgtattatcttcatttatctgcaggtactactcgacctgggggcacgtcgcgacgctggcggaggagataaagaagggcgccgactccgtccccggcgtggaggtcaccatatggcgggtgccggagacgctgccggagggcgtgctggcgaagatgcacgccgcgccggggcgccaggaccaccccgtcatcacggcgggccagctggccgaggccgacggcgtcctgttcggcaccccgacgcggttcggcatgatggcggcgcagatgaaggccttcttcgactccaccggcggcctctggaaggagcagtccctcgccggcaagcccgcgggcgtcttcttcgcgacggccacccagggcggcggccaggagtccaccgcgctcacggccgtcacgcagctggcgcaccacggcatgctgttcgtgcctgtcgggggcacgcacggcgccggcatgctgatcatggacgaggtcaagggcggcagcgcgtacggggcgggcaccttcgccggcgccgacggtagcagggtgcccactggcgccgagctcgctttggcggagcaccaggggaggtacttcgccggcatcgctaagaagctcaagtccgtgtgaaatctggtttactgccccgtaatgcatgctatgcaccgcaaagatggactcatcgtatatatatgtggagcaggatttacaccattctgtaacacgttccccttcctttccacttttgtttaataataataatactccctccaaaaaaaaaaaaaaaaana

SEQ ID NO: 23128 - DNA, 957 bp, Triticum aestivum
  unsure (1)..(957): unsure at all n locations
  Clone ID: PAT_TA_23128
agacaacaaacccacgagaagaagcagagcaatttgcaaaacaaaccaaggaggcgctcgaactctgctgctagcggcaatggccactaagatctacatcgtgtaatgctccgactctgctcaccctttttccggctagccagctgaatgacttgatcaatcatttttctttctggctgcgtcaattttcaggtactactcaacctggggacacgttgcgacgctggcggaagagatgaagaagggcgccgagtccgtccccggcgtcgaggtcaccgtctggcgggtgcccgggacgctgccggaggacgttctggggaagatgcacgcggcgcctgggcgtgaggatcatcccgtcatcacggcgaagcagctagccgaggccgacggcatcctgttcggcttcccgacacgcttcggcatgatggcggcgcagatgaaggccttctttgactccaccggcggcctctggcaggagcactccctcgccggcaagcccgcgggcatcttcctcgccacaggtacgcagggtggcggccaggagaccacggccctcacggccatcacgcagctgacgcaccacggcatgctcttcgtgcccgtcggctacacgcacggtgccggcatgttcgccatagacgaggtcaagggcggcagcccgtacggatccggcaccttcgccggcaaagatggcggnaggacgcccagcgacgccgagctcgccttggcggngcaccaggggaagtacttcgccggcatcgccaagaagcttaacgccgtctgaacttgaactgctcgggattgcacaacgtgtgtggatgatttncagntgcacaatttgtttatttagcaattactacacttttactggcttttatattttgttnngaaagaataataatgnacatgggtgaaaaaaaaaaaaaataaaaaaaagaagaanaaaaagttggttag

SEQ ID NO: 23129 - DNA, 946 bp, Triticum aestivum
  Clone ID: PAT_TA_23129
gccggccggttcgggacccccatactgagacggcacagcgacaacaagaagcagagcaaattaaaaacaaacatcgagaagaaaactactcagctgctgagcaatggcgaccaagatctacatagtgtactactcgacctggggacacgtcgcgacgctggcggaggagatgaagaagggcgccgactccgtccccggcgtcgaggtcaccgtctggcgggtgccggagacgctgccagaggaggtgctcgggaagatgcacggcgggcccggggccgtgaggaccaccccgtcatcacggcgagccagctggccgaggccgacggcatcctgttcggcttcccgacgcggttcggcatgatggcggcgcagatgaaggccttcttcgactccaccggcggcctctggcaggcgcagagcctccccggcaaccccgcgggcgtcttcttggccacgggcacccagggcggtggccaggaggcgaccgccctcccccggctgacacagccgacgcaccacgggacgcctgttcgtgccggtcggctacacgcacggctccggcatggtcgccatgaaggacgtcaagggctggcagcccgtaggcagccggtacctgcgctggcgccgatggcagcaggctgcgcagccagggcgagctgcgccgcgcggctcaccagggcagggcctcagccggtgtccccaacaggctcagagccgtctgagctccgatcaccagctgagtcccatgatccatacacacgagacaatgcacgcgctccgagagtataaggtgcaatatgattttgacacataattgtaacgtagaagcacgctatacacaattctagaaaatttaactgtactgcatttaatttcttggttaggacaaataatactatttcttcttgtgattgaaaaaaaaaaaaaaaactcccaaggggggggg

SEQ ID NO: 23130 - DNA, 533 bp, Triticum aestivum
  unsure (1)..(533): unsure at all n locations
  Clone ID: PAT_TA_23130
cgcgagccgagccgagcacaccaaaaaggagaggaggaggaagaagctagtgagtcgcgcagctagagagcacggccgcaggaaaagctcgagcttttcttgctttcggcgccatggcgaggtggacggtgcanctgctggtggtgctcctcgcggtgaccgtggcggtggcggacgacagcggcgagaagtgcacgggcgagtgcgggaacccgtgcggcatcccgtgcacctactccagcccgccgccgccggagccggcgctgcccccgcccgtctactacccgccgccggcgcccgtgttactcgccgccngcctcccgaggccttcntacccancgcccacgcncacggtccgactgcccgccgcccctcaacgatggctacacgcccgcgccntacagcccacgccgtcnaagcctcngtgntacacccgacgacnccttggcgggtaaatcccactcgtcggtgggggtanaanccaaccgtcggctggttacgcgccaacttcctctnnctaacccgccgggctt

SEQ ID NO: 23131 - DNA, 1703 bp, Triticum aestivum
  unsure (1)..(1703): unsure at all n locations
  Clone ID: PAT_TA_23131
ccccttgctcggtccctcctctcctgcccggtccccccccgtccaccgtcgccgcgcccgcccgccgctggccccccgcgggaacccgtgaccgccgcgagcgagcctcacccaacttggctagcgtcatagcctctcacgggcgcctgggcgtcgccccgcggctcgccttccgtcggacccaacacctgcctcgctggccggggccgtccacgtcttccgtccagtcttcgaaccgttttgtttcctcttccccgaatgcggtgtcccagggctgtgcatcgggtaagatggtggcgcataagatgggtaactccacctagtggtatgcgtctttttttgaggtttatgaatgccgtggaactgggaacccgtaaccttttttggtgaatactgagcaatgtgaagtaggataaatctcttgtacttgtcaagtcgggtggtttgggccatttggagtgaactctgatgatagggttaagaataagagcttggggttcctcagaagcctaaaaacaaaaaaaaaaaataaaagaaaaataaaaaaggctcgggtcgagacgcctacaggcggccactcaaactgacggctccatcctgttgtttcgcccaatggaaaatgcaatgaggatgcaaactggtgccgagaggatgtgcatgcctgcacctcctgtcgagcaatttgtggatgcagtaaaacaaaccgttttagcaaacaagagatgggtgcctcctaccggtaaaggttctttgtacattaggcctctactcgtgggaagtggggcggggccgcggcccgcgcctgctccggcgggcacggcccttcttttcgcctcccctgttcggtactccttcacggctcctgctgcccgaattcattagtgattagcgtggtcgcggccgaggtccacccctggtggaactggaggtgttaagaccattgggaattatgcctcggtcttgatggcacagaagattgcaaaggagaaaggttattctgatgttctctacttggatgctgttgagaaaaagtatcttgaagaagtatcttcgtgtaatatttttgttgtgaagggcaatgttatttcaactccagcaataaaaggaacaatattgccgggcatcacaaggaaaagtataattgatgttgctctgactaaaggcttccaggtcgaggagcggcttgtgtcggtggatgagttgctcgatgccgacgaagtgttctgcacagggaccgccgtcgtagtgtctcccgtaggtagcattacatatcaagggaaaaggatagagtatgctggcaagcaaggagtccggcgcggtgtctcggcaactgtacacctcgctaacaagcctccagatgggccaggtggaggaccccatgggctggaccgtgcaactgaactaaccaacaatgtttgcctgccatcgccgcgccgatgggttcatcatgttgttggcctagactaataaaacatgatgtgtgatggggttgcaaggtcttgtgtatcttcagtcagttttgtaggccctgcctaagtggcgtcccagtgtgcatctgtagatgctggcgcataagattgcgcagcctctccgcgaatgcgccttttttgaggtttatcaatgtttttgaactggaaaccgtagcctttgtggtgactagtgagcaatgtaaagtaggaggaataanataccttaatactttc

SEQ ID NO: 23132 - DNA, 495 bp, Triticum aestivum
  unsure (1)..(495): unsure at all n locations
  Clone ID: PAT_TA_23132
gctgattcggctggtgccacgagggaggcgaactactcctcccctacgactacttccccatgggcaagcctgggacaagctattgttcgccaatgccacgacgaccacgtactcgtcatcggcgctcacatgggaagcggcgatacatgataatctgtggcgtggcatctgcactccactaccttcaccacgggaagcagcaaagaggatcctccacagggatgtcaaagcccagcaacgtgatgctcgacgaggcatacaacgcgcggctggggcgacttcggtctcgccccgtgccatccaagctccgatgggagcgacacaccactccgacgcaagccgggtccggggccgcgccccggcgccctcgaggcttcttcacccgtcgtcccaccctcgtcgcaggcccgccgcctccggcgcctgtgccggcctggcggcctcctgggccacccggcaggcttgccatgccgggcacaagaatgtcatngtggg

SEQ ID NO: 23133 - DNA, 635 bp, Triticum aestivum
  unsure (1)..(635): unsure at all n locations
  Clone ID: PAT_TA_23133
gttctcccacctccccccccatcccccccccccccacccccccaccgccggcgccagccccgtccatggcgcccaaggccgagaagaagcccgcggcgaagaagcccgccgccgaggtcgccgagcaggccgagaaggcccccgtcccggccgggaagaagcccaaggccgagaagcggctgccggcggccaaagtccgccgccggcaaggagggcggcgacaagaagggccgcaagaaggacaagaagagcgtccgagacctacaagatctacatcttcaaggtgctcaagcaaggtgcaccccggacatcggnatctcctccaaaggcatgtccatcatgaatccttcnatcaaacgacatcttcnaagaactccccggcgaagccgcaagctggcgcgctacaacaagaacccacatcaacttccgggagatccaaactccctccgcttctcctccccgggcgagtcgccaacacccctctccaaaggacaaggcgtcccattaacaacaanaaggtcctccggtntccaaggtcctcccgtgtccctcantactttgttcccgtcgtctgcaagtganctatagtagtacnnctgctttaatcttagtttatgcggcttattcantatgan

SEQ ID NO: 23134 - DNA, 528 bp, Triticum aestivum
  Clone ID: PAT_TA_23134
gatagatctggtgcagatggtaccttcccccaacgtggtgctcgccttttattcccaggagatggtgattatgattcacagcaagatgcccatgctcctgcagatcctacttccaggcagcaagacacggttcatcctgtagtgaaacagaagcgtaacatgccatctgtaaaggcttctcctgcttctagggcagcgaaatctacccacttgtctgggtctggggagggatctgctgagcactccaagcagaattggagcaacaaggtcatcaattctgctggcacaaagatgtctgacagtatgcagagaaagtgtaagaatgtaataagcaagctttggaggagaattggcaaagagggacaccaaaaaatacccaacatagcttcttggtggcgaaaggaatgaaaattcttcatccaaaggtgtgggctggaagcaccctcgacctacaggaaatccaattacgagttgatggattagagtatagcggcgtaacttgagttcatagcggacatgcagcaaatg

SEQ ID NO: 23135 - DNA, 745 bp, Triticum aestivum
  Clone ID: PAT_TA_23135
ggcacgtcccaccatggccgccgcctcgtcctcctcctgcggcggcgccggctgcgggacccactgctcctcctccacctcgtcatccgtagaggatgctccggaggggattctgggccgtctgtccatatccggtgccgccgcctcctgcggcaagtgcggcggcggcgccgtcgtcgtggttgccggaggcgtcggtctgtgcggagagtgcttgcgcgcccagctgttcgggaagttcaagctcgccgtcacaagcaacgccatggttcggccaaccgactccgtcctcgtcgccttctccggcggccccgcctccagggtggctctgcaattcatacatgagatgcggtccaaggcaatcgaaagctgggacgccagcaattcgcaagccctacccgtcttcaatgtcggggcggcgttcgttgacgagagtgttttgttgtcgaagcccgaatgtgaagttgagcaggcaactgaagatattaagtcacttgtgtcgagtttgttgccgggagataaagcaatgcacattgcctctcttgattatgtgttctcgtcggaatcaaaagatggggaaagcaggctgagggagctagttggcatgattgctgatgatactgggagggaggatcttcttcagtgcttgcgcatgctttcgttgcagaagattgcactggaaaatgggtacaccaagatcatgctgggatcatgtgcttctacatagcatgtcatgtgctatctg

SEQ ID NO: 23136 - DNA, 310 bp, Triticum aestivum
  Clone ID: PAT_TA_23136
gaaatatcagtcaagcagagccgccattcctcttcctcccacgtctcgcgtcgtctgctcgtagcgccatgccatcgtggcgcgcgctagctcggcgacaccgacacgtcatcccgtcaccctctcgggagcttggcacgtccacaggttctcgatcctgcgaccacgagtttcgcgagcaagagcggcagctcaccaagcaggctcgccatcttccggcgatgattcccgcgtcgccggattccgtcctcctccgccacctggggcccgccggtcttcggggccgacatctaggtgcgccggagctcgg

SEQ ID NO: 23137 - DNA, 602 bp, Triticum aestivum
  Clone ID: PAT_TA_23137
ctcgtgccctcgtgccgaattcggcacgagattttccaagcagtcccggtctctgactggaggtttggcagtatagaagccaagtatcggcgagtgctgcactgggctcccaccgctacaactttgcttctcccgctgattcttaacgcacgaagcgcgcaagcgtctaggcggcaagaagatgtccccgaggctgcgcagttgccgtctaccaactcagctgctccgactcgttctgctgcttttctggatcggcggcagcctcctcatcctccccaccgcagcaggacatgtcgaaagataatcctcccccttcttatccgtgtaggtataagctaccacccgtccgaccccaagattgatgaatcaggaaacttaagcccggccagttaccagaacccattccgaccaaatcctctccgggccccaaggcaccctctcccttggcatagaggtcacaaacactgaggctgagaagcctgcatgcagttgaggcaacggaatgacttgatggcccgggcgatgggcgtgctactggtccgggtcatctatgctcttcttgttcaatctactgcatcccgtccttgcctcgatgactgtaa

SEQ ID NO: 23138 - DNA, 845 bp, Triticum aestivum
  Clone ID: PAT_TA_23138
ctgtgcgggcgctcccggccgcgccggcctctctctatgactcactttcccaaagcagtagcttctccgcggcgctcgtcagcgaactgcacaccagaccttgcggccacggcgtccctcggccctcgcggcgctcgtaggcgagctgcgcgccgttcctgaggacgcagcctccgtcgcccggcgcggcgctcgtcgtcgagctgcgcgctgttcctgaggccgcagcctccgccgccctgcgcggcgctcgtcggcgacctgcgtgccgtcccacctcggcggtcaccttcgtggccctgtttgccgcgttcgccgcttgtcgtggtagaaggattgggagaagaccgttgggtcagagaaaaaggaagaacgcaatggaaacaagatggcttacatttgggggatctgattcctcattggttccggcaagaattggtgaagaagccatcaagttcctccagcaagtccctttgttggatctgtgttcgtagatagatttgatgaagtgtatagtttggtttgtttcgtactctatgtgcgggataagttcacggccaatgattttggcgggcaaggaagatttatttccctccaaatctattttctgttacgtcaactgtgcttctggtctgacttgaggaacctacgcatgtcaatgaactacgggacagccgcctttcagaatctgtgcgtttggtctgcaagttggcatgggtctctcgttctccagtggggcattcgctcgattggcacagactccccataaagccgcgaccatattacaagtttatagtgaagtagaaaaaaaaacatgagtctctgataacgatgacagattaagt

SEQ ID NO: 23139 - DNA, 780 bp, Triticum aestivum
  unsure (1)..(780): unsure at all n locations
  Clone ID: PAT_TA_23139
ttttacgcgtccgctccgtctcgtcctccgccccgccgcctctacgtcatctctccgccccgcgcctcgcctacgacgcagatcccctactcgattgcctccgcccgagcagccgtgcccgagagcccgcccaccgccccacgccctgacgccgctccggttcgccgccgaccgcagcagccgagcgagcgagcgagaggcaagatgcctaagcggacgacccacacgtactcgagcgaggacgcgctgccggagggccccgagtccgacctcttcgtctactactgcaagcactgcgcctcccacgtcctcatcactgataccctattgcagaaaatgccaaagaggaagaccgaccgagcacatgttctagataaggcaaagcatcttgcgaggttaaatgtgaaagatgcaggaaaaatcttgttgaaacgtggagaaggaaagctcgaaaagcagtttcgcatgacctgcgtgggatgcgacctttttgtttgctaccgatcggaggaagatttggagcttgctccctatataatatgttggttgatggagcactgagtccggtggcggctgagacaaatccacatgatgctcctgtacccccttgcataacacagttgcagggtggacttgtccaagttgccattgaagtagaagaccgagcacaccgctcaataacaggntgacncgacattcgatacatactgcctgcgccggggggaggcaaaacantgcaaattaggaaagggctgctaaattggcnatncctcagggggg

SEQ ID NO: 23140 - DNA, 1265 bp, Triticum aestivum
  Clone ID: PAT_TA_23140
cgcccctccccccccccgcacccctcccccccctccctcgctctctcgctcgttcctcctctctccatagcccggtggaggaggaggagatcagctttggatgcaatcttcttcttcttctgcctgccccccacgaggagcacaccctcgcccccagattgatcaggaagccacggtcgcatcggtaacgcgctagcggagcgtcttcgaggggtttcatgttggtttaacaaggaggttggatccccgcaaaataaataaattgcaggaggttggattgatcttctactgaaacttgctactggttgttaataatatctatgcttcacggtgatcttggtcagtaaaagagagatggctacttactactcgagccctggcagcgaaagagagtcgcaagacatgtactcgagagacccgggcggtgcatcctatccgatgtcgtctgctctgggcaacttgctctatctgaacctcccctcttcggcgccggacgcggtggtctctggctcccggccgcctctcccgtctttcttcgagtcgcctggccttggcctccattcgccgacacgagcgtttatgacccaattcgaaatctgactccttgtcaagccagtctgccttgcaagcatcaacttttcaggaatcgttttggagacgggggtggggaggcttctgagggccgggccccaagaactgtaaccgagttttcaggtagtcccctctgtggtctccaggcattctgaggaatcataccgtactgttggaaagcacgctgttgccttggctgcggatcgatgtaccgaagacgggtcaatttgccttccttgctagacgaattttcttcctcgccgagcttcttcctgataacattgatctgatcattgatagcgtccttcaagcaccggaaatgtcgcgagattgtctgcagagcaactgcgggtgtaaggcttggcagatccgggcccagccaccatgtcaaaagatgcaaccacattttgcatttggtggtaatagtgcttgtatttccgatccacctcatccaacattgccatcagtttggccatcttgttctgaagctcttgcttctcagcagtggacagctcaggtgctgcatttgcgccggattcttgcgatgcgccctcactttttggccctccacccggtctctttgccatctgcttcacggtgatcttggtcagtaaaagagagattggctacttactactcgagccctggcagcgaaagagagtcgcaagacatgt

SEQ ID NO: 23141 - DNA, 1031 bp, Triticum aestivum
  Clone ID: PAT_TA_23141
acacacccgatctctcactctctcgcgtgtactccgcgagtagcaaccaagggagaaaatggcgccggtgaaggtgttcgggccggccatgtcgaccaacgtggcccgggtgctggtgtgcctggaggaggtcggcgccgagtacgaggtcgtcgacatcgatttcaaggccatggagcacaagagccctgagcatctcgtcagaaacccgttcggccaaatccctgccttccaggatggggatctgcttctcttcgagtcacgcgcaattgcaaagtacgtgctccgcaagtacaagacgaacggagtcgacctgctgagggaaggcgacctgaaggaggcggcaatggtggacgtatggacggaggtggacgcgcacacctacaacccggccatctcgccgatcgtgtacgagtgcctcatcaacccgctcatgcgcggcctgccgaccaaccagacggtggtggacgagagcctggagaagctcaaaaaggtactggaggtctacgaggcacgcctctcccggcacgagtacctggccggggacttcgtcagcttcgcggacctcaaccacttcccctacaccttctacttcatggccacgccgcacgcggccctcttcgactcgtacccgcacgtcaaggcatggtgggagaggctcatggcgaggccggccgtcaagaagctcgccgcgcaaatggttcccaagaagccgtgatttgctaggcgggatttcgcatcgtgggatcagattgctgatctgtatgacgttttcttgttggtgtcgcgaataaggcaaatgagctcgtgtgtgtgtgtgtgtgcggctggaattgcaccagcgtgcagtttttgtgctttgcgtgtgtgtggtcctggaaactcttgagatatgttcaaaaaaaaaaattgagatggaacaatgtcttcgtaatgctttcagatttgtaaaaaaaaaagccttaaataagatgtttgtgtcattgtgtgtgtttctagtcgatgatgtttgcatggtttctaattcccgt

SEQ ID NO: 23142 - DNA, 1006 bp, Triticum aestivum
  Clone ID: PAT_TA_23142
caccaacagccgcgccaacagcaacagcccagctaagcccagctcgcccaccaccagacgtaccacgtacagagctagcagcaccatccatggccgcggaggagcccaagaaggtggaggtggaggcggcgccggagccggaggccgcacagccagccgtcccggccgcggagcccgaggcccccgccaaggacgtcaccgaggagaaggccgtcatccccgcgcccgagccggccgccgaggaggagaagccccccgccgatgactccaaggccctcgtcgtcgtcgagaaggttgcagatgaacctgttgctgagaaacccacagacgagaaggctgcacacggcggctcaaatgacagagacctcgctcttgcaagggtggaaagtgagaagaggaactctttaattaaagcatgggaggagaatgagaagacaaaggctgagaacaaggctactaaaaaggtatctgctattctctcatgggagaacaccaagaaagcaaacatagaagctcaactgaagaagattgaggagcaattggaaaagaagaaggcggaatacgcagagaagatgaagaacaaggctgcaatgatccacaaggaggccgaagagaagagagcgatggtcgaggcaaagaaaggggaggaactcctcaaggccgaggagatggccgccaagtaccgcgccaccggccactctcccaagaaagtcatgggatgcttcggggcctgaagcaaaaaacgttcctagttcgcaaatggagcaagagtgaatgaagtgttcatccgtggttgcttgcttgcttccttgtttctttcatccctcccaagtgtgtagtgtgccttgtgtgtaaagtctgccgtctctgtatatacacattgctcccaggacaggtgctcggttgtgtacatctttgatgcttgacaagcaacattcttatgtgtagttaagaaagtcacatttgttattattgttgacattaaagcagtcgttttttggtctcc

SEQ ID NO: 23143 - DNA, 1383 bp, Triticum aestivum
  unsure (1)..(1383): unsure at all n locations
  Clone ID: PAT_TA_23143
gccccaccgcgaccccgaaacaagccccacccgccctcgcaccccaccgacacaacccgatctctcactatctcgcgtgtagcaagcaaccaaggccaaaaatggcgccggtgaaggtgttcgggccggcgatgtcgacgaacgtggcccggggtgctggtgtgcctggaggaggtcggcggcgagtacgaggcggtcgacagcgacttcccggccagggagcccacgagccccgagcagcgcgccaggaccccgttaacacagtcacacacagtacacacaccccgatccctcactccctcgcgtgtactagcaaccaagggaaacaatggcgccggtgaaggtgttcgggccggcgatgtcgaccaacgtggcccgggtgctggtgtgcctggaggaggtcggcgccgagtacgaggtggtcgacatcgatttcaaggccatggagcacaagagccccgagcatctcgtcagaaacccgttcggccaaatccctgccttccaggatggggatctgcttctcttcgagtcacgcgcaattgcgaggtacgtgctccgcaagtacaagaagaacgaagtggacctgctgagggaaggcgacctcaaggaggcggcgatggtggacgtatggacggaggtggacgcgcacacctacaacccggccatctcgccgatcgtgtacgagtgcctcatcaacccgctcatgcgcggcctgccgaccaaccaaacggtggtggacgagagcctggagaagctcaagaaggtgctggaggtctacgaggcgcgcctgtccaagcacgactacctcgccggggacttcgtcagcttcgcggacctcaaccacttcccctacaccttctacttcatggccacgccgcacgcggccctcttcgactcgtacccgcacgtcaaggcctggtgggagaggatcatggcgaggccggccgtgaagaagctcgccgcgcagatggttcccaagaagccgtgatttgctaggcgggatctcgcatcgtgggatccgattccgatcactgatctgtgtggcgttttcttttcttgttggtgtcgcgaataaggcaaatgagctcgtgtgtgtgtggctggaattgcaccagcgtgcagtttttgcgctttgcgtgtgtgtggtcgtgaaaactcttgagatggaacaatgtcttcgtaatgctttcagatttgtcgcttggcaagccttaaataagatgtttgtgtgtctttctagtcaaaaatgtaagcatgattcctaattcccgtattgaatttttaaaaaaaaaaagggggggtanaagtctgacnggaaaacctgcgttaccaactaacgcctgagaaatccctttccactggtatacaaagccnaacnttcct

SEQ ID NO: 23144 - DNA, 495 bp, Triticum aestivum
  unsure (1)..(495): unsure at all n locations
  Clone ID: PAT_TA_23144
aacttgatcgcctccttgctgtacttgctgcgcgttcagaggttggacgcttgaaattaatcggccagctcgctgagaggggcctgcactgcatgtctgcacagtgccctaacttcatgtccacaccccgtctgatttgctaccactaagcttgctaaactgaaccagggctcacaccagtttcatgctccgtgtttttcgcctgaaactaagggggttggtttcgatttgaacacgtaccaacagacagacaccggaccattctcggaattgattgagcacttgcagttcctatcactctttttgttccgtccgactatcctttgcccggtcagtgtctgcttaattagttggacattgcgtaangaacttgcttgaaaatggcacttcgtgtcgacgtcacattatattctcacagancttactcaaagntttanctgaaactttggancggnganatggttcttatgccnnaaccaanatttnaatcaatgg

SEQ ID NO: 23145 - DNA, 528 bp, Triticum aestivum
  unsure (1)..(528): unsure at all n locations
  Clone ID: PAT_TA_23145
ggcagccgatccccggcctggcaacacctctccttcccccatctccttctccaccaccggccgccgccgcggccaggccggcgtggcggtgcgccttccagccatccaccgcgccctctctaccagccgccgcatcaccacctccaacaccacggcgccgcagccacagcaccaccacatccagtgcctccctccagcccgcgcaaccctgcctcgccctgcttcttcttcccctccgacctcctgctgctactactccctctctccatcgcccttgctgctgccctgaatctccctcacctgcttgctgcgccttctctcttcctcccctaccggctgctgctatctctccggcctcctcccttccttctctcttcctcggaaatcctgctgctcctcgctgccgcgccgccctccctccctcgctcgctctctctctctctctctccccctctctccccctctctcttctccgctttccgattcctcacctgattctttacgccgngattntcaaaatttttnttg

SEQ ID NO: 23146 - DNA, 653 bp, Triticum aestivum
  unsure (1)..(653): unsure at all n locations
  Clone ID: PAT_TA_23146
caaccatggttcaagcatgccaaataattttagttccaatgagacatcgctgatcacattaaatcaaaagagacaactatcagaccctctgagttatgctgaggtgaatgcagatgctggtcagacttcacccactaacatcgtggctatggggttggatgaagcagattatgaagacaatgtatctgaagatggttcattagtaagagaaacggagtatactattggcaggagaaatattatgaactctaactcagacatgatcgacgataccaaaatgcatagaggtccatcgcgaacagccagatcaactctcacaaaaagcgcgcagccagcaatctccagatcaaaaccaagggacgcagttttgaagactccaagtcacacaaggaccctatccaaccagttgggtgggaggctcttccggccaaggcaaccaaaagatggcagaagtagagcacgctccagttgctttgggatgtatttgtatggtgactggtaatccgaacgagacgagaaaggtggaaatagtccgagggtagcttgtaggatncaatgtcctgttggtaactgggagaaaggttgaaacaanttgctgacaatagaacaaggctaggatatatgtccctggttccattcctggaaaaaanaag

SEQ ID NO: 23147 - DNA, 845 bp, Triticum aestivum
  unsure (1)..(845): unsure at all n locations
  Clone ID: PAT_TA_23147
aaaaaagcttnaatnccccnggaaaanaaccgtttgtaccaatgttttccaaaaccttgggncttgttggggtattcattttaaactggtcggacattaataaaattgtttttctttctaacattcggcgtaatagacttcgtttctcactattgtcctctaaaagtgttgcagaatttatgttctttttcagctgcggaggagtgatcccttttagaagaaggccttctttcttgcctgagcttggtaacgaaacttcattagtggttagcttccttcttcaacagtgggtctaattggggaagctcatattcctcaggatttagggccaaagggaaatctggcaatggaggcggcggtgtgatgatccggctgactccggtatttgatgttctttcttgggtgttaaggtcctggttattctggagcttgcttaatgtctcttgtgggatcatgtccaagagatgtttggttgttccgaaaggagttgagatccttgatgtcggaggagtcgaatggaagacctcagaggctcttttgctctctttcagaaactcctctgacgcttgtagggatgatgttgccatctcctgtgatttctcggtgtttccctcatcaagaatcaacccatggaagtagtatgcagcagcctttgcttcagcatacttccactttacaaatagtgtgtgcttttttgcccatccatctgacaaaggaagctccggtatgctatccttaatctgctgccaatatttgaccatctcgcaagctaaacgtcgtttgactgctaaagtggcctttggattatcaattgccaatccaagttgcatatcaactccccggcc

SEQ ID NO: 23148 - DNA, 628 bp, Triticum aestivum
  unsure (1)..(628): unsure at all n locations
  Clone ID: PAT_TA_23148
cttcatcggttcctcctctccacgctcacacaatttatgctattcctcgcccagtggcgccatcttcccggctccgtccctcactgctcctcgtgttttgtactgcttttgcgtcgacgaggccacggccatggccgccacgtcgtgcacgctagtctcggccctcgtagtcggccggcgccgcgggccgtcctgccagcgcgcggcggccggcggtgtggttcgatgctcgctcgacagaaaggtctccgacatggccatcaacgcaccgaaaggactgttcccaccggagcctgagcactacaggggcccgaagctcaaggtcgccatcataggtgccggcctcgccggcatgtccaccgcaagtagagctcttgggaccaagggacatgaggttgatctgtatgactcccgaacttttattggccggcaagggttggttcttttggtccgacaagcaagggaaccaacatcggcgctggtgctccttgttgttcagcatccttcgccgcccatcgtgggctggggctgactgcgccacatccatgctcgaccatgcgctngtgtggcggcttcggcctcggactccgctcctcagctttagacatcactagtatgtagagatgat

SEQ ID NO: 23149 - DNA, 475 bp, Triticum aestivum
  unsure (1)..(475): unsure at all n locations
  Clone ID: PAT_TA_23149
actaaatatagagttggaggatgggtttcactggacgaggaaatgagactagatgtgcaaagaatttggaaaagaaacatgggaagagatgataggtgcatttctgaccatggcaaggaggctcgttttccatttcttgatgagagtgtgatcaagaacattgttggaaatcccactatgggatatcgctaaacttgatgagcccgtggggaagggtgataagaaagattctgagagaggttgcaaagctgctgggtctacaagaagctgcttttttgccaaagcgagcaatccaagtttggttcaagaatagcaagggaatcaaaccgcaagaactttggcagcaaccgagccgcgaacctggcatccggcaggcagcgtgggaggtccacaagcgttaccactgacggggcaaaacagacctatctcgtcctgccaagatgctgcattgccacatgttcccaacggcacaagn

SEQ ID NO: 23150 - DNA, 764 bp, Triticum aestivum
  Clone ID: PAT_TA_23150
gttgagaacatgtgctactttgatgctgacgaaaagcgctattacccatttggaaaacgttctggaactcaggttgtgcagcagtttggaatacctaacctctttgatttgcctatacggccaactctttcgtcttctggagatactggcattcctgaagtagtggctgatccccaaggggatgtttccaagatatttcagaatcttggagtatgtgttgttcaacaatgtgctaaaatcagacaacaagtttcaacagcagtgtcctacgatagatcaattagagcaatcagagtgaaagtaccagattcagatgaggagttcttcttgcacccagcaacagtcagacggaatgaccgatctgctcaaagtgtggacgaatggaccggagagcagaaagtacagtacggcgatgtacctgaagacatcgagcctgaagagatacggccgatgggcaactatgctgtttctataacttggcctgatggatttagtcagatagcaccttatgatcaactggatatgcttgagaggttagtggatgttcctcttccagcaacagctgcagtggcctcttcgtgatatagtagagataatgttcagccatcaaggacaaagaaaaaaaaatacctttatgatttgataggctcaaggagtttctaggcctacagcgaattttgtgtgattattgtaacagtgtagaaaaagcaatgtttattcaaatatgaaattaagatgtttgtcttcttatgttccgatcgctt

SEQ ID NO: 23151 - DNA, 527 bp, Triticum aestivum
  unsure (1)..(527): unsure at all n locations
  Clone ID: PAT_TA_23151
gcaaggccaagaggcacgtccacgtatccgagtccaacccgtcggggtacaccatcgactactatggccagcacacctgcaaggatccctccacatttccatcactcatcgtccaaggggccgccgacgctgccccgctgccggactgcgcaaacctcatcaagcttcgcgcccatcaatggagccaaccgtgctttcactaccagcacgagcacgaagcgctttttctcatcatctcatgaaagaagcgtctgattatcatcctatgctcttctcccgcttctccaactacagctcctcgccgccggctcaagaaggcggtgtccagcggctcaacgttcgccggctttgccacaagggagtacaatgcagtacgccggcgggccgttttcatcgtcctggcctggggtcatcgcccttccccgggggtctgcgcccgcggagcgccggccggtggtgctgggcccggcggcggcaggtcaaccgcggtccacattggatngttnnccgccagggaagggccacct

SEQ ID NO: 23152 - DNA, 531 bp, Triticum aestivum
  unsure (1)..(531): unsure at all n locations
  Clone ID: PAT_TA_23152
ggcaggtggtcgggggcagcgtgatgggggagctgctcgcgtcgggccccgtcatggtgatcgcggccacgttcggcaacgccacgtacgagaggctgccgctggatcaagacgccgaggagggcgccgtgctgtccgggtcggagggcgccgccacgcagctggagcagcagggcagcggggccgcccgcccgtgcccccgccgatgtacgccgtgccgcaagacgccgcccggcgacatgttcgggcagtgggggcaaggccggccgtggcgccggcctccgccgaacgtcattcttagcgctgcaccggcgaaccgcatcgcgcgcgcggttcctctaccttgctagtttaactttctgcttcttccctagtcctttgcctaacttcaataacctggttaattaaggtgctatgtcatcatgggtactggtgagggtttttcctttcccttcttccctccccttccaccgccgtctttttctactcggcaggttcagcccatcgggtctcacnaacccacgaacaann

SEQ ID NO: 23153 - DNA, 1523 bp, Triticum aestivum
  Clone ID: PAT_TA_23153
cccacgcgtccggagagagcgcaacaccaacgcgagcccgttccgtaccctgacgctgcggagcgcccacgcgttcccttcgcccgctccgcttcctctcccccaagcccaaggccgccgcctcaggtgtgttgattgcagcggtggtgatcgacgacccgtgcacgtttcggacctactgcattgcatatacaatgcaaggcatatctgtgtgcggttcggtcgtctcgccccacggaacaaactgcagatcagcctgtgttgctaggaatgatctgaggttctgttacaaaataaatccagtaagccatggggcatacgcgtggcactggtgcgcggaaaagctgcacatggggaccaaccgtggaaaaataaacaccacagtaaggactaatgccagatggttctttggaggagatgctcgtaacagtaacagtaacaataatgcggccgcgaggctggagcgcagtgagtctgctaacgaagacatcttgatcttctactttcagctggatgtacagactcggatacagtatgcattgaatatagagcactttgatgcggcaacagcttgttgcggcaaagcttgcgggggtcgagcccgcggtgaccgggccgcgcgaagcttaaaagaaggttcattcgaagaatgaagctcaaggataaatcttttaaatcttcctacgcgcgcgtgcagatttgcaagaatggctatttgaagaagcgagaactaatgctttggcagccgtgctgcgtgccacaacccctatgcttgaggctgtgtcgcgggcactctctgcggcacccctggccgtccaaagcccgggggttgagcttcgactagggcagaaagtacgcctcaaagtacatggatatagagctgtgatatgtggcatggatccctgtgtgctgtgattccgggtcggggtccgagacgccgggggtgcagaagttatctaaaggaccaaatcaacctttttatcaagtgctggttgatgtatatgctgacccagaactccttgttgcctatgtcgccggaggaaatctttcagaagctgaagaatcagagaaaggaaggtttgagcacccctacaccgaattcctattttatggcgaggacacagctcgggacttcattcctgtgaagcaactccgtgagaagtatgacccagccacgctatgaagcttctggagatgaaaatgacgacgatggcactacaaatagctaaacggtagcaggagtttttctaagaacattccttattcaccaccaccaatgaggatcagagaagattgaggatcaaggtactatctggcgtagctacagtagcactgagtgggcaggtgtaatgaagaccgagtcatcgcggatattgcaagaaatcacaaaaacctgcaatgagaggagctacatgcagtgtccgaccttgcagattggggaagcattgcgctgataaaatgtgcaacttcctcctgcgcttttgagtgcgagtggttctaaagtcaagaatgtaagaagatcc

SEQ ID NO: 23154 - DNA, 775 bp, Triticum aestivum
  unsure (1)..(775): unsure at all n locations
  Clone ID: PAT_TA_23154
tgtaggcccgccatgtcggaggttgtggcgatgctctgcagcgtcgggagtgggagatcgtcaccagcttactgctgtcactgagtaataatcaggggttgtagttgaccgaggacggccaaagattatgaccgtcacattcacatacatgttttacaatgggcatggacatggcaaaagaagtgggattctgcattctgatctggctcctggtcgccctagttctgttgaaggtgaatgggagataccctgatttgcactcagatttgccgtccatcacaaaacacagagctatttctacagtgtaatgcgttaccgtacttccacacctcgcgcccgtggcgtgtgattcactctcttccatacagcgctagacctgcgcacgcgcctcgatcagcagacaaacgaacaaaccgcatactactaccatcccttccttcagtgagacactgcacacgctctagacagctggtgtttgcacgaacctgtcgctggcagacagtcaccacacgaccgttgtggttccattcttgcccatcgaactccgtcgacttgcttctttccgaaacgtccagctctacagcattcaccatgtcgctcctacgatcctttacgaccaggctcaacaagacggagaccaccgtgaatgatgctcctctcggccgcgctgccagccagcgcaacggcaagcccatctatcgttcgcagatctcctcgcctctctcannngtctcgacaacgaacatgctgtcgtacctcggccgcgaccacgcta

SEQ ID NO: 23155 - DNA, 511 bp, Triticum aestivum
  unsure (1)..(511): unsure at all n locations
  Clone ID: PAT_TA_23155
gccatctctccctccagcctggactggccctccctccccctcacgcgcacgcacacggccgcacccagctcctcctccgctctctctgcgccctctgcctctccccaggctcgctcgctcgcggagagagaaagcgagaggcgagggaggtgggagatcacagatcaggaggcttttgtttggtcgagagaccacaagctccaccacggcccaatcaccgagcctctgccttctttaggcgcgctcccctcccacggtggaggccgaatcatctcctctctgcctccctcgacccacttcggcatctgccggccccggatcgataccgccgccaccgcataaataccgcctcccctgccactggcactccccctctcttctcctcccctctcccccgcccctcccgggcgtccgccgcgcaacggtccgcggaaccttggtcggctgagagagagagagagagaganagagagagagggaagatgctnaaccaagagtcctnnatggatgg

SEQ ID NO: 23156 - DNA, 955 bp, Triticum aestivum
  Clone ID: PAT_TA_23156
tttgttggattctgggattcattggggagcagcacctgtagtgaagggcatacgggatgcaactcttgatttactgcacatccttgtagctgtacatgccgaggtatactcgggtgctaggcctttgttggagaaaacgatgaaaattttggtcgagggtttggtcgacatctttcttagcgcgtctgatgagaacaaggccaaagatctcagaatgttggatgcaaatggtttttgtcagctcatgcttgagcttgagtattttgaaaccgtgttaaacacatacttctctactgaggcacaacaagctctgaaatctttgcaagagagtttgttggagaaggcctgtgaaagtggcagtgaagatgctgcatcagatgataaacaagtgccatcagtatcacccgatgatttgcttgctcttgctcagcaacacggcagtgatctgctgcaaggggagctggagagaacccgattaaatatagcatgttttatggagccaactcttcaatcaggctcgaaaacttcagcttattcgtcttaccaggcaccagcaccacccccagctcaagtctcctcccctagttttagaaggcagcagacaaattctcctatagtctctagaagacgccgatgaactaaatgctgagagcaacattttctttatcgacgtggcctcttccctaaactccctttttaagaaggaagtccctcttttcttgggttgcctgtattttttatccattcattgtaattagcatcatgttgtgtattatgaattttgatccattcttttggtgttgtatgataaaaagggcagggtacaggtgctgctgtacgggactatgtacttgtataatctccagaaactggaattgttatttccccgtgccgaagtcagatacacggcaaattatactgttttaaaccaagtggtagatctaaaaaaaaaaaa

SEQ ID NO: 23157 - DNA, 743 bp, Triticum aestivum
  unsure (1)..(743): unsure at all n locations
  Clone ID: PAT_TA_23157
ggcacgaggcaattccctctctctctctcatctctcatctctcatctctctagccttcccgtaggatccctagttagcattgctcttcttttcccttcgcccatctccaatcccaaagacacagctgctagctcgcagaatccataccctgctctgttcttgctggctctgctcctgacttgacctcttctccttgccacggacagaggagtacggcagaatccttccgtccgtcccctattttgttcttggtgttttcatataggcgcagctcgagtcgagtccatcccaggtggggggtgggggcggccattagtttttcttctttcctctttggagtttgcccatgtcccaaggtctctgctgcggctctgcttagcgccctgtttgcccctcggaaaaggaagaaaaagctgccgcttcctcgctaccttttctccgtcttcctctccgtctcgcagctttcatcggccgagaagcaaggagatttctcggttgacgagcaatctcgtggggtttaggggtttaggaattcattcggttcttgcggagctgtggtggtggcggcagcggtggaattgattgatcggccggaggagaagagctggagtaaattctcggtttgagcggnggtggttgtggttgaagggggcattggcgaagacgtcctcctgcatacccacggggctgcgggttggaacctggacatgggtgaaaggcggcggngtnncccgggggcncac

SEQ ID NO: 23158 - DNA, 621 bp, Triticum aestivum
  unsure (1)..(621): unsure at all n locations
  Clone ID: PAT_TA_23158
atctctctccctcacccctcctccacctccggcctccgccacggccaggccggcgtggtggtgcgcctccccacccatccatatatccatcaccaagcgccgctcaccaccagcgcccatctcgcctgccatacccgcgcgcctccacctgctgctgattctccttgccgctcccttcgcctacctcgctgttgttcttcttcccgacgtcctccatgctgcccttctgcttctcctctgcttcccctctcctagcgcctcaactagctgcttcctcttccccaaactttgctgctgctccttccctctcctcaacgtccctgctgctgcacttctcctcctaaccttgctgctgttcatctctggacccccaacatgctgctggctcctctccaacaacgacccccgtgctgcagccctcccccctcccccagcctcggagtggcggngctcccgatcctccccggcgatccctccttgaggctcctganaactcgtccctgcggttcctngcccgaantcanagccaagagaaatctgaacncctcnctangganttttcgaattttgcncggtaatcgcagttgancgaanccantaatgttagtgccgtagaaacag

SEQ ID NO: 23159 - DNA, 543 bp, Triticum aestivum
  unsure (1)..(543): unsure at all n locations
  Clone ID: PAT_TA_23159
gaattcactagtgattagcgtggtcgcggccgaggtagatctcaaagcctcgctcgaatcatcagcatgtcgtccgacgcccgccgtcccgcggcgctcctgcagatcgctctcttggtcgtcgtcgccgcggtcatcatgaacagctccgtctgccttggagccgccgtaggcactggtgatctcgaccctacccatcctacgtgcggaacgaactgcccatcgtctggtcaaccctacggccgtaggtgcagcaaaatttacggctgtagtagagatggaccaccggcgacggcgggtgaccaaccctaagtactacgtacacccgtgccgccggccccatctccccaacacaatgcaagggttcatccatgtcgatcgacatgtgtaactgaacggcgcgccggctttactatatgcatgcatgaccctttcctacgtacctgctacaagtttacagttaaaattatcctccccgtggtacctacntttnanggggggntctggaataaaaaatngggaaacccttgganaaaaaaaaaa

SEQ ID NO: 23160 - DNA, 451 bp, Triticum aestivum
  unsure (1)..(451): unsure at all n locations
  Clone ID: PAT_TA_23160
gcctcggcgtgctcggctcccccatccgcgcccccttggcgctctccgccgagttcaacctcctctcctccaacccgcccgccttctcgctcctcttcaagccccggctcggcgacttctccctcgccaactccgtccgctcgccgcccgtccccgactcccccgcgctgccgctgtcccacaagctgtccgacctcaccaacggcgacgaccacgaccatgagggccacaaggagttctccctcaaancgggaacgggttcgcggcgaacgccacggccgccgggaacaccggcggaggggtgggcatgctgctgtccggggatgcgcctcaccaccaaggagcatgctgcccgctgtgggaacaggcgcgtcggcgggtccgttccgggtggcggggggcgcctgtgccgaccggcgcgcccgcaaacggccggtgcntccgcaagaac

SEQ ID NO: 23161 - DNA, 1157 bp, Triticum aestivum
  Clone ID: PAT_TA_23161
cccgtcccgttctccccccgacccggcgtccccatctctttcgcccgcctacctcccctccccggctcgtgccatccccacgcccggaaagatctgccccggatagcggcggggggcgctcccggcctgctgggacttcggccatgagctgcggcgtggggcagggcgggtggctgctggactacggcctcgtggaggaagagatccaggcctccgacttcatctacatggtcgacgacccgccggtctccagcgtgatactgggcttcgacgctcccaggagggaggacgccgcggcggctgcccaggacaactccggcgccaagaaaagatcccgtccagagtcgagcgcgcagcccggcaccaaggcatgccgcgagaagctccggcgagacaggctcaacgagaggttcaatgagctctgcgccgtcttggagcccgggaagccacccaaggccgacaaggtcgccatcctcagcgacgccacccgcctcctggaccagctgcgcgccgaggcccagaagctcaaggcctccaacgagtcactccaggactccatcaagagcctcaagtccgagaagtcggagctgcgggacgagaagacgcagctgaaggccgagagggagaggctggagcagatgctcaagggcgtcagcgttcgtcccgcccccggccgccgcggccgcgccgcagttccaccccgccgcagcttacgcgcacgccggcaagttcgtcccggcgtacgccgcgggctacccgccgccggccgctttctggcagtggataccgccgacgtcgctggacacgtccaaggaccccgcgcactggccgccggtcgcgtgattcatcagctcgatgacgcacgcacggcggcgatcgtcggaggataagcgtgtgttgaagcttgctcgtaccgtaggaagttgaccgaagcgcgcgcccgggagataacgtcggggtttgcttgatggattgtgtagcggtctctatggattgtgctgtggatataatgatccagggctcgcctgatgcgggttcctggtgatcattgctcattggagcagtctgtgtaacagctcgtagtgtgatagcgatgaatatggttcataattatagggtcgatgatgatgcttatatagggaaaaaaaaaaaaaaaa

SEQ ID NO: 23162 - DNA, 483 bp, Triticum aestivum
  Clone ID: PAT_TA_23162
aggaagctcggcaacctgctcttcttcgccttccccacgcgttgcctgtttctcggcgtcgtcaagatctgggccggcggccggtcagcgctaccagctggcgatgatttgcaggatctctctgtctccttctccagtgataaagggcatcaagttaatcactttggatatatgggagggaaagagagtgacaggatgttgatgacggtggaatctagcattggtgaaagacaaagcagtgtggttgaggcatctgatgtctggtctcagccaagcaatgaaaatttcagacaatgcattgtttcaaactctcataaaaagcaagattctcgcagtaatggctacattctcataaacgcaaatggtggtctgaatcaaatgcgatttgggatatgtgacatggttgctgttgctaagattttgaaggcaacactggttctaccttcacttgatcatacatcctactgggcagatgacagtgaa

SEQ ID NO: 23163 - DNA, 500 bp, Triticum aestivum
  unsure (1)..(500): unsure at all n locations
  Clone ID: PAT_TA_23163
cagagtgtagtgaacccacttgccaccgtggcgggtggggatcattttcccggccggcatcccagtgagttcgcccatgccccatgggttcactacactctggtccagatcccacatgccagcgaagcgagtgggtatcatacacacatccggcaacacagaaagtacaaccaaagcgacatgtttttacaagcgagcaccgagtccggcaagtccgcaaagcaagctaacagccaagaggtccaatccaagtttaaactgacgctagcctactacacaanatgggtggctggaaaaaggggaggccaagacagattttgcatgcacttcatacatcaattacacgcaatcccctccagtttcctgtcctaatcgggtagnaattacaccggnatnggatctggctcaactcccnaaaattaacgcctccannccaanaaagagcactttcaanaacaattnncacataagtcatcnagnntcaacagaaatcttcttnt

SEQ ID NO: 23164 - DNA, 445 bp, Triticum aestivum
  Clone ID: PAT_TA_23164
cccacgcgttaggtcacgctttcgccggtcgatcgcagcgcgaccatcaaaagttgcaccgcggttcggcctgcgtgcggtgctgcgtgccaacctctgcgatcgatcaaccctgcgatcatggcgggaactcgcgttgatgagaccacggggggttgttcgccggcgtgcgaccacgacggcggcattgagaccgtcatcgacgacctccccgtggacgtcctgggcatcgtgctccgctgtctcgacgaactgtccctggcagcagctgggtgggttggcgcgggattccgggagccgacggacgacccgagaccgtcatggacgccctccccgcggatgtcctgggcatcgtgctccgccgtctcgacggtgcgtccctggcggcagctgggtgcgcgagcgcgggattccgggagctcgccaacgaccccgacgcgtggcc

SEQ ID NO: 23165 - DNA, 544 bp, Triticum aestivum
  Clone ID: PAT_TA_23165
cgacggcagcacactctgcttctcactgacgccgccggccacgcctctccccctccgagcgccgctctgctcgccgccgccgtcgccgcctacgagctgcggctcctgcccccactgcgcgctgcagagctcgcgcggacgggttcggcgtgatgggggacgacggggcggaaggggaggcgccgcgctgcgtcggctgcggccggcgcgtgaggacgctcttcgtgcagtactccgcaggcaacatccgtttgatgaaatgcgatgtctgcaaggctgtcgccgatccctacatcgagtgtgaattcatgattatcttgatcgatctgattctacacaagaccagggcataccgacatctactgttcaataagctgcacattggttcatctattgacaagggaatactgtgccagttcattctgatgcatatcgttcttgatgctttttcaaaaaacaacaaagctgatggggattcgtccaggaacacattgtccacaatttgcaattgcaccgaggttctgggtgatgctttgctggggaa

SEQ ID NO: 23166 - DNA, 607 bp, Triticum aestivum
  unsure (1)..(607): unsure at all n locations
  Clone ID: PAT_TA_23166
cggctcggccgtccacacccacccacttcacccgtcccctacccgttcggcgaaatgccgccgccgctctccgtctcgcacccctcgccgcagcccctctccctcctcccgcgccacgccaggggcccccacccccactccatcgccctggcccagcccctctcctccagggcgccgcccgcctccgcctgctccgtcgtccccgcgcgccactccgactacttcgacccccgggccccgccgtcgcagcgcgacgcctacgggcagccgccgctggagagggatccgccggttcctgggggccaggccgggagggtgttcgccagctacagtatctacaanggggnaaaggccgcgctggccctttcgaccccaggccgccgnanttcgttgccgctccgaatctggggcgtacaaggtggccaagggagggggttcgtgctgctccagttcgcccccggcggtggggcctccggcggttatggttcgccgtccaagtggtcggtgttctgtctgatttggctggcttcttgccatgccctgcatactcctgggtntcttangacctttaaggggaganataaggaagtngaaantctaaggtnnn

SEQ ID NO: 23167 - DNA, 545 bp, Triticum aestivum
  unsure (1)..(545): unsure at all n locations
  Clone ID: PAT_TA_23167
aataactccattcagacagcgttgggccgagcaccgccgtgtgtcgccgccccacgcccggctaccgcatgcagcagccacaccgcaggtcgccgctcacggcaactacgcgcacacatgcaagcagccaccgtcgccccgcgagctttgcctggccgcgcactgccgcaaccacacgtgagcttttctgacacccaccgcccacggtcgacctgcgaaccacacacgcaccgtcgcgaagtgttgattgatccccctccatggcctcgtgctcaccgtcacagccccgtcgccctgggggacggtggaggggcaaagatcccgtggagctgcagccatggggggtcaagcattatccgtccctcctggctcctcaanttctgggtcggggtatccgtttgggtccggtgcgggcagagacatgggtngaattccctcctttgggtgcccccncgagggtgcgggcggggacttcttagtttcaaaggtctataaaaatctttantgggttaacaattgntatccaggttaaagggggannccng

SEQ ID NO: 23168 - DNA, 636 bp, Triticum aestivum
  unsure (1)..(636): unsure at all n locations
  Clone ID: PAT_TA_23168
gatttctctaggcgtttgcgaagcgcccccccgggccggtctagtctcgagttttttttttttttttttttttttttttttggctcctgaagtacagtttatttcatataggctgaattatagtttaccttcagtacaaatattgatttgctactgcaacagaggatgattcataacatagatagcatcctttcaacatagataaataaagccttaggtaaagaaaaactagtcgtaggtcatcatgcaccagaccagcagcgtgtgggcaatcgatagatagatacggttgaaatgcttcttctcctcagccctgcagtgctgaaaatgcttctttgattgtgatggcatcagcgtagacgtcctgcattgctgggcgatctttaggcgtctccgcagcgcacagcaagccaatcttaacaagagccgtgatgcagcccattattccaagcaagcaattgatgatttcctggcctgaagaactggccgcttcttcttcatctcgggttccataaataggggatgatgatcctaggatcaaacccctaacatttctggtgcaactcataatcgtaagcctacgcttcgcgactacaaatgcagccccccggccgnaccccccaattgaccaacaan

SEQ ID NO: 23169 - DNA, 512 bp, Triticum aestivum
  Clone ID: PAT_TA_23169
attccacctcacacaacgagcaagatctcatctgctcttccccttttccgctggctacgagagccacgctagtgtcttgttcaacgccggcgatgtaatcatcgtcacgctcctatccagcagcgccgcggaccactcggagcggccggaggtgctggggaccccgggcgccgtgctgcgacgggcagcaggaggtgttggaccactagcggccgagctgcgacgggcttctccggcgtcgattgacaacttcgacccgagctgcaactgtctgcatccggtgctggaaccagcgagtcccggtgctaccaccggctgcagcgatgctggaaccagctcgacggcaagctgcaacctggctgtgtcgagtaccggaaccaccgttctccggtgctactaccggctatgtcgggtgctggaaccagttattttttttgctggaaacttgctactttttgctacaagtccttctttttttttttttgcgcctagtgatttgctggaacccggac

SEQ ID NO: 23170 - DNA, 872 bp, Triticum aestivum
  Clone ID: PAT_TA_23170
ccgcctgggcccatccttaaaccctagctctccctctccctctcccgtcccgcctccaccttcccgaccgcttaagccctagctctccctctccctctcccgtcccgcctccacgatggcgaccgccgacggccagtcccagcctgcggccaccgaaccctccccatccccggccaagcgtaagacggacaccgactccgagatctctcccctcgacccacccgccaaggccgcccgccccggcgctgacgaggaggccgccgccgaggccaaggcccgggtcgcggacaaggggaagggcaagatggtggtcgatgaggaggaagaaggcgacgaggaaagcgacgaggaggaggatgacgaggaggtcgagggagatggcgacgagagtgacggcttatgcgaggatcccctctccgaggtcgacctcaacaacatcctgtcctctcggacccgccgctgctccccagcacagcctggggcgtacctggtgccaccagaggaggcagcggaggatgacgaggacgatgaggacgcagacgtcgacatggctcccggggaggagagcggcgacggggaggagagcgattagggtcgcagctggactaactcgctaagcaatcccttcgtctcgcgcttgtgatgcacagaaatgtttctatgaactgttcccttgtggaagtacatttctgcgattgcatccagtttaggcctttaggtaccttatttatgtatcatgagcgtttaatttcgcaggtatgacctaatttaagtgtttttatcaagtaaacaagtatcattgctggtgcttctggattaaaagaaaaaaaaaaaaagaaaaaaaaaaaaaaaagaagaaacaaaaaaaagaa

SEQ ID NO: 23171 - DNA, 690 bp, Triticum aestivum
  Clone ID: PAT_TA_23171
cccccctttacctttttctgtagcacctttgatctttatgccctcctcccgttactttatcaagaaatctcaggacaaatcttgagaaactttagttagagacagaccgatggcggcggcggcggcgagcgtcggaggcggggcggcgccgttcgtgtggaagacgtaccggatggtggaggaccccgggacggacggggtcatcgggtgggggaagggcaacaacagcttcgtcgtcgccgaccccttcgtcttctcgcagaccatgctgcccgcgcacttcaagcacaacaacttctccagcttcgtccgccagctcaacacctatggcttccgcaaggtggatccggaccggtgggagttcgcccacggctccttcctccggggccagacgcacctcctgcgcaacatcgtccgccgtggcaccgccgtcggcggcggcggcggcggcaagcgcaaggacgcggtggcggccggcctcaccgacgacgacatgacgatggtcgccacggaggtggtgaggctgaagaaggagcagaacaccatcgacgacagggtggccgccatgtggcgccgcgtgcaggagaccgagcggaagcccaagcagatgctcgcgttcctcctcacggtcgtcggcgaccgcgacacgctgcagcgcctggtcggcaacagcggcaacgcggccggcgg

SEQ ID NO: 23172 - DNA, 490 bp, Triticum aestivum
  Clone ID: PAT_TA_23172
acctataactgtatttcaaataggcataagatggagaatatataccctccaggagtgtcacctccttgatggttccaacaaattgatatcgttgtttgactacttctctaagaaatataatgttccaataaattggtatccagatttaatttgactacttctctaaaaaaaacttactacatatagtgtgtagacacttgaaatctggaaatcgcaagatcctcctcatccccgaaaatcgtgagatcctcttcgtccttggaacgcctcaccggtgtatcatctacacaccatgggtcgcggtcggcggttcccaatctgttggaagaaaggcggccatggtgagctcgccatgtacctccgccgccacctcgctcatcatgtcatgaaatatcattgtcgattgggggaaatccattagaatcttggctatctcatttcttctttcagccacatctcacataaaccaaagcttagaaagttcctgact

SEQ ID NO: 23173 - DNA, 1003 bp, Triticum aestivum
  Clone ID: PAT_TA_23173
catgatcggctccttcctccccctccccaccaccatcaccaccacctccggccgcccccttccgccccgcgccaccacaccgaccctccccttcccaaccaccccactccgtctccgccgccggcccgcccgcgtctccgtgtcgtcgtcgtcgtcgtggcgtcacgaggagggcgcggggagcaccaacgggtcgctgccggggcttcggcgcgttggcgaggaggaggaggaggacgacgagtcgtgcccggtggagtgcgtgacggagttcaagacggacgaggagttgaggcggttcctggagcggtcgagggcgacgggcgcgctggtggtggtggacttcttccggccctcctgcggcagctgcaaggctacagagcagggcttcatgaagctctgcaagggctccggcgaccacggctcccccgtcatcttcctcaagcacaacgtgattgacgagtacgacgagcagtcggaggtggcggagcggctgcgcatcaaggtggtgccgctcttccatttctacaaggccggggtcctggtggagtccttcgccacccgggacaaggagaggatcaccgccgccattgccaagtacacatcacctgagcaggagcctgagacggagccggaggagtaatttctactccaaatacgtacatacatcaagagccatctagctagcctggtaatcgagtggtctgccaaagctagctagtgaacctgcattgtagcaggaaaaactgggattggtttttataataaagcagagcatatcatgaaatagttgtatgcaaagggatccatgtagaatggtcgaggatagatcctggttgattactcaatgccattccagatccagcgaccccccgttgcaaaatttcagtagttgacctgatcatttcaacacctgaattctactctgtttttgtcctaaaacagagttctattctatgtgtttttttgcctcagaacaaattaagttgaaatggtgtgattc

SEQ ID NO: 23174 - DNA, 339 bp, Triticum aestivum
  unsure (1)..(339): unsure at all n locations
  Clone ID: PAT_TA_23174
ctccgcctacgcctctgagggccgcgacggcctgctctggtggcgcgacctcgcgcgctgcgccgcgggcgacgtctccgccgcgctcgtccaggccaaccagacgctcgaggaccagtgccgcctccactccgccccgcccctcggcaccgtgctcgccgtcctcgacggccacgccggccacgccgccgcccgcttcgcctgcgaccacctcgtccccaccctcctagaggccgcgtccggcccggggggcgtcacggnggacgccatcagggacgccttcgcgggccacggaggcggnccttcatctgcgcaagtctccagncagtgggacancaa

SEQ ID NO: 23175 - DNA, 1647 bp, Triticum aestivum
  unsure (1)..(1647): unsure at all n locations
  Clone ID: PAT_TA_23175
gattcggcacgagcaccagtacacgcccgggcggcccgtctccgtgtcggcgctgcagcccagcgacaccttcccgcggaggccccacgcgtccgcccccgccgagcaggccgtcatggcgtccgagtgcggcttcaacaccctcgacgcgctcatcgacgcaaccgtcccggccgcaatccgcgcgccgccgatgcagttcaccggcaagttcgacgccggcttcaccgagtcgcagatgctcgaacacatggcgcacctcgcctccatgaacaagacctacaagtccttcatcgggatgggctactacaacacccacatcccggccgtcatactgcggaacctcatggagaaccccgcgtggtacacgcagtacacgccctaccaggcggagatcgcgcagggccgcctcgagtcgctgctcaactaccagaccatggtcgccgacctcaccggcctgcccatgtccaacgcctcgctgctcgacgaggccaccgccgccgccgaggccatggccatgtgcctcggcatcgtcaagtccaagaagaagaccttcctcatcgcctccaactgccacccgcagaccatcgacatctgccagacgcgtgccaccggcttcgacatcaacgtcgtcgtctcggccgccaaggacttcgactacagcagcggcgacgtctgcggcgtgctcgtgcagtaccccggcaccgagggggaggtgctggactacgccgagttcgtcaaggacgcgcacgcgcacggcgtcaaggtggtgatggccactgacctgctcgcgctcaccacgctgcgcccgccggggcgagattggcgccgacatcgcccgtgggctccgcgcaacggttcggcgtgcccatggggtaccggcgggcccgcacgctgcgtttctcgccacctcccaggagtacaagccggctgatgccccggccgcattattcggagtgagcgtcgactccagcggggagccccccccccgtccgccgtggcggaccccggaccaagcgcagcccccccagtccgggcggacggcaaacggcccccccgcgcatgcgttgctcccccacgccacggcggtgtatggctcccaaccatggggccgggttggcctgatggcctggcgctcgacccgngtccattgncctngcntggnacttttcngccccattggttttgaanaaagctttgggnacaagcnaacgggtgccaagaancttggacncttanttttgtaccaccggtcncaannaatcaacttttgcgccttggantgccttnantggccgaatntnncccgatanggaanggcccccggnaaataaaaacngtagcaatggaaaacncntttcggcngttnngttccgaaacnccgtnaaccaactcgaaatcnaacccngnnttgnccntttctcatntggagagaaaccaancnaaaccttttgggataaggggaatgtntttggagaccanagactctggttctcanaaggggntttttttctcncnttngggtgggggcaaagtgnnccaantggganancttttacatcnaggtntggganactccacttccgcaacccntgggangnggttattanannntctcnaaattcnctttctctaaaacnntctgcg

SEQ ID NO: 23176 - DNA, 463 bp, Triticum aestivum
  unsure (1)..(463): unsure at all n locations
  Clone ID: PAT_TA_23176
acgcacgcagctacctctgagtcctcactcacgcgcatactgagtcaccgatccaagcctctctctcgccacctcgcgcaccgtcaacgtctatggaggcctcgccgtctcgcagcgacagcttctcccgcgcgtggctcggctgcagggcgtccatcgagcggntctgacgccgacgccggcctcgggtgctcgttcaacgagctccacgtccttcatcgacatggaccccgcaggagctcttctccatgcggtggacgtcctccgccgcagtgccggngggaggatgacgaggaggctgccgagttcgacttcggtcaagctgacgtgcgccggcgcgcagtgcttctccccgctgcttgtcggcgccggacagcccctcctcccgtgcgagcctggcgtcgtgtcntacntgtcgtcgcccgctttctactccgcgcagaacacgcnggnctccgtcggt

SEQ ID NO: 23177 - DNA, 670 bp, Triticum aestivum
  unsure (1)..(670): unsure at all n locations
  Clone ID: PAT_TA_23177
cggagacgcgccggacaaggtgtacgccatcggggtatgccgcggngatcanaacgcctccgcctgccaanactgcatcgccgccaccttcanggacgcgcanaagctgtgcccctacaacaggggggccgccatcttctacgacatctgcctcgtcggcttctccgacagggacctgctcgtcgcgcgcaccaactccgacgaccaggaagtgcagctctacaacgcccagaacgtcacctccgacgtcaagccaagttcaacgcaaccgtctacaagctcctcggctccatggccggagtacgtcgaaaccataaactcggcgagggaagttcgccaccgggaccatcggcttcgacgatacctaccccaatatctacaagcatgggtgtgggtgcacgccctgacctgacgccctgggcaagntgtcgcgcttgccttgtccgccaccaattgccgaggatgcccgcgcgtcttcatccccggtacgcggggcgccaaggatcaccggcctgcgatgcagcgtgcggtatgaggtatacccgttctacaacggcgccatcatgctgcantgccggggnactcgctggtaagaagagtatgaaaccggtaaaatcctgaatctgtaccttaatggnactcnactnggaacatgtgggtgctttgctgg

SEQ ID NO: 23178 - DNA, 473 bp, Triticum aestivum
  unsure (1)..(473): unsure at all n locations
  Clone ID: PAT_TA_23178
ccaagttaagcagtacacactaagtttatctggcatgcacatcgttctgctgttggcacgtaagcagactaaatgataggccatcaggaaaacatatcattatttgagtcatgacccgttggncaaagcactaaaaaaatgtatgcatgttaatcgatggagaataacatgaacaactcttgtaactcactgttgaagccagcatgagcaagtattagtagatcgtgtttatgagtaaacagctttagtcataagtattctgctgactgggtgggtttatttgttttcttttaatcatcaaatatttgtgagtgggggcatatcaagttaccgtatcactataatgtgtgctcacttttggacaagaaaataataccactggactaatttttccgggtatttttttggtagctctnaacgctcatatggggttnaactcctgggggtagatacaaaggaagtgttgtggggcc

SEQ ID NO: 23179 - DNA, 893 bp, Triticum aestivum
  Clone ID: PAT_TA_23179
ctcgtcccgaattcttctctttgtgttacataagttcgcccccgccttctatgtgcgctctcggcctccaggtcgagcccaaatttgactccagcccaatgtcccaacacctgtcagcggtgtcccctacgaacctccagctctcactgtagagtctgcagagccgagattgagtaacaaagtcctcacttcgaagaggattcccaatcgctttcgcgatcacctgtcagtggtgtcccctacgaacctccagctctcactgtagagtctgcagagccgagattgagtaacaaagtcctcacttcgacgaggattcccaatcgctttcgcggtctgtatcgtcttcatctctcaacacattcccctatcaccattatcgtgaagctaaccacgatcagatcagatggttagggtcggagccctactcgtcacccacccttgatcatggaggaaaagccatccgatgagtttccggagcgtacccagcacccgatacggagatggtggattggatcaagtcgacctcgaatgttacaaagaagggagatatagatgaatatgcgcacctcatgtggtcccggtgtctaggcctcgcctggctggggctgcaggttttttgagactttttcccgcgcacgcagtttccattgctaccatttttattttttttgggtagaaggttccgtggaaaaggtggctgaattccacgggtaaatactgagctgaatggctattcatcaaggggaatatatcaatgatctttcaagtaacaaaagaggataggagcactgtacaaggtgtggcctgggtcagagaggagcccaatgtgctagatagtcatagactcaagtagtacaataaactcggccccacaaaaaaaaaaaaaaaaaaaa

SEQ ID NO: 23180 - DNA, 1445 bp, Triticum aestivum
  Clone ID: PAT_TA_23180
ctgccctcccctcctccccccgccgtcccctcccagttccccgcagccgcttcgctcgcttgccttctctcgccgtctccgcctcctcctccagtcctccgtcccacccctcgacgattcctcggcgatgggcggcgcggcggcggcgacgggcgccgccaggtggatccagcggctgagcgcggccaggatctcgacggaggcgctggagcggggccagagccgcgtcatcgacgcctccctcaccctcatccgcgagcgcgccaagctcaagggcgagctgctgcgtgctatgggcggtgtcaaagcttctgcaacactcttaggagtaccccttgggcacaactcgtctttcttgcaggggcctgcgtttgctcctcctcgcataagggaggccatttggtgtggaagcaccaactctagcacagaagaaggcaaggaattaaatgatccaagggtgctaactgatgtcggtgatgtccccatacaagagattcgtgactgtggtgttgaagatgacagattgatgcatgtaatcagcgagtctgtcaaaacagtaatggacgaagatcctcttcggccgttggtcttaggaggcgatcactcgatatcttatccagttgttagggctgtgtctgaaaagcttggcggacctgttgacattcttcatcttgacgcacatccagatatctatgactgttttgaaggcaacacttactcacacgcttcttcatttgcaagaataatggaaggaggttatgcgaggcgacttttgcaggttggacttagatcaattaccaaagaaggacgtgagcaagggaagagatttggtgtggaacagtatgagatgcgcaccttctccagagatcgggagaagcttgagaatctgaaacttggggaaggtgtgaagggggtgtatgtctccgttgacgtggactgcctcgaccccgcattcgctcctggcgtgtctcatatcgagccgggaggcctctcatttcgcgacgtgctcaacatcctccagaatctgcaaggcgatgtcgtcgccggagatgtggtggagttcaacccgcagcgcgacacggtcgacgggatgacggctatggtcgccgcgaagctggtccgggagctgagcgccaagatctcaaaatgagcagcgacagtcaggacagaggcagcagcagagaggattttcaggcacagtggtcgttgatcttagttcctgccaatcattcagttgtgccacgttttagtctgacaatcttctataaataataaaatcaggctgcaaaacgacttcgaatttggtatgtgctctgtggtatttgttggttctcctttcacatgcacgcatccaagattaagctcgtaggtgcctagtagtcgataagaacatcgtctctcacgcaaaggatatgttgaaaaatctgaaatgaatttgaaaaatc

SEQ ID NO: 23181 - DNA, 472 bp, Triticum aestivum
  unsure (1)..(472): unsure at all n locations
  Clone ID: PAT_TA_23181
ctcacgctgcgccacgtgatctccctgctggatcaggttgaggatgttgccaaggttcctgctcggattgagaacttgatggcagagaagcagctatacgccgcagtgcagttgcatgttcagtcaatgctgatgctagagcgggaaggccttcaagcggtaggtgctcttcaagatgttcgatctgatctaacaaagctgcgtggtgcactgttctacaaaattttggaggagctgcattgccacctatacaacaatgggggaatatagcttgggtgactttaaagcatgggttgacagtgaggacataccaacttcctgggggccaactggtccgcctagtaaacagcaatgcagcctctgtccaaggagaaacaatgtcctattaaaggtgaaanatcacnttttgtggaccagctactgcagatgggaataacaaaaaccaagttctgttgggggggccccctttgtt

SEQ ID NO: 23182 - DNA, 775 bp, Triticum aestivum
  unsure (1)..(775): unsure at all n locations
  Clone ID: PAT_TA_23182
ggcggnctacnccgcggcgcgcgaggccggcgggggcgccgtcnacatcctccactgcatcgaggcctggggccccgacgagcancgccgcgcctacgangccatcgcccggttcgagcgcgacggnctcgaccgcctccanatcatgcccggggcctcggagctctgcgggttcctccacgcgaggcagatcaggaggggtctaatcacccgcaatgtgaaggacgcaagttgatttgtttcaccaaaggtttggtatgacatttgtgcctgcattaagcagagaattccgtccctataagccagatccagctccattgcttcatatttgctccacttgggacattccaccaaccgaggtgatcatggttggtgacagcctcaaggatgacatcgtttgtggaaagagagcaggagcattcacttgcctacttgacgaaacagggcgatacgccccccacgattctttgcctgaagattttaagcctgacttcatggtgtcttcactcccccaagtactgtcggtgctggaggagcatttcgatgtggctccagtgtctgtcgccgagagtagaatatgacaggaaacgttctacaccttgaatgtaatattggtaatgtccgagctgtacgattnaatttatccataccctccaaaaatatgactgctactanaaangatttgttgcanttctgaccgtgatgcanctccagcaatgtgtccattanggatcatcaggaccaaaggatttnaccgtnaatttnccgtcaagaa

SEQ ID NO: 23183 - DNA, 780 bp, Triticum aestivum
  Clone ID: PAT_TA_23183
ccgacatcaacttcagcctggaggattacgacgacatcaagcagatgggcaacctgaccaaggaggagttcgtccacgtgctccggcgccagagcacggggttcccccggggcagctccaagtacaggggcgtcaccctccacaagtgcggcaggtgggaggcgcggatgggccagttcctcggcaagaagtacgtctacttggggctgttcgacaccgaggaggaagccgccaggtcgtacgaccgcgctgccatcaagtgcaacggcaaggatgcggtgacaaacttcgatcccagcacctacgccgaggagttcgagcccgcggcttcgaccggcgacgcggagcagaacctggacctgtcgctggggagctcggggggctccaacaagaggggcagcctcgacggcggcggcggcggcgacgacgacggcgcggcagggtccgaccagcgcgtccccatggccttcgagctcgactggcagacggcggcggcggcacggagcaccaaggccaagttcgaccagaacttgacgcatcaccagatgccccctcccgccctgcaagcctcccacatgcccttcagtcccaggcaccaccaattcatgggcaacggcgatccggggacagcgggaggcctgtcgctgacggtcggcgccggcggcggggccgggcgctggcctccgcctctgcaccaccaataccagccgccgcatccgcagcagcatcaacagcagcagcagcagaggctgctgcagggctggggcaacgtcgtccccg

SEQ ID NO: 23184 - DNA, 545 bp, Triticum aestivum
  unsure (1)..(545): unsure at all n locations
  Clone ID: PAT_TA_23184
ctagcttcctgagtagtacatcctcttgacgttgaccatttgctttcccatcgcagaggatcatgtccatgttcacctccagcagctccggcgtgccgtccccgtctccggaggcgggcagcagcatggtcagagcggcgcggcagccccagccccaggcgtttgactacttcgtggttctagacttcgaggcgacgtgcgagaaaggcgcgcggatctacccgcaggagatcatcgagttcccctccgtgctcgtcgacggcgccaccggcgacctcgacccccgccgagttccgcacctacgtgcgcccgcaggaccaacccgcgctgaccgacttctgcagggacctcaccggcatcccggcaggcggcctcgacgggggcgtgtcgctggncgaggngctccgcctgcaacgccgcgtggctgcgggcctcggcgtggggcnaagaaccggcggccgccccgtccgcccctcgcgggggggggccccggcatgcccccaccgtgcccgggattcccgctagccgcctttaaaaacctcccc

SEQ ID NO: 23185 - DNA, 583 bp, Triticum aestivum
  unsure (1)..(583): unsure at all n locations
  Clone ID: PAT_TA_23185
ggcacaaggacctggaccaactcgcgagatccatggagcgcctccccggggtgcccaccaaggtggaatttgctgacatcaagaaggccaccggtaacttccacgaagccatgaagctcgggggaggtgggttcggcaccgtgtacaggtgcacgctcacggcctccgcttcaaagacggagcgaccgatggatgtcgcggtgaagaggttcacgccgcgatgtgcagaaccgctgctacgacgactttcttgccgaggtcagcatcatcaaccggctacgccacaaagaacatcgtcccctttgtcgggtggtcttataacaaanggagaggccgctacctgtgttcgagttcaatgaccaaacggcaagcttggggtnaacatcctttccccaaagtgaggcaaatggcaccgggctacaacaaggggcaacgcactggcacggcattcggcaaatggcaaccgctacggatctcaagganattcnacgggctnantagtcaacaacgatacaancnatgggcncacgnaatcaggnaanaacntatctancncaactttgggccgctcgnnaatttgctg

SEQ ID NO: 23186 - DNA, 1174 bp, Triticum aestivum
  Clone ID: PAT_TA_23186
cggcacgagggggtgttcgacacgcagggcgacgagtccagcacctacaaggagatgatcgtgtcgctcctcaccggcccacgcgtccgcaacatcagcgacttcgtgccggcgctgtcgcggctggacctgcagggggtgcaggccaggctgcgccgggtgcaccgccagttcgacgggctcatcaccaagctgctggcggagcacgcggcaacggctgaggagcgcgcccgggagggccggctggacttcgtggacaggctccgcgccagcagcacgacgaggacgaggacggcgagaccatcaccgaggtcaacatcaagggcctcatcttcgacatgttcacggccggcacggacacgtcgtcgatcatcgtggagtgggcaatggcggagatgatcaacaacccgtctatcatggcgcgcgcccaggaggagatggaccgtgtcatcggccgtgaccgccgcctcgaggaatccgacatcgccaacctcccctacctgcaggccatatgcaaagaggccatgcgcctccacccctccacgccgctcagtctcccacacttctcctttgaggagtgcgaggtcgatggacaccatgtccctgccaacacgcggctcatcatcaacatctgggccatcgggcgggacccggccgcatgggaggatcccttggaattccggccagagcggttcctatccgggccggcggccaagatcgacccgatggggaacaatttcgagctcatcccgtttggcgccggtagaaggatatgcgctgggaagctggctggaatggtgtttgtgcagtacttcctgggaatgctggtgcacgcatttgagtggcggctgccagacggagaggataaggtggacatggctgagaccttcgggctggcactgcccaagaccgtcccgctcaaggccgtcgtcaagccgcggcttgtgcctgccgcgtacacatgattgttcctgtctcggaagttctagacgatcgcctcgctcggtgtagtgtgttatgtttgtggtgacccaagctttgtgttgcatgtgtacatacatacttcagtcacttcgtacatttaccttcctcacagaataaaacatgtgcccacattacgcagtcaaaagagtacaattgcctgtttttaccgagaacgaattatttcatcatt

SEQ ID NO: 23187 - DNA, 851 bp, Triticum aestivum
  Clone ID: PAT_TA_23187
ggcattcaatgcatggccgccttcaaactgcaaggagcatcgatgaggtcatccagatacacgatttcttcctccagaagtgtctaaaagaatgcttgctgttgttgcctgagctcctcatgaaagttgagaagctgaaagcattatgtcttcaatacgcgacttccatccagctcttgataccgtccatcgaggtggctgctcctgagagcaaatcgaaatccttgtcgtcgagagcaagagccaagagatcacaggacagagacgagcaactgaaactagcatccgagaacgccgtgatgtcgcagtcaatcctgaaattcgagtcggagttcaacgcggagctccagagcctcgctcctacgctgagcaagagctcacaggccgaaccgtacctgacccatctcgcgcagtgcattctcggcgtcggaatcgaccagtgagcttcttcaggggttccatgttcagatggttgcaaagtttgcatgtgtggttgtgtgcgtgtgcgattccgcggcgtggcagtgcgcttgctgccgtcgacgccggtgtgcggtcttgtgggtgagctggaaacttgtaaaacatacagaattatgcttccacgtggtggatgtagtcatgtagatgcttggttaggctttaattagctggtgctgtaggctggtgtaactgtttgattatacatactctggtggactggtggtgtgtttgtgtgctgcgattcagcatgctcaggctttgtgcccctcgggaacccggctgtgttgtttgagacgagtcgccgatgtagtaagcctgtagcttcaagagcctggctacgaatcagagtggaagcctcagttgcgatc

SEQ ID NO: 23188 - DNA, 1022 bp, Triticum aestivum
  Clone ID: PAT_TA_23188
gcaccttgcagcatgtgaaacaatgggatctgctggtaccatttgcacagacaagacaggaactttgactactaaccatatggtggttgacaaaatctggatagccgaggtttcaaagtcggttacaagtaacagtagtttggaagaactgaattctgcgatttcttcaagcgcatggagcctacttttgcagggcatttttgagaacactagtgcagaggttgtcaaaggaagtgatggtaaacaaactgttttgggtactcctacggaaatagcgatatttgaatatggcttgagcttgcaaggatatcgtgatgctgaggataggagctgcaccaaggttaaggttgagcccttcaattcggtcaagaagaagatggcagtattggtttctttacctggtgggggacaccgttggttctgcaaaggtgcatcagaaattattgttgagatgtgtgacaaagtgattgatcaagatggagatgttattcccttatcagacgatcggagaaagaacatcacggatactatcaactcatttgcttcagatgctttaaggacattgtgcttagcatttaaggatgtggatgaatttgatgagaatgcagatagccctcctaatggttttaccctgataatcatatttggcatcaaggaccctgtgcgacctggagtgaaggaagcggttcagagctgcataactgctggcatcattgtgagaatggtgactggtgataatatcaatacagctaaagctatagccaaagagtgtggcatattgactgatgatggcatagcaatagaaggaccagattttcgtaacaaaagcccagaagaaatgagggacctgatacctaagattcaggtcatggcccgttcgttaccattggacaaacatttgcttgtgacaaacttgagaggcatgttccaagaggtggttgctgtgacaggtgatggtacaaatgacgctcctgcgttacacgaagcagatattgggcttgctatgggcattgcagggacag

SEQ ID NO: 23189 - DNA, 1476 bp, Triticum aestivum
  unsure (1)..(1476): unsure at all n locations
  Clone ID: PAT_TA_23189
gtcatggcctcgccggcgacgccgaggccggcgctgatccggccgcgggcctcgcgcagccgctcccagttgggcgccgtcagcctcgcttccgaccacgccgccgccacggcctcctcgggccgccgccgcgacttcgtcttcgtcgtcaacccctccggcgccaatggccggacgggcaagcagtggaagcagctgctccccttcctccacacccgcctcgccgaccaatgcaacatttgcgagtgcatcacatcgggcccgtcgcacgccatagatgtcacgagggaggctataaaggacggcgctgatgctgtgatcgccgttggcggngatgggacgcttcatgaggtggtgaatggcttcttttggaaaggaagcccggtccgtgctctcgatcgagggcctgatcacttgacggcacttggtctcatcccacttggaactggctcagactttgctaggacatttggatggtcaaacgatccccgtcgggcgattgatcgaattgtgagaggagttaaatcaaaattagacattggcatgatggaaggtccaaatggagacccacatttcttcataaatgttgctgacatccatctgagtgccaaggcaggttattttgcttctatgtacaagaggtttggcaacttatgttatgttctgggagctttagcaggcttttgggttcacactaatcgagatttgagtgaaatggtaaatggaggagaatggaaaggaagcccggtccgtgctcttgatcgagggcctgatcacttgacggcacttggtctcatcccacttggaaccggctcagactttgctaggacatttggctggtcaaatgatccccgtcaggcgattgatcgaattgtgagagttggagttaaatcaaaactagacattggcatgatggaaggtccaaatggagatccacatttctttataaatgttgctgatatccatctgagtcctaacggcgacgtctttgtgcaatctgacggggagcatttcggttttcttccgaccaaattctcagttctgcctggtgcagtagatttcttcagctagaccgctgtgctgtttcttcctgtcggattccgacgaacagaagaacgcgtgattcttggtgtgagttgccctgttcacctggtcaatttcttgtgccatagatcaccacgttcttcctcctgttacactagcttaagatgacgtgacaatcaggttgctccactcactcgatcttctggtctgatatggtagtacgcacgtgaaacaaattactgatgtgcagcagccacccgccatgtaatttctctgcctgcatgcagcatagaatagtcgagtcgttggtgttcatagacaagctgtagagtcacagcacaggggccgaactggtatgagtgtaaatttcaccgttgtttcttcagtcttgtaagtaccgtgtgcaataatacggttgcttgttgctcgaac

SEQ ID NO: 23190 - DNA, 487 bp, Triticum aestivum
  Clone ID: PAT_TA_23190
gcaatgtcctgcggaggttgctcgggggcggttaaaagggtgctcaccaaaatggaaggcgtcgagagcttcgacatagacatggagcagcagaaggtgaccgtgaagggcaacgtcaagccagaagacgttttccagacggtctccaagaccgggaagaagaccgccttctgggaggccgaagccactcctgtaccggaggctaccccggcagccgacgccgtgcctgcacctgaggcaaccccggcagcagacgccgcgcctgcaccggaggtgaccccggccaacaccgtcgcttgatgaccacgcacagatgatgccgccgtgacctttgaaaactccaagatattgttgttgagagagtcatggcggtttgcacgatgttacttacgagttgactacaacgtaatggaataaacaaagtgtgtatgatctagacaaatgaacacgtcgaccacatgatttacaatagatttcagttctatta

SEQ ID NO: 23191 - DNA, 573 bp, Triticum aestivum
  Clone ID: PAT_TA_23191
cggacgcgtggggcaggcatcatcaaactctccctccgacgacatcgatcgccggggtcccgatcttctcctcttgactcctgctgcaactgccaaccatggcctccgagactgttgtcctcaaggtggcaatgtcctgcggaggttgctcgggggcggttaaaagggtgctcaccaaaatggaaggcgtcgagagcttcgacatcgacatggagcagcagaaggtgaccgtgaagggcaacgtcaagccagaagacgttttccagacggtctccaagaccgggaagaagaccgccttctgggaggccgaagccactccggccgctgctgccgctgaggctgcgccggccgctcctgcaccggaggcggctgccccgacagcagacgccgcgcctgcaccggaggcaaccccggccaacaccgtcgcttgatgggcacgcatagatgatgccgccgtgacctttgaaaactccaagatattgttgttgagagagtcatgtgtgggcggtttgcacgatgttacttacgagttgactacaacgtaatggaataaacaaagtgtgtatgacttag

SEQ ID NO: 23192 - DNA, 906 bp, Triticum aestivum
  Clone ID: PAT_TA_23192
cgtgagggcagcatcaaaatctccctccgactccatcgatccccatctcccgctgtgctcctgatgatttctgcttgagctgccctccatcgcctacgagtctgctctccgcaaggtggcaacgacctgcggaggtcccgcggggggcgctcaggggcgttctcaccggaacgcaatgcatcgcgagcttccgattgtatccgcatcagcacggaggcaccggccatgcctgggctgtgcaacacgacggtactcaaggtttctctgacctgcggaaagagctcggcgtcggctgaaagcgtgctcaccaaagtggcaggggccgcgaccgccgccgacgccgtgccggcgcctaaggcaaccgtggcggccgacgccacgccagaagctgtgttcccgccggtctccaaccacggtggaagacgacgcccttctgggacgccgaggccactccgcgcaccccacgctaccctggccgatactgtagtggaggcagccacggcagcacgacgccgcggatgcaacggacgcggccccaacagcgtacgccgcgcctgcaccggtggcaaccccggccaacaccgtcgcttgatgggcacgcacagttgatgccgccgtgacctttgaaaactccaagatattgttgttgagagggtcatgcatgtctgggcggtttgcacgatgttacttacgagttgacaacaacgtaatggaataaacaaagtgtgtatgatttagaaaaatgaacacgtcgagcacatgatttactatagatttcagatctattaatgttctacagctcttccgttgacgaaagtgttcagtacagccgtccatgttaaatttacacagactgaaatttatagtacaaagatacaatgttgtattaaaaaaaaaaaaaaaaaa

SEQ ID NO: 23193 - DNA, 1676 bp, Triticum aestivum
  Clone ID: PAT_TA_23193
aaaaaacaaacgcagccaccagcacgacccttcctctcgatcttatctggacctcccgccccgccccgcccctcaccgccgtccgccgccgcgcgccgccaccgcctgcctcgccgccacgcctacccctaccccaagtgccaacacacccgcgaccatccactactggcgacccgcggccttcgggactcctccccgttgcttcgactacgacctgacagccccgtagcggcgtggggatggcgagcagcaacaccggcgagccgagcacggcgccgcaaccgaatcggtggtacgaccttcgattggggtcctcctgccgcgaccccgcccttaccaccaagttctgcacgctccgctatgaatttaagccagcatctattgacaagactcaagctggctctctgcagaagagcaaagataaccgggtaactgtggaatttcataacaatcagcctggcaggccaaaggtggcattcgagggaagccaagaagagtacaaggataatgatggtgtcttgttttttgatggtgagacctttcgcttggaacgattgcaccgggcagtcaagagattaaggcatgtccgggttccgggagagtcaacttccttggcagctacaactactggaatgggtgaatctcattctcctccattagcgaaagttggcaagttgcctgcaacgaacaaaccttctatacacccagttccggttgaggttgagcacattgacattggtgaacctgaaaatccaggaccaagaaacagtaacaggagctctacatatcaaccagtcaccacagacccattttcctcttcgcctgatcccaatgaccaagatgaaaacctagacatactcggtgatgatgacaatggctcacccaataatatggcctcagcacaagggacgtcttatcgcggttttgacatcaacttaccaaatcagctcgacatggatgatgaggttgctgatgttgatgtaaatgacgaagctgaggagggacttaatgcagctgaggcgctgcgagctcaagtcaatgcagaaggacagcaggtggagcaggccacctctagttcaagtggaagcagcagcggcagcgggagcggaagcgggagcggcagcagcaccagtggtagtgacggcagtgatggcgattcacccagctccggaggggatgttgatatatgagttcggtttcaggctgctgacctaacttgctgtctatgaatcgcacttaagtgcatgtttggatcatgtcctgaagcaagattgcctggcctcaagggcgcctgagattttgcctggattctgtttggttggtgtcctcaatcatcttattatagcctggcctgaaaacttgtcaatgccattagcctgccctggccagccaggcaacgtgattagcctgggccaggcgtcccgtttgacacgcctggtgggctgatgcatctgcctggtactattttaatatttctggaggtgatgggtgtccagagttttatcgaccaaagtgtaatttgtacggcgactatccaccaaacgcatatggaccaggcaagcctgggcaggcagaattctccgacttctcaggcgacatccaggcattactttttgccaggcataagggccaggcctcgaaccaaactgacccatatttctacttcgtactttgta

SEQ ID NO: 23194 - DNA, 742 bp, Triticum aestivum
  unsure (1)..(742): unsure at all n locations
  Clone ID: PAT_TA_23194
gcttcctggtgacaacgttggcttcaacgtcaagaacgttgctgtgaaggatctgaagcgtgggtttgttgcatccaactccaaggatgacccgcccgcccgcgccgccaacctcaccgccctcccccgcggctggcaccgccctgcccgcatcggcgctggcgccgcccccgggccggactcccccccccccctcctggcggtcttgtgcgcggagctgggtgaccaaagatctgacaaggcgaatctgggaagggagcttgggagggcgctgcccaagttcctgaagaacggtgacgctggtatcgtcaaagatgattcccaccaaagcccaaggttgtggaagaccttcgccacctaacctcctcttgggcgcttcgctggtgcgtgacaatgaagaacaaacgggtggctggttgggtggcatcaaggggcgtgggagaaagaaggaccccaccgggcgccaagggttaccaaagggctgccatcaagaaagaaaataggcatctatctatcaagaaaggggttttgttcaatggggcaattgcttttgttgctgcaagactccctatcccgggcgaagcaaatgatcctggnctgtccggttaaantactggntatttctaatcctgcttcgggggtaaaactcctgtgcctttgagnactggattttgttggtgaaaaatgcaagnttanttanattgcaaactaaaaaaaaaanggggggggcccggttanccnc

SEQ ID NO: 23195 - DNA, 522 bp, Triticum aestivum
  unsure (1)..(522): unsure at all n locations
  Clone ID: PAT_TA_23195
aattgcaagcttgcttgcctttattaattcagtacacaatgcnacttcatccggcccgcagacccctattaggacaacattgattgcaaaagacatttctagataattacactgaagttccattagggcgtccagttatagctgcaagtagttttggcatcggaagcatgtcgatctcctggagaccctcgagaacccgaaccacttcacccatcatcggcctatcggactcgtcatcttggatgcaccataatgccactttgcaaaccctctcagcctgtttcaaatcaaagtcaccatgtagttgtggatcaaccaaactctgcatatctcccccacaaagcttgctgatgacttgcacagggaaatattcaacacgatcaccgctgccagtacctcggccgcgaccacgctaaatttctccnttnccngaggatgaatctcaaanaaggtaccaatggcaaaagctgtnaacancanctttggggtggggntagnaaactccactangcnattcctngg

SEQ ID NO: 23196 - DNA, 611 bp, Triticum aestivum
  unsure (1)..(611): unsure at all n locations
  Clone ID: PAT_TA_23196
cgagtttttttttttttttttttttggcaaataaggatagttttctattgaacatgtgtcaaagcaagtagctgaagttttcaacattattacatggaatcactatgtaaaaatacataataattatctcaagcagtagattagcaccactaaatactgtaaactcaatatggatggcaagaatagaaataattcccttgccttattactaaccagttgttcttgtttgaataagcagaaatgataataggaaaacgaatgacacttgtcccataactctccattgcacatcaagagatgtatatagctccatcacccgacgatagtggattgcaaaccccaagccacccaaagaaagggcctgcccctccgcgcgtcgggtgtagccgggccccngcccctgcgtcatggctcgttgggtggtccgttcggattaggtccttgtcgcgaactcgccgccctggggcattcgaatacccccnctcctgggaggcctgctctcggccagtcccgcgccccggtcgcggggaggcctgcgggcctcatgtagtgtatttctgggttggnaatccatcagggatacttcanattcggaaacacctggnnggant

SEQ ID NO: 23197 - DNA, 249 bp, Triticum aestivum
  Clone ID: PAT_TA_23197
cgccactgcctcctgtcccgcagcgggctgcaacgatgagactctgtgcgcgtgccggccggagggtgtcgctgcagagggtggtcggccatggccatatcctccgcgccgtcgatctgcgcggatgtgagccttttcttgttctgctctttttgtttgtagttcaagaatgatcaattcttcgtgagattcgtgtgagcgcatatatactattagttttcctatcaacaagatgtgttcttcatcctc

SEQ ID NO: 23198 - DNA, 1211 bp, Triticum aestivum
  Clone ID: PAT_TA_23198
gctccgagccggccgggccggaaccactccatttgcatcgggagagtggacgcgccgattgttggttgcctccgcaccgccggggactgcatctacacctggagtgacacggtcaagcgttggccgcaggccaccgcctgtggctgtgcggccgcatcgtcgatcttgccgcgaggatgatgcggccgagggccggcgtgtactctgctctgtgagtcgccccgccttaggacaggctacctcgtctggagcgcgtcgccgccgccaccgccgcaagacagaaagcgctactgttgcagcgccgttgcttgtatgggcgcctcccgctgttgccggagcgtctaattagactagagggtgtcgcaccggatccgctgctgcgccgagaggagccaggccgaggggagcatcgctgcgccgaggcgcgccactgcctcctgtcccgcagcgggctgcaacgataagactccgcgcgcgtgccggagggtgtcgctgcggagggtcgtccatggccatatcctcgacgccgccgatctgcacggatgtgagccttttcctgttctgcccttttttttttggtatttcacgattgatcaattcttcgtgagattcgtgtgagcacatatacatacaggaggaaaacaattcattgttagattattaattgattgcaagaagccaagatcgatcaatcaatctcctgattagtttctatccttttgttcgaggaacatctcgtctccgccgtgaatcgcgtggtggccgaaactctagtagccaacttctccagacttgtccagtcatcgtctgcggcaattgcagatcgccggagtggcctcctctggccatagagaggccttgccgtttgccgccgctgtcgtcggcagtcatgtggcgtattgaagcgccggagggcgccgcttcgacgcgcctacagaggagggcgtcgtcaaccatggggtgcctcagccgcctgcatcgcgcgctggtgctgcgccgctggagcgctgtcgaggccgagggtccttgtgtccttggggccggagggagtcgccgccacagccgtgtatcaggccgatggtcagggacggtggtgccgtcgagttctcggcctaattgctctctggaagaggcgtgcgtgataacgtgtaaagatgaagagagagagaggagcgaataatgggaataaacagtatcactttattgatgcc

SEQ ID NO: 23199 - DNA, 1624 bp, Triticum aestivum
  Clone ID: PAT_TA_23199
ggcttcacgcgatgggtaaccgccgccggtgagtgcgaaccggccggtagttgcgccaccgccgctgcttgggaagcgaggccgtgtcgcacaacgcctgagggcaccgccatgcgcaggaaactgtgccgcaccggagtacgttggccgcccactcgcgtcgagcgccgatgatcttcgggtgcggttgcagcgccttaggtggtcgctcggacgagcgctggaggatgctgctgggaaggccgggggcctctagccccgggtgccctcgtgccagggggaagcagcgtcgggccggcgttgagaacttcgggcgtggaggttagtgcgtcttgtgtgcaagagcaaaaagaatggaatatggtcacctgatgatgtagcaattaagatcgagagtttggtgtttgtataaattaatgcttcatcgtcttggagaaggggcggcccagatcctcgttatttttcatgtgatccccttttctcttcttctgttcttggccgaacttggtgtttcgtctgtgaggacgatttttctcctcaatcctctgtcttctttttggcctacagcatgaagaatgaaagtgaatggacgaactaaaaaaaaaaatgaacgacagggcgccccgtccccctgccgccggccgcgatcagactctgtgcgcgtgccggccgcacggtcacgacacagtgggcgagccacccgggtcctgacagtcatggggatggattttcgatcgagtgaccctggatgcctccgcccatttcctgttctgtgcgtcttccttgtgtaattggtgagtgtgcccaatttcaagttctgatgttcctgcttggagtatgataaatccgctcaattgattgatgttctgtcctttggcagagtgtgttcgaggcttccaattgttgaatcgatggaggctggcgctgcgttcttccatcggttcttctttctttgtagttcacgattgatcaattcttcgtgagattcgtgtgagcgcatatacatacaggagaaaaacaattcattgttagattattaattgatgattgcaagaagacaagatcaatcaatcaatctcctgattagtttctttcctttttgtacgaggaacatctcgtcttcgccgtgaatcgcgtggtggccgaaactctagtagccaacttctccagacttctccagtcatcgtctgcggcaattgcagatcgccggagtggcctcctctggccatagagaggccttgccgtttgccgccgctgtcgtcggcagtcatgtggcggattgaagcgccggagggcgccgcttcgacgcgcctacagaggagggcgtcgtcaaccatggggtgcctcagccgcctgcatcgcgcgctggtgctgcgccgctggagcgctgtcgaggccgagggtcctcgtgtccttggggccggagggagggtcagggacggtggagccgtcgagttcttggcctaattgctctctggaagaggcgtgcgtgataacgtgttggagagaatcgagagagagaggagcgaatggaaaacagatatatgaatgaacagttattctattgattgaagattggggtatttatacccagtttacaaggcggttaaaaaaaaaaaaaaaa

SEQ ID NO: 23200 - DNA, 1022 bp, Triticum aestivum
  Clone ID: PAT_TA_23200
gcgcgcgcccgacgccgaccgccgcacaagcgcagcctcggctcgggtctcgggcacagtcgggggcaggcacaggcagacgctgcaccgtgcgccccgtggccgcagctggggccgcctggaggtcgctgtagctgcagctgaagaacgggccggcagggcccgagggatggtacccgccgcggagttgcgcgggtggagggctagcggggtccccgaccagagggggggcctcccagagcagcagagggggggccgcagggggtcaccccaccccggcgagaactcctccggccatccgaccacgggcctctacgggaaggcgccgcgcctcgcgctgcgccagaccttgtcgtgcagggccctccggtgccacgggaggctgttgggtctgcgcgggcatcctcatgaggcggctgcgacgaccccgtcctcggcggactccgggccttgtggtgatcctgatgaagtgaaagcgcggctgaagtagtgggcacagacagtggcatgcacagtccaacgctgcacctagtggagtgaaggtcgggacgagggtgcttacgagtgcagccggtaacatgtgtccgaagatgggctcaactgaaggtggctgaagctgaagattctgcttacatggctgtaagatacattatctcgacgagatgcttgggttgcgcgctctcgggataatataacggatcggtgctttccgaaaatttcatagagggagatgacttatgacaccacagaactgcgagacatcttcaggcgatatgtcctctaagctttaatgaaagcattggaagcttgtgttccgtcataggcaatggtcattagttgttttaaacgtgcaattcggagacctgctagtgcttttaatcttcccttgtaatggtcattaggagctccaactgtgttctactgcgccaagttgagctttgcaaatatgtcagtaggttggctcagcctaacagcaaactgtggctgttgaaaaaaaaaaaaaaaaaaaaaaaaaaaaaaaa

SEQ ID NO: 23201 - DNA, 1023 bp, Triticum aestivum
  Clone ID: PAT_TA_23201
gaatctgtgaagtgggtgtcgctccttgctcatcaacctcgagttgatctaaattactcagtcgtagtgatggaagacaccacctttcccgccgggatcaccggcatggaggttggcggagtcgtcttcggcgcgtccgcgacgcccccacactcatcaaagatcctcttcctcggtggtgccggggagcgaatcgggccacgccatggcacgctcaagctggtgacggtgatcggcgtctacctggagcagtcggccgtgccgttcctcaccagcaggtggcagggaaagcccgcggaggagctcgccggctcggccgacttcttccgcgacatcgtcgccggcccgttcgacaagttcacgcaggtcacgctcgtcgacaccctgaccggccaggagtactccgacaaggtgactgagaactgcgtcaacatctggaagtcctcggagcactattcggtcgacgaaggccatggctccgccgcgacaagcgagctcaaggcaatcttctacccggcgtcgttccccaccggctcgaccatcttcttcacgcattctgccgacggtgtattacaggtagcattttccgacgacacaaaggttccggaacaagagagcgcccgggttgatagcagggccctgtccgaggccgtcctcgagtctatcatcgtagccaacccctgttcaccgccgtcctcgagtctattgtcggcgagaatctcgtatctcattcggcgagacgtatcctggctttccgcatctgtgatctcacatgaaacaagtgatcgaccaatggatgacagcttggacaacatgaaaccttattatagctaaaaagataaagactgtaccattcgcatattgttgctattactctctgcactagttatggtcatcgtgtagtaaacaaaataagagcccgacttgaggcacgaaatatggtgggttgttttacttttgtttcgaactagcaagtgtgagggcgacatctcaacatctttaatatagattaggtgaggtgcc

SEQ ID NO: 23202 - DNA, 1111 bp, Triticum aestivum
  unsure (1)..(1111): unsure at all n locations
  Clone ID: PAT_TA_23202
gtntaccactttccatacctactcctctcctaacgtagatttctttctttctgttagactataatccccacctcgttcctctgcacgcctccgcagcctccctccctccccccacgtcccacctcgccggcgtaccttggacggcgcgctggggattgcccctgttgcccagggtcaagtttccccggcatctgagccgcgcttggatggaggagtgagggacgccgaccgccggtcatccttctcaattccaccatggcggatccggtgggattccaagtgacctctacggccggcctctgtcgaggtgttgagcggccaactggtgatccgatctgactgactgacgggagatgaggcaaactggtgagtcgatctgactgactgacggcaggtccggtccgtcgccgcccggcgacggtgactgttcaccgcagattccaggccggcaatataattcttgcagatctaccagaggagcatccgctattgctttgaccacgacggatctgaaggtaccggtgggtactcagatctgcaaggatatacagccgcgcaggtctccactgccagagtcatggcaagtcgcagaaccatgcttaccggtgatgggattcatcgcggtaattttgcgctaacgccgtggatgcggtggcacggtgggtcgatatagtcctcggaccgagaaggttgtatctagctttctcgtctactcatcccagcagagctcactagcccgcgacacagctactgtttgatctcccgtggcagaggcctagatctgttcgatttgctgaggtctgcggtgcactttgctgaagataagtgatgcagctttggatattcagccatggctgatgacaagtgatgcagctcggacactcagatcagatgcgtgacacaggatgtcgactcggctcgcaagatattggtttggagcaggccagttaggtgcaacggttgcccagtcttggagatcaatatttcacttgaacgttggtaaaatagcacaagtgagatatgtggttttgaggattgtttgacaagatgatggtttatttttatttttgttcctcaggtaactaataactaaccgcgttattttgcggct

SEQ ID NO: 23203 - DNA, 476 bp, Triticum aestivum
  unsure (1)..(476): unsure at all n locations
  Clone ID: PAT_TA_23203
cctccaggcactttacttctgtgttcctttccgcgagcaattactggagtactatgctaacaataaaagcgccagcgatggcgaagagaacatgttaacctgcttagctgacctcttctctcagatcagcaatcagaagaagaaaacaggcgttatcgctcctaagcgttttattcaacgactgaagaaacagaatgagcttttccgcagctatatgcatcaggatgctcatgaatttctgaattttttgttgaatgagctagctgacattctcgagaaagaatgtaaagccaataaagaaactcctcaaaattcatcttcaaataatgagttctaatggccctattaatggtcagcccaatggtagtcataaagaaccagagactacatgggtccacaaatgcttccagggaatattgactaatcaaacaaaatgtccggagatgtggnaaccgtcactgatggagatngaaacn

SEQ ID NO: 23204 - DNA, 315 bp, Triticum aestivum
  Clone ID: PAT_TA_23204
acgagcggctcttcatcggaggtatggcgtggtgccggaggccatctgcggcggcgcgggcagcttcgagatcgacttcacccggcccaagccgcaggcgtacatgcccgcgtacaccgcggcgccgccgagccacggcgtgactatgcagcaggcttcgccggtggacatggggtacttgactgtgccggagcgtccggtggcggtgaccggggagggcagggtggcgaggctgatgcggtaccgggagaaaaggaagaaccgccggttcgagaagaccatccggtacgccgttcagaaggcctacgccgagtc

SEQ ID NO: 23205 - DNA, 994 bp, Triticum aestivum
  unsure (1)..(994): unsure at all n locations
  Clone ID: PAT_TA_23205
tttttttttttttttttcgtaccacttttacatatgggttaatatccctaacaaagagttcctcaacattctggtacacttaaggacttgggtgctcgtggtcgggcggccgccccgcgggcgggttggtttttttttttttttttttttttttttttttttttttttttttttttttttttttaagaaattaacacaatatatacattcatgttaaacaaccacaaattacaagaaaaacatacaaaatacacaaaacaatttattcgggcaaacaattccacatgtcccatgtgtggaaatatatatgatctctaaggaaatctaccatatgtgtggaaatatatatgtaccatacttctttcacagtattacctcggccgcgaccacgctgctcacgcgtgtattcgcataatacttccgtcattctgtaaaattcatcaacttactgcgaaaccacatgatcatccagttgatcattctattgggcattaaacctcttaaccatgtcacgaagacgctctgcaacatctgtcatctccggtctctgattgacatcaagatttagacattgcataatcatctctcctagattatcaagaatctctcgatctacctctgcaagttccttgtccacgagctcaatcacagacttgtccttcgtgtaagcatcaagaaagttcctcaataagctattcttgtcaggatgtgatgccttcttccccgcaaggggctccaagagcacaactccaaacttgtagccatcactcttcttggttagtaatcctgttggtagaagaactggatccatataactcatgtcaccaataacatttccagtgtgttgcatatctgtaacaattaaccttgatataccaaagtctgagatctttggtgtgaactcgtcattcannnngtatattagctggtttaacatcaccatgganngnnnnnngtagtgctttctgaatgcatataagctagnnnttccgnn

SEQ ID NO: 23206 - DNA, 602 bp, Triticum aestivum
  unsure (1)..(602): unsure at all n locations
  Clone ID: PAT_TA_23206
gctcccatacacaggcacacagccatggagattcgaagcacgccggcggaggactcgagcagctgcagcagcctgccggcgtagtgcttgagcacctccagcttcaggtgcgcaccgttcgttctccggctcgcccgcatgccatctctcaagcagcaaagtagcagcagctagcagcacgtacgccggcggccggccaccaagctccctcatgcacgtagcagcgaagcagcagatgtgaggcagctgcaagcggcagcggcacgcggcgggaaggcaacaactcaccaaccacacgccggcgagcggcggcaccaacaaccacggaggccacaagccacatgcgtcgtcgacggcgccaccaagagcggcggccaggctcatctcccatagacgcatcttccttgctgagcaacaagcaaccgcacgctccggcaangccaacaacggaccggcgcgctgccacgcaagcagccgaccggctacgtgcaaagagaggcatgctcaaacattgactantgncgggatcccctatatncnggggcactgtactgcgggatatcggncccccttgngggggncttttttttttaaatttgcga

SEQ ID NO: 23207 - DNA, 746 bp, Triticum aestivum
  Clone ID: PAT_TA_23207
cgcaactaatcagaagctaaattgtcaggtcaataggctgcttttgttctgcaaggtgcactgtgatgatggctggcatgtcaaagagaggaatacctttgatattcttgtgagcttcattgaggagaaccagcatatctttccggaacaatcaaggcaggaagctgttattgttgtgaacaaaatagtgtcaaatatcctggattgtactaagcagaaggagacacatgaatcggatgctaacgcttcagaggagatgatctaccttgctgctgtacttaggctaatgggttcctcttttctagaggttcttcgctctattagggaaatgagggctgcaggtgacaggcatcatgaaaatcatatattacttcgcatatctgaaaccatcggcttacttgggcaatatgaagctaatggacttaacatacatgacttatttggtatgactgagaagtctgttgacaaggaaaacacctcagtgctgatgctttttcattttgctagcctatttgccttatgtttaagaatgaggtttggttttctgtggaaagcttgcattgtcatgatcatgatggccatgaatcttgtgattgatgaagatagaagtctgagtgcatttcagtttcttattgcttcgaaagagcttgcaatctattcaattgaccaagaggatagtttgaagggttctgcctgtagaaaatcttctacatcaatagctttgcagtacctgcccgggcggccgc

SEQ ID NO: 23208 - DNA, 749 bp, Triticum aestivum
  unsure (1)..(749): unsure at all n locations
  Clone ID: PAT_TA_23208
ctctaaaatatgtctatatacatccgtatgtggtaggccatttgaatctccaaaaagacaaatatttaggaacggagggagtagtattcacttgcagagaacgattcacaacataacacatttgagtcatctattttggaacggaaggagtactctagaaggcaccggataagtaacacagacgggcactacatcagattaaacccaaagtagactgacagaaagcatcgcatattggcgaagatcttccatcgaacattggaactccatccagagagcagtcagccacccagcacngatgaaaccgtcttcggtcaccggatacgaagagtaaccttggtacccaaatcccttgacgccatcagacgtatactctccccagtacttctcgtgctcctcttccagcttagctatgaaagtgtcgaaatcctcggccgattcctcttgcccctgcttttgcttcgagatcttgcctacctcggagaagccggcatctgcctccgtcttcttgaaggccgctgcttctccgtcggaactgcagcccttgcgcggacggcgacggccggccgccggagccttccttttggtgctgcgcttgccctccccgcagacggccgcgtcctccgccttgctgcacagcttgggcggagaccctctgctggccatcgctcctcgtcggatctaatcaccggaggctggacggaatttgatgatttgcttattgggttggcttgattcaagcctcgtgc

SEQ ID NO: 23209 - DNA, 609 bp, Triticum aestivum
  Clone ID: PAT_TA_23209
cccacgcgtccgcccacgcgtccgggagaggagaggccaacgtagcttagtgtcgaaacataccgcctagcggaggtggtggctggcggcggcagcaacggcgatggggatctggggctggccgtgggggcggcgtgggctctcgggcttcggatccgcgtccaccgctgaggacatcgccgccggcatcgacgccagccatctcacagccatcgtcacaggagcaacaaatggcattggcaaggagacggccagagttcttgcactgaggggagcaaacgtgatcataccagcaaggacgctcgagagtgggatgaaggtgaaagagagcctcgctgaagaggtcccgagctcaaagctacatgtcatggagatggatctgagctccctcgactctgttcgcagcttcgcgggctccttcaactcctcccataagcatctgaacgccctcataaactatgcaggcataatggcctgccctttccagctatcccaagatggcattgagctacaattcacaacgaatcatcttggccatttcttgctgacaaatcttctacttgacaagatgaaatcaactgccaaggagaccggtatgcagggcaggat

SEQ ID NO: 23210 - DNA, 598 bp, Triticum aestivum
  unsure (1)..(598): unsure at all n locations
  Clone ID: PAT_TA_23210
cacaatcctccctccgttcatagttgctcgcgagatccatctcccagaagcatctcgccaagatccacacaatcttcttgcgccggcgcagcagatcgattccgtccttgcctttttctctctgtagcggccgttgagatgagattaccccatacccttatagcggctagctcgactccgcacacgcgtagggggcgatctcacctcaacagctgctctcagtgagcttttacctttacggtgggtcgcttgttggtaacgccctcttctcctcctggtcagaaattcgttcgataagncantagncanaaatccccccttttaaaaattncaagggcttcnggcccttgttttggnctgtattcaaattttanacatttcatgagtgattgttgtcatcttcttggaaacttgganacangaatagagctgccatgttgcagatctggaggaggacttatccaggaataggagacaactcaaccggaatanaccgcttgtcacctancatagacatanttttaaganattcgtggncggtaaaccgcacacgaaataancaatanntggattgggtgcnaacanacaanatattttt

SEQ ID NO: 23211 - DNA, 909 bp, Triticum aestivum
  Clone ID: PAT_TA_23211
actcacctttcctgttcttccgagggtacttgtggggggccagtctctttttcctcgtagatagaccacgcccaccagctctaccctccggtcgtttcgctctcccctctagctcgcagccgccgcgcgtgactccagatctcccgcggcgcgaccatggcggcggaaggcaaggtcccgacgctggccgaggaatattcactcccacccaaggaggtccctgtggaaaaaccagctgaggagaaatctgctacgatcactgaggcctcaccagctgatgagcctgctgctgatgttgaggaaaaaagtgaaactcctgaggtgaaagagccagaagcggaagaaactgttcctgctgcagaggaaagcgatgcggctcctgaggaaactgaagagaaaccagaaattgtgattgagacggctccagcagattttcgtttccccacaacaaatcaaacaagacattgcttcacacgctatgttgaataccataggtgcgtagctgcaaaaggagatgatgctcctgagtgtgaaaagtttgcaaagtactaccgatcactatgcccaagtgaatgggttgaacgttggaacgagcaacgggggaatggtacgttccctggacccctgtaagcttcagtggcgctggaaggacaaacatgccatcatccccacctccctggtgactggacaaaggtaggctgtgccgaggattcgtcaccttcctttcctttttgaggactacttacaaataagtttttgacttgatgtaagctgaaggtgttgcccatcagtttctcccaacgatcattcactggattttatacaacatccacctttggaatttgaaaaaaaaaaaaaaaaaaaaaaaaaaaaaaaaaaaaagaaaaaaaaaaaaaaaaaaggccccta

SEQ ID NO: 23212 - DNA, 1217 bp, Triticum aestivum
  Clone ID: PAT_TA_23212
acaataataataataataatattaatgacgatggttcaaatacagtagtactactttgacagaaaatagatagaagatgcgacttaagctattaagttgtcactaggtttatggacaacgcatcaaacatggcagttattacagaaagaacaagatggactgcagcatctccacccagagaagacatcttccaaaccagcagaaaacagtttctccgcggtatagcagtaagctaagctcggtctgtgctcgtgattgagacacaaccaagttccggcttcttcaatagagcagcagccatgccatgatacaaacaccattgttgggtcatctcgagcagggaccaacatccaagatccatcaagagtcacatcagacaatgatggacaaccaaaaccagaatcagcagcaacttccaacatcaatgaccacaaaggtaacagacttggtacctcaaaagttgctatctatgagaatgggtctttcatggctgggttcaagcagtaggagcttgcaggcttattggaaacagaaggcatgtcatcaaaagtgctaggcattggttccaatggtggaagcggtccacttgctaagaaagttgattgagtggcaccatcaccgtagtgaaggccattagatgattgatccagtgggtactgcgaaaactgattgtttggcacagacaaataggagaaggttccaccaggcaaatcataggagaatgtttcaccagaaaaatcataggagaaagtttccccaggagcaaacagatcatccaaccctatataatcatcatccatgagcaagtccagagtttgcttgctgcaaattgttttcaataacatccccgttgctagcagggaaatttgcagcaggcatatctcctgactgggaaagtactgccaattggtcatagagctcagcagtatttatctcaaaagcttgagcctcaagctcagacattggagggagaccagaattctctggcaaaactacatcatcgttcggagaatcatccaaaaactttgccagttcgtccaacaatattccatcaatttcaggaggcgcgtcattgacctcatcagaacaccagctctaccctccggtcgtttcgctctcccctctagctcgcagccgccgcgcgtgactccagatctcccgcggcgcgaccatggcggcggaaggcaaggtcccgacgctggccgaggaatattcac

SEQ ID NO: 23213 - DNA, 641 bp, Triticum aestivum
  Clone ID: PAT_TA_23213
taggggccttttttttttttttttttggcacgattacaataattataataatgacgatggttcaaatacattactatttttaacagaaaatagatagaagatgcgacttaagctaggttgtcattaggtttatagacaactcggcatctaacatggtagctattacaatgaactacggtggactgcagcatctccacccagataagacatcttccaaaccagcagaaaacagtttctctgcgataaagcagtaagctaagctcggtcacttgtccagttttttgctcgtgatcagagacccaacaagttccggcttcttcaattgagcagcagccatgccatgatacaaacaccatcgttggaccatctacagcagggaccaacacccaagatccatcaagagccgcatcagacaatgatgggcaaccaaaccagaaacggcagcatcattcagcaccaatgaccacaaaggtaacagcatcattcagcagtctggaaacagaaggcatgtcatcaaaagtgcttggcattggctgcattggtggaagagatccacttgcttcgaaagttgattgagtagcaccaacaccgtagtgactgccattagttgattgatcaagtgggtactgcaaaaactgatt

SEQ ID NO: 23214 - DNA, 3953 bp, Triticum aestivum
  Clone ID: PAT_TA_23214
cgtccgcggacgcgtgggcggacgcgtggggtctctttttccttctggtttgatctcgaccaccagctccaccctccggtcttttctctccttccctctagctcgcagccgccgcgcgtgactccagatctcccgcggcgcgaccatggcggcggaaggcaaggtcccgacgctggccgaggaatattcactcccacccaaggaggtctctgtggaaaaatctgctacgagcactgtggccgaagttgttcctcagaaggatactgaaacctcaccagctgaatgagaccgctgctgctgttgaagaaaaaagtgaaactcctgaggtgaaagagccagaagcggaagaaaccgttcctactgcagaggaaagcgatcgaggctcctgaggaaactgaaagagaaaccagaaattgtgcttgaagactgctccatgcagattttccgtttccccaacaacaaatctaaaccaacacattggttcaccgcgctatgttgaactacaataggtgcagtagctcggaaaagggagatgatgcaccatgagtgtgaaaagtttgcaaagtagtatcgatcaactatggccaagtgaattggggatgaacgtagggtacgagcaacgggagaatggcacattcgctggtagccctgtcaaacttccgtgcagcccgaaaggacaaacctgccatcacttccaacaattgtcactttgtgacgaggaattagttcccttcactttccaattaggaggctttacttgcaaaattaaagtattggacactaatatgtaattgattcaatggtgcctgccaacattgttcatccgatatcaaccaaccatcagtgaattcgcatttataccacatccagattttggattttgcaattattttcgataacatccccggggctagcagggaaatttgcagtggacatatctcctgactgggaaagtcctgccaattggtaatagagctcagcagtatttatctcaaaagcttgagcctcaagctcagacattggagggagaccaggattctctggaaaatgtacatcatggttcggagaatcatacaaaaatttgtcagttcgtccaacaatataccatcaatttcaggaggcgcgtcattgaccaatcagaacagatattaaaatgtccggaaaattgaatataccgctgagcagcggaccgccgctcgagacttaagatattacgcgacgcaacactggcggccgaaggaaaggttacgccgctggacgaggaaaattcacacctacacaaggagatccctgtggaaaaaccagctgaggagaaatctgctacgctcactgaggcctcaccagctgatgagcctgctgctgatgttgaggaaaaaagtgaaactcctgaggtgaaagagccagaagcggaagaaactgttcctgctgcagaggaaagcgatgaggctcctgaggaaactgaagagaaaccagaaattgtgattgagacggctccagcagattttcgtttccccacaacaaatcaaacaagacattgcttcacgcgctatgttgaataccataggtgcgtagctgcaaaaggagatgatgctcctgagtgtgaaaagtttgcaaagtactaccgatcactatgcccaagtgaatgggttgaacgttggaacgagcaacgggagaatggcacattccctggacccctgtaagcttcagtggcgctggaaggacaaacataccatcatccccacctatcctccctggtgactggacaaagttactttgtgccgagaattcgtcaccttcctttcctttttgaggactacttacaaataagtttttgacttgatgtaagctgaaggtgctgcccatcagtttctcccaacgatcattcactggattttatacaacatccacctttggaatttgactgaacttgctgttttgcgtggcacggttcaagacggtcattttggttgcacaggaaatttcgaaaccgcgtggaataaaattagcaacctaattctagcagggccgatgtttctgaaacccatttcatttctcctgtcttctaagtatacattttatttggttatatagcttatagcacatataatctgcataaaggaggcaatgacctcttcttaattcacaaggcctatgaaacataaaagaaagtttccccaggagcaagcagatcatcaagccctatataatcatcatccatagcaagtccagagtttgcttgctgcaaattgttttcaataacatccccgttgctagcagggaaatttacagtagacatatctcctgactgggaaagtcctgccaattggtcatagagctcagcagtatttatctcaaaagcttgagcctcaagctcagacattggagggagaccagaattctctggcaaaactacatcatcgttcggagaatcatccaaaaactttgccagttcgtccaacaatattccatcaatttcaggaggcgcgtcattgacctcatcagaacagatattaacatgttcagaaaattgaacagactgctgaggagcggatggttcctgcataactatggcagtagccaaggcagaactttcaacctgtggatcctctacacctgacgacggtgcaaaagagaagatagaagatccaacatctaaattctcccattcattttcatcaaaaggagccccatattgctcgccgatccttgggccaagcccactctttttaaatatcttgcagagtacataagcatccttagagaaaccagcagacaccaaagtttccggacgcgtgggatcttccattttgtattcatacatcacccagtcagtcctattgcctttgggtgccttgccttcatgaaaaatcaatgttttcttcaacccaacaatgcgagagttcagctcaattgttctgtcttttccacttgttttccaataaccatttggtgtggcacggttcgtcctagaccctttaggatattttttgtcacggggacaaaagaagaaccactcaagatctttgctctggagacaggatttatcaggaaggtcccaaggagcaaatttgtacagctcaacctctgaaatagcttcaacaaaaagtttcttccccataatcttccttttcaagtagtaagaaacaagctcaacatcagttggatggaaacgaaagccaggtggcaggcaagcttgagccatcactgcagtgggtctcttgtgctcagtatcaagagaagaacacaagaggtgaaacacaaccagaaatggttcaccagattaggcaattaacaataccagtaatcagggaaatatcaagtctggccagaaagggatatgctttagccctgaaaggacagaattcagggccacagatcaaccaaacttaaggagagaggagctctcaaatgcttggagaacagacaagaaccagagaagagagcttcagaagattgcagtgtgagcagagtaggacagctcacgttaaacaactattctgaagggaggatcaaaagattgatgagattagaccagaagagagaatggtccaaccgaaagctggaggagaaacaactgatgggaaaccaggcttggcaagactcaaggaaagcagtccaccaaagactcaagcaacaaatgtttctgaactcagatgagaagtttgagtcttgccaattaaaccaactaccactgattcacatgataggaagtattcgcacaaaactccagatgatccacttgtatcaagtgaagtcccggaattttatgcaatctatgaaccagaagtagcacgagaggaaataaggggatccctcgctgacttcaaaagacatgagtgactaagatcaaaaacgagaaagaaccggggaagccagcaggacgatgggggaggccgagggggaggaggtgagcgcccccgcctgccccccccacgcgtccgcccacgcggccg

SEQ ID NO: 23215 - DNA, 695 bp, Triticum aestivum
  unsure (1)..(695): unsure at all n locations
  Clone ID: PAT_TA_23215
ttttttttttttatgaaattttcctttaaagtaaccttcaaatcaaaggtgcctttaatttatcaagcacatgtgacaacatacacaaatttcacaaatatacatacgaatttgatcggctcgaacatatcgaataccaccaataacacacagcacaatcccggcatcactggtgcgccgtccaaggatgcctagtatggcggcatcaccacgtgaattttacggaaaaaagtacaagccgccggcacaccgtccaacgaaacgctggaaaatcatgggtggaaaccgaggtttcaaccgtacaaacatcgcccgtcccatgcaggagctgccggacacccgaaaccaccaccgtagtagtacggcgccgtcgtcggcgggtaacagctcaccggagcaaagtctactgtggggtacaaactgctatccggctcccccaccgtggggtaaattccacggctcgatgtctcctgcaacggcgggtagaccgctcgcgccttgactgaacactgacgttcgggtcacggcggtaaacgcaagggctcacgggcgcccccatccccccactcagcaccccataccccgccccgcgggccgtcgacgcggccgctaccccgggtaccaattacnctganaaaacccttcaanngntaaacaaagcnacnttcctcaaattcacnaaggangacccctnn

SEQ ID NO: 23216 - DNA, 504 bp, Triticum aestivum
  unsure (1)..(504): unsure at all n locations
  Clone ID: PAT_TA_23216
agtctgcctgtactagctttgtcctaattttaacttagaatctttaggataacctgaagtatgcttgtcttgcttatactaacggcgtagcataaacgtaccagttattggaattcaattgcgttgatgaaagtagcattagtatcatggtaactgttcagtttaaaattgctctcattcaagttcttcccttttgtaccaagatatggaaccaaggtttgagcatatgtaatcttgataattggccttcggtttaaactctatggacccaaggggacattcactccattatctctgtccattttacactttttgcgtacgccatggagttgatctattgttgtcttaacttcaagctttatttgtaaaaagtatgttagtggcaaagtaattaaaagatgaaaccatgtgctattaagattttgagttttcctgcggattattcaaagagagaacaacatctatatgtttggatcggttgttngcaaaagatncatataaata

SEQ ID NO: 23217 - DNA, 884 bp, Triticum aestivum
  Clone ID: PAT_TA_23217
agcacccagacatggaaaaaaatcccctttctcttactgctctttggatcgaggtctggccgaggcagggatggcgcaaagcttctggccgcggatctagcgctgctcaccttcccatgatgcggcatctcatctctgctgaactggagaggcagatgtcaggtcagagagctgggtcgtcgcgtttgacgaccatctcctccacagttttcctcgtcgatctcgtattctccaatcacccgggatagaggtcagcatgcctggtatggtcgatgcgccacatctatgcatcgttcctacttcctccataatgcccaattcttcacaggtgagaaggaaacttggatggttgggtgtgacttatgtagaaaggagttgcatgccacttcataatttgggccgcctttgatattgcctgagcaccaagtctgaagatctcgcatcatagagagttcgcttcaattgtcctggtggtgggatcgtcgagtctcggcgtcgtacagttggttggcttcaattttcctagtcatggtgctgagtcgtgagttgctgggtgtcttagatttccaggcggatggtgggcgtgtgctgggtgctgggtgcggccagctgtgtattttgatgtatgagttctggctgtgcccttatggagtccttgtatgcttattatttttcttccaattaaagcctatatgtgacaataggttgatggatgcggccaattttgtatttttatggggactctgtccgtaagcactctttgtatgtgtttacgtgtccttggcttaccgagtgtccgagttatgtatgtgtcctttagagtcccgattaggaattgcacgtgacaatagttggacatgtaacgcctttatataatatattag

SEQ ID NO: 23218 - DNA, 793 bp, Triticum aestivum
  unsure (1)..(793): unsure at all n locations
  Clone ID: PAT_TA_23218
cagggctgacccaccccaccccctccctgctctgccattacttggcgtgtgctgctgccgctgctgaggtgaacaggagagagaagaagaatagaagagcaagcagtgagaactctgaggcagagagagagagagagagagagagcttctggaagaaggagatggaggtgcaggctcgccatggcttcctaccaacagggaggcagcagcacctccatggccatggccaggctcaccaacaacctcccgcaggagaagatgagtggtgggagtacttcccctgccccttctgctacattgaggtggaggtccccttcctctgtgaccacctgcagaaggagcactgctttgacatgaggaacgctgtgtgcccgatctgcgccgacaacctcggggccgacacggccgggcatttcagggagcagcactcacagcaactcgctctcaggaagtcttcttcttccagggcaggagcagcagctgctgacacccagccatatggaggaggaggctcatgctgcaccgtcctcggatgaatcatgggccggccggtagctcatggacgttcccccgaagaaggacctcgaggagcggttgcggagggtcgagtttgtgaagcagatgctgatgacaacgatagcttgggactgattatccagggctggttatagcacttgactagctaggattgctcaggatcttggaagtgccatttttgttgagattgaccctttggtacatgtatacctgcaaccttggatacctgaatnaccaatctnatccttttaagcta

SEQ ID NO: 23219 - DNA, 694 bp, Triticum aestivum
  unsure (1)..(694): unsure at all n locations
  Clone ID: PAT_TA_23219
ctcgtgccgaattcggcacgagtntgtagttcacttcatctttctactaccctgcaagccttgttaatctttgttgtgcttgcagtactcttaggtgatgttcatgggcgacaccactgcgatactttctcctgtggacatctccataatatatcacatccattccgccagcaaggggatccacataggtgcggtgttcaatcatatgagctggtttgtactngatagcaagggctataattcagatcaacacagcgacatactttgtcactgagatcaactataccgattcatccttctgggtcgtcgatgccaacttggacatgaacaacagctgtcctcttcctcactgggatcagcttccttacttcatcgggatccaaaggtctggcaaagcccctggcggggggttgctcccttcgactccctctgccggttcctccgtggagcgctcgcgggcagtgccactaccgccgccttctgctcgttcccgcgcgccggcccctgcctgcgcgcancaccctgttgttgttggggactgcgcgcgtccctgccttctgcgcctcctgcgcctcgggcatgctcttgtggggtcgcccctggtagtctccctcaccatcatgcctttggttaacacggagctgcctctcgttctcnctcgctggtctcatttgcntatggcaatnanttgcct

SEQ ID NO: 23220 - DNA, 342 bp, Triticum aestivum
  unsure (1)..(342): unsure at all n locations
  Clone ID: PAT_TA_23220
ctcgcctatactggggtgcttttgcaccaaacacggtaattcggtaggtttcttgtggagctgttcatgtggtggccctatcggatgatggcctgctgcaagcatggggtaatgtttcatgttaaaagtcttgtccatcttctgtccgcatgttttacttgtaaattcttaaggaaagacgtactgggtctacatactaaactgaaactttggatgttggtgcnatctttgtcaatcgctagtgacnaaggttcncanantcaatcagaactgcatggtaanatttcaaancctangatcaaaaactgttaganncntaaaattgncgaaaancntcantca

SEQ ID NO: 23221 - DNA, 741 bp, Triticum aestivum
  unsure (1)..(741): unsure at all n locations
  Clone ID: PAT_TA_23221
cgagagagcacgcaccaccggcggcacccacgctcgggcacgggggcgcacgacacgacgagaaaaggacgccacccggccacctcctcggctcctccccctcgtggtctcctcctccgcccacacccaaaaagctctagggaaacctcctggtgccggatcggatcggggatgtgggagtcggtggcgctcacgctggccggcgccgccggcaacagcatcggcaaggtgctccagaagaagggcaccctcatcctcccgcccctctccttcaagctcaaggtcatacggggctacgcgctcaacaggctctggatcagcggcttcctcctcgacatgtgcggcgccgccctcatgctcaccgcgctctcgcaggcgccggtctctgtcgtgcagccgattgccggctgcggcctcgccatactctgcgtcttctcccatttttacctcaaggaggtcatgaatggccttgattggattgccatcacaatggccggtctcggcaccataggagtcggtgtcggaggggaggagcagaaagtggaagagatcccccttttcagtataccttggctggtgctcaccttcgtccccgtgtgtgggccgccccacactggccctctcacctaccaaaggccgacacgcgaacggactaagtatnnagagncaatacgntaaaacagnattgttggattacatgntccaaatgatctanttaatggttccaaatnttcactcatt

SEQ ID NO: 23222 - DNA, 571 bp, Triticum aestivum
  unsure (1)..(571): unsure at all n locations
  Clone ID: PAT_TA_23222
atttttcagcctaagcaacgtcacgatggcacagttgcttggttagcggcgtgcatgtcngctgctctcgcagatccatcctctgagccacgcacgtatcaagctgctaggcgcattcctcattggacagaggccatggagcacgagtatcaagcgcttcttcgcaatcagacatggactcttgttcctccacaatcacgggtaaatgtcattgattccaaatgggttttcaaagtgaagaggcattctgatgggtccattgagcgctataaggctcgtctggttgctcgtggttttcgccaagcgttttggacttgactatgaagacaccttcagtctantggtcaagcctactaccatcagacttcttctctctctggctgttactcgaggtggttctctcacctgatgtcaaaatgctttctcatggggtctggcggaggaggttaatcccancctccgggttcccgatcggatcgcccatatcncgtctcgtcaaggattatggctaaacagccccntgctggatgtctctgaaggtctccgtaaggttgacacanncggccnatgt

SEQ ID NO: 23223 - DNA, 1695 bp, Triticum aestivum
  Clone ID: PAT_TA_23223
accgactagtcaaaatgttgattctgttcctccgctacctgaagacaaacctccaactcctcccccgttgccatcatctccaccacctctaccacgccctcagtgtcctgtcattcaaggttcacaggttcaaggagcattgcatgtggcacctgatcgagtcgagccagatactttaagaaatgttcaagatcagcaccctcattctattgcaaataatcgaggcaacatggatccttgtgcggttccattccagcctccaccgccctatacttctggctgtgcagggcatccaaaccagatgcatccgccgccaccgctgcctccaccgccgcctccaccacctgccgcacctttccatcctcctggaccccatggaaatttttctgggcccccagtaccgccccacggaaataactatcaccgtccaccagcaccaccacctccgaataatgcataccatttgcagccaccaccaccgcatccaccaccaccgcatccaccaggtccgaatcagttcccatatatgccacctgaacaccaacaaagagcacaaccttggaattgtaatcctccctatcctgagggatatcagtacaatggacatgacagagggcaccctccatacgataggagacatcactttgatgatagatggcatcacttcgacgatagagggcgacgctttgatgacggagggcatcatttcaatgccggagggcatcattttgacgatggagcatatcactatgattatagagggcatcacttcaatgacagaggacaaatgcaccatgaacctatggatagaggaaggtttcctccacattttggaccagatcccccgtaccctgaccattttgaagcttcatcctcccaccgtgggcgaccatcggacggtccacctggtccatgtaccgactggtcgatgccgcctaggagatccaagtatcctcctggctccagacattcaatggagcctccaatgtcccatgaaggaggttggaggaggcacggaagacacaataatgatagattccatagatgaaggggcgcagaagctttgtgtctcaaccatgctgagcctcatctgcgattaacagtacaatggtttccagaagagggataattcctgacaattttaatggttatagattttagttttctttctttttgcctttggtgggccgtgaaggggatcttcattgtctccattcgcggacgggcttagcatgaaatctctttgcaaaagaagagatggaacaggccctggttgtacaaatgtatgtcaccattcttctgcaaatgcagaaacggaagggacttcaatggtgcgtagagctgttctgtaacaatctagttagccttacagtctaccgtgttgttgagaaattcttcactattgatttccattcaaatatcccttttgtaatccaactgtcatttcaactaccttactgaaactgcctgacattgtatattgccacaatctagaatgttcttttccgggtgaaaaaaaaaaaaaaaagagactagttctctctctctctctctctctctctctctctctctctctctctctaaccctctctctccctctctctctctctctctctctctctctctctctctctctctctctctctctctctctctctctctctctctctctctctctctctctctctctctctc

SEQ ID NO: 23224 - DNA, 1061 bp, Triticum aestivum
  Clone ID: PAT_TA_23224
gaacgacgctgtttcagctcggctctacgaggaggagatggccgcggtagacgacatcatcggctccagtgcggggaggtggtccctccacggcaggacggcgctcgtcaccggcggaacccgcggcatcgggcgctcggtggtggaggagctggcggcgctcggggccgccgtgcacacgtgctcccggaaggaagccgagctcggcgagcgcttgaaggagtgggaggccaggggattccgcgtcacgggctccgtctgcgacgtctccgtgcgcgaccagcgcgagctcctgctccaagacgtcgccggccgcttcgccggcaagctggacatcctcataaacaacgtgggcacaaaccatagaaaaccaaccactgaatactcggcagatgaatattcgttcataatggccaccaatcttgaatctgcatatcatctatgccaacttgcacaccctcttctcaaagcatccggggtggccagcattgtcttcatatcatcagtctctggagtggtagccatatctagtggctccatttatggcatgacaaaaggtgcgatgaatcagttggccaagaacctagcgtgtgagtgggcgaaagacaacataagaatcaactctgttgctccatggtacatcaagacttcactcgtggaagaggatttggcgaaagaagatttcgtggatagcatcgcccgtcgaactccgatgaggcgtgtgggagaacctgaagaagtatcatcgctggtggcgtttctctgtatgcccggttcatcttatatcactggccagacgatctcggttgatggcggcatgactataaatggcatgtacccgactgagaactagcagaaggggtgaagctgcacggtggttcagagcaaatcgtgatacagagcaaatcgtgatacgtggatcatccgtgtccgcgtgtataacctgtatgggaaggttatcttgacgtacaatctgtatgtgtatgtttttccactttagctaaatgcaagtcgtctggaggtgtgataaaaaatgatcccttgttaaaaaaaaaaaaaaa

SEQ ID NO: 23225 - DNA, 708 bp, Triticum aestivum
  Clone ID: PAT_TA_23225
gaacaacacctccgatagtccgatctcacacccacccccggcctcgcgatcatcccctcccccccttggacaggcctcccgaatccggacccccccaacgcgcgcagcgggacgaggaccgacgggcggggcacagagaggccgggggtgatgagttgttacgctgcatggacggagcaatcgaggagcctctccacaaggactattacaaagttctggaggtcgattacgatgcatctgacgacaacatcaaactgaattatagaagattagcgttgaagtggcaccccgacaagcataagggcgaggatgatgtcacagctaaatttcaggagatcaacgaggcttacaaaattttaagtgatccaattacacggcttgagtacgacttttctggctgttacgaggtcaatcaatatactgcacgtgagtacctttcaagatttaagggaatgatacttacctgcaatggccttggcatagagcattcttcaaaatgggcgcgacacttgagggaatgggagccccattgatcaataggtacagcatgtttattcccgaacttgttcagtagcgtctctgatggcgattgggcatgtattttgttcttctgtaactccgcaatggaacctgtcatgtgcccttgcacttgtgctagaaagagatacatgtttgcttttcctgacaaaaaaaaaaaaaaaaaaaaaa

SEQ ID NO: 23226 - DNA, 737 bp, Triticum aestivum
  unsure (1)..(737): unsure at all n locations
  Clone ID: PAT_TA_23226
gtctcgagttttttttttttttttttttttttttttttttttaagaacgagtaaatattttgctaaatgtgcaattcaaatgaaaacatttttttttgtttttttttcgtttttttgtcgttgtaggggataaaaactgcaattcactattttgaagaatgggtaacatttaaatgctgccaattctgtaaacactgcacgaatgcacagtctaacattgcctgcatatctacgaggtccatatacagtatactactggaatctgcatattctatatcatgaagtctaccaacacatccactctgtcgcatcagctcgaccagcgcccatgtcacgtgctgccggcggcgctgatcttcacgtccgggttccgcaccgtcttgagccacatccccgcgagcaccctcgacgacaggctccangacgacgtctggccgccgctgctgctgcctcgccctcgctgcccgcgacgatggcggcgtctgcaccctcttggcggcgcggcccggcccgtgggcgagcgtccactgcatcgccgtcagcttctgccgctcggcgcgccagctcgcgcttccgccgactcccgacaaacacctcgtctgcacgccgcccacgtnaagntcctcactttgaacctcccccgctaagcccgcagcgccaacatccgcgccgactggacgacgngatatcggngcgccacgctcgtacgccggacggntacgcaactggatggcgcn

SEQ ID NO: 23227 - DNA, 741 bp, Triticum aestivum
  Clone ID: PAT_TA_23227
ggagctcgatcgagagagagatccaaagtcaaccatcgagagagagatcaggcatggagaagtacgagccggtccgggagatcgggtcgggcaacttcggggtggccaagctgatgcgcaaccgggacacgcgcgagctcgtcgccatgaagttcatcgagcgaggatacaggatcgacgagaacgtgttccgggagatcgtgaaccaccggtcgctgcggcaccccaacatcatccgtttcaaggaggtggtgctcacgcccacgcacctgggcatcgtcatggagtacgccgccggcggcgagctcttcgagcgcatctgcgacgccggccgcttccacgaggacgaggcgcgctacttcttccagcagctcgtctgcggcgtcagcttctgccacgccatgcagatctgccaccgcgacctcaagctcgagaacaccctcctcgacggcagccccgcgccgcgcctcaagatctgcgacttcggatactcaaagtcgtcggtcctgcactcgcggcccaatgtcgacggtgggcacgccggcgtacatcgcggcccggaggctgctgtccccccccccgtacgccggcgggcacgcggccgtgcggccgtcggggctgatccgcggtggcctccccggcggccactgcccggtcggggcgccgtggaccccttcgacggccccccgaccggcccccgggtcacgtcggtgcagtacaagatccccgagtacgtgcacg

SEQ ID NO: 23228 - DNA, 628 bp, Triticum aestivum
  unsure (1)..(628): unsure at all n locations
  Clone ID: PAT_TA_23228
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgttggcccatccgagggcatcaagaattccgagacctgtcctacttgccaccgctcaacacggaggcctcctcaagcaagtcgactaccttgattccgctccaagtgggtgccttgctccnagttcaacaaggttgggttcatcttcccttgagcacaaccaatcccctggggtactacgatggccggtactggacaatttggaactcctatttccgggtgcaccgacgcacacaggtatnaacgaggtggaggagtcaaagaaggatacctgcccctattcccnatcaccnttccgacaaatcccaantgnatgctcagtcatgccttaaaccacgggctcaagatccggaaggctaaaaatactcacacagcatttaatgcaatcatttttaancnaaattcttggnttcctccattactcaatttncaaaaattttccattaattnaatg

SEQ ID NO: 23229 - DNA, 1113 bp, Triticum aestivum
  Clone ID: PAT_TA_23229
gtttgccgccgctagcggttgctgggtttccttcggtggcgttttctgtgtgtactgtgtggagatctcgtcacgggacggtttgtggctcccttcttccggcgggtcttcgcatcgttgcccctgcaggtcttctggacgatgccgggtcggtttctccgcgctccttggggagagctgctccgcgattcatcctctcgcccgacatgaagctgcttttcgttggcctcttggcccggatccctgctcgaggccgttccggccacgcatcctttggtagagcaattcagcgatacatccagaagcccgataagaagcaactattgttatgcctcttggactggatgactggtcaaggctattccgtggactcatcatcaaggaacttgcttttgaaaaatgcacaactctttggccaaaaacaactgatagcagaaatcctttcaaagcagcaagcagcttcaaggataacaaataagctcattgattaacacaaaatttaatcaaatcgaagttgttcagattcatcatataatgttctggagatagttttttgatgatcgacgataccaaattcacaagggtctgtcaggttacaagttatcatcctcatgtttccaggctacaagcaaaacttgttgagtttcagattatgccaggctattcaattcagcgaggtcacccactagaactgcaactgggattgaggatgacaaccgggcttgcagtgatgttaatattggatcttgggatggctaagagaaacgcaagtaagttaatagttacattttttgacagcttcatctgtgcaagttgctcaattttggtggttgtgcgattggcattatgttcttgctggaaacaagtgcctagttctggaaagctgaactgaagatttttaatcttttgcggtgttgctgcacatgcttttctgtaaaagcatagtgaaacatggaaagggcagagtttttcgaggcagtaaatgtaagacgtgttacgtaggacagttctgaagaagacttgtggagttcgcaacttcttttgttgcatctgacttgagaaatcatggcaactaattactggaaaaaaaaaaaaaaaaaaaaaaaaaaaaaa

SEQ ID NO: 23230 - DNA, 646 bp, Triticum aestivum
  unsure (1)..(646): unsure at all n locations
  Clone ID: PAT_TA_23230
cgccctcgtccggtctctctcttcagcctcccctcccccgtcgccccgccgcgtcccgggccatggggagggcgccgtgctgcgacagggcggcggtgaagcggggcccgtggtcgccggaggaggacgacgcgctgcgcgactacatgcagcgccacggcaacaccggcagctggatcaccctccccaagcaaagccgggctcaagaggtgcggcaagagctgccggctgcggtggctcaaactacctccgccccgacatccgccacggcggcttcaccgacggaaggaggacaccatcatctactccctctaacagccagctcggcagcaaatggtcgctggatcgcgtcgcagctgggagccggaggacggacaacgacgtcnaagaacaactgggaacacaagctcaaagaagcgcctcgccgcgcgccgccgccgccttctcaaccccccccccgccgccccccgccgccggcgccgcccggcgccgccccaccctcgccgcctgccgccccgtcccgtcccttgcgccggggtgcccgacaactcccctgtcccgacccccgccggtgacctcctccccgcggggcccctcgccccccggccagaccttccccaaggctctctcgctcgcgntcataaac

SEQ ID NO: 23231 - DNA, 383 bp, Triticum aestivum
  unsure (1)..(383): unsure at all n locations
  Clone ID: PAT_TA_23231
ggctgacaaagcgattaaccaaccccgagacggtcaggcagtttccgcttcgtcgtcttctccgggtcctccacctcgtcgcctccctctctccacccctcgaactcctcgccccgccggctcccaaatcccgcctccccgccttaatcccctcccaccgccgacgcggaggagaccggccaccagccgtctcgccgccggattcggccgctgatcgagggctgcttgccttgctttgggtgctcggattggatggcgggccggtcgcggggcccctggtcggcgtagcgggctggccggcgccatgtttgcgccgaggaaggtggaggacgagatggcgctgggcaggcagaggacggtcaggtatccagcatttaggactn

SEQ ID NO: 23232 - DNA, 464 bp, Triticum aestivum
  unsure (1)..(464): unsure at all n locations
  Clone ID: PAT_TA_23232
tttttttttttttaaataagaacaaagttcttgattggaatcagtaaaataaagtttacaataagagtaaggattcatcgctttggaacattaaaaatatacaacaatcggtgcacttcacagagtgacttggaaatggtaattggacaataactggtacttacactcgcaaaaggaaaaatgtggtacttaaaccttatttgtaatatcgcggaagaaaaaacctactaataaaatagatcacaggacacttngagttgttgcgtggatccggaagcaaagtggtaggtggtccgtcgctgtattgccgttttgcacgtgttttgattaatccccatttattgaggatattcnaggaacatcactttgggccggatgcatattaaaatggncatctgcagcttgttgcatccaactcctgattgctcccgtccacaagagganggacgcaanttccggaattt

SEQ ID NO: 23233 - DNA, 621 bp, Triticum aestivum
  unsure (1)..(621): unsure at all n locations
  Clone ID: PAT_TA_23233
cattccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccagtgccgatgagatttgctgtttgctgctcaagcaaagcaaggatacagtggagaaggttgtggaattgttaagaagcagttgctgttcctgaaggcactgaatttgcggtaccaccaantttctgaccttgggagctgatcactgggacacggtccgagattggtgatgggcttngaggaggagtccagattaagcgtggaggagacgagcgcgcaagcaatttcgacattggaagatgctgccacgctcaatggacaactgtctctgcgaatcatcttgaagggaggcctaatcctaatgatgggactcgtaacaatatctacctgggctgatcntgtggccacatagcgtatatatggggttgtgattcccgggcctgtcccccgcgggtgtataggtattgtaataagtactgtnacatcaatgctantttcncgaaaaaaaaa

SEQ ID NO: 23234 - DNA, 852 bp, Triticum aestivum
  Clone ID: PAT_TA_23234
cacgcatgcgattcccgttattacaataggcctctttcctcgtcctctcgatccaccgccgcatcagtgcttcctcaaataacagctgatcgatcgagccaccattcgccaagcagtattcccatcagttcgcagtgaggctccgtgatacgattccccatccgtgctctccgccggccggccgggaagggaagggagcggaattcctccgacgatggcgttcggcgaagggggaggcgacgccacggcccctctcatctcctccgacgggccgaagcgccatctcaacatcgtcaggaacgggaacgaatggacggcgtcggcgcacgtgatcacggcggtgatcgggtccggggtgctgtcgctggcgtggagcatggcgcagctggggtgggtggccgggccgggcatgatggtggtgttcgcctccgtgacggcgctgcagtccaccatcttcgccgactgctaccggtcgccggacccggagcacggcccgcaccgcaaccgcacctacgcgcacgccgtcgagcgcaacttaggtagcaacagcgcgtgggtctgccagtttttgcagcaaacagccttgttcggctacggcattgcctacaccatcaccgcttccatcagcttcagattttgacccgcagcggaatcagattttggaaagcacgtcccgggctgcttccgcttttggttcagattttggcagcgaatttctggaatcggattctgctgggttcgtcctttgattcagattttgctgtgcgtcagcggaatccatcgataaaagctgaaccaaacagggccttagcctcgcgctttgtgaaaaaagtgaccgtcacgcctagcatt

SEQ ID NO: 23235 - DNA, 1298 bp, Triticum aestivum
  Clone ID: PAT_TA_23235
ggccgccacgcggcaagggcggccagccagccagatacaacatacagcaccgagaaagattctttccccctcctcctcctcctcctcctgccatccgccgccggccacccaacaatggcggccacccccctcgactccgcctgggagtggctgatcaccaacttcagcgagttccagctggccaccgtcgtcaccttcgtcctccacgagagcgtcttcttcctctccggcttcccctccctcctcttcgagcgcttcggactcttcgccaagtacaagatccagaagaagagcaacacttctgattaccagaacagatgcgtcatgcgtctcattctctaccatgtctgtgtgaatttgccagtcatgattttctcctatcctgcctttaagttcatggggctgaggagctctcttcctctgccacactggacggtcattgtatctcaagttcttttttattttatactcgaagatttcatattctattgggggcacagggctctgcataccaaatggctatacaagcatgtccacagtgtgcaccatgaatatgctacaccattcggcttaacttcggaatatgcacaccctgctgaaattttgttcctgggatttgccacggttgttggtcctgccctgaccggccctcacttgttcaccctttggctgtggatggttttgagggtgttagagacggttgaagctcacagtggatatcacttcccttggagcccatcaaacttcctgccactgtatggaggctctgacttccatgactaccatcatcgtgtgctctacaccaagtcagggaactacgcctctacttttgtttacatggactggttgtttggcacagataagggttatcgcaagacaaaagccatcgaaggggaagaagggaagcatttgtaaattgtggaggctactctctcttttctctgagtcaactcatcagaactagtttttgatctcttgtattggtgataacattgtgttcatgggaggagatacatgcggcattgatcctaggcatgggccgtcgatcctacatgtcgttgagtctctgttctcccatatttgctagcatgatgagatcatgtgttgtgtaggccaacttatataatttgtggtgaattaaatttgttgtgctctgttggggtttgttcccatggcagaagtaactatttgaagcagcaataacttgtctgaaagcaccaaaaacttgccgatttagtgatttcgcaagccgaggaaggacccccggtgccattcgcctgtgcggttcaaaaaaaaaa

SEQ ID NO: 23236 - DNA, 703 bp, Triticum aestivum
  unsure (1)..(703): unsure at all n locations
  Clone ID: PAT_TA_23236
cttgatattatctctatttcttgatccgcaatcaggttactgtcgcttatactatcagcttcatccgcgccctggtcattagtctcctagcttggcactaattccatatcttcaaatacttgccataatttgccactcgtcccggattcggcacctgcaacaatctgatttcaaacaaatttaataaatatatattcatcatgcagattctttctttcccactcctacttatcggtctcctctcagtaggatttgtatcaactgcaccagcggtcaaactaccttggtctttgaagctccgcgacgatggtgggtggttattacgagcaagcccgacatgccatcaccaacaagggggatatgcatacccgtcagatggatatccttccccaactgggggatatggttctccccgagggcggatatccctccccaaccggcggatatggttctccagacgatggatacccagcgcccacgggaggttacgggtcccctgacgatggttcccccgcccccgcgggtgggtacccgtctcccccctatccagcccggccccagcttccggccccccccgcgacccagcccccaccaaccccggggaataccaagtcaactggggggatacatgttcggagcancggnaaaaaaaaggttcaattgaaaatttaagtttgntttttcaaaagcccgcctctacaaa

SEQ ID NO: 23237 - DNA, 620 bp, Triticum aestivum
  unsure (1)..(620): unsure at all n locations
  Clone ID: PAT_TA_23237
ggccaaacagaaacagctactaggcgaaggacacatcggcaattatccatcgatcggggccttgtcctgtccgcgggtggcgccgggcgccggtgacaaccgacagggcagcaagcgtggatcatccgagcggaagcggaagccctcctcctcctcctcctcctccggctccggggcaccgtcgtgacagcagaggtccgctgccatcacctcgtccgccgccgccggcgctacaacgaggtgaccaccatgggcatggagagccggaggtcgtcggggaggaggctgctggcgttgccgttgccgttgcgacgacgagctaccagcaccagcagtacgagctcgccgtcatggtggcggcgctcacccacgtcatcagctccactcaaaccggcggcctcgccggtgcaancgcgtcngggaacaaggtgcttanacgttctcgatttttcaatgctgcaactttcaanaaagcttttttttgggggttccttttaactnccttggaatcnttggcgtnctgattntaaaaataattctacccnattcggngtgttgaattcccttaaaaaanaactntaaaatttnattaagggnnnaacaagggnaagcaaaaaaaa

SEQ ID NO: 23238 - DNA, 362 bp, Triticum aestivum
  Clone ID: PAT_TA_23238
catcccaatcaagtctttcatcttcgacagccgagcttacagcattacgaaggatgtcttgcagctgtggatcaagctgcggctgcggctcaaactgcaactgcggcaagatgtaccctgacttggaggagaagagcggcgccaccgtgcaggccaccgccgtcgttcttggcgtcgggcctgcgacggtgcagttcgaggaggccgccgagtccggtgaggccgcccatggctgcagctgcggcgccagctgcaagtgcgacccttgcaactgctaaggtgcaagcggtcgatgcgcttgtggtgattgtgccgtgtgtgatcgagtgcgaataatgaaaccggccctggccgtctggttg

SEQ ID NO: 23239 - DNA, 750 bp, Triticum aestivum
  Clone ID: PAT_TA_23239
ctcaaatcccccaatcacttattcctcttccatcaacaaaaaatataacagcaaaactgaggctgtcgagctgttgcatcttctggcggcgctgcttacagcactacctccggaacaagttgcacctcttcgacggaggagcggacagcgtcacgaaggacgtccttgccgcggtgcactccaactcggtcggcgacgacggccgagcttgcagcaccgcgacggcctgtcttggagctgggggccaacgctgcggctgtgccgcaaaatggccgtcggtctcgggtgtacgcggccttcgacggaagagttcggcggccaccgggtgaaggcccccggtcagtccgtcccatggcgccgtctgggccgcgcgaatgggcagtgcggcccgtgggaccggcgaggctggaatcaggcggacccgcgctgggtgcttgggcggcgtgtcttcgagtgggaccctttgcaactgccaatggtgcaatgggttggtatgcgcttgtgggtgatttgtgccgtgtgttattcgagtgtcgaattaggaaactggcgcccgacgtgcttaggtttgggtgcctgtggtatgggttgcaatcggaagtcaagggtaatttgcaaaattttgtgtttgtgtgcgcggagtctatatgtgtgtctttgaaatggtccatctgaactgaagtgaatatatacaaaacaggttcgcgcaaaaaaaaaaaaataaaaaaacttaaaaaaaaaaaaaactcg

SEQ ID NO: 23240 - DNA, 1102 bp, Triticum aestivum
  Clone ID: PAT_TA_23240
cggccgctcgaggcggcaggccggggtgacactatagaaggccggccgagcctggagaacctctttcgtcccctcgtcgcctcctcgtcctctccctgcaacgacttttctcccctcttgttccaaacccaaatcgagccaaaccccgactttccaaatcgcgcagctcggcgatccgggaggatctgcgagaagcggaggcgccggcgccgccggaggcaggcggcggtggcggcgaggccgtcagcggcggctggggtgtctgcgatgataacccggtcgaagctggtggagcagctgcgcgactaccagatccgatcccagcacaagcgcgaccttatcggagccatctcatggggcttgctgtgttgcctcctaatagtatcctcgtacatgatgctatacttcaggcacttctggttatcagccgtcatcatctccgtcggcatccttcttcccgccggcctgtatattttgaggcagagaaagctggctaagaaaagagagcggagattattgttgcctctctccatgtaaggttatcattacattgtagtggtaggttccccccgattttgcggttgttcttgactagacagaatccgcattccgggcttgcttggcacacatccaaacagtttgataggcctctgctgcctagtatacgtccaccatattctttagtcttcactaaagtgctggaagaagtacaccatcaatttttgatgctccagtgttgggcgaatggatacaccagcttgtgtgtttctgctgcggtttgttttcctcttcttccttttttcttttaatggtgcttgcagcctgacaaggtatctcgatgtatccgaccgccccgagtcacacttttgtaactaaagaagaatagattgttttgttgttctgatggaatttgtgagcttcatgtcctctccggccaccctcagtcagtcagtccagtttggtttggttcctggatcgaagtgatgacactggatgtggtgctttcgcagaattgtatctgcacaaatcatatatcgagcactgtagtgctcctgaaatcccttttgtccctgtaatattttacatcatatgcgcttaataa

SEQ ID NO: 23241 - DNA, 2293 bp, Triticum aestivum
  unsure (1)..(2293): unsure at all n locations
  Clone ID: PAT_TA_23241
acgagggcgatttatcngccgaggagcggctacgccgcgagcgttcccgggagcgtggccttggggtcactcggtacgagtggcgtgcccgtcgctctggcggcccctcttctcgtgcgggcattgtcgtgcctctcccctcaggggtttactttcaggacctgtctggctctgaaccagtactcaagctacaaagttcttccacatcaccaattattgacccacatctatctccagatgggaccatgattgcatatgtcagggatgatgaactgcagtgcaagacatataactttggttttgatgatggcgaaactaggcaattgacctacggtgcaagagaaagtggaaaggtccatggacttgctgagtatattgctcaggaagagatggaaaggaagatgggattctggtggtctcctgatagtaaacaccttgcatttactgaagtagattcatctgccattccactatacagaattatgcatcagggcaaaagttctgttggtctagatgctcaagaagatcatgcttatccatttgctggagcagctaatgttaaagtgcgccttggagttgtttcttccggtggaggagaggtaacttggatggatctcctttgtggagaaccaaatggagcacatggtgatgaagaatatctagctagggttaactggatgcatcataatgctcttgctgttcaagttctcaatagagctcacacaaaacttaagctacttaagtttgatattgccaccggtaaaagggaagtcttacttgaagaagagcatgatatatggataacattacatgattgtttcactcctctagacaatggagtgagtagtaaacatccaggtgggtttatttgggccagtgagaagacaggatttagacacttgtatcttcatgacaagaatggtgagtgcttaggcccaatcacgcaaggtgactggttggtcgaccaaattgctggtgtgaatgagagttctggacttatatattttactggaacactggatggaccattggagacaaatctgtactgcaccaacctctttcctgattggagccttccattacaagcccctaagaggttgactcgtggaactggacggcattcagtaattcttgaccatcagttgctaaggtttattgatgtgtatgactcagtaaaatcaccacctgtgatcctgttgtgttctttgcttgatggaagtgtaataatgcctctgtatgagcagccactaacagttcagccacttaaaaagtttcagcagctgtctccagagatggtccagtttacaggaaaggatgggacttcattttatggaactctctatcttcccgatgagaagaaatatggaccgcctccctacaaaacacttgttaatgtttatggtggtcccagtgtccagctcgttagtgattcatggattagcactgttgacatgagggctcagtatctgcgaagtaagggaatattagtctggaagatggacaaccggggatctgcacggcgaggtttgcattttgagggacagcttaagtacaacattggtcatgtcgatgctgaggatcaactagctggtactgagtggttaataaagcaaggccttgcgaagcctggacatattggtctgtatggctggagttatggtggttttctctcggcaatgtgcctatcaaggttttccgacacattctgctgcgccgtgtctggtgccccagtgactgcatgggacgggtacgataccttttacacagagaagtacctgggtctgccctcagagcatagtgatgcttacgagtacgggtcaatcatgcaccatgtgaagaatctcagggggaagctgctcctcatccacgggatgattgacgagaacgtgcattttaggcacacggctaggctcatcaacagtttgatggcggaacgcaagtcgtacgagatcctcctcttccctgacgagaggcacatgccacgccagctagacgaccggatctatatggaggagaggatctgggattttgtggagagaagcctatgagagtgggagaaaattcatctgtagaaatctgccgttgccctgtgtaactttaacgtggatagttggtatgatatcgtggacttcatttcatttcccgtcatctgtatttatccgcaagtgcagggacatgcatgattcttgtctgcgataacgaccgtaatggtcagctgctctggttgcagagtgaataatccaatttttttcatgtgatgtaggaacttcaaaacaaggtnagaatgttataa

SEQ ID NO: 23242 - DNA, 1173 bp, Triticum aestivum
  unsure (1)..(1173): unsure at all n locations
  Clone ID: PAT_TA_23242
gcggcccctggtttcctcttcctcccaccccgatcccctcctcttcccccaacgctgctctcctgcactgctctactcaagctccaatcctctcctacagtccaccaccaccgtgctctatatctcccgtcgtgccgtagcttcgcttcaccgccgcgcgtcacccacccaacccctccgcctctcacgctcatctcgactccatcgccgttccccttctgctcccgtcgcgtccctgccgtctccaccccgtccgtgatctcgggcatcgtttctttcgtgggattggctgacgggaggagggagatgagccgtgggaggtctccggagccgcttgatttcttcatatggactgtcgaggacgtcggcttgtggcttgaagagataaatcttggtggctacagacaagtttttgaagaaaatagtgtcaatggagagtatctggagagcttgtcgatgtttactaccgagcagattctgcggtttatcaggcggtgccatatgaaatggggagactttatcacattgtgcaaagagttgaggcgcattaaagttgcctgcctgaaaggggagcaagaagtccggaggccatggtgggcaccatcatgcctatcagtggtgtttgtgagggcggcaaagcggaaccgacagtcccgagttgtctctcttaagctggaaccttgatgctcgctggccgcgccggaacaccgcgccgagctatcccccagattctctgccttacgggcactgcaaccgcgctatccccacaatgtaggagcagcagtatgctccgtgtccaacccgtttctctacccctgttttgtattcctttttcatcttataatataggtttgtggaatagtaagtaacctgatgttacctgaagtggataagtatatgtgcagatggttcctgtataagatctgcttcttgcatatcagcttgagttgttcttggctcaagaatggcctagagcagtagatcttcatggcactgaaatcgacgatgttcttattttgttaatgctggccagaacatcaatatgatatggttgtggcatgaaaaggggggccggtaccaatcgcctaaangngtctattaccggctanggcctcgttaaactcngctggaaacctgggtacaactanccctganaacccttccagggggtaa

SEQ ID NO: 23243 - DNA, 629 bp, Triticum aestivum
  unsure (1)..(629): unsure at all n locations
  Clone ID: PAT_TA_23243
aaacttgcagccgccggcgtcaccagccgaanaaaagaaacagccatgagccgcccgcacgcggtgcttatcccgtacccggcgcagggccacgtgacgccgctgctgaacctcgccaaggtgctgcactcgaggggcttctacgtcaccttcgtcaactcggagtacaaccaccggcgcctgctccggtcgcgcggcgaggactcgctggccggcctcgacgacttccggttcgagaccatcccggacggcctgccgccgatggagaacgaggacgtcacgcaggacgtccccgcgctctgcacgtccttcgccacgcacggcgccgcgctcttcagggagctcctggcgaggatcgacggcgacgggaggccgccggtgagctgcgtggtaacggacggggtgatgagcttcgcgctggaggtggccggcgagaggggcgtcccggcgttggtgttctggaccaccagcgcgtgtgggttcatggggtacctccacttcttcgagctcgtcgagagaggcttcgtgccactcaaagatgtactaccaccccctaaccgctacctgcatgcaactggcattacgtgattgactgcaaattagtactataactgtgctgcatgtgtcgt

SEQ ID NO: 23244 - DNA, 537 bp, Triticum aestivum
  unsure (1)..(537): unsure at all n locations
  Clone ID: PAT_TA_23244
ggaaagggagagaaaaacctcagccctctacatacagtcattatattacctcaacgatttcaacactcaatgtaagcaaacaagggccacaaagggcaaaaaagcacaagggctagcaaaaccgagaacaaataagatacagaagagacccgtgtttctacaatcttattactgaacccccatcgaaaatggttggacatagcctaagcgaccatcccccaaagccgtgcactttccacacctctgcaagctgaaggatcatggaagaatccaactagtgactggatatattaccttttgtactgtatcagctcccaaagtgctccaggatctcctcaagactgaaccgggaggcgccttgtcagaagagacaatgtctcctatgaactttgatgagggagcanangccgcccaagaagtttggncgttaacccctcgctctcaacaaatccgcaattcaacaactngacctccgngcgccgcccggcgcgncacgcgttggngtctactcagnanaccgacgccnataaatgggan

SEQ ID NO: 23245 - DNA, 793 bp, Triticum aestivum
  unsure (1)..(793): unsure at all n locations
  Clone ID: PAT_TA_23245
cttcaaccaggccaagggacttacgtcgcagctcctcccggccatgaggaacgtgcaggcggcgctggctggcctgggcctcgccgacgccgtgaaggtcaccacgccgatcgcgttcaacgcgctcaagaaatcgttcccgccatccaagagcctgttccaggacgacatcgcccagtcggtgatgagtcccatgatcgacttcttggagcagacgggctcctacctcatggccaacatctacccgtactacacgtacacgtcccaatcagacacaatcaacctcaactacgcgaccttccgcccgaacgacggcgtcgtcgacgatgggaccggcgtcaggtatgacaacctgtttgacgcccagctcgacgccgtgtactacgcgatagacaatctacgggcctcctccaccaagcgcaccgtggagaccttgctcaggggagcgcaccgccgacatgtgcccgtggtaacaggggaatccgggtgggtgctcctactgcccacaggcggtgggggccaagcaagggaaaacgcccgagccttgctaccccgtccgccgtcaagctcggcggccggcgcggcgcccgccccccgtgccgcccgcgcccttcggcgctgccgccgccgaatctccgtgtaatcttcgccttttttaaacgagaacgacaanccgccgaacagcanattncggctgttctacccnancgggaacccgtgttatccgtcactntaaggccggcgnaccccaccccngtccaacaaatcnacttgtgcttgcgaaaccgcgtcn

SEQ ID NO: 23246 - DNA, 1016 bp, Triticum aestivum
  unsure (1)..(1016): unsure at all n locations
  Clone ID: PAT_TA_23246
acctcccttccctgttccctcccgcccgcccaaacccgagatctcgcagcgccacccgccgtcccttccacgcaagcactcgtccggctgccgggagcgtagccgaagcaacccggccgcgcccagccgagccggcagggccagattcccggtgctccggcggggctagatctgtgaaatcccgcccgccgatcccacctcccccgaggtgtgcgcagggaatccttacatgtcaccgctatagagtgatatatatctcttgctggtgctgtttgtggtgctgctagtcctggttggtttgagaagatgcagaggaatggggtgatggaatgcagcgtctgccactccaaggtcgtggcggggacccccaggagcatatcaagggcatacgacaagcaccacaacaagataacgtccaagttccgcgcgctcaaattcctcctcgtcgtcggcgactgcatgctcgtcggcctccagcccatcctagtgttcatgtcaaaagtagatgggaagttccagttcagccccatcagtgttaactttttgacagaggttgcaaaagttatctttgctatcgtgatgctaattattcagtctcgaaagcaaaaggttggggagaaaccacttctggcacgttcaacccttatacaggcagcccgcaataatgtactcctagctgtccctgcacttctatatgccatcaacaattaccttaaatttatcatgcagttgtatttcaatccttcaactgggaaaatgctaagcaacccttaaagggtactgggtcactcgctgttcttctgaaatttataatgagaaggaggttctctgttattcagtgggaagctcttgctctatatactctattgggatcagcatcaatcaactatcgaactgcacctaccggcggggcggcattcggtcttcctatcactgctatcgcatacatctatacactgattnttgtaactgttccatcactagcttctgtctacaacgagtatgcaatgaaaagt

SEQ ID NO: 23247 - DNA, 614 bp, Triticum aestivum
  unsure (1)..(614): unsure at all n locations
  Clone ID: PAT_TA_23247
tggagcaggacctccccctcctctggccgctagctagctagatactgcagtggttgcagcttggctttggctttggttgcttgcttgcccccgctcccccctccccccctcgcccccccccccccggcggcttctgcggtgaaggtgcgagcttcgggccgaccttgactgcggtcgaagggggcgaaggcggaagcttgctgccggatcgattggggcgcttgctttccgggcggtgcttggcggtgccgctttcggcagtaaaggcggggggatcttgcgcccacctgccgccggatcgagaaatcccctgcggcagcggtccgtgatagctgcgggcaggagggtgccgcgcgccgcccgctccccctgtcccggattgccggggagctcccgccggggtcttaaccggggccccacccaccaaggtgttttgcccaaaaaccccggcgccggccaaccaaccatgaaggactcccgtcctgctccggggaaaccgggtcaaattgccgacgcgcccctccccagacaaccccggggaggnccgggnaaaactcgtaactgctctacaaaaccaccccggccggcctgctctcncgtaactgganaaaacc

SEQ ID NO: 23248 - DNA, 294 bp, Triticum aestivum
  unsure (1)..(294): unsure at all n locations
  Clone ID: PAT_TA_23248
gatggaagtcgcgtctaatcgtggattagctagatatccgtatctagctcacgattctgcagacggatgtttgcatttaagtcattctgaaagaatggctatcgcaaactccaaagtttctgtcctttcccgcgttgttaacgcggtggacagttttaataccaatagtcgtgtacagacattggaggaccctaagatggataaaaccacttaggttgttatttatagcattgctatattcattcggttaagttngatattatgttgatttaaatgaaattcattaatccatta

SEQ ID NO: 23249 - DNA, 918 bp, Triticum aestivum
  Clone ID: PAT_TA_23249
ccacgcgtccgcagaatctgaattattcagcctcccacacgatccaggaaggcacgaagtgcaggcaaaggggaattccagtccggccgccgccacgacagaccggaccggcgagagcgagagacggagatggcgctcaccaacttcatcgtgacggcggcggtggtgggcggggcgctgcttctcttcaccaccgacgtccgcaagtccggtgctgtcttccgccgcaacgcccgccaaatccgacagtggctcgaggaggacaccgcctccgccgcatccaagtctgcaaaagaagcagttccacctcccaggaagctggatacagaggttcccaaggacaagccaaaggatcactgaaatggacaacaaaaatatgttttcattttgagagaagtatgttcagccaaaggagcactgaaatggaccgctggatcgcatagatataacttttgtcgaagttagtcaacttgttctacccttgctgagtgatagagatctgtagctcataaatacatgcatgacgaatatgtttccattttgtttcgagtattttggcgcctgtgtagatgcagaataagaagggagcaaccaattggcagtttttcttcacaaaaacataaatatatagagctctcttttaagccttctgatgacgtgtggatgttctatccagtccatagaggagagagttcctacatggtatcttccaatattactacaatcatccatccataattgacgctatagaccaggtactgccttgaaatgttactacaattatccatccaaattgcagtttgcacagctgccgagctgtggtttgtgggcgtcctccagatcagtttgaactgtggttcatgtatcttgtcataactgattgaacaaattatggaggaccctcggcttttgagatcg

SEQ ID NO: 23250 - DNA, 1037 bp, Triticum aestivum
  Clone ID: PAT_TA_23250
gtcgctgcccccggccatctccgcccaaacccgcccgatgggggtccacgggcctcgggtccggcccatcggccccgccgcccctgccccgcgtcctcgcccaccgctccgtcccacgcccacgcgtctgctcgtcgattcgccgccttggccgaggcaagcggcgcctccccgcccccaggtgaccctggtgcggaaggagctgcgcaaggaatcactgccaaaagactcaagatgagtttggagtgtcctggattccagtccatgttccgcaaggacgaagcaacgcgagctagccgagggttcagattgacgttcgctttgattctcgttgattcattgttttgaccgacccaagcagcgccggcgctcacggaggagaacctgatatttctagaggcctgacgcgcggtcgatcacacttactacgacaagtcctccaacgggtggagctggttcaggtaccacaagcaccctccaggaaaagcaggttccagctgtgcaaagtctgcataatactgctatccatactgcgctatagcaaaatagctttggatcaggactaacctctagccaggaaagaacctgaatcccaagatggatgaaatgctgctgagacgttacaagatattccagcagaggcatccttaccgtccgcattacaaggatatgagaacattggggtcctgaaggcagtgacctgtttaccatacacatatttacttcctttctagggcggaacaatggaaggcacaattccaaatttccaagtacagctcttcaagaacaggatctctgaaggaacaacaatttacaagcttggcgcttaccagaatgcccgccgttgtgatgttttggggaaaattagcagatgcccttgatgcagacaagctacaacggtggtctgctcaagaacccattatagttctatttgttggcatgccagtacatgaatttaatgaaacttgaccttcaagtcctgtctggcaactcgatggtacatgaatccaactatttctgaagcggcagctattcta

SEQ ID NO: 23251 - DNA, 600 bp, Triticum aestivum
  unsure (1)..(600): unsure at all n locations
  Clone ID: PAT_TA_23251
gaattcggcacgagccgacatcgccgggcgccaccggtaatgcaatggccgccatcctctcttccgccgcgccaacgacgccgactcccccgcgcgcccggaggcctcgacaggcgcccaggaataggcgcctcccccttggaggccccgcggcgggcctcttcaccacgctcggactaaatggcggcagcgccgctctcgccgctcctctctcctacgaggagatgctgcggctctcatccgacaccgccggtggtgggggtgacgggttctccctcccagacctcggcctcggcgggttggtggacttcgtcgcgcagaacccgctcgtcgtcgccgcgggcctcgccgtggtcgccgtgccgttggccgtttcccaggtgcttggcggtgcctccaagccgtacgaaaccgtgtccgtgaaggccgcgtaccggaggcttctggaggagcctgacgcgcaactcgtcgacatcaggccgctcaaggacgcccgggaggtcggctcgccggacatctctgggggcacaaaaaagggggggggccgtctccccctacagggaggnaaaanaaacggnttcttgannaaaccttngcccg

SEQ ID NO: 23252 - DNA, 476 bp, Triticum aestivum
  unsure (1)..(476): unsure at all n locations
  Clone ID: PAT_TA_23252
tcacatcaaagcaacacacacagccgacgggatgaggatgcgctcacgcgctctgctcgtcctcctcctctgctctctcctcgccggcgcggccaacgccgagccctctccggacccgacgtacaacgactgccacccaggcgacaatggcggcgctgctcgccgtcaaggccgccctcgggaacgcctaccacttcgcgtcgttggacgcccgacaacccctgctgcgactgggtacgacttcacctggcgacaacttcaccgggcgcgtcgtcnggnctcgccgtcttcccaggacgccaaactcaaaggnaacatcccaacgcctttgccggcttccaaacctggaagactaaccttgcgcaactccccgggtctcnggcctatacgccggcatcggaanttccaacttccnacctngatccctggaagctnttnggcccnncancttctgggngcctaaaaancactcctnt

SEQ ID NO: 23253 - DNA, 870 bp, Triticum aestivum
  Clone ID: PAT_TA_23253
ctcgtgccgaattcggcacgcgggggggtgtcggcaccaggtcaatttaaactttaaattgattcatcttcctttcctttttttgacatttcgtaaaatgtctaacaacaaacaatgtgtggctgaaacgggggaggggctttctagctccacaagtggaatgttgcgcggtgcaacaacgggtggtggcgtgatccaccaatcgatgcgaagggggtacgacagtaggaagttttcctatgatgtcggtgtcgccagatcgtccgcgagtgtggactttggtgcgacgagaatggaccgtttggatccggaccgggcgatgatgttgtttaacaacatcagagaaaagtacggggtgcacaagttggcacctgagcaaatgtgggcctttgataaggctctattcttttctcacaccattaatggtgcctcggttttgcaaccgaatgaaggggtctttttcgtggggaagaggtcatacgccatgggattggcgttgtcagtgttgggcactgacgctaggcggttctttcgaacctacgcggacgagatccgcgaagtcaaccggcagatcctgaatgaggttgatcacatggactacgggaagtccgacaagtacaatcagctgatgcaggtggcaagggcgcggggtatggaggcatacccggacctcgcgcatgattcggctgatgcctgtagttggttgactctggagcaatctagagtcatagctcggtctaaggatcgagtgttagacggtttggaacctgatccgtataaaaggtaattagtttatattatgagtatttgaatttgagtgtttgcgtttctgaatgaatacatttcagctcgtgccgaattcggcacgag

SEQ ID NO: 23254 - DNA, 671 bp, Triticum aestivum
  unsure (1)..(671): unsure at all n locations
  Clone ID: PAT_TA_23254
tttttttttttttttggtgagaaattgtgcgtgttaacttattaaccattttaattacacgtgaggtaacaacaaactcactaagatacacccaagtcatgtcatcatcatcatcttcctaggtcgacctaggtactagtaagtagaaagaaggtgacgcttgatccaagagcagagcagctgcgatgcattcctacggctcggccatgtcgtccttgccgtgctccccgtcttgggcctgcccgtccatctgggccacgggcaccggcacctcatcggcgttcacgtcngtgctggctgcaccacgagtaccgagggacgccacgccctgccctgctgacgccagcgtgtcgcccgatgggaccagctccggggtgctctgccgggcggacggccagctccgccaccatcgccggacggcaccgcccccgccgggcacaccacccgtatcccggtcttgccgttgcacaactccccgtaacttccggcaacaaagctccccggcgcgccccggcccccccccgcccggatcggcacggcgctcgtcaactcttctcntgtgcgttacacgcggtggaaagngtacntccgggtcctgggtcgtcggcgcanggactcggtgtctccgcggcttcctcagaanacagtagtgccccggggcccancccggg

SEQ ID NO: 23255 - DNA, 617 bp, Triticum aestivum
  unsure (1)..(617): unsure at all n locations
  Clone ID: PAT_TA_23255
gtgcgtgtacgaccgcgtcctcgccggcgtcaaggccagtgacgccctcgtgatcaagacgtgcttcgagatggaaggcccctacatcaactacctcactgcccagcacggcaagccggtgctcgtcacgggcccggtcgtgccggagccgccgcagggcgagctggaggagcggtgggccaagtggctctcctccttcccggacaacgccgtcgtgttcgcctccttcgggagcgagacgttcctcccggccgccgccgcgacggagctcctcctgggcctggagtccaccaaccggccgttcttggtcgtgctcaacttccccaagggcacggacaccaaggcggagctggccaagtgcacgccgccggggttcgccgagaggaccaagggcaggggcgtggtgcacacgngggtgggtgcagcagcagcacatcctgcggcaccgcagcgtggggtgcttcgtgaaccacgccgggctgagctccgtggtggaggggctcgtcgccggctgccgcctggtgctgctgccgatgaagggcgaccagtacctcaacgcggcgctcttcgcgcgtgacctccgcgtcgnggccggaaggtggcgcggcgcgacagcg

SEQ ID NO: 23256 - DNA, 888 bp, Triticum aestivum
  Clone ID: PAT_TA_23256
actcgagaccggtgactctgcaagtggtcctctcctctgtctatctctctcgcccgccaccggccccgatctcggcgatgccgcctctcacgacccccaagtccggcgacgccctcttcgccagcgtcgagcgcgtaaacgcggagctcttcacgctcacgtacggcgccatcgtgcggcagctgctcacggatctcgaagaggtcgaggaggtcaacaagcagctcgatcagatgggttacaatattggaactcggttggttgatgaattcttagccaagtcaaatgtatcaaactgtgctgacttcaaggagactgctgatactatagcaaagcttgggttcaaaatgttcctgggcgtgactgcaactgtaaccaattgggatgctgagggtacaacttgcagctttgtattggaggacaacccacttgtagattttgttgagcttcctgatacttgccaaggtcttcagtattgcaatgtgttgagtggagttatcaggggagcactggaaatggtttccatgaagacggaggttacatgggtccgcgatatgcttcgtggggacgacgcctacgagatgcgggtgaagctcaccaagcaagtcccagaggaatacccctacaaggatgatgattagtttcatctcaaagggtagctcttccgcacggtggcgcttgtttgcttgtctggatatccgttttgctttccctgtgggtgtaattctggtacagccgtcatgttttacatgaggcacctgtgcattgtattttgcagctgcaatgtgtaccgcagatgtattgtagagatcttatatggctttcctactttggaacagtgcgtggaaatgaagtgcttttactctgattagatgctaatctttttgg

SEQ ID NO: 23257 - DNA, 1256 bp, Triticum aestivum
  unsure (1)..(1256): unsure at all n locations
  Clone ID: PAT_TA_23257
caccaattccgctccggtgctggacccctctcgcccctgatctccctcgcccgccaccggccccgctctcggcgatgccgcctcccacgacccccaagtccggcgcaccccctcttcgccagcggcgagcgcatagaccacacattcactttgctgctgcaggttgcaacagctaaattaggctacaaggttcgctctgaaaggctgtgggcgagctcagctgccaatggccctcaagatttcaagcagccaggcgccagggctgctgccccggcctattcgatctccagatacttctccactgttattgatggcttgaagtacacttcctcccacgagttggtcaagaacgacggactccgtggccacgattggcatcagtgaccacgcccagggccatctcggggaggtggtgttcgggggagctgccggaggccggcacgaaggtgagccagggcggagccttcggcaacgtggagagtgtgaaggccacctaagcgacgtcaactcgcccatctccggcgaggtcgtcgaggtcaactcaaagctgtccgagagcccccggccttatcaactcgaagcccgtacgaggaggggtgggaatgatcaaggtgaagccgagcagcccggcggagctggagggcctgctggactcggccaaggtacaccaagctagctggcgaggaggaggacgcccactagtgctccttgctcgcttatcgttccttttttgttgcaaccatgtcgactactcttgtctacaataattaaaccagcttcaccatgcgattcagtttatcggttccaattttctcttgtctttgtacatggcgtccagcagtttgttataccatttcagtgaccgtgacatcagagatatgggaaagagtttgtaggttagtttgttggtaaaaacagacattatcatccaccaacagatcatcatataacaactctaatatgttttgtctaagatttcacgtttttagtcagggactgaaaagatgatgtatgcttttgctagatactttttctcgtttccatctgtccatggtccatggagtcaaataaaatgtgatcttcaaatagattccgcactctgcccgaaaagtttgttaccaagcctctgaaaccccccttcagggggggcatccccaaccttccttaagggggatnaaaggggggttaaaacctaccngggattnttaaaatggggttnggggggattttttaaaaattcncaagtcccccaaggn

SEQ ID NO: 23258 - DNA, 838 bp, Triticum aestivum
  Clone ID: PAT_TA_23258
cccccgcgtcacggcatcgtgctgcgctcccccctccccctccccctcccccatggcatccgcgccgagcaccaccgcgtccacgctcgcgccccctctccgctcgcccctctccttctcctcctcccgccggctccctttcgccgtcgcgctccctcgggcagcggggccctcctcctctgccgcgcgcccgcgcgggggcgcgccctggcgcgcgtccggtgccgcggggcggtgaagctggtcggggagggcgagttcgaggcggaggtgatgcagtcggacctgcccgtgctcgtcgacttcgtcgccgactggtgcgggccctgccgcctcgtcgcgcccgtcgtcgactgggcctccgaggaatatgaggggagattgaagatcgtcaagatcgaccatgatgcaaatcctcagattatcgagaagtacaaggtttacggtctcccggcgttgatcctcttcaagaacgggcaggaggtgccagggagccgaagagaaggcgcgataaacaaggccaagttcaaggactacatcgagcctctcctggagacctcaaatgtggcctgatatcatcgcctgcagtctgcaggaccgattcttgtaatggttcacacttcagaggatgccaaatggcactggcttgagctgcacagcttgcatattgaacagtttttccccactccatgagctctagtctgtaattactaattacctacacgatcaggactatgtatggctttcattgctttgggaaaaaatgtcatgcatctagggctgagtattccatggagtatgtacacttatttaattggttattaaagcaaggccaatt

SEQ ID NO: 23259 - DNA, 659 bp, Triticum aestivum
  unsure (1)..(659): unsure at all n locations
  Clone ID: PAT_TA_23259
ttttttttttttttttttgaaacaagcagttttattgatggaatcaagaaattttacttatgatcatttaaactctagacaacatctaacagaaaaagaatagctttgcttcactagtgctgataatttcttctttgtctggtgctttggaacataaactcacatgctttattgttcattacaatggcaagaggaatagaacatatattccctcccatatttcactgcacatatgccaacggcccaacccaacgatctggacaatcacaaccatcaataatgatacaaattagtgatagctccatgaagttaaatagtaaatgctgtcgcacgtacgctgctatcaaccataaacacatatgtcacatatatgtttacataagagaagcagctagcattactaagttaactggacagatagccccataaagtagggtacagagtatactcgagaacaaaagggaatagctgccgatattacctggggagtaaagacctatgattcaccattatctaaaaagccaacaatggaacagcaaaatgcgagccagattatcagtgccaatctgccaatgcgtctgagtacaagggaacataaggaagataagntccatggaacctgtcaagatcgtggatgaacngacttccagtatcaattn

SEQ ID NO: 23260 - DNA, 697 bp, Triticum aestivum
  unsure (1)..(697): unsure at all n locations
  Clone ID: PAT_TA_23260
ctcgggcccggtccagctctcgagcaccactaaactatacacaaggaggacctcgtcggcataatcctcaggcagcgagcagaggggcgtcgtcgacgatggaccgcgccgcgctcccggcggccgtcgagcccaagaagaagggcaacgtgaggttcgccttcgcctgcgccatcctcgcctccatgacctccatcctcctcggctacgacatcggcgtgatgagcggagcgtcgctgtacatccagaaggacctgaagatcaacgacacccagctggaggtcctcatgggcatcctcaacgtgtactcgctcattggctccttcgcggcggggcggacgtccgactgggtttggccggcgcttcaccatcgtcttcgccgccgtcatcttcttcgcgggcgccctcatcatgggctctccgtcaactacgccatgctcatgttcggccgcttcgtggccggcatcggcgtggggtacctctcatgatcgcgcccgtgtaacggcgaagtgtccccgcgtctgccgtgcttctaactcctccggagggtcataactcggagctcccggtattccaactcgcttgccgcttcctcgctcgtgggaattgcccaaagggggccttcttcgcccctccggccgaccccatccccggcccgagagcctccggccaagtttnttaantcaacccgggggng

SEQ ID NO: 23261 - DNA, 873 bp, Triticum aestivum
  Clone ID: PAT_TA_23261
gcgtccggcgacctttcgtactgaaggtgccatgcctcatgacattggtttgttatttgtttaggatcccacaacagaggggtagctatggctacagcacagggattagtggtaccaagcatcaagaaagtccagtcactttctatattggagatcacgaaggaattgtcaagattacatgagatggcactgcaaaacagactaagcaccaacgatatcactggtggaaccataacactgagcaacataggcgccatcggtggcaagtttggctctcctgttctcaacctgcccgaagtagcgatcattgcgctcggccgcattcagaagctccctcgctttgatgatgacgaaaacgtttacccgtcctcgacaatcaatgtgaccgttggagccgatcacagagtcgtcgacggtgccacggttgcaaggttttgcaacgagtggaaaagcctggtggaaaagccagagctgctcttgctgcacatgcgatgatccagcaagttacctggatgcagagggccgctcggtcgaattccaaagatgctgaaattcaggcactctgccatctgaagttcagatgcaaacgtatggaatgccaggttggtagatagggccataaggagtcaatcaactcaagtatatgtaactaataattgattgacgtgacctgttttatgcaagctatgtgatcaccctgtgaatatttgtatattacattggaaataaagctatagacctacaaaaaaaaaaaaaaatccttgacccggtgcggtgccccttgaggagtggaaactgtatctgcacatatcgccgaaatcaccaagcgagtgatgacatgaatctcaatgcacctcggccgcgaccacgcta

SEQ ID NO: 23262 - DNA, 705 bp, Triticum aestivum
  Clone ID: PAT_TA_23262
aacagggcgagggaggagctgtcgttcgagctcgggagggcgccgacggacgaggagacgatgaagaaagtggggctgtcgccggcgaggtaccgcgacgtggtgcggatgacgaggcccacctactcgctgcactcgcggaaccgtgtcacgcaggaggagctcatcaaggaggtcaccgacgtggacgccatcggggtcgacacccacaagcacaaccgcctcctccgcctcgccattgacgacctcctggattcgctgaagcccaaggagagcgtggtgatcaggcagaggttcgggctagacggcagggggaggcgcacgctgagcgagatcgccggcaacctgaggatctcgagggagatggtgcgcaagtacgagctcaaggcgctgatgaagctcaagcaccccacccgggtcgactacctgcgaagatacatgtgaaattatctgtatatatctcggtcgcgcacatacataccggttctctaatttgattatgctgcatatactacattgcaagatggcatagactcatcattgattccgtatttcggacatgtatataagtctgtatatacgagtgaggttgtatatataatatttgatttagacctcgcgctgatgtaattcatagcacgcagaaaagaaaatggtctctggtttattaaaagaaaaaaaaaaaaaaaaaataaaaaaaaaaaa

SEQ ID NO: 23263 - DNA, 754 bp, Triticum aestivum
  unsure (1)..(754): unsure at all n locations
  Clone ID: PAT_TA_23263
cccacgcgtccgccacttccccggccccgtttccgcgagccggccccctccagcccccgattcaaaccgtcgacgccgtgtccccgtcgccgcgtgactcctcagcggcgaccacccacctccacccgtcgcgccgccggagatcacgctcgctcgcgcgcgcccctgccctctcctcgccgggggcgcccaaagcttagctgctcgggtgccgtcgcccgctcggaggcggcgccgccgatctcgcggcgttcccgaggcggcgagctcccgcgcgagatcccggcggtgatgtgcggatcggagcatggttgtgaacccagccggtgttagctgcagtcggccgacggggagcgagcgctgcggccatggcgatttacatcgcgcgggaggcaaccaagctatggaggaaggtgtgcgcggagacttcggtggagctgcagcttctgttcgagaagtggcacctgctacttgccggaattgtgtttcagtatattcatggattggctgctcgaggagtacattacttgcatcggcccggtccaatactccaggacatgggatttatggcccttccggagctcgggcaagacaaaggttatcttagtgagactgtattcacttgcatcttcctttcatttctggtgnggagttttcacccttttgtttatcatagcaaacgtttctacactgttctactctggcgcagggtgcttgcattnttagtcgcttcacagtttttgcgaattattac

SEQ ID NO: 23264 - DNA, 640 bp, Triticum aestivum
  unsure (1)..(640): unsure at all n locations
  Clone ID: PAT_TA_23264
gcacaggccacgccctcactcctccgcctctcccagcgacggactccacggatccacggcggtgggggcccgatggctgcggcggcgaatcctagggtcacgggcgcggctcccgcgcccctgctgctccctccacgcctcctcggaaggagccgcggccggcgcgggacgttgctcgccgccgccctccgaggcgcgccgtcggggagcccgagccaccgacagggtcccagcgcggagcaacgctgtttggcgggcgtgccctgggcaaccacggcacggagaacggcgccgtccggccggcgaagcggttctgcctgcaccgggcgcttcgccctgaccctttccgcgcggcgggctcttcttcttcaatcccgcataaatccttgtgtttgttacgaatgcggcacctcaaaatgacccgaacctcccttcgcctggatggcggcaagaccgtttggcccctcgccaactgttgccccgacngtgcaacgctgggggatacggatccggaaaccaactntggaaggcgctggaatctnatgtctcggggcgtctctgngctccctccttgctccgggntcactcgtccttcctagtaancctttcantaacaactncgaattnctggacccctaga

SEQ ID NO: 23265 - DNA, 599 bp, Triticum aestivum
  unsure (1)..(599): unsure at all n locations
  Clone ID: PAT_TA_23265
ctcgtgccgaattcggcacgaggcagtgccagtgaccaccgtccgtagcaatggcaacttcttgctcgcttcctcctcttgtgcttcttctccttcttcttctggtggcgctaccgctctcgtcagcggccatccggccatctccccaggtcggcaaggttcttcgccaaagcagttcgctcaatcatcaagaaatccaccaaggagtacctggaagatagggccaaggacagcgtccgggacttttccaagccagggcaacaccggcaagggtaacaacgaccagctgggcagctcggcggcggaccaattcgggtgccttcctcttccgacctctccatccgggacgccctcatcggccacagacctctccctcgtcctggacatcaacaagtgagctcgtcctggaccaatgcggcgtgctacagccgaccgacggaacctcctcaaaattggctgcgacgacaagaagtgaaggacgtgttncccgacttacaaccgtgcccggcaaacctgacacnctgtccgcaactcgggggcctgtttggtacaagagaatntacggaggggggganaaagggaacccccacgaanttaat

SEQ ID NO: 23266 - DNA, 615 bp, Triticum aestivum
  unsure (1)..(615): unsure at all n locations
  Clone ID: PAT_TA_23266
gtcaccggcaagtgggcctgtcggatccacacgccacaagggctccccgaaccaccagtcggatccccgcggcgccagggctccccatgccggatccccacgccgccggcaggtgggaaggctgctgcgaagatccagccggggtggccatggagggatccagtgggcggaggaggttcgtccgcgcgccctgacttccagcagtcctacctccgcaagggcctcccctgctcctcccccgcagccagatacatcttccctgcgacctaccgaggccctccgccggcgccccgccaccggagttagacaacgggcgaccgcggcacgggaagtctggntgggggtctgcaccggaagtcgccgttccactgccctccgccaacctccaaccccgnctngatctaccgggaacggggattcccgtccggccgagattcatctgcaagcctctctcctctngcctaccagtttcaccctgacgcaatcatcgcaggggactgcacttcctccactttagaggaancccacaagttgngggacnctggcaacaangnaggctgaacnccaagaatggaatntggganaccaagtgggggacgnanccagccgaaggtc

SEQ ID NO: 23267 - DNA, 1205 bp, Triticum aestivum
  Clone ID: PAT_TA_23267
cgcctgctaggtaccgggtccggaaattacccggggtgcgaccccacgcccgtccggaaccaaaacgccctcgtccctcttccccctcctcgttcctatcgccgccacccctcctcccctcgatttctagcacccatcgcgaccctactccccatcccatacccagcctgctcctcgcaccctcgccgccccaatggagacagccgccgccgtgtccgtgcccagatccgcctgccgtgccgcgctccccttcccggcgcccctcaagctccagggccgcgttgcgctcccccgccgggcgctccccggggcgccgaggcagcgcctcgtcgcgcgctgcgcggctgccgacgacagtgcggcggcagagctccccatcgagaaaaggttcgccgccttcccggccgtcatggacatcaaccagatccgcgagatcctgccccacaggttccccttcctcctggtagatagggtcatcgagtacaaggcaggagagtatgctgttgcgatcaagaatgtcacgataaatgacaacttcttccccggccaacttccgggaccgcccgataataccccttccccggccacttcccggagcgccccctaatgcccggcgttctcaatgctgaggccatggcccaggggggccgtagcgaatttctgctgcgcaggggtggtggatcccaggtcaaggtcgcattttactgctggtggcactttggtcatgaggatgaccctcaccaagtatcacacgaagttcgggcttgcaaagatggaaggaaaagcttatgtgggtggcgatgtagtgtgtgagggggagttcctccgtattagccgccactgggtgaacaggatctgcttgtgtgcgatgtgatcctctcacaacgatctcgattagagtgagtccaagttcacttgttgagtgaattgagtttgtgaactgaacttacaacatgtgaggcaattttatcttgggttttacatcaagttgtgtaatggccttttggggccgagtcaggctgtgttgctggtgttacaagggtacgatatctgtagtttcgtggtataaactatgcttcttaaaaaaagatacttcctctgttccaaattataagatgttctgatagactaaaatagcctaacaaaacgtcttataatttggggcggaggtggtacatgtcaatgctttgcccagaaaaaaaaaa

SEQ ID NO: 23268 - DNA, 711 bp, Triticum aestivum
  Clone ID: PAT_TA_23268
caggctgagctcaatggagttgacattgggtgacatggttcactccgtggaggccaccatcagtgtgaaagtggttggcggggagtggccacaaggtttcagaggtgtatttacagccactaccgccagcatagacgaggagaaaatcgagttgcttgatttcggagacgacaaattgcctgttgcagctgatggctcgatacagctctcacgaagtgttgtgtctgttgaagacgacgggcagctgagagtctctgtcatggcgcgtcacctggtggatcgatctgtccgacgggcttctggagtactcgcagctaagacatcctccagaagctatgctaaacttgaagttttctcttgtaagatggaagtcactgtcgcctgatctcttctcccgtactggccacattaccgtgacatgccgtgtcctagcatatgaatggctttggtttggctctagttgtcggaagcacagtagttatttatctaatgcatgtatgtatggttcgtagcatgtgttatgcggtggtactgtagacaagtcagattcggtgggtgttctagtcggttaaacaagcttatatatgcttgtatagtgagtttaggccgtgctctctcgtttgactaatctattatgtcatatagtcagtacagattcgaaggttgttccagtaaaaaaaaaaagtctaaaaaaaaaaaaaaaagcggccg

SEQ ID NO: 23269 - DNA, 889 bp, Triticum aestivum
  Clone ID: PAT_TA_23269
cgggacagaaggcgggaccccccgcgacggccgcgcctggctgtcatcatacggcacagaagcagaccccccaaccacgaccggcgaccgcgcaccgcccggcccagatccccgcccgccggcagcgaccatggcgacggccaaggccgccggcgaagagccggccctcggcatcccgtacaacccggcgcaggcccagggcagctactactacccgccggacccctacgcggcggggcgggtgccgccgaacgcgatctacgccggcgcgcccaagggggtgcccctgcagcacaccatgttccgcgacacgcccgcccccttccactgccagtcctgcggcgacgccgccgtcacctccgtccggtcgaagccgagtgtcgcatcagttgtggcttgcatgatgccgttctttctgggcgtgtgcttcctgtgcccctccatggactgcctctggcacaaacagcattactgccccagctgtggagaaatggtggctgagttccaaatggacgatcggtgcatcgtggtcgacccaaccagctggaccgagccaagctttgacgtgcctgcttagagcgctcacatgaactgcctgatatgagtatatgatatagtttccaaccgtgtgttgttcttgtgtgatctgtacataaataaaatggctactttgtcattatatcatgtagcatgttgtttcttagtttgtgtccaccgtctgctgggtaatgctttgtaatgagtggcctacattgacaatttactgcagaaataccacgtggccgaccgggccggtaaaaaaaaaaaacatcgaggggggccggccattcgctttagggctatacatcatgccgcgtttcaagcggatggaaactgggtccaatatcct

SEQ ID NO: 23270 - DNA, 545 bp, Triticum aestivum
  unsure (1)..(545): unsure at all n locations
  Clone ID: PAT_TA_23270
ttttttttttttggcccgcggctcgcctgccctgtttccaactccataatccaatctagatgagtcacatatacgtactgtacccagggttcatgctggacaacagagcaaaggtataatactgttaattacaccacttgctcacaaacttcttacacacccggcacacaccggtagcgagtcacatttgcataattacattggtgtaaattctccagtttgcactatgtatgtacgtatttatactggtacaccttttcaataaaccctacgtaccttgtatactttttgggggctatccttccaccctttcccagtactcttccctttgattcttttgtggttccacaaaccctaatgttcacacaagcttcaagatgggcttccaacacgcttagacctcctgggacatctccagggtngagtcgccgccgccttctgggaagaccgcttatctcntcccgaactcgtaaatttccccgaaacaaacaggtcgccangcaccctcctgagcgctcaactgtanagcacccactggaaccctc

SEQ ID NO: 23271 - DNA, 687 bp, Triticum aestivum
  unsure (1)..(687): unsure at all n locations
  Clone ID: PAT_TA_23271
gaggggggatttgcaaacgcaccccagtaacgactaacaataacaacacaggccagagatactttagacagcagctaaattattcacccaaaagtatcaaccgacggcttaacaaaggggaggcacatgcacaccccgctaccccagtaatatccagcactccattttaccgactaacaataacagcgcaccagcactatatccccatgtccaacgtgctggtacagattacatactgaatgacacagatttattgccaccacaagggggtatgggattgctctagctctcggcgctgactgcatcggctgtggcttccttctcttttacctcctccgagctcacctcccttggcttgtgctcttggcaggtgccttctcggtctctgcctcggcggtgactgtttcatttgtttctggggatgtgcttgtggtgccgtcttctgcgggagctgccttcttgatggtgccgaccttcacatacttgctcatgaacttgtattcccagtcttgcagggcgtcgagctcaaacggcccgaggccagaggtatccccgttcaggtcctggggctcgaaagacatcttggctagagctctgctggcgtctttgccagcgaatagggcataaggtccaccaggtccgtagaacattctgctctgcgtgacgtcatncgcgagcccggccggc

SEQ ID NO: 23272 - DNA, 1203 bp, Triticum aestivum
  Clone ID: PAT_TA_23272
ttgttgtttgttctttttttttttttttagacaacagctaaattattcacccaaaagtatcaacagacggcttaacaaaggggaggcacacgcacaccccgctaccccagtaatatccagcactccattttaccgactaacaataacagcgcaccagcactatatccccatgtccaacgtgctgatacagattacatactagaatgacacagcgttatctccacaaaggggaggcacatgcacaccccgctaccccagtaatatccagcactccatttgactgactaacaataacagcgcaccagcactatatccccatgtccaacgtgctggtacagattacatactgaatgacacagatttattgccaccacaagggggtatgggattgctctagctctcggcgctgactgcgtcggctgtggcttccttctcttttacctcctccgagctcacctcccttggcttgtgctccgtggcgggtgccttctcggtctctgcctcggcggtgactgtttcatttgtttctggggatgtgcttgtggtgccgtcttctgcgggagctgccttcttgatggtgccgaccttcacatatttgctcatgaacttgtattcccagtcttgcagggcgtcgagctcaaacggcccgaggccagaggtatcaccgttcaggtcctggggctcgaaagacatcttggctagagctctgctggcgtctttgccagcgaatagggcataaggtccaccaggtccgtagaacattctgctctgcgtgacgtcatagatctgacccttgatggccatgaggaggggtttcttggggtcggacccgtcgtactgccggagctcctcctcgtcgacctcgcccagctgcacgggcggcgggagcggctccgcctcgggctcctcgcgcggccgctgccggggaggcggcggcggcgcaaagatccccgacacgacgtggtacagcgcggcggcgaccgccacggcggtgaagaaggccgtcggggacagccccgtgtacgctaagatcgcctgcttcagcgtctcccagagctccgccaccgccatcgtgaaggctgtgctcacctcttccgacgaggggtttggagacttcggggatgaggggcggggcactctggtcttttcgcggccttcgatctcgagaggaggagggtgaggaaagggcggacgcgtaagaaa

SEQ ID NO: 23273 - DNA, 538 bp, Triticum aestivum
  Clone ID: PAT_TA_23273
ccctccttgcagtttactagttgattcgggcttcctctcaggaatcccttgtggatgtgtaggtacactgatgatttcaggcacaggaagaagatatgaattgtccactggatcaatcttgcctgaacttccagatttccctgcactctgtctcgatcttttgctgggaccagcaacacgactatttccttcagccttccgatctcttagagcagcacaccttgtatttttgaaccacttgtcaagcggttcaaaagaaatacccaattctgttgagagattctctttcacctcccgggttggaagctcactttcagcaaaagatttgcgtagtacctgaactgcctcaggtggaattctgaagagttttctcctctgcggttgggctttctcattcgattttacatctaaggaaccctcggcagacttaactccaacaccagctgaatccactcttcttttctttctcctattattaagtaccccaatccttcatcttcactccgccttttcattctcagtcagtttccaggggggg

SEQ ID NO: 23274 - DNA, 956 bp, Triticum aestivum
  unsure (1)..(956): unsure at all n locations
  Clone ID: PAT_TA_23274
gcggggaatgaaccagaaagagctctccgcatactagcgaaaatgaggcgcttggatttgaagccacatatctggacctatgaaattatgttttctctgtttggcaatgtcaatgttccttatgaagaaggaaatatgctatcacatgctgatgtttccaaaaggataagcataattgagatggacatgttaaaccatgagattcgacatagttttgtgtctatgaagaacttgatacgagcctttggagccgagggaatgatagatgaaatgctgaggtacttgaatgttgctgagaatgttttatggaacatggatccttatcagaagagtgatctctacggcattgtgctgcatgctttggttaaagcaaaggaaacacctaaggcaataagaaccttcaagatcatgagatcatggggtctcccaaccaatactgccatttatagcatcatgatagagtgctgcaaattgttgccgtgtgtcaaatcagctggcgctttgttgtccttgatgttccgagatggctgctgtcctacggttgtgactttcacatctctcctgaaggttgtattagcaaaagaggattttgagggggcactggatctgctggacttgtgcataactgaaggaattcaacctgacattgagattttcaacacaatactctcagaagcgaatgcaaaaggtaatattcatgttgttgaatacattattgagtgtattcacaagagcaaaagattcnaccccattaatcaacgcttgggtacacattttggtgnctaacgttggaccaaagaattgtncaacaaccgcctcccaagcattgcaagtcctcaagtatgagaatgatacctttggacgcnaacatcctcaaaggagaaaggacaactttnanaggatctaacctcaacgaagttcaaatncnaatttaagttattagacattcnaanaac

SEQ ID NO: 23275 - DNA, 703 bp, Triticum aestivum
  Clone ID: PAT_TA_23275
gccggccgggtcggattactccgcggcatcacgcaggcaggcaggcaggctagccgtgctccctcccgtctcttctctcctctcccccaaagaggtcaaagacacagggagaggactcctccgcatctgcatccgtcctcctccgcgcgcacgaattcgagagggagaggagcggtaatggggagggctccgtgctgcgagaagatgggcctcaagaggggcccctggacgccggaggaggacaagatcctggtcgcccacatccacagccacggccacggcaactggcgcgcgctgcccaagcaagccggcctgctgcggtgcggcaagagctgccggctccggtggatcaactacctgcggccggacatcaagcgcggcaacttcaccgacgaggaggagcagtcaatcatccagctgcaccagctgctcggcaacagatggtccgcgattgccgcccggctgccggggaggacggacaacgagatcaagaacgtgtggcacacccacctcaagaagcggctcgacctcagcgcgcaggagcagcaccaggaggccaagaagcgcaagaagccggcggcggcggcgcggaagcgcgacggcaaggtcaagatgaggaagctcgacgcgctgaccgccaagcggcgcccgtgctgtcctcgcccgagcgctccgtctcgtccacgctcaccgagtcgacgtc

SEQ ID NO: 23276 - DNA, 1475 bp, Triticum aestivum
  Clone ID: PAT_TA_23276
gcgtgcgcggttacgctggatcgccgcgccatccggcaggctagccgtgctccctcccatctcttctcttctctttttctcttctctccccccaggaggtcaaagacacagccgcgcacccccgcatctgcatccggcctcctccgcgcgcgcgaattcgggagggagaggggcggtaatggggagggctccgtgctgcgagaagatgggcctcaagaggggcccctggacgccggaggaggacaagatcctggtcgcccacatccacagccacggccacggcaactggcgcgcgctgcccaagcaagccggcctgctgcggtgcggcaagagctgccggctccggtggatcaactacctgcggccggacatcaagcgcggcaacttcaccgacgaggaggagcagtcaatcatccagctgcaccagctgctcggcaacagatggtccgcgattgccgcccggctgccggggaggacggacaacgagatcaagaacgtgtggcacacccacctcaagaagcggctcgacctcagcgcgcaggagcagcacgaggaggccaagaagcgcaagaagccggcggcggcggcgcggaagcgcgagggcaagatcaagatgaggaagctcgacgcgctgaccgccaaggcggcgcccgtgctgtcctcgcccgagcgctccgtctcgtccacggtcaccgagtcgacgtccacggcctcggcggcggcggagcagcacggcaactcgggcagctccgcgtccgcctccgcgtccgtcaaggaggagtgcttcacctcgtccgaggagtcggaggagttccagatcgacgagagcttctggtcggagacgctgtccatgccgctggacgacatcaacgacgtctgcatggagccccacgacgcgttcggcaagcccacgggcgccgccgacggcgacatggactactggctcaaagtgttcatggagggcggcgacgacgacaacaacaacgacggcgcgctagacttaccgcagatttagggagggagagagctctagtttcgtcgctgctcccgattgatcgttcttttttctctctctctacccgcgccatcttgctgcaccggagggattgctaacagagaagagtgccctgccccgcggaggaaaattagtagccagcaagaacgcggatcatgaaggcgcccggtcggtagatttctttgatccatcttgtttgttcaccttgctgtatagaaagatgagagatcagcgatcggaaccgatgcattctgagttagtagtgattatctgttcatctgcacggggtgcaaatatcagtttctgtaccaccatggagattactagattctgaaatggagtctgcttttctcacttttctcaaaaaaaaactcgagacacctgcccgggcggccgctcgaaatcactagtgaattcaaaagactaacaggtactccaatatgtataactttaatatatg

SEQ ID NO: 23277 - DNA, 574 bp, Triticum aestivum
  unsure (1)..(574): unsure at all n locations
  Clone ID: PAT_TA_23277
tatcggaacgaagcaaatccctaaacgtaggtaggcgacggcggcggcggcgacagtggaattctttggttgctaaccggcgacgagcagttgaatgagagtaggaggccagggcgcggcgggagtactcgcgcagcggtgtgaactctttctctgctcccccttctcctctgctactaggcgagatgggtggcgccgacgttccgaagcgcgacgacgaggaatggaagcagacggcggtgtacaactggggatcaaagagaagcgctcaggatgaggagatgccgggattggacttgagaaggaggctgagaagcatgctgataaagagaagcacaagatggagaaggtcattgctaggatcaacaaggagcaaattatatgcagagataggatgctactgtttgtaatcagtatgtgtgctagcttgtgtgtcatcctgtttgcagtagcaggaaagtagtagaagtgggatgatgtttgcagtacgaggaaatgagtttgtattatgaacatgatctatgtgtaaatggcaaatgatatgtttgtgcgtttatnnnnnannnnnnnnnaa

SEQ ID NO: 23278 - DNA, 247 bp, Triticum aestivum
  unsure (1)..(247): unsure at all n locations
  Clone ID: PAT_TA_23278
acagctcatacaatggttagggtgctggaccacgctgtggctggaggcattgccgccggacccctgcagcactcccccgggaccgtcgtgggtctggttttcgtcttcatggccgcggcagcgatcgtggcaattgccgtgttcggctgcgccgacaacggggaagggggaaagccgacacggngccgcaaccactggggaggcggtggcgcangaggtggcgcangttgcggangaggattgggtg

SEQ ID NO: 23279 - DNA, 729 bp, Triticum aestivum
  unsure (1)..(729): unsure at all n locations
  Clone ID: PAT_TA_23279
gttgcacccgtccttgcaaagcaaagctgctactagagtctagactggtaacatgaagctattctgtgatgaagtgctggcaactgttgtgcccatagcagtgtactgggtgtactccggcgtgtacatgtggcttggccagtgccagtcaatggacaggtacaggctacaccccaggaaggaggagaacggcaagaacttggtgtccaagcgcgacgccgtcaagggcgtcgtcctgcagcagctcctccaggccgccaccgccgccgccatgttcacccttgtaggcgagagcaccgcgacggccaccggcagagcaccgcagcggacctggaccgggacgtgcttgacggtggcgtgccagatcggagtggccatggccgtgctcgacgggtggcagtacgtgtggcaccggtgcatgcacctcaacaggttcctgtaccggcacgtccactcgtggcatcaccgcctcgtcgtgccctacgccttcggcgcctgtacaacaaccatcgagggctcctcctcgacaccatgggcggcgcgctcggcttcctcgcctccggcttcccccccccctccccttcttcctctgcccgctcgcctccgtcacgcgcgtcgcccccgactgcgcacgggctgccggggaaggttcaccggtgcttctggnaaanacgggtacacatttcacaacagtgccactatggatanaatttcgaacctcttcggaaa

SEQ ID NO: 23280 - DNA, 646 bp, Triticum aestivum
  unsure (1)..(646): unsure at all n locations
  Clone ID: PAT_TA_23280
ctcgatcgaaacaagtccttggtaatatagccatggatttcttgccaaagacaagcacgatggcatcgtcgccggagggggcagcggtggtggacgcgtacaagaaggcgctcgccacggcggccacggtgaagcgcgtacgccatgctggcgcgcggcatggcgcgggaagctcctccccgacgagatgcgcgccgcggtgcgcttgggccgctgcgttcgtgcgctcccgctacaagcgctcccgaagaagcaacggcatacgattgtcatcccggcggggtgctcggcggcgttccgcctccggcggcgggtacaaccaagaaacgacctgtttcgacccggcgctcaccttactgggctaccaagattaaaccgcaaaagcaagagccggtctcctcgccgcgcaaccgcaacaaaggaacccgcgggaagcgccagctggacaacctcctgaacatgganaacgggggtcaacaacgacacttccaagnnttaattccgtggccgtcatcaaaacggggnaacggggnaaaataaggccaagaatcctggagtaacttcaaccgggcaanggnangggctcaaantactgccttaacattcaagggggggacttggtgaaaacnccctaaanttctanaaa

SEQ ID NO: 23281 - DNA, 570 bp, Triticum aestivum
  unsure (1)..(570): unsure at all n locations
  Clone ID: PAT_TA_23281
ccgaggtgtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactgggtgtgaatgttgcggttatggttggtggattccccaggaaggaaggaatggaaaggaaggatgttatgacgaaaaatgtttcaatctacaaagctcaagcatctgctcttgaagctcatgcaagccccaattgcaaggntttggntgttgccaaccagcaaacacaatgctccctccgaaggagttgctcatcatcctgagaagaaatcantgttgaccgccagacacacaggcatcgtagattcnagnactnggtca

SEQ ID NO: 23282 - DNA, 866 bp, Triticum aestivum
  unsure (1)..(866): unsure at all n locations
  Clone ID: PAT_TA_23282
ctcagaggaagcagcatcaggtgcaagaggtcaggccgaaggctggcacacattcccctctccctttctgctttcctcctcctctccagtggaaaggaaaccagagaacgatgccctcctagaacacactccaaggatccccaccgagatgtatatagcctcgtggcaccaatccattggttgcgacaggaattccgccggcggataatcagttagcatcatcctgtcctgctctgctctgctggtctagctagctagcccggtccatgcaaatgccgttctgccccaagctgtgggatcggagcccggtcccgccggcgaacgccatcgccgtcaatggcacggtggtcgtcgccaacaccttcggcctctccgcgcccggcaagtccaccaccctgcgcctcttcagcggcacccaaatcgaccacgagacggggaaggggaagctgagcccggaggcccgctgaggggcggcaagaagaccaagcacgggaagacgaccacgccgccgcacctcgcctcctgcggggcggacgccgaccccggcgccccgccgcccgtggccgcccgccaccggtcccgcgccctccggtgctgccgccgccccgcgccgctggagcccgcccgggtccgcagcatccacttcgagtgcaactcctgggtgtacccctacaagaagaccgccgccgaccgcctcttcttcgtcaacacgagctacctgccttccaagacgccgganncgctggtgctgctgcgggacgaggagctgcggagcctgcgaggggacggcaagggagagcgcaaggactgggagcgcatctacgactacgaccgctacaacgacctcggcaaccccgacaacnnnn

SEQ ID NO: 23283 - DNA, 780 bp, Triticum aestivum
  unsure (1)..(780): unsure at all n locations
  Clone ID: PAT_TA_23283
cagggaagtcagctttcctcccccgccggccgccccgcgcactccaccagcacgcacaagacagaatcaaccgacccgcagcccgaaacccacgacagagcaccatcatgtccatgtccacctcgccgacgcggctccggttcccccagtagggcgacgcatatatggcgctatggctcgcgctgctcctcggcgtggccctccccgccgcgacgctggtcgcggccgcgtgctacgcctaccggcggcgccacatgccgcgtaacgcgccgccggagctgccggtgggtgctcgtgaagtcgtcggcgcggacccgtcggtgagccccgggctggccgaaagctcaacgccaagtacaccgccagcagcggccgcgtgggcgtccggttccagcagttgcaccaccaccaccatctccgcgccgactccaggcaccggggaccgggcggtggcccgctgcaccagggcccgttccagtnggggcgattacccgcgcctgggtgatcgaagcggcggancacgggtggggcgctcctgtcggccttgcccctccccgccccccccggggccccgcccccgctgcggtctgccgcccgccttcccggggcgcccctgctcgggggcccgcggacgcccgtgggtcccgcccgtgaagtntcggtaaccgtgcgcggcacgggcccnctcaaaagaatggtcagancttcanccntcgaaacnagnttgaacaaaaggtttgaccaaatgaancccccggcccataagaancttccaagccn

SEQ ID NO: 23284 - DNA, 571 bp, Triticum aestivum
  unsure (1)..(571): unsure at all n locations
  Clone ID: PAT_TA_23284
ctcgtgccgaattcggcacgagctcgcgccgaagtcggcaccggatcacatctaccactatgcctccaaagatcgatcctaacgaaattaaggtgatccacttgagagctactggtggtgagattggtgcttcttcagcccttgctccaaagattggtcccttaggactttcccctaaaaaagttggtgaggatattgcaaaagctactggagactggaagggtctacgtgtcacagtaagattgacaatccaaaacagacaagcggcggtctctgttgtcccatcagcttcatcactgggtcattaaagcattaaaagagccaccgcggggacaggaaaaaagtaaagaatattaagcactccaaattccgataactcctggatngaaagtgattggacaatcgccccgaaactatgaanattcaaagtccgctcctcaaaaagaactttaaaaggaggtggttaaangaaaattttggggcanctgcatctctggtgggtgccaagtccatggaagaatccgaaagatncaatgatgattcgacagtggagaatagaatccggatgaan

SEQ ID NO: 23285 - DNA, 990 bp, Triticum aestivum
  Clone ID: PAT_TA_23285
cgcccacgcgtccgccacgctcactccttcttccacacacgcagagcacagcacaggaaagcggagaccttcgacctgccagctgcatgatggcaaggcggcagagaggattccggctcggccggaagctgctcggcctctggcgctgggcgctctgcaaccgccggcgacgcggctacgcccgcctgcagcggtgccagctgggagctggcgcaaagccgtcccacgcggccgtcgggagcgccaagctgcagcagcagcagcagctggtggtgctgccgcgggagcgggacgagccccggcggatgctggggtggggtcggtcgctggcgcggcggatgaggctcctgccgcggcgtggcgagcggctgctggaggacgccggcgaggcgaccacgcccaaggggcaggtggcggtgtacgtgggcggcgacgagcccggcggggagtcgatgaggtacgtggtgccggtggtgtacttcaaccacccgctcttcggggagctgctgcgcgaggccgaggaggagttcggcttcgagcaccccggcgggatcaccatcccctgcgcggccacgcggttcgagcgcgccgccgccatggccgccgccggcggcggcaggaaggcgcccggctggtggtagcacggcgcctgcagcctcctgtacagtagtacatgcatacacatgcgtgctcgattgaatagatagctggatggatgtgtgtattttttttacctgtttgacttttttttcttttttctgggtgtttgcgggcgctcatgcgatgcgatcacgcgagtttttttagttttagagaagatggaggagcgacccgggcgaggaggccagatttgcttccagcctctagctctagctcaacatgttccccaacttgcatggtgatcgtgtgcgtcctgtatgatctctggtggccgatctagtaggcagccattaatttgctgcatcgatcaatggatcatggctgccaatt

SEQ ID NO: 23286 - DNA, 1190 bp, Triticum aestivum
  Clone ID: PAT_TA_23286
cttcattcagtgttggagggctattgagggggcctcgcacctttttcacatttctgggaatggtactaaccagaattctgaatttcgcctatgggggcatgaagggcctgtgacttgtctttccttggattcaacaaggatttacagtggttcttgggatatgactgttcggtccggggacagagccgagatgaagtgtgtgcaaaagttcatgcatgctgactgggttttggccctggctcctcatggaaatactgttgccagtacagctggtagagacgcatatgtgtgggatatcggaaatggcgagttaacaactataatttccaatgcccatgttggtaatgcatattctgtagctcgaacacacctggcaggtgtgctgtttactggaggagaggatggggcaattcgcttgttcgatgtttctgagatatctgatgatgagaatattaaaccagctgccacttggttgccgcattctggccctgttcattctcttgcttttgagtacccatggcttgtttctgcctctagtgatggcaggattgcactaattgatttgaggaagatcctgacccccctaaactcatcaaagcgccgtttcagggttaagccctttgatccaagcaccgtagagcctccacagcgaatgcttcatggctttggatgctatcttttctccgtcggcatcggtgcagatagaatcatatgtggaggcgaggatggctctgtcagggtctggaacttctcggaagcactggagattgagaagaaggcacaggctttaaggagtctgagacaggagaaccgcatgaggcggaggaaggcgcaagtggagatgaatgcaaatggtagaagggttgaccattgctcagtagccatgaaaaggaacccattgaagggtgataagagtgtcacttggcaaatcaagcgtcccatcagtgacaaggtcaagtcttagattgggtatttgtacccttcgtaatataacatttttcttttccgattccatccataagctcggtttgctacatgtaggtcaacatttggcattttcctatattcaacttatatctggtgcaccgtggtcgcatttgatatgtatgcaattcttatttgacctggtgtacattgggtctaatggaagaaagtttccatgaaaaaaaaaaaaaaaaaaaaaaaaaaaa

SEQ ID NO: 23287 - DNA, 813 bp, Triticum aestivum
  Clone ID: PAT_TA_23287
tttttttttttttttttttttggagaaaaggattccctgagtgatttcgagcggccgcccgggcaggtttttttttttttttttaggcgatttcaaactgagttctttgatttattattacatcacacatgtgcgcgtattggcactacaatagatatttttttgcgagtataacaataaacatttataccgtgtagtagagtgcatgcattccccgggagtagagcaaagcaaaccactacaaatcaaccaatgctcacctctagccagtagcactaatccctcatataaactgtattaaagtaggccaatcggcatcgtcatgcttagccggacacagacaggcacgaggtcgacgacgacgtggccgtctccgtccacgtcgccggcggccacgcccggcctgtggcggcgcatgtggccgccgagcgcctgccccgtggggaacgcatggcggcacgtgccgcagcggtgcaactgcatcggggccctggccttccctgggcgcgcgccgagcaggagttcgaggccgtgcgcgcgcacccgcggccgctcgtggctggtccggtggccgcccagcgccttggaacgtggcgaaccggcgcccgccccccccgcactcgtaggccccgcccgccccctgcggccgcccacgcttgttcttgccgatcaccctgctagacgctgccggcgaagatagcttaagcagcagctctatcaacttgatcggcgactgtgtatcaccactggccacgtcctttgtcatactagcgagctagattaacgtgtacacgtgctgcttgcagacgtttt

SEQ ID NO: 23288 - DNA, 1399 bp, Triticum aestivum
  Clone ID: PAT_TA_23288
cgtgatctgcgtcttgcccgctcccgtctggccaatgctgagctgcagaagggaacaagtaattataacaggacagatgttgttgatgacactgtttttgataatgctgttgacgataggataacttctttagtggaggacatcatcaaagagcgttcagaagcaagcagcagtgaaggtggtgaagctgatggtgctaccattgctgcacttaacgatttcacaagctgtaacaacaatacaagcccattggatgaggacaccaacatagagcagttagaatctagtgaaagcaaaatccatggcgcttttatggctaagctcaaagatttgatgttctgtagtgatgatgtaagttcatcaaacgagggcaatgctcatcagctccaaacagcaagcaaagaatgaattcggtcagcttgaaggacgtgggtatggccagggctgcaagccctgaaaacggcgtgaaaggtcacaagctttaataacaatacaagaatggtggatgaggacaccaacatagagcagctagaatctagtgaaagcaaagttcatggtgcttttatggccaagctcaaggatttgatgtgctgtagtgatgatgtaagctcatcaaacgagggcaatgctcatcagctccaaacaccaagcaagaatgaatttggtcagcttgaagacgtggtaatgtcctagctgcaagtcatgaaaagaaccgacaataacaatagcagcgttgtgaatgagggacaagaggttttccattccgatgattgggcaggtcactttgaaacaaaacgacttggtcgaggggtgcaagatgagctgatccagaagactgatttgcctgatgacgctgggtccagggcccaatctgatgaagcggatagcaaaaccgcaagccaatatgtcagtgcattgcttgaagagccccgtgctgtctcagcaccggcggaacctgcaagagcgcaaatgcatgacgagcagctgagcagctcaccgccggaatgggagcacgtgctgaaggaggatttcttcctcccaggaaaccatttgaagtgaaaggcacctgctcgccccttggtttgatttgaaaatcctgtgtgttgtatatatatgttattaacttaaagtaatatgcgagccggagattgcgacataagttgcaggatcacccgtcgtagtacgtggttgctaaaactgaagcttcatgtagaaaataatctcaactcatggctcatactgagctttctgtaaatacacgctgtgcgtcctatctggttgtatgctttggaaggatcgtcatgcacttcacttgacacctatattatcgtaacatgaattgattgtgtgtgtgctatgcttacatttgttccttttgattaaaaaaaaaaaaaaaaaa

SEQ ID NO: 23289 - DNA, 923 bp, Triticum aestivum
  Clone ID: PAT_TA_23289
tcggcacgaggcctgatcctgtgaaatccttgaagttgaactttccgtcagcagcctcctcccttcaggatttgagcgccacaggcaacagccctctacatcctagtgctggtaggggtaatattcctgggtcaccagaagctgacctgtatatgaaaagcctgaatagagcatctccttcccacagtgcggtccaccagaactctgatgcacttgtgaatcgtcctggccatgaggcatccaccaatcagtcttcagattatgcaaatggctctgcaccagatatttcaaggctatctcttgcgagttctgaagcaagagaatctagtttggaagaaagacatgctggttccaatgtacaaacctcagaacaatcgacggatgaagcatttcaagcatctcttttgaacggtgattcacaggaccatgtaggcagctcttctgttaatgggagtcttcctaatagcggtcagcttgatggggaatgtgacgacgccaatgggatggtacgagttccaggtgataggacaaattacagtagtgatgcatctggagaagttgctgacggtgggccttctgtctcttccgcccctcaaagggaaaatgtaatgctcccaagattgggtgatctccgcatgagagggcaatttgttcggcggcaaccatctgacaggggattccctagaataacatctccctcgtccatggatgcccgaggtgatctttctgccattgagaatcaggtacgcaagctaattgatgatttgagaagcgattccatagaagctcagagatcagcaacatcagagatccgccttctagctaagcacaacatggagaacaggattgtcattgcataattgtggggctataaacttgctggttggtctccttcattcaacagatgccaaaatccaagaaaa

SEQ ID NO: 23290 - DNA, 615 bp, Triticum aestivum
  Clone ID: PAT_TA_23290
cccacgcgtccgtctttcttttccttccccacgaagccttgaaacccacaccgatctctggctctgtgcccacgcgaccacatttcttctcccctgcttttcggcagccgccgcccctttgtccacaaaatccacatcgccttgagtggggttcgccgtgaggcacttcggatgagatgcgcgctgccgggaaggtcgtcctgtgctgatccgccgccgcctctttccccggaaaatctacatcgccgtcctgcccgttgcggacaggagagcggggtggtggcgagggggagaggcgggttgattgggcggcgccgcgtcgcagtgtttgaggtggctagaggagggcggcgctgcgtcgctgtgtttgaggtggctagaggagggtaaactcctctcccactgcggaacagtccacggtgccgtcaccgtcgtcctgattccttggacgccaccgacgcaagcgacaagagaagctcggctcgaagcgatctcgtctttctttttccccgtcgcgcccttcgtttttcgtcgggttgttcgaccgaaggcgtcggatgaggaagtatgagaacgggcgaaaaaggagatggggaagggtggcgtgttatggga

SEQ ID NO: 23291 - DNA, 880 bp, Triticum aestivum
  unsure (1)..(880): unsure at all n locations
  Clone ID: PAT_TA_23291
ccccacagccaaagcagtagcttctccacggccgggagacatctcgacggcgagcgccgtgacctcgatttgctagcatgtccgagcaggagggtcctggacatcgctgcaagctggctcatccggctggttgtcttcctcggggagcgcgtcatctccgtggtcccccgcgcgcggcgctcgtcagcaaactgctcaccatccctgcggccatggcgtccctccgcccagtgcnggcngctccgtaggcgagctgcgcgccgtccctgaaggccgcagcttccgtcgcccggcgaggcgctccgtgggcgagctgcgggccctccctcctcggcggtcaccttcgtggccctgtttctgtgtgatcttaagtattgcggcatgtttccagtagcaagactatggttatgggcttctttaaattcgtatacattataaatcccgtttgtaagacttatcttcatacgtgcatcacaaccacatcgtgtcttgggcctactataactgaatttctccccccttttttcttcagcacggactcctattagttaaaattattttattagtcccatctaaaaatctatatgaccagaacaagttacaactactccataccttgacgagaacntgtgaatgtccgngttgtattgtactggaaatttttacttttatgatgattgcctcttcggatgctaaaccaagaatagctactgtatagaaggatnntgcntttcagataaaatgntcnatcttgggatctttcanctgtcgtgatgtgntgtanntttgacccnttaatatgcccttanatggtatacagaaggaacactttgtngatanaaccgtnatataangagagaagaggncncgaaggaagnaa

SEQ ID NO: 23292 - DNA, 612 bp, Triticum aestivum
  Clone ID: PAT_TA_23292
cccacgcgtccgcgaatttcttccccccttccggtggcgatctgcctccgacgaccggaaccacgtcgagcgtttgaccctctcctcctcctaccccctgcactagatcgaatcactcttactgcctggatcgggcctcccggagtagcggaggagaaggaacggcggggcttggagagagggctgggcgcttgcggcggcggcggcggcggcggcagcagccgtgcttgccggctacagaggcgattggggggtggagttgaggtggagcatctggctcattcgaggtccggccgagggcagcgatttgggggacagcagtgcacagtcgcagagctttggtgaacacaagtgactcaaaataccaatctctctggtggagcatgtactaaactgttagcggaagggttcgaggagtatgtttgcccgagcttgaaacctgatttactcatagctcaggaagaactggtgaagccatccacgtgtgtttggatattgattccattatattgcagcacagtctgtagttctgttgggtgatggaaaaaatgacctggtagaatgagaaggaattaaagaactgtttcaatgaacattctacaagaccttaag

SEQ ID NO: 23293 - DNA, 804 bp, Triticum aestivum
  unsure (1)..(804): unsure at all n locations
  Clone ID: PAT_TA_23293
tcggcacgaggccgactgggcggcttccccgcgtgctgcactcggggaagcctgacggcctcatggacgagatccccacattcgtcgtcgaccccctccccgccggcaaggaccgtggctatatcgtcctaaacaggccatgggcatttgtacaatggctgcagcgggcaaagattgaagaagagtacatactgatggcagaaccagatcatatatttgtgaaacctttaccaaatttagcttttgacaatgatccagcagcattccccttcttttacatcacaccatccgaacatgaaaaaattatcaggaaatactatcctgaagaaaggggtccaatcacaaatgttgaccctatcgggaattcccctgtaataattaagaagacactgcttgagaagattgctcccacatggatgaatgtatcactagaaatgaaagaggatcaagagactgacaaggcttttggatgggttttggaaatgtatgcatatgctgttgccagtgcattgcatggggttcagcatatccttcgtaaagatttcatgatccagccaccatttgataagaagctcgacaatacatttattatccacttcacctatggatgtgactatacactcaagggcgtactgacatatggagaaattggtgagtggagattcgacaagagatcataccaagataggccaccgccaagaaatcttacattgccccctccnaggagtgccaacaaacggggttacactggtaaaaagggcaatgaagctaccgcaaaccttcccnaggtggggatgatgggat

SEQ ID NO: 23294 - DNA, 454 bp, Triticum aestivum
  Clone ID: PAT_TA_23294
gaacccacgtctcgatcccatatcctctcgatcccgcacactggctcgcctcctctcacccatggccggcgccgccacgctcgtcctctccctcacggccgccggcgccgttcctcttcgcgcccagcttctcacctggacggcccccgaccccgcggccggccccgccgtctggacgtcgctgtcggacgccgtcatgggcgacggcgccgaccagccaccccgccgctggatcctccttccccggccggcgccggccatggcgaccaccacgcgtacaagtacaaaagccctcatgctccaatgagatccagcgagacaggttcgtccccatctagcccggtcagcgctcgtaccctgcatcgaccagatccactcgacgtcgtcgtacagatccgcacgatgtcgacggtcagtgttgaggagcgcctctgccaccactcctctgggatct

SEQ ID NO: 23295 - DNA, 991 bp, Triticum aestivum
  unsure (1)..(991): unsure at all n locations
  Clone ID: PAT_TA_23295
attcggcacgaggtaccaaccatcttcctccgcgggtcttacttcagcacggcgcgctactactcctagcacggagcagagcaggacaggacattaatggcgtccaagggcgagagggatgtggagatccacgtctcctccccgccgcccgacgaccgcgacgccgctaggcccttgctgcccgccgcctgcgaggcctactccgtctccgccgcaatcctccccttctttttcccagctctgggtgggcttctctatggctatgacatcggggcaacatctggtgccaccatatcgctcaagtcccccacatccagtggtacagcatggtacgacctgtcatcagtgcaaaccggcctcgtggtcagcggctcactctatggtgctttgatcggatccgccacggcattcaccattgcggattttctaggaaggcgcagagagcttgttgtttcttctatcatgtatttgattggagctcttctcaccgcagtggctcctaacttccttatcatggtggttggtcgctttttatatggcataggaattggattggctatgcacgctgctccaatgtatattgctgagactgctccaagtcagattagaggcatgctcatctctctcaaggagttctttattgttcttgggatgcttcttggttatatagtaggcaatctatttgttgaagtgatttctggttggcgctacatgtatgccaccagtgctccgatatgtgtcattatgggcatcggaatgtgctggntaccttgtcacctaggtggctctgtattgcaaacaaggaaaaggaaatngcgggaganaaagaaatgcncacntgctaagtcaatgagggcaagctcaccganttgnttcggacagncanttatcggaaaanccanacttgtnaaaaaaacaggtcatgantttnaggaattccaacaataaattgggggttggttttaaagccgggnacagttnaanancgaaa

SEQ ID NO: 23296 - DNA, 366 bp, Triticum aestivum
  Clone ID: PAT_TA_23296
gactccatccaggacaattcagtatggcaaagcgatgatgaatacagtgtgcaaatcacatcagaaacaagctatatatactcgacatgctagactcttcacagcgtcgcaatgattttgctctgctgaaattgaaatacggtagttcttctgtcattaatcattgttcttttgttattaggatgtcatccgcagcaggatccacaagcagggagggaactctgatcgtttgatcggaggtcagatagtgtgcgaggaccgcgagggccacctccgccgccgcccccaccaccatatggacccccaccaggacctccgatcccgaaggccaacacaataggaccggaatcctatgatgtcggcacc

SEQ ID NO: 23297 - DNA, 897 bp, Triticum aestivum
  unsure (1)..(897): unsure at all n locations
  Clone ID: PAT_TA_23297
accaaatccctcattctctcccgggcagccagccggcctttcttctcccgcacgacagccctcccgacgccgccgccgccgccgccgccgccggcgaaatggcgtcccgcatcgcctcccgcctcctccgacgctccagccccacattgggcctcctgaggagctatgcacatgtcangaaactacagcagtcaactttcaggtcttattccagttggtccccaaagctcaaagctgacaagaaggaacaattacttcccaaatgcctctccttaccaactctggagtaggtcattcgcatcagacaatggagacaagtttgaagctgttgtacctttcatgggtgaatctgtaactgatggaactcttgctaacttcttaaagaaacctggcgatagagttgaggctgacgaggccatagcccagattgaaactgataaggtcaccatagatgtttctagtcctgaagctggtgttatcgaaaagtttattgccagtgaaggtgatacggttactccaggcaccatagttgctatcgtatcaaagtctgcagcacctgctgaaacacatgttgccccatctgaggaggcgccccaaaaagaatcacctccagtaaaagctgaagagaaatcaccaaaagcagaagagaaacccacaaaagtagaacctcccaagaagcaggcaccaaagccaactccttcaaaaacctcccctacagaaccacagctccctccaaaagagcgagagcgacgggtgccaatgcccaggcttaggaaacgcattgccaaccgtttgaaggattcccagaacacatttgcaatgctgaccacattcaatgaagttgacatgaccaatttgatgaagctgcggtctgactacaaggatgaatttgtcaag

SEQ ID NO: 23298 - DNA, 479 bp, Triticum aestivum
  Clone ID: PAT_TA_23298
cattgcaaacttcaggaatgacaaagaaaacacaggaaaacacgaaacaagcataaacagtaaaaaaataaaacacttcaatccacattaaacacgctgaccataagttatacatgttcagtcgcacaaataacggcactgcgaataaatttagcgtgctaatcatggtttaacagcggaaatgcttactaaggtagaaatccagcaaggataatcatttacttccattattaacatgtatctgtgtaaatcatccatgccaaaatgtgttgctgctgggatagtcactactgaaacttccaagatcaacttctttgaagaatttcattggctagctttaggaaacctgcaaagcaaaaaaacaacaacgtagtcactatacaatataaattttaaactatatataagcacatatatttatttatatccatgttcccaatgaaatagatgcaaacataataagcacacacctgtttgtg

SEQ ID NO: 23299 - DNA, 402 bp, Triticum aestivum
  Clone ID: PAT_TA_23299
ttttttttttacaagggaaatgggcttgtgtgaggatcatgtgacttgcccattggcagtcacactgtaacatgcggccatatatcagcatccaaaccatatccaacggacagcgtcgctctaaagcaaaacatccttcacacttaaccccgggcatctatccagcacaactgaacaagaaaaatgcttcagacgcgtgcataattgactagtagcttctgcatgttatccagcctcctgtggaaatttgccaagtcctccttgctacgcctctcagctaaatccatatcatccaaattcttggatatatccttcatactctggtcaaactctgcagtcatgcgctttatttcctcacgctgtttggccagcgttttatcatcatcagaataaaccacttgc

SEQ ID NO: 23300 - DNA, 423 bp, Triticum aestivum
  Clone ID: PAT_TA_23300
agggagcgtgttgaggagaaagaaggcattcctcctgtgcagcaaaggctgatttatgctggtaagcagcttgcagatgacaagactgccaaggactacaacatcgaaggtggctcggtcctccatcttgtccttgctctgaggggtggttactagttaagctgtaatggaaacgcttgcgtcctgagagaagtgaccattggtggcatggaacctgtgttgcaaagagataataacaaactagctttgcttagtgggaggggctgtcttccatgttatctgcctatatgatttgacaaaactactcgcaagtttatctgcctctgttattagctctgccatatatcatctgaattttgggttgtgtctctgtcactctttcctgaattcaagattgcaagttccattttagggctaaaaaaa

SEQ ID NO: 23301 - DNA, 721 bp, Triticum aestivum
  Clone ID: PAT_TA_23301
acgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacgggggcggttcgccgcccccgacgtcgcgagaagtccattgaaccttatcatttagaggaagggcatactgtacatcgatgaggtcataaagctgaagccggggaagaagcagcagaagaagtaacacatgggtgagcttccccatttgacttctagcctgttgttaagacgccgcgctgcatttgtggttccgcagatttcatgtggttttctctgtgccggattttggcaggccccggtaccaggctggacctagtaataatactctgtatgcgacgtatgtgaaacgtctgatgaatttgttgtatatgacttgcataccgtggggggatcggcggattccaac

SEQ ID NO: 23302 - DNA, 716 bp, Triticum aestivum
  unsure (1)..(716): unsure at all n locations
  Clone ID: PAT_TA_23302
ggcagagttataaaagggaagggaggtgccactttaaaagtattcccctacaagggcatctgctaaagctgggacactacgttgagttcttactgtgatatgcaacgtgtcctttttgaagaggaacaatcagcatataaccaagctatgcttcaagaatatttgtgatgggaaagatgcacccacttacatctatgcaccacacctccacatacaatgcttctctatgcaaactgatggagtactgcttgaccccagctataactgtgcttcaaggaccgttttgaaagaaaacgaacttccggttgggctatgctagtggaggagcataaacaactggaggccgagcagagcacgaaaactggtctcctcaccgtccgatgcccggagggactaccaatgggcatcacttcgccaaaggggccaaggacaattaccttcaagcaagacaagggggcctataaccctaacacaacaccngaggaagtccctgactcngccttgctccccattcttcatgggggatatccgattcttggcctgcctgatcttctggaacgcaaactgtcctcancgtangggtgaatccaatcaaattcataccatctccttcaacgctgcccgctgtcctcgtggaataacatcanatggtcctttgcttgtgttgcctccaaanctttgccgttcccaacttnaatttncccnggcnaaatttc

SEQ ID NO: 23303 - DNA, 547 bp, Triticum aestivum
  Clone ID: PAT_TA_23303
ctattggaggcagtagaggcaccaatggagcccccacttcaattttccgaaatcacaaaagactaaccttaatatcttaattgtagagtcctagaagattgaaatctgaagtcggagtactagcaatatggaattaaccacctagcctggccagatgtagttgcatgctgtcagtttaaaacagtactccctccgtctcaaaattcttgtcttagaattgtctagatacggatgtatctaatactaaaacgtgacttgatacatccgtattatgacaaatttaagacaagaattttgagacggagagagtacttcagaagattgaaatctgaagtcggagtactcactactactcacccatacatgttcattacattgcctagcaactaattaagtactactccacttacatataagggtagtcatcatcatcaacatcttagctgccatacttgttttctcgttgttgtcatcactcatcagcatactatgcaacttatgcagttatttaccaacaaggcttccaccaagcatgcctgactttcac

SEQ ID NO: 23304 - DNA, 460 bp, Triticum aestivum
  Clone ID: PAT_TA_23304
aagcaagtggtagaggttgagccatggcagctccgagagcagtcgtcctctgcgtcctgctggcggtcgccgtcgccaacgccgaggcggcgtcggtcatcgtcggcctggccaagtgcgccgactgcaccaggaagagcatgaagtccgaggaagccttcaaggctctgcaggtggcgatcaagtgcaagaacagcgctggcgagtacgagagcaaggccgtgggcgccctcaacggcactggcgcttttagcgtgcccctggccgccgacctccacggcgccgactgcgtcgcgcagctccacagcgcgtcctccaacgcgccgtgccccggccaggagccgtccaagatcgtgccggtgtccgagggcagcacctacggcgtcgtcgctggcgacaacaccggcacgccgtccgcggcgtcgccggagtgcgcgttcatgtccctgtgccggccgat

SEQ ID NO: 23305 - DNA, 653 bp, Triticum aestivum
  unsure (1)..(653): unsure at all n locations
  Clone ID: PAT_TA_23305
aaaacccaatctcactgaccgtccacaggctctaccatcatacaccagtttccaatctccagggtatcaccttatcaggaacgcagcaacatcactcgaatccaaacaaactacacctccgttggaaaaacatttcaacataagttggaacaacacactcaaagctcagtctttgtattgaactgtggagccatcaagcgatgatgaaagggagcacagtcaacatgaatgcctcgtaactgaaagttgcagacccggagtaagacgtgtccttctccttgaacttctcagtcagaccctacagacgtatgaaaccaattagcgccgtgaactacagaacgttaatgtgtttgtttgtgtagtataatgatgatgggaaataccttgaccgtaaggcaacacctgcatatagacaaaacaaaagaaagaattaggaatgttataaaccaaactgaaggatccaacttatcgaactgtattttcacaaaaccaagcagaaaataaggagtccaatagattggcagccatttttttcatttctgaaacttcagaacagttgggcacatctttaattcacaaaacggaagaagccgactcaacaatttgagttcatgagataatagaagtaccagcaagtcacagacaatnactac

SEQ ID NO: 23306 - DNA, 766 bp, Triticum aestivum
  Clone ID: PAT_TA_23306
cacaaacgccggctcgctctcgctccgtctccctccctcctcccccgctccgcgccctccgccgccagatcccgacgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgtgcggtcttcgtcgatcttgagcccaccgtgattgacgaggtccgcaccagcgcctaccgccagctcttccaccccgagcagctcatcagcggcaaggaggacgccgacaacaacttcgcccgtggtcactacacaattggcaaggagattgtggatctctgcctcgaccgcatccgcaagctggccgacaactgcactggcctgcagggcttcctggtcttcaacgccgatggtggtggaaccgggtctgggcttgggtcgctcctccttgagcgcctgtccgtggactatggaaacgaagtccaagcctcgggttcaccgcgtacccatccccttaagtgtcgacctctgtggtcgagccctacaacagtgtgcctgccacccactcccttgtggagcacaccgatgcttccatcctgctcgacaacgaggccatctacgacatctggcagcgctcctggacaatcagagg

SEQ ID NO: 23307 - DNA, 686 bp, Triticum aestivum
  unsure (1)..(686): unsure at all n locations
  Clone ID: PAT_TA_23307
ccccctccagccccctcgcgccccagccgacgccgccgccgccgtcgccgncgccgactgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaagagggccggagagctttccgcggaggagatggaccgcctgatggcggtggtgcacaacccgcgccagttcaaggtgccggactgggtcctcaacagaaagaaggactacaaggacgggaggttctcccaggtcgtgtccaacgccgtggacatgaagctcaaggatgaccttgagaggctcaagaagatcaggaaccatcgtggtctgcgtcactactggggtgtgcgtgtccgcggtcagcacaccaagactaccggcaggagaggaaagactgttggtgtctccaagaagcgataagctgctttacaaagattcctcatagctttgctactactgtgttgggccaatttcagaatcttaagggaggggtcttatttagatgaataccttggatgatggtttgccctagataaggttttggttctggaacctttaaaatatggatcttgaattctttgg

SEQ ID NO: 23308 - DNA, 643 bp, Triticum aestivum
  unsure (1)..(643): unsure at all n locations
  Clone ID: PAT_TA_23308
gccggctctcccccgctccgtctccctcccccctcctcccccgctccgctccctccgccgccagatcccgtcgagcccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgcgcggtcttcgtcgacctcgagcccaccgtgattgacgaggtccgcaccagcgcctaccgncagctcttncaccccgagcagctcatcagcggcaaggaggacgcggccaacaacttcgcccgtggtcactacacaatcggcaaggagattgtggatctctgcctggaccgcatccgcaagctggccgacaactgcactggcctgcagggcttcttgtcttcaacgccngccgcggtggaaccggtctggcttcggtcgttcttctcgacgcctgccgtgactatggaagaagccaactcgggtaccgggtccctccctcaggtgtaccctgtggcaggcctcaccagggctg

SEQ ID NO: 23309 - DNA, 489 bp, Triticum aestivum
  Clone ID: PAT_TA_23309
ccacacagccagccaaactcctcctctctctccgtcatctcagatccagccgccccttccatctcctcttccacaaccggccaccgtcccgatctgaaggtctccgaacagatcagcctcctccccaccacggcgtgcggcgaggagtccccggatcgctcgccgtcacccagtgcggtgcagatctgggagtccgccctcaccaagcattcgatgcgttgatggctcctagcaccagataccgcgacgaacgagctgtgttctgcctcctccggctgccgaggaccacggacgccacttcgtctcaccggctggctcagcatcagcaccgaccactactcacaggtaatcccccattccccgcttgccaaatctaggagttgtattactaggtaataaggattgggatcgcttcttcctgcttgcccataatttgtgttacagattgatatggattttgattgcaggtgtgcaaaattgttgctacgt

SEQ ID NO: 23310 - DNA, 555 bp, Triticum aestivum
  Clone ID: PAT_TA_23310
tttttttttttttggataattatacatgtgaagttcattaaaatatatagtagtatgttacagtaaacagggaactgaatccccttgttcaaaatcacaaactactgtaccaagctagctagctacgtaggcaatatatatatataagcaagtaatttacaatttcactttgtggattcagtacaacgtgtgcaaaataattatacagacgacccccaaaaacaatacatacctagtaaaagcttagctgaagcaaggcctggctaaaagatactccttccgttccaaattaattgtcgcagaaatgaatgtatatagaactaaaatacatctagatacatccatacctgcgacaagtaattcgaaacggagggagtacctacgtacgagcaccgactacatgacggcgcatgccgcgttggggttctcgtcggagaaggcggaggtgtacttgacctcggtggaggaggccctggcgagcggcgcggcgtcggggtcggcgacgacgttccggacgtagccgggaggcgccttcttgtcgtaggcgccgggggc

SEQ ID NO: 23311 - DNA, 420 bp, Triticum aestivum
  Clone ID: PAT_TA_23311
gccttaaaaccagtgacttataagtcatgcctgtttggttgtcacctgacttataagtcatctgagcataccttctcaccttgtttttttatgtaaatgttgtgggactcatgtaaaagggggtgacttataagttttaagttggggtggagcaacttatgacttataagttggggtgacttataagttactccctccgttcggaattacttgtctcggatatggatgtatctagaactaaaatacatgtagatacattcatttctgcgataagtaattccgaacggagggagtaggtccgtttgacaaaataagtcacttttacacttttcaacttataagttggtgacttatttggaaccaaacagggcctaacatacactagtaacatacacgtatttgtagactatgttactaccg

SEQ ID NO: 23312 - DNA, 481 bp, Triticum aestivum
  Clone ID: PAT_TA_23312
gggagcgccatgaacgtagtgggcagcctctgcgtttacgccgccatctgctgcaaggagggcgccacgccgaggtggcctggcagcagggtcgcctgggaaggcttcaccgacgcctccgacgcggacctcgttgccgagcacgagatctgggctgccgttgatccgttcacaaagaacgaggctttcaattgcagcaatagggatgtattcaagtggaagcagctctggccgatgctggctgatcatttcgggttggaatgggcagggtacgagggagaggacggccggttcatcattgccgacgccatggcccggaaggaggcggtgtgggcggagatcgtacaggagaacgagcttgtcacgacggagctcaaggagatcaccaactggtggtttgtcgacgccgtgttaaatttcgaggttgagcatttggatagcatgaacaagagcaaggagcatggattccttggcttccgta

SEQ ID NO: 23313 - DNA, 385 bp, Triticum aestivum
  Clone ID: PAT_TA_23313
gatcaagagcaatggctcatgatttccattattcgtctattacatattggcgtgacattgttcagtttgtcaatgacattgctgaatttgtgtgactgcgtaaacaatagatgtacatatgttacagccttacaggaagaaaaaaaaactcagttacaacttgcaccaggttcagagaagttgcaggcgcctagcccgcacttattccagacctatgccctttattctgttgctgagctgctaatattctcagaactactccctctgtccagaaatacttgtcatcaaaatggatgaaaatgaatgtatctagaactaaaatgcatctagatacatctatttcaatgacaagtatttccggacggagggagtatgagcccaagat

SEQ ID NO: 23314 - DNA, 405 bp, Triticum aestivum
  unsure (1)..(405): unsure at all n locations
  Clone ID: PAT_TA_23314
agttaaacattcatattgccctgattcagttggggcgttctcgatagtagcactttcttcagtattatcagttgagatgtcccagcaaatctgattctcggatgtatcgcacgtaaggccttctttgtctgcagatggataggatgaagcaagaggcagcaattacaaaaacaagggaactaaagaagctctctgaggcaacgctttcatctatgttcgatagcagaccagtgcatataatcggagagattaataatttactgagttcaagtgttagtcagttagctgggtgatttgattgattgtaccttcgtccctgaactaaaataaacgatatgtaaagcaggttgaatatcttatggtatatacttttgcaacgtgtagtccttgttctaaanggggggg

SEQ ID NO: 23315 - DNA, 267 bp, Triticum aestivum
  Clone ID: PAT_TA_23315
tagcgtggtcgcggccgaggtacatatgttacagccttacaggaaaaaaaactcagttacaacttgcaccaggttcaaagaagttgcgggcgcctagcccgcacttattccagatcgatgccccttattgtgttgctgagctgctaatattctcagaactatgatttgttgagcccaagatatgcaggacctggtagctcatattgcctgaacttgagttcctaaactacaaggatctgttggagttccacctgcccgggcggccgc

SEQ ID NO: 23316 - DNA, 462 bp, Triticum aestivum
  Clone ID: PAT_TA_23316
gcacgaggcaacaaggcgccttcctcgccctcctcaagcaagcgagaagccaagtcacgaagatggcagggcagttgaaggccaagatcctcgccgcggccgccgtcgccgtggtcgtcgcctcgtccctggtcggcatggcctccgcggccgacgcgcccgccgtgtcgcccacctccggcgccaccgccgcgccgcccacctccggcgccgccggcgccgccccgaccttcgccgccgtgttcgtcgccgccacggcgttcggctacctcttctgctaggcgtgcgcccatatggcgcccggtttggtgccgcggcgcgcgcgcgcatgctcttcttttctggcatttgttgttgtgggttcatgggcgttccggtgcaacttcgtttcttggttcgaggtctgtagttgatggtgtgtgtacagtgacgatattaaattgaattcatacgtttcatctt

SEQ ID NO: 23317 - DNA, 954 bp, Triticum aestivum
  Clone ID: PAT_TA_23317
agagtcataaaccttgtgcaagttggaaaacaaattttggcaaccttattatatgaaccaaacatgccctcagtggacattgtaaatgtattgacgtcccaacagtgagtcctgtatttctacttgagattgtgtctgcacatcactcttctccctagcaaactgaagaatattttgaaccattaagcaaggacgcatttttctctttggcttctattcgtcgagcttattttgctgaagacttttatgtctcaacatttgctgttactcatgagtcatgatgctcacctgcttgatagcctctgtcataatactcaattgtttttcctttttctctactgtaattgttttgtactctactgcatgagtctgacaatctaaccttatgcgaaatcttattatcttgctgcagttactcactattattttatagtatgaaaatcttagaatgcccgacaaacgtttcatataccatgaaaggctatgacgatctaacctcaagtgaaatggcaaaaaaattgtgcaacttttttatatgaaccaatcatgcccttagttcgacactgaaaatgtattcccatcccaacagtcctgtgtttcttcttgattactatatcaactgaaaagatcaatgccaactaatccgtattttcctcctgtgtgccctctagtatggactgaactcctcaggggactacacctacaacacactgggtcaaaatgcagcgcccccccaatgagaagcttttgtgtgacaggtgattaggaaggaagggcatgcatggccttgttggaagcacctgtgcagcatatttgtagtatattgtgatattccatggtgtaatgcacactacatacatttgtgcacccattcaccctgtcaatctcgactcattgtacatagttccatcattagtgaagattatatatgtgtggccctggttggctagttgg

SEQ ID NO: 23318 - DNA, 584 bp, Triticum aestivum
  unsure (1)..(584): unsure at all n locations
  Clone ID: PAT_TA_23318
caagaccatccggtgattcgctgcttgcaaacaacagctagtaaatcggtcaccgtgggggcggggacatgagattcagagaagagatgctgctgcctgcctatactagttcatatgtatccacccgcctagatctaccatactcacctcgtttcactgtcctactagtagttcctaggccattagctcctgcttgctttttttgctgcacaatgcttattttactgctagtgtccatttagcagtttttttactatgttttggcctagttttgttcacatgtataataagcatcctgaatgctcatttagcagtgtattaataacactgcttgttttattcacgtgtattcagattaatacactgtgttattaagctgcacaatgctcatcctgttggctacttgtcgatgttatccgcataactatnnnctgccatgtcttttccacttttcttttcgctttctgtaatgctaacttgacggtaaccctatagtttgttggctgttgcaacccnnnagcggtgcntccattttaacgcatgtactagtgtgctaaaacttgcaaaagncacaaatcttgagc

SEQ ID NO: 23319 - DNA, 782 bp, Triticum aestivum
  unsure (1)..(782): unsure at all n locations
  Clone ID: PAT_TA_23319
tggctacatcattgtgtacaagttcatccaagatctccatttttttgtaactgnaggagatgaggagaatgagctcattttagcgtcagttcttcagggattttctgatgctgttggcattcttctcagaaacaatgtagacaaaaggaccgcacttgaaaatctggatctcatctttttgtgccttgacgaagttgtttatggagggattgttctggaaacagatggaaatgtgatagccgagaaggtgtcaggccatggattggaaggagctgggtcgttcactgagcagacgataagccaagccctagcgacagcaagagagcacttcgcgaggtctcttctgaagtagtgtgtgtaggcatctttcgggttggcgatgcgcccagcattgaactcgtgtgtttcctcttgtagcacagtgcacctagtttgcaagaaagaaagaaagagcgagaaaatgacttgaatctttgcacgtgagttcgttcgttcgtctattgttgtggtgctcgtcgacattttgtcgcagagatgtactccctccgttcggaattacttgtcaccaaaatggatgtatctagaactaaaatacatctagatacatccatttcaatgacgagtatttccgaacggagggagtattaatgaattcaggttctaccctcgtgatctgaagtctctgtggagacattgtagtatagtactctgtttacatttttctcgtaatgagtgtgtttaccttgtgatgtttcaaactgattatttcccggacgcgtggg

SEQ ID NO: 23320 - DNA, 332 bp, Triticum aestivum
  Clone ID: PAT_TA_23320
cgaatgcaaacctggaagcgtggagaatcaggccttgactgccccactcgaaagataggatttgaattagtttaaccagaagcgaactgtgtacaggttactaacctgtgtctcgctcgcagccgcgccgggacccgtgtctcgctcgcagccgcgccggcacccgtggatcgctggaagcctcgccggcacccgtgtctcgctggcagccgcgccggcacggggggcaaagtttgaagaaacaggcctcgcacacctgatccgacggcaaactttgaagaaacagttcaaatccacatgatccgaatgcaaacctggaagcgtggagaatc

SEQ ID NO: 23321 - DNA, 726 bp, Triticum aestivum
  Clone ID: PAT_TA_23321
tttttttttttttttgaacacaagtacttcctccgttcataaacataagatgtttttgagatttcaatatggactacagacaggctgaaatgagtgaccaaacacactaaaacgtgtctatatacatccaactcagaaaaaagttactagaaaatcttatttgtgaacaaaggagtacatagctagactggacatctttgacatactacctccgttccaaattactctgtcgctgaaatggatgtatctagaactaaaatacatctagatacatccatacgtgcgacaagtaattcggaacgttgggagtacatttatacattcaaatcgtccatccaaagagcattaccgcaaatgcacggatccaacttcactttaagcagaacgcccagaaagatacatttctgcggtggcagtatgcaatgcagctccaattggaaggacatcctcgtcgacgaagaaatgcgggttgtgagcagagtggaccgaaccgactttctcatttctaatgccgataccaaacataacgccaggaactaactgttggtagaatgcaaagtcttcccctgccatgatcttctctccgggcttcaccttgtctggaccaagcaaacttctgcccacattctctacatgctcgtggagtctctcatcattgacgacggcaggataccttgggtgggagggagcccccaatatctccgtaactcccgtgcacctatgtac

SEQ ID NO: 23322 - DNA, 659 bp, Triticum aestivum
  unsure (1)..(659): unsure at all n locations
  Clone ID: PAT_TA_23322
tttttttactagagtagtataccataacttgttcgaatcctccaaatggcttgtccggtcagcaaagcagtacgtactaataacaacacaaagtgccagtattatacagccggtaacagagctagtggcaaaacaactctagcaaccgtttcgatacagctgggacgatagctacgctcagatcaaggtcagccctgaagcactgcagcgccatcatgcgatgaggaaagggagcaccgtcagcatgaacgcctcgtaaccgaaagtcgcagaccccgagtacgccgtgtccttctccttgaacttctcggtcaggcccttcactgtgaggcagcattcaatgaagttgtcatattcaaccgctttgttcttgcccccagtcttgtcaaatttggaaacaagcaagtcgagcacagttggagaaacggaatatccaagatctagaagagcatcacgcagttctggtgcatcaattctaccacttcggtcacggtcaaacctctcaaatatgcccctccaattctgaaacgtaaacacanaatgaanccttggccatntccgacttgggttggtgaagagnaatgagagtgacgtccgaggtgaacctgntgcnaacanaancgcgaatcctgctcataccgcncttcggccgcgctgaa

SEQ ID NO: 23323 - DNA, 384 bp, Triticum aestivum
  Clone ID: PAT_TA_23323
ggtcatcagccgactgagcgcgcaatcgttttccttatttttacatctaaatcatctattgaagatgtctaacattagaacttactctgttcgttcggaattacttgtctcggaaatggatgtatctagaattaaaatatgtctagatacatctatttctgcgacaagtaattccgaacggagggagtagctaccagtgctaccccaagagaatcaatctaagagaataaacgaagaaactaatttaaaagtttgcgcattatcttccaaaacttgctgaccctcagtcagatctgcagagagcacgggcggcgcgcatcaacgccgccccggccgcgccgcgcatcccttgcttcctcctaggacgactcgccttggcccgtc

SEQ ID NO: 23324 - DNA, 549 bp, Triticum aestivum
  Clone ID: PAT_TA_23324
tgagcttctccttgctgcttacagccgagtgacggagtcagcctagctgccatgacatccgcgatgagctggtggtgggcgggcgcggtgggcgccgtcaagaagagccaggacgagagcgccgcgtcctccttccagagcgtcgccctcgtcgtcgggtccaccggcatcgtcggcacctcgctcgtggacatactcccgcgacaggacacccccggcgggccctggaaggtgtacgccgtctcccgtcgcccgcttcctccctggtgcccgccgccctcccccgccgtcacgcatctgcagatcgacctggccgacccggccgccgtagcagaggctctcacgccgctcgccgacatcacccatgtcttctacgccgcgtggtccagccacccgacggaggcccagaatcgggaggccaactccgccatgctccgcaacgtgctgtctgtcgtcgtcccgggctgccccgcgctcgcccacgtctgcctccagaccggccgcaagcactacgtcggccccttccgaggccgtcggcaagctagggtg

SEQ ID NO: 23325 - DNA, 450 bp, Triticum aestivum
  unsure (1)..(450): unsure at all n locations
  Clone ID: PAT_TA_23325
ctcgtgccgttcctcttttccccaaggcaaccaaaccatctcgattctcgactcgtggggaagtttcgctctcgccggcgtcgacggcctagggttcgaggaacgtccgtccgtccgtccggggaaggagcggtagggaaggcggagatgatcgaggtgggtgctcaacgaccgcctggggaagaaaggtgcgggtcaagtgcaacgaggacgacaccatcggcgacctcaaagaagtgggtggcggcgcaagacggggacgcgcccccgagaagattcgcatccaagaagtgggtacaacatctaacaaggaccacatcacctcaaaggactacgaagtccacgacggatgggcctccgactctactacaactnaaccgccgccctctctcctctcctcaagttggccgattctnatcatgggtcatcccttcccgtattcctnaactc

SEQ ID NO: 23326 - DNA, 652 bp, Triticum aestivum
  unsure (1)..(652): unsure at all n locations
  Clone ID: PAT_TA_23326
gcacgaggatcgatcgagcagccacttcacaccagcaagtggcagtagttcgatccagaggttcaagcatggcggctccgagagcactcgccctctgcgtcctgctggccatcgccgtcgccaatgcggaggcggcgtccgtggtcgtcggcctggccaaatgcgccgactgcaccaggaagaacatgaaggccgaggaagccttcaaggctctgcaggtggcgatcaagtgcaagaacagcgccggcgagtacgagagcaaggccgtgggcgccctcgacggcaccggcgccttcagcgtgcccctcgcttctgaccttcatggcgccgactgcgtcgctcagctccacagcgccgcctccaacgcgccgtgccccggccaggagccgtccaagatcgtgccggtgtctgacggcacaacctacggcgtcgtcgccggcgagaacaccgccacgtcgtccgcggcgtcgcccgagtgcgcgtccatgaccctgtgcgggcccgatcaagaagcacatcattgagcactttccaccataaagaagcccgtgccgcccaagccggaagcccaaagccccagccccacccggacttacgggccccgtgccccaagcccggagcccaaagccgcaagccccanccnggaattacc

SEQ ID NO: 23327 - DNA, 771 bp, Triticum aestivum
  unsure (1)..(771): unsure at all n locations
  Clone ID: PAT_TA_23327
cccaccgtgattgacgaggtccgcaccagcgcctaccgccagctcttccaccccgagcagctcatcagcggcaaggaggacgcggccaacaacttcgcccgcatcgaccacaagttcgacctcatgtacgcgaagcgtgccttcgtgcactggtacgtgggcgagggcatggaggagggcgagttctccgaggcccgtgaggacctggccgccctggagaaggactacgaggaggtcggcgccgagggcggcgatgatgaggatggcgaggaggacgacgactactgatctgctcgacggctcgacggaggatcagtctcctgccgcctatctttaactacatgttgctgtgctgtcctgtcttggaaacttgtgtctgggtgtttgggttgttaagccatccatcggtgctttctatgtcgctgttgaactgcatcattagtacgagaagacaatctcttctacacatctacgaagcccctgcgtcttgtgctttcctgactgcaaggtcgtctttaactgctcccatcttgctgcattcacatcttcttttgagatggaggatcgtctatttccttgccatttatcatggagctcactagcaacattttcgtctggaataagttcaagtatcttctggcacctctcctcagatgcaaatagttgttggctatgtaacagcttgtcttcaaagaagcatttcagaacatcggtgtatgaccgtgcaggaaagggtgnnnnncaggcccagncnncgaaacnnnnttcagt

SEQ ID NO: 23328 - DNA, 913 bp, Triticum aestivum
  Clone ID: PAT_TA_23328
ctcgtgccgtcgctatttacttcccacagcaagtagtggagttcgattcaggggttcagccatggcagctccgagagcactcgtcctcggcgtcctgctgctgatcgccgtctccaacaccgaggcggcgtccgtcgtcgtcggcatggccaagtgcgccgactgcaccaggaagaacatgaaggccgaggaagccttcaagggtcttcaggtggcgatcaagtgcaagagcgtccacggcgactacgagagcaaggcggtgggtgccctcgaccgcaccggcgccttcagcgtgcccctggccgccgacctccacggtgccgactgcgtcgctcagctccacagcgctgcctccgagggcaccaccttcggcgttgtcgccggcgccaagaccaacgtgttggcatcgccagagtgtgcatcggcgaccctgctcgggccgatcaagaagcacatcatcgagcacttccaccacaagaagcccgtgccaccgaagccggagcccaagccccagccccacccagactacggcccggtacccaagcctgagccgaagccgtagccccacccggactaccaccccatccctcccacgcccacctacggcggcggcggcggtggcggtggataccacggacaccactaactccgatctgccaccgtccggcccaacactgaaatttcatcaccgggttcagtgagtgatcgaggtcgttgctttggtcttctgccattcgctgccccgttttactatctgcactgcagagttgagagttcagaataaactttgtgaggaacacatgcatggattagtgtgcttcgattgcttttttatgattgtaatttcggtgtgtgctttgtataagcagttattgtggatcaagtgatttaatcaagtccatttgtgtcagtg

SEQ ID NO: 23329 - DNA, 800 bp, Triticum aestivum
  Clone ID: PAT_TA_23329
ctgatcgaatttcaaactgttaattatacatcggtctgttaattaatctagtacacatgcatgtgcaagaatcagaagaacaacaaggccgaaatcataggcaatatggatcatagactaatcacctactgcctctcaagcatctccgtatctctctgcctctctatgtacgtgtagtgtaatcgtctccggtgcacagatggactcctccccgcacgcgagctccggtgcccacagtcgccatgcgcacgctcgcacgaagggccgccggggctcgatggtctgtcggtggatcaggaggtgaccttggcgcgggtgcacggggcgaaggagtagccgtgctgctggtggccgccggcctgcacgtgcacgcggtgcgaggaggaggagtgcgagtgcgccgtctcccggtcgacgagcgcgcgcaggcggaggaattcgtcgacggagcagggcagccacagcgggccggccgagttgtagccatacgtgtcccgagccgcctccagcagccgctggaacagcgggtggtagaggtaggcgatggggatgacgaaccgccggaacccgtcgccctgctgctccgcctggccgacccgcaccgccagccaccccttcttcaccttccccctcttctccgcctggtccccttgcatgatgatggcagctccctcgccggcggtccaactgcagccgccctctcgccgtcgctgctggtggtggtgctggtgctaagagatcactgctctattgcaggcagctagagccaaggagccaatccagaggtgttgtggggcagt

SEQ ID NO: 23330 - DNA, 659 bp, Triticum aestivum
  Clone ID: PAT_TA_23330
attcggccgaggaatgattgagtcctggtgaggtcattgctggacatgcatggtctccgcaggcaaggaacacataaaagtaattcagcgtgttatcagaaactcatgagcatgaaagagaaatttggatcatgttcgaacatggtagagagcagatcgaggagaacttgaagattaaaggcaatgaaaggtatatgcctcgctagcacacaagaacagtcaggaccatgtacgaatcggacgaacagttggggctatgtcacaccaccaatcgaacagttccgcgccgggacctgtgtctcgctcgcagccgcgccggcacccgtggatcgctggaagcctcgccggcacccgtgtctcgctggcagccgcggcggcaccgggggcaaagtttgaagaaacaggcctcacacacctgatccgatggcaaactttgaagaaacagttcaaatccacatgatccgaacgcaaacctggaagcatggagaatcaggccttgctcgccccgctcggaagataggatttggaaattgtttgttgtatatggaaagagcaaaaatattagattaaactattgtttatggaagcttctcgtgacggaattttccgatatgattccatatgatttgatttgattggtgtcgtaaattgaaaaaaaa

SEQ ID NO: 23331 - DNA, 379 bp, Triticum aestivum
  Clone ID: PAT_TA_23331
aatggaggctggacgacgtctgccacacgagttaacatgccaggctcctgacttactttagttcatgtcttcatggccagcaagttgtcctggttcctgcatagattgtactccctccgttcggaattatttgtctcggaaatggatgtatctagaattaaaatacgtctagatacattcatttctgcgacaagtaattccgaacggagggagtaattttgtaggcagaattatacaagaacttttcggatgtcccactcatactttgcagaattttgacgaaggacttgtatgttttaacagaactctgttttacagagtagacactctgaataaattgctgacgaactttatttttgtaaaaaaaaaaaaaaaaaaa

SEQ ID NO: 23332 - DNA, 599 bp, Triticum aestivum
  unsure (1)..(599): unsure at all n locations
  Clone ID: PAT_TA_23332
ctcccttcctgcccccgaccgccccagccgccgccgccgtcgccgccgccgccgactgcagccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggccggagagctttccgcggaggagatggaccgtctgatggcggtggtgcacaacccgcgccaagttcaaggtgccggattggtcctcaacaggaagaaggattacaaggacgggaggtctcccaagtcgtgtccaacgccgtggacatgaactcaaggatgacctttaagaggtcaagaaatcaggaacatcgcggtctgcgtcactactggggctgcgttccgtggtcagcacaccaagactacaggcaggagaggaaaactgttggtgtctccaagaacgataactctgacaaagatctgcatacttgtatacgtttggtcattcanaatctaagatgtcctgttaatgatacttggatattttgccta

SEQ ID NO: 23333 - DNA, 885 bp, Triticum aestivum
  Clone ID: PAT_TA_23333
ctgcccccatcgtcgacatgttcaatgtcgccagcgcccgacatgatggacataagcagctaaagctgtagagatgcattaacccaaaaaccacaagataattcccaacgaaaaactgacaagagcatgaactcatttgtatacaccctctgttttctccacaagatattcctctgcttatgagttaacatgtgcaaattcatgaacaaattgaaaaatgcccaatggaagaaaacacaaaactgcacctctaaattggtactccctccgttccaaattacttgtcataaaaatggatgtatctagaactaaaatacatctagatacatccatatctgcgagaagtaattcggaacgaagggagtacttcaaaattacataccttatgttttctccttggtagcaattttctccttcaatcagtaaaggccgttttctaacagtacattagtaattgatgacttaatagcactgcatcgataatactatcaattggctttgttgtgaggtcaggatagtcaggtagaaacactactgcaaacgatggatgttcttcggtattggttcttgtgatacaaaactcaaacaggagaggaggctcttggatcttggacgaagaggagcatgatctcctggccgtcgtcatcatcggaaggtgaagatcttgggggtggagacgagatctgggaagtagtaggatggcgaccccggtcccgtcgccccatctggaggggcagagcgtcgaagggaggagggcagggggcgtcgcagtcgccggtcggaggaggcaggagcggtggacggaggcagaccagagcggtggacggaggaggttttccagtcgccgccgccgccagtcgttcacgagtgcgagacagaacgagc

SEQ ID NO: 23334 - DNA, 655 bp, Triticum aestivum
  Clone ID: PAT_TA_23334
caatggcaagatacatgttcccggacaggcaaacaatgcctatatcttcccagggtttggcctcggcgtggtgatgtctggagctatccgcgttcatgacgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttgggcaagtaggcgccctcggccaaaggacctggtgaaatatgcagagagttgcatgtacagccccatctaccgcaactaccgttgaattcggatcaactccagttatgtacaaatcagtagccttgcatcaactgcaagatttcctaagaatacaacttggttcagtcttccatgcttcaatacggctacctctaagctttctagcatagttgtttcacgtcctgttctgcccctatgtattccgcagtgtttatcttttgcgatgtgatgtaaaatagccccggttaggcttttggatcctagtcaatcatggcactgctgccgtccttccggagaaggataaatttggaataaagtttgaatcgacgattcctccgtcggtactgcgtctaaaaaaaaaaa

SEQ ID NO: 23335 - DNA, 742 bp, Triticum aestivum
  Clone ID: PAT_TA_23335
ggcgcctccaagacctaccctcaagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtaaggctacaccgagatgcttcattttgttagtttcttttcgttcagtagatcttatttagccttctctgttgtgttatttgttcaggtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttgggtgaaacaagtttgatccagatttgtgtgttttttacaccgaatgctcgaggtgctgctagtactttgttatctatctatctatctctattacaaaaaaaaaaaaaaaaaaggccccta

SEQ ID NO: 23336 - DNA, 804 bp, Triticum aestivum
  unsure (1)..(804): unsure at all n locations
  Clone ID: PAT_TA_23336
aagcacaaggcttcgagcgtatgctgtgcctatacgtgagcttcagtgccgagtgagccatagtagcctagcctagctgactcccgcgatgagctagctggtggtgggagggcgcggtgggcgccgtcaagaagagccaggaggagcgcaccgagctctccttccagagcgtcgccctcgtcatcggatccaccggcatcgtcggcacatcgctcgtcgacatactcccgcgcgacgacacccccggcgggccctggaaggtgtacgccgtctcccgtcgcccgctccctccctggtccccgcagccctcccccgccgtcacgcatctgctcctggacctggccgaccctgtcgccgtggcggaggccctcaagccgctcaccgacatcacccatgtcttctacgctgcgtggtccagccacccgacggaggctcagaaccgggaggccaactccgccatgctccggaacgtgctctccgtcctcgtcccgggctgccccgcgcttgcccacgtctgcctccagaccggccgcaagcactacatcggcccgtacgaggccatcggcaagatccccgtcccagacccgccctacaccgaggatatgccccgcctcgattaccccaacttctactacgaccaggaggacgtcctctttgaggaggtctcccgccgcgacggcgccgtcagctggtctgtgcaccgtccctccgtggtctttgggttctctccccggagcgccatgaatgtcgtggncagcctatccgtctatgccgccatctgccgcaaggagggcgccatgctga

SEQ ID NO: 23337 - DNA, 533 bp, Triticum aestivum
  Clone ID: PAT_TA_23337
acggaagcaggcaggcaggcaccccaacaactccactctccccccattatccccagatccagccggcgctccccccaccgcccgatctccacgccaccgccggccacctccgctctccgccccccagcaccacaccccgcccgaccgagcccccctctccccagacccgcgatgagctggtggtgggcgggcgcggtgggcgcggtcaagaagcggcaggacgagcgggcggcggcggcggagcccaccttccagagcgtggcgctcatcctcggctccacggggatcgtcggcacctccctcctcgacatcctcccgcgcgacgacaccccgggcgggccctggaaggtgtacgccgtctcgcgccgcgcgccgccgggctggtcgacgccgccgccgtcccccgccgtcacgcacctgcaagctcgacctcgccgacgccgccgccgtcagggacgcccttggcgccgctcaaccgacgtcacccacgtcttctacgccgcgtggcaagcacaagacgaggacgcaacggg

SEQ ID NO: 23338 - DNA, 686 bp, Triticum aestivum
  Clone ID: PAT_TA_23338
cggacgcatcctcctcaacgagcactggatccaggatctgccgtatgaccgcaccggagagctccagaacctcgtctccttcgtccatgacaacctcgacctctgcaaatgggctgctctcgctaccgttgccacccaggcactctcgcttttgttggcgatggttctacgagccatggtttcacccacgagtagcgactacgacagcgatgaagattttgtggtcataaggaggccgctgcttattgcccaaggtgctccatcctatctccctaccacggctgaccccagaggtgtccatccgaacctatggagctcatcaatgaggcagaagtatggactgaactcctcaggggactacacctacaacacactgggtcaaaatgcagcgccaccgcagtgagaagcttctgtgtgacaggtgatgaggaaggaagggcatgcatggccttgttggaagcacctgtgcagcatatttgtagtatattgtgatattccatggtgtaatgcacactacatacatttgtgcacccattcaccctgtcaatctcgactcattgtacatagttccatcattagtgaagattaatatgtgtggccctggttggctagttggaaagggacttgttgtcaacatttcgtttggatgggtttgttaagctagctagatagcagtttatcaagtg

SEQ ID NO: 23339 - DNA, 676 bp, Triticum aestivum
  Clone ID: PAT_TA_23339
attcggacgaggcgccgacgcccatcagcacctgcccccctcgccgtcgccgcctcgcctcgcgcgaccgatccaccgccgcggccaccatgtcgctgatcgccggtgaggacttccagcatatcctgcgtctgctgaacactaacgtggatgggaagcagaagatcatgttcgccatgacctccatcaagggtgtggggcgccgcttctccaacatcgtctgcaagaaggccgacatcgacatgaacaagagggccggcgagctgactcctgaagagctggagcggctgatgacggtcgtggccaaccccaggcagttcaaggtgccggactggttcctcaacaggaagaaggactacaaggacggcaggttctcgcaggtcgtctccaacgccctcgacatgaagctcagggacgaccttgagaggctcaagaagatcaggaaccaccgtggtctgcgtcactactggggcctccgtgtccgtggccagcacactaagactactggcaggcgtggaaagactgttggtgtctccaagaagcgataagctaacaacggcttatggcaacagcagcagtgaacaagccttaccttccaacatatcttatgaaaggtttctgtttagacagtttcctgaaattatgttttgccctaggataatcttgcagttatgga

SEQ ID NO: 23340 - DNA, 425 bp, Triticum aestivum
  Clone ID: PAT_TA_23340
ttttttttttctaccatacaggagtattcgtctagtatccagaaataaaaatttcaatcatatcctcgtactttatcttctccaaaaaattgttttcaagtattccctccgttcggaattatttgtctcggaaatgaatgtatctagaactaaaatacatctagatacatccatttctacgacaagtaattccgaacgaagggagtaactgactagatcactagatcattcaaatataagaacacaaattgagaaaggaaccttgctcttgtggagattaaaacgcaataggggtgtgggcgtgttcctgaatcctgactttctgtcttccggaatcctgatcgaagcaacgaacggcaccgggcgtgagggtgggcgtgtacctgttgctcttcatggcagcaagatgaccagctgatgggatc

SEQ ID NO: 23341 - DNA, 877 bp, Triticum aestivum
  Clone ID: PAT_TA_23341
aatcgaactagtgcgccacttttcatcagagttccgatgcatcgatgagcagataagctctactaggagtagtataccatacataacttgttcgaatcctccaaaagacttgtctggtcagcaaggcagtactaataacaacagtattatacagccggtaacagagctagtggcgaaacaactctagcaaccgtttcgatacagctgggacgatacatacgctcagccctgaagcactgcagcgccatcatgcgatgaggaaagggagcacggtcagcatgaacgcctcgtaaccgaaagttgtataatagaattgaccgtctcaatgaactttgctctttctattttgacactgtcctcatcagtggaccggtctttggtgccatcaaaacagagattaggatggtgcatccagagtttggtccaatttctggacacaatgctggtccttgcaacctctttcagtgaaagcagagacaatataacaggtcgaatatcctcggggaaatcctccatgtggaaggaggatagcccgggttcgtcgctgaggccgctgtggccctccgtcctcctccgcttggtcgccgcttcatcctccatactgctgcaggaagggaggcaatcaaatcaaacgaaaaatcacgggtcctctactgcaggaaataatataggcgactgacccgacgccgaccgcgaccccgaccccgaccccgaccctgattccgttccacacttatataggatttgctggcaacccctttccctttgaaacaggatactaggatttgtttggaacccatttccctttggaaaagggatctactaacctatcgggaaatggcggaggagaccagagaagagatcaaatcgatcgaga

SEQ ID NO: 23342 - DNA, 668 bp, Triticum aestivum
  Clone ID: PAT_TA_23342
ttatcactgcaaggggattatcccttctcttttttcaaggagttgactcttgtaagggtattgttttctcaggattatgctttctcaaggatcaacttaaactcataatgttagtcgcaatacaccagttgcttcacatttttagcaatcatcataggctgctgctcagcacctctcgagctcatctaggctactcttcgtcaacccagtcgtcctcctccgtcccatcatccagctccatcatatccccagcatcttctatctcttcttcctcttgtccctccttcacatcttcttttccaacagattgtgggtacaagatgtcgcccgagcatagcccagattcaaccttaactaagcgcatggtcattcttggtccgatctcttggagtctgacggcactttttcgggatgctctgttcaatttgtctatatcacttgctagacttacagtcgctgcttcatcgtctggttcactttctgatccatatccagcttttgtcacataatcactaacatctttaagatcccttaagtctggcacttgattgttctgcatgagttttctaatcttgcggctgaccccaacaggctgtagcttgattgagtaatgccggaaatcgatagcctccatctctttgtcatactgtagcaataatattctttga

SEQ ID NO: 23343 - DNA, 948 bp, Triticum aestivum
  Clone ID: PAT_TA_23343
gcacacaggcaagtagtggagttcgattcaggggttcaggcatggtggctccgagagcactcgtcctcgccgtcctgctggcgatcgccgtcgccaacgccgaggcggcgtcggtcgtcgtcggcctggccaagtgcgccgactgcaccaggaagaacctcaaggccgaggaggccttcaagggtctccaggtggcgatcaagtgcaagaacgtccacggcgagtacgagagcaaggcggtgggcggcctcgacggcaccggtgccttcagcgttcccctggcggccgacctccacgacgctgactgcgtcgctcagctccacagcgccgcctccaacgcgccgtgctccggccaggagccatccaagatcgtgcctgcttccgagggaaccaccttcggcatcgtcgccggcgacagcattgccacgcggtctgcagcgtcgccagagtgcgcgtccatgaccttgtgcgggccgatcaagaagcacatcatcgagcatttccaccacaagcagcccgtgccgcccaagccggagcccaagccccagccccatcctgactatcaccccgtgcccaagccgcagccccacccggactaccaccccgtccctcccacgcccacctacggcggcggcggcggcggtggtggataccatggacaccactagtgactccgatctaccaccatccggcctagcagtgaaatttcatggcttgttgctgtcagtgatgagcgacgttgctatttatgtcaggggttagcttgatcttctatcattcagaataagagttgtgagggataagtatgtgtgtcaggcaaatgtacgagtgatgggtcagttttttttacaaggtttgtaatatcggtgtgattttttgtaatgggaagtccctatatatctgaatgaaccaagtactccctccgtcttggtgtgtaagtcatctcaa

SEQ ID NO: 23344 - DNA, 1065 bp, Triticum aestivum
  unsure (1)..(1065): unsure at all n locations
  Clone ID: PAT_TA_23344
ggcacgagcattcatccatcagccacttcacaccagcaagtggcagtagtgcgatccacacaagtttaggcatggcgactccgagagcactcgccctctgcgtcctgctggcgatggccgtcgccaacaccgaggcggcgtcagtcgtcgtcggcctggccaagtgcgccgactgcaccaggaagaacatgcagaccgaggaagccttcaaggctgtgcaggtggcgatcaagtgcaagaacagcgccggcgagtacgagagcaaggcggtgggcggcctcgacggcaccggcgccttcagcgtgcccctggctgccaacctccacggcgccgactgcgtcgctcagctccacagcgccgtctccaacgcgccctgccccggccaggagccgtccaagatcgtgccggtgtccgagggcaccacgtacggcgtcgtcgctggcgagaacgccgccacgccgtctgccgcatcgccggagtgtgcgtccatgaccctatgcgggccgatcaagaagcacatcatcgagcacttccaccacaagaagcctgtgcccgccgaagccggaagcccaaagcccaagccccacccggactacggccccgtgcccaaagcccgagcccaagccgcaagccccacccggactaccacccagtccctcccacgccccacctacggcgggaggcggcggcggtggataccacggacaccactgagtccagtctaccaccctcccgcccagcgatgaaattggtaaagttgctctttaggtcgagctacgtacgatgaaatttcatggcttgttgctgttagtgagtgagcgacgttgctatttatgtcacgggttagctttatnttttacgtatcattcagaataacacagttgtgagggataagtatgtgtgtcaggccaatgtacgggtgatgggtcagtttttttacaaggtttgtaatatcgatcggtgtgaatttttgtaatgagaagttcctttttcaaaaaaaaaaaaaaaaaaaaaaaaaaaaaaaaaagggggggcccggtacccaattcgccctatagtgagtcg

SEQ ID NO: 23345 - DNA, 740 bp, Triticum aestivum
  Clone ID: PAT_TA_23345
aaacagaacctccagtcaacctgattaaacataagacatggacaacagaacagtattgttcggcgattataggctaagatatggaccccaactaatactccgttccaaattactcgtcgtagaaatggatgtatctagaactaaaatacatctagatacattcatacctgcgacaagtaattcggaacggagggagtagatgcaatgcaagtggcttgaaaaatgatcacaaatgttaccatccgccaggaaaatgtgctcttcagcgctgtaaaccaaatcaggccttgcctcaagcatgctaacttatttacatctctatgatcacaaatcatcgcctatcatcctgagataccatctccttgcaagatgcagatgaagcttatgggatttcgctcctgtcttctttcatcgtcccagaggatgatggttcaccgctagaatctggggaggcagctgcctgccgtggctcttccttcaaagaggtgggcatccctgaaatttccttcataaggtgcaaccggagatcagtcgggcgaactccctcaccaatgcacaccataacaaactgtgaatagttgaaaagaacatctgcagcagcttgcttcttctgctgagtctcatagtcatcctcggtgatcataggagtgtcttgtgcagccatttttttatatcttctaatccaagcagagcaggtgaatccggatcgaacaccccaatcagcgagagacccggccggc

SEQ ID NO: 23346 - DNA, 559 bp, Triticum aestivum
  Clone ID: PAT_TA_23346
gaattcggcacgagcaaacctggatatgaggtcaaggacgcgcgatcgaggttttgtacggtttgtagggagaaagggcaccccgcaggggtgatcttccgaaaaaacctcgcaaaatccctacctgcggcaattgcggtgtagctgggcacaaaaaaaccagttgtttcaacccggtcttgccgtttgtgaagcggcctcgcgacgggccagtagagtgatgttcggttcagcgcttgaagcaggtactccctccgttcggaattacttgtcgcgaaaatggatgtatctagaactaaaataccgtttagatacatccatttctgcgacaaataattccaaacggagggagtagttgaatccaaaaatccaatccagagtagttcgatttcctgcatttatgcttaatttgggactgtgatctgtttttccaataagctttgtgccttgctggatggcagtttaatttgaattcatgctattactcttatccttggcgtgtgattttaattttccaataagggatatcacaactttaaaaaaaaaaaaaaaaaaaaaa

SEQ ID NO: 23347 - DNA, 413 bp, Triticum aestivum
  Clone ID: PAT_TA_23347
ttttttttttgaacagataagctctactagagtagtataccataacttgttcgaatcctccaaatggcttgtccggtcagcaaagcagtacgtactaataacaacacaaagtgccagtattatacagccggtaacagagctagtggcaaaacaactctagcaaccgtttcgatacagctgggacgatagctacgctcagatcaaggtcagccctgaagcactgcagcgccatcatgcgatgaggaaagggagcaccgtcagcatgaacgcctcgtaaccgaaagtcgcagaccccgagtacgccgtgtccttctccttgaacttctcggtcaggccctgcaaaggtaattcagccaaattataaaggtaattcagccaaatgaacaccgtgaaatggaacaacatacagatgc

SEQ ID NO: 23348 - DNA, 813 bp, Triticum aestivum
  unsure (1)..(813): unsure at all n locations
  Clone ID: PAT_TA_23348
attgcaaatggtnagggacgtatggaaagtataatgttaagattaggaaggacacaagagataagcatcaattttgtctgcgtgctgtggaggtgcagtgcaatgagtcaggcaaggttcattctgtactccatatagagtatcctgattggcccgaccatggcgtaccaacaagcactgatgctgtgcgacaaattcaaaaacggttacatcacattccgagagaacatcctatagttgcacattgcagtgcaggaattgggagaactggtgcttacatcaccatccatagttcaattgagagaattctccttggagacacaagctcttatgatcttgttgaaactgtaaaaaaatttaggtcccagcgaactggaatggttcaaactgagcaacaatacatgttctgctaccgtgcaattgcggatgagctgaaagatctgctgagttcatcaggccattgaggtatttctaagaactggactgcttgtcgcccttgtatttccatagtaaaccgaagcatcttgttgcttgttgcgtttgttagggcaccagtgcattaagaccactatttcaacctggtctccaatattgttaagacaactgcttgttgaagaatcagtagagtttacaacatctggtggacccaagcatgtaaacagccctccgggaatcattcctcgaccaacagtagcagaatcatgggtccctttcccttgtggatgatttatattgtttcccaagacaccacgaagatgaatgccaggcgtatatagttagatgagaccaatgcatcgtnattgtatcgaaact

SEQ ID NO: 23349 - DNA, 656 bp, Triticum aestivum
  unsure (1)..(656): unsure at all n locations
  Clone ID: PAT_TA_23349
cgcacctcctcccctcctgcccccgagcaccgcagccgccgccgccgccgccgccgccgccgactgcagccatgtcgctgatcgcgggtgaggagttccagcacatccttcgtgtgctcaacaccaacgtcgacggtaagcagaagatcatgttcgcgctgacctccatcaagggtgtgggccgccgcttctccaacatcgtctgcaagaaggccgacatcgacatgaacaagagggctggagagctttccgcggaggagatggaccgcctgatggcggtgggtgcacaacccgcgccagttcaaggtgccggactggtcctcaaacaagaagaaggattataaggacggaaggtctcccaagtcgtctcccaacgccgtgggacatgaactcaaggatgacttgagaggtcaagaagataaggaacatcgtggncttcgtcacnactggggcgtcgtttccgtggtcaacacacaaagatacgggaggagaagaaagatgttgggtcccaaaaaggataactgctcacaaagtcccatancttgcacacgggttggcantcacaactaagatgtctgttaaacatacttgtaagtttccaaaaagtttgtcngacttaaaatgnctaatcttggaccctaaatgttgaaggctaa

SEQ ID NO: 23350 - DNA, 945 bp, Triticum aestivum
  unsure (1)..(945): unsure at all n locations
  Clone ID: PAT_TA_23350
gcacgaggctcagacatggcagtttcgagagcgctcgtcctcggcgtcctgctggcgatcgccgtcgccaatgccgaggcagcgtccgtcgtggtcggccaggtcaagtgcgccgactgcaccaggaagaacttgaaggccgaggaagccttcaaggatcttcaggtggcgatcaagtgcaagaacgtccaccgcgactacgagagcaaggcagtgggtgccctggaccgcaccggcgccttcagcgtgcccctggccgccgacctccatggcgccaactgcgtcgcgcagctccacagcgctgcctccaacgcgccgtgctccggccaggagccatccaagatcgtgccggtgtccgagggcaccaccttcggcgtcatggccggcgccaacactgccacgctgtccgcggcgtcgcctgagtgcgcgtccatgaccctgtgcgggctgatcaagaagcacatcatcgagcacttccaccacaagaagcccgtgctgcccaagccggagcccaagccccagccccacccggactacggccccgtgcccaaacccgagcccaagccgcagccccagccggactaccaccccgtccctcccacgcccacctatggcggcggcggcggcggtggataccacggccaccactgagtccggtctatcacccccccgccaagcgatgaaattggtaaagttcctctgtatcttagccatggcttgttgctgttagtgagttagcgacgttgctattcagaataacagttgtgagggataattatgtgtgtcaggcaaatgtacgggtgatgggtcattttttacaaggtttgtaatattaaatttttgtaacgagaagttcctatatctgaatcaaccacgtacactcattttcccaaaaaaaaaagggggggcccggtacccaattcgccctatagtgngtcgtattac

SEQ ID NO: 23351 - DNA, 909 bp, Triticum aestivum
  unsure (1)..(909): unsure at all n locations
  Clone ID: PAT_TA_23351
tcggcacgagggcagagtccttcccgagtgcggacagcgggctcgtaccagcagcgtctccctccgacctccctggagcagccgctccagcccagcaacgccgccgcccggatctacgccggcgaccattccatagaacttggagttgaaatagggcatcaacactgtcaattgcagaggcttggagctgcttcggcatccagtagagcaaacaagaaggtaaagtcggaaacaaatatttcatccttggaaggacttctcatcttgcaatggaagccaagttctttcggtttctgaagcttgttggagttggcttcaaagcaaggaccgagcgtgaaggccgcgagttgtttctgaaactgggctacagtcatgaggtgcagttcaccgctccacctgccgtccgcgtcttctgcttcaaacccaacataatatgctgtactggcattgacaagcatagagtgcaccattttgctggagctgtccgatgcagcaaacctccagaagtgtacaaagggaagggcatactgtacatcgacgaggtcataaagctgaaaccggggaagaagcagcagaagaagtaacacatgggtaacctccccatttgacttctagcttgtttagataccgcatcacatttgtggtgccgatttcatgtggttttctcgtgccggattgtggctagccccagtgccatgctggacttcgtaataatactctgtatgctatgtgaatcatctggtgagcatgtactgtatgacttgcataccttgggggcggatcagcacattcaaacatttgtgtttttgttttgggctggctagatgcatgtaacctactttcaatagcccagtgtgtttgttgatgtcactactttcttcatattttctctatacaatantagctcgt

SEQ ID NO: 23352 - DNA, 907 bp, Triticum aestivum
  Clone ID: PAT_TA_23352
agcgctcgtcctcggcgtcctgctggcgatcacggtcgccaacgccgaggcggcgtccgtcgtggtcggcctggccaagtgcgccgactgcaccaggaagaacatcaaggccgaggaagccttcaagggtcttcaggtggcgatcaagtgcaagaacaacgccggagactacgagagcaaggccgtgggtgcgcttgacggtaccggtgccttcagcgtgcccctcgccgccgacctccacggcgccgactgtgtcgcacagctgcacagcgccgcctccaacgcgccatgccccggccaggagccatccaagatcgtgccggtgtcggagggcactaccttcggcatcgtcgccggcaacaacattgccacgccgtctgctgcatcgtcgccggagtgcgcatccatgaccctgtgcgggccgatcaagaagcacatcatcgaacacttccaccacaagaagcctgtgccacccaagccggagcccaagccggagccccaccctgactacgggccccgtgcccaagccggagtccaagccgcagccccaccccgactaccaccccgtccctcccacgcctacatacggtggcggcggtggtggataccacggtcaccactgactccgatctgccaccatccggcccagcactgaaatctcatcaccgagtgcatgatcagtgtcagtgagtgaccgacgttactatttatcatcagttgcatgcatggccgcgtgggtattctttggtggtcttcggccattcgatgccccgttttagtatctgcactgcagagttgagagtgagagttcagaataacatttgtgaggaacatgtgtattttttttaaccgggctttttaccccttttcattgcaaagaacggaaatacaaccagttcaagctaaa

SEQ ID NO: 23353 - DNA, 716 bp, Triticum aestivum
  Clone ID: PAT_TA_23353
caaccaaggcttcgagcctgtgctgtacctatacgtgagcttcagtgccgagtgagccatagtagcctagctagctgactcccgcgatgagctggtggtgggcgggcgcggtgggcgccgtcaagaagagccaggaggagcgcaccgagccctccttccagagcgtcgccctcgtcgtcggatccaccggcatcgtcggcacctcgctggtggacatactgccgcgccacgacacccccggcgggccctggaaggtgtacgccgtctcccgtcgcccgctccctccctggtccccgccgccctcccccgccgtcacgcacctgcacctcgacctgttctttcctgtcgccgtggcggaggccctcacgccgctcaccgacatcacccatgtcttctacgccgcgtggtccagccacccgacggaggctcagaaccgggaggccaactccgccatgctccgcaacgtgctctccgtcgtcgtcccgggctgccccgcgctcgctcatgtctgcctccagaccggccgcaagcactacatcggcccgtacgaggccatcggcaagatccccgtcccagacccgccctacaccgaggatatgccccgcctcgattaccccaacttctactacgaccaggaggacgtcctctttgaggaggtctcccgccgcgacggcgccgtcagctggtctgtgcaccgtccctccgcggtctttggg

SEQ ID NO: 23354 - DNA, 796 bp, Triticum aestivum
  Clone ID: PAT_TA_23354
aaaaccccggacgcaacccacgaaaactagggctttgcacagggtttagcggcgatctctccccctcttcctctcgtcgacgcgcatccatggcggccgccacctcctcctccctcctcggccgccgcttcctcctcctctcccgccgcttcgtcgcttctcctctccgctccttgtccaccaccgcgcccccgtcctcacactcggccgcgggatccgatgccgagcccgaccctgagccacccgccgatcagggtaatcagtaccggagccagccgaggcctcccatcaccacccgccctctcgagaatggcctcgaccacggcatctacaaggctataatggtgggaaaggtgggtcaagagcctgtgcagaagcggctgcggagtgggaagaccgtcgtgctgttctcgctgggcaccggcggcatccgcaacaaccgccgcccgttggacaacgaggagccgcaccagtacgcggaacgcagctccgtgcagtggcaccgcgtatgcatctacccagacaggctgggtagcctcgcgctgaagcatgtcaagaccggatctgttctctatttggaaggaaatattgagacaaaggtgttctccgatcctataactgggctcgttagacgcataagaaaaatagctgttcgaggaaatggtcggtttctgtttcttggtaacgatgggaatgggcccaaagataagtgaagtgaaagggcgttgagtactttctgaaagttgggtccaacaaaatccatttgagaactgaaactgaggtactggacgtgcta

SEQ ID NO: 23355 - DNA, 1068 bp, Triticum aestivum
  unsure (1)..(1068): unsure at all n locations
  Clone ID: PAT_TA_23355
agccacttcacacagctaagcgagtggtagaggttcagacatgacagctccgagagcgctcgtattcgccgtcctgctggcgatcgccgtcgccaacgcggaggcagcgtcggtcgtcgtcggcctggccaagtgcgccgattgcaccaggaagaacatcaaggccgaggaagccttcaaaggtctccaggtggcgatcaagtgcaagaacgtccacggtgactacgagagcaaggccgtgggtgccctcgacggcaccgggagccttcagcgtgcccctcgccgctgacctccgcggcaccgactgcgtcgcgcaagctccacagcgcttgcctccaacgcgtcgtgccccggccaaggagccatccaagatcgtgccggtgtccgagggcaacaacttcggtgtcatcgccgggcgccancaccgccacgccatccgtggcgtcgcccgagtgtgcggtccatgaccctgtgcggggccgatcaagaagcacatcatcgagcacttccaccacaagaagccggtgccaccgaaaccggagcccaagccccagcctcacccggaataccaccccgtgcccaagccggagccgaagccgcagccccacccaagactaccaccccgtccctcccatgcccacctacggcggcggcggtggcggtggataccacggacaccactgactccagtgatccagtctaccacccacccgcccagcactgaagtccccatggtttcgtgctttgagtgacgttgctatttatgatcgcagcatgcacagttggtttgggcttttaataatccctaccccgttttccagtatttgcagaatgagttcaagaataactattatgagggtcagtgtgtcagacaagtgtgtgggtgttgttggaatcttgtcatgaaaaatcaattcgccggccttcctagtgaagatgccgctactcatcaaatactcnttgattgtgtgaatcaaaagaanaagtntgaaatgatatgtaaatgagcattcctttccctaaaatgtcnaacttggttcgcttgcnaaaaatatgntctggatagtc

SEQ ID NO: 23356 - DNA, 617 bp, Triticum aestivum
  Clone ID: PAT_TA_23356
gccggccgggtcgggaaaccaccgcccccgattctcaattgaaaagcacaagggcgctgcagctctcgccggggctagggtttggtcggtcgatcgatcaatcgacgcgagcgggagggaagatgatcgaggtggtgctcaacgaccgcctggggaagaaggtgcgcgtcaagtgcaacgaggacgacaccatcggcgacctcaagaagctcgtggcggcgcagaccgggaccagggccgagaagatccgcatccagaagtggtacaccatctacaaggaccacatcacccttggcgactacgagatccacgacggcatgggcctcgagctctactacaactagcctcatcaccccggccattgcaggtttgtcacctatctttgcctgcgatgatagctttggttgcattccagtcccagtgtcttcagagctcaatgtgtgggcagaactccagcgagctactatttaagtagtgcattattgtacccatgatgattattgacagcctgaacatgttttccctatgatcaacctgcaaatctagtgtgctgttactgtgaagtttataaataacataaactgtgttaccaaaaaaaaaaaaaaaaaaggccccta

SEQ ID NO: 23357 - DNA, 1053 bp, Triticum aestivum
  unsure (1)..(1053): unsure at all n locations
  Clone ID: PAT_TA_23357
ccacgcgtccgcggacgcgtgggcagccactgtgacacaggcaagcaagtggtagaggttcagacatggcagctccgagagcactcgtcctcgccgtcctgctggcggtcgccgttgccaacgccgaggcggtgtccgtcgtcgtcggcctggccaagtgcgctgactgcaccatgaagaacatcaaggccgaggaagccttcaagggtcttcaggtggcgatcaagtgcaagaacaacgctggtgactacgagagcaaggcggtgggtgccctcgacggcaccggtgccttcagcggtgcccctcgccgccgacctccacggcgcccgactgcattgcacagctccacagcgccgcctccaacgccgccaatgctccgggccaaggaagccatccaagatcgtgccggtgtccgagggcaccacctttggtgtcgtggccggcgccaagacggacacggtggcatcgccagagtgcgcgtccgcgaccctatgcggaccaatcaagaagcacatcatcgagcacttccaccacaagaagctcgtgccacccaagccggagcccaagccccagccccaccctgantacggccccgtgcccaagccggagcccaagccgcagccccacccagactaccaccccgtccctcccacgcctacctacggcggcggcgggggataccacggacaccactgactccgatataccatcatcgggcacaacagtgaaatttcatgccttgttgttatcagggagtgagtgacgttgctatttatgtgcgcgggttagcttggtcttattatacccctgcgtcctaaaattcttatcttagattcgtctagatgcagatgtatctaatactaaaacgtgatttgatacatccgtatttagacaaatttaaaacaagaattttgggacgaaggaagtatcatattcagaataacagttgtgagggataagtatgtgtgtcaggcaaatgtacaggtgatgggtcagtttttacaaggtttgtaatattgaatttttgtaatgagaattcctatatctgaatca

SEQ ID NO: 23358 - DNA, 1213 bp, Triticum aestivum
  Clone ID: PAT_TA_23358
ctctgcttcagtatagttcaaggtttctatcttagccagccttctagcaatggcaacaatggcgccgacctgcatcgtcttctccgtgatcgtcttcctgctcctttccaatgccatcaccactcaagccggcacctttggcagtggcaaacctaaggcaacaaacctcatactggaagcgtgcaagaacgcctcgggcgagagccaagacaccggtgtcacaaaggaattctgtttgtcgaccctccagttggacagtcggagcgccaaggctaaagacctccgtgacttggtggtcatctcgattgacatcctgaagggccgtgtcagtgatgctggcgtcaaggtaaagaaaatgctgcaaaacgccaagaaaggcacgctgacaatgtatgctctcagcatttgtgagttgcaatatgagaaggtggtgagcacgctcaacatctgccaaggcacaaacgccggctcgctccccatccttttccgtgctccgcctccccgccccgcgccctccgccgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggtgacaagaccatcggaggtggtgatgacgccttcaacaccttcttcagcgagaccggagccggcaagtacgtgccccgtgcggtcttcgatgatctcgagcccaccgtgattgacgaggtccgcaccagcgcctaccgccagctcttccaccccgagcagctcatcagcggcaaggaggacgcagccaacaacttcgcccgtggtcactacacaatcggcaaggagattgtggatctctgcctcgaccgcatacgcaagctggccgacaactgcactggactgcagggcttcctggtcttcaacgccgtcggcggtggaaccgggtctgcgcttgggtcgctccttctcgagcgcctgtccgtggactatggtaagaagtccaagctcgggttcacccgtgtacccatttcttaagtgtcaacctctggggcgagccctacaacaggggctggccacccaatcctggtgagcaaaccgatgctccacctggttgacaacagggcattttcgaattggaagcgctccctggacatcaaaagg

SEQ ID NO: 23359 - DNA, 1216 bp, Triticum aestivum
  unsure (1)..(1216): unsure at all n locations
  Clone ID: PAT_TA_23359
cttcttctctcaacccaaatccaaatcccaaatcccaaatccccaacccgccggcgatggctcgcggcagccgccccgggaggaacggcggcggcggcggcgggtgcgcgcgctgcttcctgggattcctgctcaagttcctcgccttcctccaggtcttcgccgccgtctccgccgtgctctacgccgcctccatcctctcccgctgggcgcggcaccacgagctgcacttcgaccacctcctcccagacctctggttcgcgtgcgtcgtcatggccgccggcctcctctactgcgccatcctcctcgcggggtacgtcgccgctgaggtcaacagcgggtgctgcctctgcttctataccatcttggccatggcgatgatgctgctggaagctgccgtggccggccacctcctcctcaacgagcactggatgcaggatctgccgtatgaccgcaccagagagcttgagaacctcgtctcctttgtcaacaacaacctcgacctctgcaaatgggctgctctggctaccgtcgccacgcaggtgttctcgcttttcttggcaattactctacgagccatggtttcgcccaccaatgaggactgtgacagcgacgaagattttgttgtcataaggaggccgctgcttcttgcccaaggtgctccagcctatctccctaccacggncgatcctagaggtgcccaccctgggcctatggagctcatcgatgaggcaaaagtatggattgaactccacaagcgactacacctacaacacactggatcaaaatgcagtaccgccacagtgagaatctgcgtgactgatgacgaagcacataccatatatgcagtacataagtcatatgttgcaatatgccatggtgtaatgggcactgtatacatttgtacgcccagttattctgtgaatctcggttgtacatagttccatcattactactccctccgtcccaaaatataagaacgtgtcactatagtagtaaagaacatatgtgtgaatggctgccctggttggctggctgctatttcttcgagacccgcttactagtgctgaatctggagcaaatccgcaactcagtcattgggacagccaggagatggccgtatgtaaataaatagtctatcttgttggatgtcttgggttggctggtttcttcaatgtagccaaagagatggatgagcaagaatggcagtatttgc

SEQ ID NO: 23360 - DNA, 1422 bp, Triticum aestivum
  unsure (1)..(1422): unsure at all n locations
  Clone ID: PAT_TA_23360
ccagtttaacctttaccttccgtgaatcagagacgacaatggcgctacccaacttctcttgccgttgcctggctcggttgcttcttaccgtcctcatcacactctttcttctgaggggcaacctagtcgccagtgatcattgccgccccagatatttaaaaggcgcagccagtccatcagttaaaggcgtagtcagtccatcagttaaaggcgcagttagtccacctagtccacttaacccggtaccctgcccaataatgtaccctacatacaaaaaggctaaacctacgggcgagctacataagggctacggacctttccatccttaaataatctgcctccctgaatttcactgggtggagcccccttccctttcattttccaatcaaaatttcccacatcagttcatcatgtattcatgtgtaaagtgcgtgatattccgtccgtagatgtagcgttactcccctccatagcctaaagcatcatttcagcagcgagaacatgtggataagctggatggtttgtgcaggatacgatgccatggcaagttttctgcatacaaatgtaatgtttaatttatcgatctacttcctccgtttcgaattactcgtcacgaaaatggatgtatctagaactaaaatacatctagatacatccatacctgcgacaagtaattcggaacggatggagtagaacgttacataaggctcatccccaagggaaacgatcattcatggaaaatcacccggggtgaggatttgccatctgtgattcgcctcgccaccagttcttgctcatcctcactctttggaaaggaagactctgttgaacaacacgacttggtctcaagggcatcgcagtacttgcattgctcagctcctttgagaagtatcgcctgcaagttgggagctcggtccagcaaggctcttataaacgcaaactgctgttctagcgatctaaagccgacaaactggagctctttcagtagcccgttcttggagcaatggaagtccatctcccactgaggatttnnnntttcagcaaataccgaccttctctcctcatcattcacaaatgcgctgcatgcatggtcccatacctcaataagtaatatttccattgtgggtgtcgcctcaaggaaagctaatgtccatataatgtcaaattcaacaaagataccacgcaaagtcagcttccttagcttgttgaatgcggtggagagttgcttcatttcaggttggatccaaagctgatcacattaaaagaaaataagaacaaagcagttcagaagcatctataagaaactgtttaaaagcatagagatgtatgttatcaaattatttacaggtatgtgtgttctccatcatgtaaaatacacatccanngcataactagatagacctgcccgggcggccgctcgaa

SEQ ID NO: 23361 - DNA, 918 bp, Triticum aestivum
  unsure (1)..(918): unsure at all n locations
  Clone ID: PAT_TA_23361
acgtcatggacgcggcggccagcagcgccgggcagagcgctgccagggtggccgatctgctccgtgggttcctcgccgtgcagcagcgccgcgccgaggcttactccaagctccgaagtgggttttctgaatatatggctaatggaggtgaatgcgcctatcaacaactatgtgggaatgttacagccgaatttaatgattgctcaacacagattcttgaaatggtgtccctcctgtcaaagccaagtttttgtcgtggagatcttgccaacttattgaaggatgtgcaagcatgtgagagagataagttgcagctgacagctaggattcaggtgttgaagaaggctggccgtccttcggaacgcctggtaaaccatgagcactgcaggtcaagcagcacgtcccagcatgtgtgtgcgaacctcaaggagataaccgaggcttcaggcaccgagggacgcagaggcggacgcagagtatgacgctgctctgaaggaggcaatacagggcattcaagaggcagtgactagcataaacgagcacatggaggaagtgcggtacgagatcgacgccctcgaggctgacacggttgacagcaggctgagtgaagtcgaggaagcgttcccggatgctctgttgatagagtagaagagtgataggtgcttaagtcttactccctccgtttcaaattactcgtcgcagaaatggatgtatctagaactaaaatacatctagatacattcatacttgtgacaagtaattcggaacggagggagtaccagggaagggtttctatttggagagttagagctgttttcatattgtttatttttgcgacaagtgaaattggatagcctgtttctactaacaacaaacaaatgagtgtgctagctatttgaaaggagggtgnatatgaag

SEQ ID NO: 23362 - DNA, 935 bp, Triticum aestivum
  Clone ID: PAT_TA_23362
accagccacttcacacaggcaagcgagtggtagaggttcaggcatggcagctccgagagcgctcgtcctcgccgtcctgctggcgatcgccgtcgccaacgccgaggcggcatcggtcgtagtcggtctggccaagtgcgccgactgcaccaggaagaacctcaaggccgaggaggccttcaagggtctccaggtgacgatcaagtgcaagaacgtccacggcgactatgagagcaaggcggtgggtgccctcgacggcaccggcgccttcaccggtgcccctcgccgccgacctccatggtgctgactgcgtcgcgcagctccacaagcgccgcctccaaacgcgcggtgctccgggcaaggagccatccaaagatcgtgcctgtttccgagggcaccaccttcggcatcgtcgccggcgacagcattgccacgccgtctacagcgtcaccggagtgcgcgtccatgaccctgtgcgggccaatcaaaaagcacatcatcgagcacttcccaccacaagaagcccgtgccgcccaagccggagcccaagccccagccccacccggactaccaccccgtccctcccacgcccacctacggcggtggtggcggcggtggataccacggacacccactgactccgatctgccaccatccggcctagcagtgaaatttcatggcttgttgctgtcagttgagtgagcgacgttgctatttatgtcaggggttagcttgatcttctatcattcagaataagagttgtgagggataagtatgtgtgtcaagcaaatgtacgagtgatgggtcagttttttttacaaggtttgtaatatcggtgtgattttttgtaatgggaagtccctatatatctgaatgaaccaagtactccctccgtcttggtgtgtaagtcatctcacgaaaccaaataatcccaa

SEQ ID NO: 23363 - DNA, 1006 bp, Triticum aestivum
  Clone ID: PAT_TA_23363
ttcaaaaatatttgtttccgtccttaatggcctttgtaacaaactccttcactttctcattgaagtcgcagagaagagaagcacctgcaaccgccagcactattttgtatatccttcatgatccttaaagaatcagtcttaaagccctcctcggcaagcatatgtctgcctcgtcgaacacaagaatcttgatctccctagtggcaagcttcttatgggtaatccacttggtgagcgtcccagaagtgccaatcaccacctgatcggtcaccggagccattttgctgatgggcatataatctttctgagccggcggggttgcacaggcacaggtaatgccggtaaacttgcccatcctcatgagcacagatttattctgctgcgcgagctccctggtggggcagatgcagatggcctggggcatcttgcggttggggtcgacgcggctgagcatgccgaggacgaagcaggtggtcttgccggagccgttgtgcgcctgcgcgacgaggtccctgtagggcggcgtgaggatcatggggagcgtgatggcctggatcttgctggggcggctgaaccccatctcgtcgtgcagccccttgagcagctcgggggtgagcttcacgtcctcgaaggtcgtcgccgactcgtacaccgtgccgcccgaggtcacggcttggatttgggagtcgtcggagtcgtcgagcaggggcgggccctcggcgccgccgtcgtcgtccggcacggagagcgagagcgcctcgatctgcttcgcctgcgcctccaccaccggctcgatgggggcggaggaggaggagcaggaggaggcggcggcggcggcgagctcggcctccgcctccgccttggccttggcctcctcctcctcctcgacgtcggcccaggacttcttctccggatcgggcttggcggcgccggcgtgggccatcggagcagatcgagaaggatcgatggcgatgagagctgcttcagccggacgcgtgggcggacg

SEQ ID NO: 23364 - DNA, 905 bp, Triticum aestivum
  unsure (1)..(905): unsure at all n locations
  Clone ID: PAT_TA_23364
gcaagtggtagaggttcagacatggcagctccgagagcactcgtcctcgccgtcatgctggcggttgctgttgccaacgccgaggcggcgtccgtcgtcgtcggactggccaagtgcgctgattgcaccaggaagaacatcaagaccgaggaagccttcaagggtctccatgtggcgatcaagtgcaagaacgtcgacggcgagtacgagagcaaggcggtaggtgcccttgacggcagcggcgccttcagcgtgcccctggccgccgacctccacggcgccgactgcgtcgcgcagctccacaacgccgcctccaacgcgccgtgctccggccaggagccatccaagatcgtgccggtgtccgagggcaccaccttcggtgtcatcgccggtgccaagacgaacgcgctggcatcaccagagtgcgcgtccacgaccctgtgcgggccgatcaagaagcacatcatcgagcacttccatcacaagaagcccgtgccgcccaagccggagcccaagccccagcgccaccctgactaccaccctgtgcccaagcccgagcccaagccgcatccccacccggactaccacccggtccctcccacgcccacctacggcggtggtggtggcggtggataccacggacaccactgactccgatctgccaccgtccgacacaacagtgaaatttcatggcttgttgctgtcagtgagtgagcgacgttgctatttatgtcacgggttagcttgatcttctatcattcagaataacagttgtgagggataagtatgtgtgtcaggcaaatgtacgggtgatgggtcagtttttttacaagctttgtaatatcggtgtcgattttttgtaagntgagaagttcctatatctgaatcaaaaaaaaaaaaaaaaa

SEQ ID NO: 23365 - DNA, 639 bp, Triticum aestivum
  Clone ID: PAT_TA_23365
tcggcacgagggcgaagtctttgctagggtttgggttggggggaatctgacgcgagagcgggagcgaagggggaggagaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcaccctcaaggactacgagatccacgacgggatggggctcgagctctactacaactaggcgccctgacccaccccgaccgtgctgcgtgcccccctactgctgtgaggttaatctgaatttttctgaagccatgggtgcacttccagtcgcagtgtctttagctaatgagctcacatacatataggcaacttgagtgagctatgtagtacatacatggttgttgcaagttaccaatgactattgacagccttgcatatattgtcatgtgacaaggatgaacctgcaaaattagtgtgctgctactcgcagaccttaccttaaataacacaggttggtcgtgataatcacggtcctgtgcttctgttaaaaaaaaaaaaaaaaaaaaaaaaaaaa

SEQ ID NO: 23366 - DNA, 1003 bp, Triticum aestivum
  Clone ID: PAT_TA_23366
gcagctccgagagcatcactcgtcctcgccctcctgctggcgatcgccgttgccaatgctgaggcggcgtcggtcgtcgtcggcctggccaagtgcaccgactgcaccaggaagaacatcaaggccgaggaagccttcaagggtcttcaggtggcgatcaagtgcaagaacgtcaacggcgagtacgagagcaaggcggtgggtgcccttgacggcacagctccacagcgccgcctccaacgcaccgtgctccggccaggagccatcaaagatcgtgccggtgtctgagggcaccaccttcggggtcgttgccggcgccaagacaaacgcgctggcatcgccagagtgcgcgtcggcgaccctgtgcgggccaatcaagaagcacatcatccagcacttccaccaaaagaagcccgtgccaccgaagccggagcccaagccccagccccacccggactacgggcctgtgcccaagcccgagccgaagccgcagccccacccggactaccaccccgtccctcccacgcccacctacggcggcggtggtggcggtggataccacggacaccactgagtccggtctaccaccctcccgccaagcgatgaaattggtaaagttcctctgtatcttagccatggcttgttgctgttagtgagtgagcgacgttgctatttatgtcacgggttagctttatcttctacgtatcattcagaataacagttgtgagggataagtatgtgtgtaaggcaaatgtacgtgtgatggttcggttttttttacaaggtttgtaatatcgatctgtgtgaatttttgtaatgagaagttcctcactggtagaaaaagggcctgttgtctcggttctggaaccgggactaaagggtcggtactaataccctgtccctttagtcccggttcaatccagaaccgggacagatgggcctccacgtggcctgtgcgcggagcccaggcaggagaccctttggtcccggttggagctttttg

SEQ ID NO: 23367 - DNA, 594 bp, Triticum aestivum
  Clone ID: PAT_TA_23367
tgagccgtagtagcctagcctagctgactcccgcgatgagctggtggtgggcgggcgcggtgggcgccgtcaagaagagccaggacgagcgcgccgcgtcctccttccagagcgtcgccctcgtcgtcggatccaccggcatcgtcggcacctcgctcgtcgacatactcccgcgccacgacacccccggcgggccctggaaggtgtacgccgtctctcgtcgcccgctgcctccgtggtccccgccgccctcacctgccgtcacgcacctgcacctcgacctggccgaccctgtcgcccgtagcggaggccctcacgccgctcaccgacatcacccacgtcttctacgccgcgtggtccagccacccgacggaggctcagaaccgggagggcaactccgccatgctccgcaacatgctctccgtcgtcgtccctggctgccccgcgctcgcccacgtctgcctccagaccggccgcaagcactacatcggcccgtacgaggctatcggcaagatccccatcccagacccgccgtacaccgaggatatgccccgcctggattaccccaacttctactacgaccaggaggacgtc

SEQ ID NO: 23368 - DNA, 747 bp, Triticum aestivum
  Clone ID: PAT_TA_23368
gacttccaagcatatcctgcgttttgctgaacacaaacgtggattgggaagcagaagatcatgttcgcaatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcagttcaaggtgccggactggttcctcaacaggaagaaggattacaaggacggcaggttctcgcaggtcgtctccaacgcccttgatatgaagctcagggacgaccttgagaggctcaagaagatcaggaaccaccgtggtctgcgtcactactggggcctccgcgtccgtggccagcacaccaagactactggtaggcgtggaaagaccgttggtgtctccaagaagcgatgagctctatatcaccctgagaaatcttggccgcactaccgtgttggtttgtgtccaaacagtcctgatgaagggtttctgtttaggcagtttcctgaaatggtgttttgctctaggacaatctcgcggttattgaaccttaatatatcgtgtccctgggttgtgtttttttgacactttataagtaatttcatttggatgagacttaattctggtttgactcgttacattgttaactcgactccgagaggagtgccttcccagtgcagttcattcacattgcctgttgtggaggataaaaaaaaaaaa

SEQ ID NO: 23369 - DNA, 611 bp, Triticum aestivum
  Clone ID: PAT_TA_23369
actcaaacacgtgcttctacgtccattaagataaatatataattccaaacaagaaaaacacatatatactttacctcagaaagtgggttaagcctagcataccatgcacaaacaacgatagggtttctaacccactaataaattaggatttcttaaccaaccaggagagatgatactacagagacaaaaaaatcataatgcttgtaggcaccagcacaataagagcaacattgaccaccttctgcatgttatccagcctcctgtggaaatttgccaagtcctccttgctacgcctctcagctaaatccatatcatccaaattcttggatatatccttcatactctggtcaaactctgcagtcatgcgctttatttcctcacgctgtttggccagcgttttatcatcatcagaataaaccacttgtccccccgtgccactgccaccgtgggacatgaggcgagaacccgccgccggcgagagcgcgtggaccggcccgatacgggggcccatcggcggcgacctggcaccgagggccggcaactttctggcgatggagcgcaaagccatcgggtttattggaggcggcggcggcttctagggctgggtttcg

SEQ ID NO: 23370 - DNA, 915 bp, Triticum aestivum
  Clone ID: PAT_TA_23370
gatcttgacgtgtacttgcatggtaatttcaaaccaaatgccactaaatagtacaacctctgttcatttctttttttggactcatggccagtctaaaaacatcttgattaatggacagaggggataactgtttgaatttggtaaggaatccagacaaaataccttgcatttgattactatttccttgggtaattcgtatgtatgtctttttatttagttgtctgttacttgtgcaacttcagattcagagcccattattcactgaccggggtaacagttgatcagtcaattctcgatttgttagcccttgacacatttgcagaaggcgccagtgcatggcatggcagaccggtagttgcctagcatcagattcaagtatcttatcaagtggagtatcacttgtcttgaaactgtaccacaccctgcacatcttttaccaccctaattattcaaatccacaacggcatcaacactgtcagaaacagcttaaataatccctggaatgtagtactccgtccgaaaatacttgtcatcaacatggacaaaaagggatgtatctagaactaaaatacatctagatacatccccttttattcattttgataacaagtatttccggacggaggggtacttccttcgtcccacaatgtaagacgcttttgcaacctattttgggacggagggagtattcgcttgctactactacttggtctgtatactgtagtagtgcttttgccctggatgtgatgtataaactgcctttgtggccagataagataagtctttgaattctcatcggacaaagttatcgtccggtgcatgtggtggagaaggacaggtttggaataaaagtttctacagtttcttcctcggtaaaaaagacaaagataaaaaacgaagagactgagaaaaccc

SEQ ID NO: 23371 - DNA, 1204 bp, Triticum aestivum
  unsure (1)..(1204): unsure at all n locations
  Clone ID: PAT_TA_23371
cggacgcgtgggcaacgcacccccgcaactccactctctccccattatccccagatccagccggcactcccctcccctcccctccccccaccgcccgatcccgacgcctccgccggccacctccgctctccgtctcccagcgccagaccccgggacgaccaagctgcccgcagccaatccctaaccccccctcccgccagatccactccgcccccgcgatgagctggtggtgggcgggcgcggtgggcgcggtcaagaagcggcaggacgagcgggcggcggcggcggagcccaccttccagagcgtggcgctcatcctcggctccacggggatcgtcggcacgtccctcctcgacatcctgccccgcgacgacaccccgggcgggccctggaaggtgtacgccgtctcgcgccgcgcgccgccgggctggtccaccccgccgccgtcccccgccgtcacgcacctccagctcgacctcgccgacgccgccgccgtcagggacgccctgacgccgctcaccgacgtcacccacgtcttctacgccgcgtggtccagccacgagacggaggaccggaaccggggaggacaacgccggcatgctccgcaacgtgctctccgtcgttgtgcccaactgccccgcgctcgcccacgtctgcctccagaccggccgcaagcactatgtcggacccttcgaggccatcggcaagatcccggcccccgacccgccctacaccgaggacatgccccggctcgaccaccccaacttctactacgacctggaggacgtcctcttcgaccacgtctccggccgcgacggcgccgtcacctggtccgtgcaccgccccaccgtcatcttcggcttctccccccgcagcgccatgaacgtggtcggcagcctgtgtgtgtacgccgccatctgccgcaaggagggcgccacgctgcggtggccaggctgcaaggtcgcctgggagggcttcaccgacgcctctgacgcggaccttgtcgccgagcacgagatctgggcggccgttgacccgttcgccaagaacgaggctttcaattgcagcaatggggatgtgttcaagtggaagcagctctggccgatgctggccgagcgcttncgggtgggatgggcaaggtatgaaggtagaggacagncgggtcggtcttgccgacgccatgaccgggaaagaagcggtctgg

SEQ ID NO: 23372 - DNA, 897 bp, Triticum aestivum
  Clone ID: PAT_TA_23372
cctgctcttatgcagtataaatatcctgaaaccctaggattctcagcgagcttatcgcttatcatccgcggcttgtgcatctcctccgcctccgcttgacccatccaagtcagggatcgccatgtcggactcggaggagcaccacttcgaatcgaaggccgacgctggtgcgtccaagacttacccgcagcaggctggcaccgtccgcaagaacggcttcctcgtcatcaagggccgtccctgcaagggttgtggaggtttctacctcaaagactggtaagcacggccacgccaaatgccactttgttgccatagacatattcaacgggaaaaagcttgaagatattgttccttcttcacacaactgtgacattccgcatgtgaaccgtactgagtatcagctgattgacatatcagaggatggatttgtgagccttcttacttcagatggcaacactaaggatgatcttagactcccaactgatgagactcttgtggcccagattaaggaaggttttgaaagtgggaaggatcttgttgtgactgtccagtctgctatgggggaggagcagatctgcgccctgaaggatattggccccaagtaacttccctgccttggaagacggaactactgtatctcaaaacttaaatggaaaaagaagtgtatcaccaaaggattgctactgagacgttcacctggcttgagctggcttttgctatagcaaacacaagtgcagggattgctgggtgtcgcaccgtatctgactttcattatctgtggttacattctggaccctgtattttctatgattttatgccacctactttttagtattaagtatcaataaattggtttggaacggttgaattgcatccaattcatgaggtttcttgtta

SEQ ID NO: 23373 - DNA, 998 bp, Triticum aestivum
  Clone ID: PAT_TA_23373
gaaaaactcgactccaggaagccttcactcctcccaccatcccatcgattatctgtggcggccatgcgggtaggctccagggtggtcgtcctcgtccgagactccgccggctacggcgcagccctcgctgacgcgctccggccgtcgccggggctcacgaggggttcctcgcccttcgatctgcctctcgataagtacggcctcaatggcgagaaggcctccggcgaagctcgttagcttctctgactccagtggctctcctcaggtgtccttttttgttctgcctgactataggcctcctgttgctgcatgtgctatgaatgagattttagcattgatttcttctgaagctccctccatccagccaattctgattgtaccattcatcacaagaccatcaggctgcttccatggaatggttaatgcaacaaaaactgggcagttaactacacttcacgctgctgaaataggggcatcaaatgagtttactcacttgttggttgacggaattattaaacctcccccatctttgcaaatacgcggtgaaccaatacaatgtttgctggaaatggtgcgggtattgaagataccgacagttcttcttgtcacatcaggtgggcagcaccaaggcaaaagttcttcagactctgaccttgaggtgctgcagtgcgtgggagatcacgtagccaagcacatcaacttggagttctccaaagaaactgtcattgagacaggggttgagaaatcagcaagcattcaagaaccctggcgtgaactgtatctgtgacgattctaaaacgtatcgttttgtgcccttataaatagacatcttaacattttagattcggacgtacttttttttcttctttttttgcgggtggaacgtattctgttcacggtgtgctagtgatgaattatgtgatttgtgcaaggggcttgtaacacgagccacactttgttttcctttacatccaacttgttaagaagtgcaatgtcgc

SEQ ID NO: 23374 - DNA, 1432 bp, Triticum aestivum
  Clone ID: PAT_TA_23374
cggcacgaggctggaacttcactgcttgctggccccacggtatgttgtgatcttcaaatcaatgtttatcttcagagtggcgagtgacatccactttttcagttgaaattgcagttttgtatggcattagctactaaatattgcaacatttttatcaaattgatttattattttggggcaattatcttagtaatgatcaaattcacactatttctgtacaatcttccagatttgtaggctagacacaggctatgtgcttaagaaatgtgatgatatagcacctgcacatttttactacaaatcacaatattggaagaacattttgcttgattccattagtatcattgacaaacttttagcttacattagtcagatactccctccgtccgaaaatacttgtcatcaaaatggacaaaaagggatgtatctagaactaaaatacatctagatacatccccttctattcattttgatgacaagtatttccggacggagggagtaccacttaaatatacttacataaacatcttgcaatcgatacctcggcgtttactaagcacaattaaaacactgttcatatggttactaagcatagaagtgctagcccacatggactaagcaaatttcattaacatatcctaccccaacaaagggttgttagaaacaaagataggacaaaaggcagcatgcgcggaccgtcccttctacgcatctctatattcataatcttcatggtcactgtcgcgcaattctgatggtggcagccagtttagaatttttgattccactgacttagcagagagcatcttggccttcaacatctcgagatctccatccaacaatttctgcaaatcagccaatgcattcaatgcttccttacaaaggtcttctggaagttcatccttcctcacagacaagacatcgtcaagggtattcattgtatgctttgacagatttcctaacctagcacggatttctgtaccggtcattgtccagtcaagtagagcccttttgacagccttgtccacgttctctttcaatctgtcctttgggtttatggggaaagacaacggcacttcatcaccagcacatctcactttaaccacataatccttgtcaacttccaatgtcagttcaaaataaacacaaccttgaaatgagcctctattattgattacctgtgtctcacccaataggatattatgctgaaccatcacatgctccccgaaaaatattctgatacacttgcgctcgccataatccaaccaagtaggaatctttactgtccgttttattggaagggtgctgtgtcttggaatcactttggtaaaaattccttttgaggactcaaatccaatagagagcggaatcatatcatcactaatctcttgttcatcttctagaatgagagcagctcggacgcgtgggtcga

SEQ ID NO: 23375 - DNA, 936 bp, Triticum aestivum
  unsure (1)..(936): unsure at all n locations
  Clone ID: PAT_TA_23375
gcgcccctccgtccctcctcgcgcgtcgtgatccatccagcccagcaggtgattaaggtcgccatgtcggactccgaggaccaccacttcgagtccaaggcggacgcgggggcgtccaagacctaccctatgcaggccggcgccatccggaagggcggcttcctcgtcatcaagaaccgcccctgcaaggtggtggaggtttctacctcgaagactggaaagcatggtcatgctaaatgccactttgttgccttagatatattcaatggtaaaaagcttgaggacattgttccttcatcccacaactgtgatgtgccacatgttgaccgccaagattatcagctgattgacataactgatgatggatatgtcagccttctcactgagagtggtaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttgggtatctaagtgcttctgggtgtttgagatacacatacataggcatcaagatatctgttgggtgaaacaagtttgatccagatttgtgtgttttttacaccgaatgctcgaggtgctgctatactttggttatctatctatctatctctattataataccttttgggaatttggaactgagtggggcggaacttagattccggttgctcatccgcctactctaatgaatgaattggttggggtaaaaaaaaacnnggggaaaaaacncccagggggggcccgtaccattccccanangancctataccgcccacggctcnttanactcngacgggaaactgggtacccgtggt

SEQ ID NO: 23376 - DNA, 831 bp, Triticum aestivum
  Clone ID: PAT_TA_23376
ccaggccgcgaacaagagcttcctaaccctagttcggcgacgactcggcgcgcggcggcggttggttcggagccgacgagggccacgtggggcacgcgaagggagcgcagccgccggcctccgccgtggttgctcgcggcatcggcgaggacgacctcctcgaggggtttcgcagcccaggtaagtcagaaagaaatattccatcctcggacaaacttctcttgttgcaatggaatccaagttctttcggttcctgaagcttgtcggagttggtttcaaagcaaggacagagcaaggaggccgcgagttgtttctgaaactaggctacagccatgaggtgcagttcaccgctccacccgccgtccgcgtcttctgcttcaaacccaacataatatgctgcactggcattgacaagcatagagtgcaccattttgccggagccgtccgaagcagtaaacctccggaagtgtacaaggggaagggcatactgtacattgatgaggtcataaagctgaagccggggaagaagcagcagaagaagtaacacgtgggtgagcctccccatttgacttctagcctgctgttaaggcgccgcgtagcgtttgttgctgcagatttcatgtggttttctctgtgctgggctattatggctagccccggtaccaggctggacttcgtaataatactccgtatgtgaatcgtctgatgaacatgcataccgttgggtgggggtggatcagcggattccaacatttttgttttgttttgagctggctggatgtgacgtatcttcaatagttcaatgtgtttgttgctgacacaactctcaat

SEQ ID NO: 23377 - DNA, 1265 bp, Triticum aestivum
  Clone ID: PAT_TA_23377
ctaccagtataggagtaccataacttgttcgaatcctccaaaagacttgtctggtcagcaaagcagtactaataacaacaccgaagtgccagtattatacagcacggtaacagagctagtggcaaaacaactctagcaaccgtttcgatacagctgggacgatacatcttttcgaaaaaaagctgggacgatacatacgctgagccctgaagcactgcagcgccatcatgcgatgaggaaagggagcacggtcagcatgaacgcctcgtagccgaaagtcgcagaccccgagtacgccgtgtccttctccttgaacttctcggtcaggcccttcactgtaaggcagcattcaatgaagttgtcatattcaaccgctttgttcttgcccccagtcttgtcaaatttagacacaagcaagtctagcacagtaggagaaacggaatatccaagatctagaagagcatcacgcagttctggtgcatcaattctaccactttggtcacggtcaaacctctcaaatatgcccctccaattctgaagactgtaaaacacagaagtgaactcctttggcccgatcttgcggacgttggtgttggtgaagaggtacatgaggaggtggacggtgcggaggctgaagctctggctgctgaacccagagagcgcggactgcagctccttgtcgtcgatcatcccgctgccgtcgcggtccgcggcctggaagcacgccaccacgttcgggtccgtccccggcgggaacgtcgacggcaccagcgccgcgaacgggctcccgtacccaccggcgccgcctcctgcgtagggctgcgcggcgggtggccccccgtagggcgcagcggacgaaggcggctgggcgccgtagggctgctgcccgtagccgcctccgcctccaccgcccccgccgtaaggctgctgcgggggtggagcgccgtggtatgggtcggagccggaggagtaggaggtcttgccttccttgggaggcttctggccgtaggacggtggggctccgtagccgccgccgcctccgccgtaaggctgctgcgggggcggagcaccgtggtaggggtcggggccggaggaggaagaggtcttgccttctttggggggcttctggccggagggcggtggggctccgtagccgccagcggcgccgtaggggtagccggagccggggggtggggggtagccggccatggggttaagcttggggaattggagttgtgtgctcgatcacggggacggggatggaa

SEQ ID NO: 23378 - DNA, 908 bp, Triticum aestivum
  unsure (1)..(908): unsure at all n locations
  Clone ID: PAT_TA_23378
agccacttcacacaggcaagcgagtggtagaggttcaggcatggcagctccgagagcgctcgtcctcgccgtcctgctggcgatcgccgtcgccaacgccgaggcggcgtccgtggtcgtcggcctggtcaagtgcgccgactgcaccaggaagaacatgaaggccgagaaagccttcaaaggtctccaggtggcaatcaagtgcaagaacgtccacggcgactacgagagcaaggcagtgggtgccctcgacgggaccggcgccttcggcgtgccactcgccgctgacctccacggcaatgactgcgtcgcacagctccacagcgccgcctccaacacgccgtgccctggccaggagccatcaaagatcgtgccggtttcggaaggcaccaccttcggcatcgtcgccggtgacaacactgccacgccattcgcagcatcgccggagtgtgcgtccatgaccctgtgcgggccgatcaagaagcacatcatcgagcacttccaccacaagcagccggtgccgccgaagccggagcccaagccccagccccacccagactacagccccgtgcccaagcccgagcccaagccgcagccccacccagactaccaccctgtccctcccatgcccacctatggaggcggtggcgacggtggataccacggacaccactgagtccagtctaccaccgtggtcctgcccagccatgaaatctcatcaccgggttcaaagtcaatgagtgatcgatgttgctatttatgatcggtttgcatgcgtggatggattgcttggtgttgtgccatttgctgcctcattttagtatttgcaccgcaaagttgagagttcagaataacagttgtgagcaacacagggnatcactgtgtattttgnctttttaaagnatttg

SEQ ID NO: 23379 - DNA, 909 bp, Triticum aestivum
  unsure (1)..(909): unsure at all n locations
  Clone ID: PAT_TA_23379
gcacgaggctactagctacttacttcacacaggcaagtagtggagttcgattcaggggttcaggcatggtggctccgagagcactcgtcctcgccgtcctgctggcgctcgccttcgccaacgccgaggcagcgtcggtcgtcgtcggcctggccaagtgcgccgattgcaccaggaagaacctcaaggccgaggaggccttcaagggtctccaggtggcgatcaagtgcaagaacgtccagggcgagtacgagagcaagggcggtgggtgcccttgacggcaccggcgccttcagcgtgcccctggccgccgacctccacggcgccgattgcgtcgctcagctccacagcaccgcctccaacgcgccgtgctccggccaggagccatccaagatcgtgccggttttcgagggcaccaccttcggcatcgtcgccggcgacagcattgccacgcccgtccgcggcgtcgcccgagtgcgcgtccatgaccttgtgcgggccgatcaagaagcacatcatcaagcatttccaccacaagcagcccgtgccgcccaagccggagcccaagccccagccccaccctgactatcaccccgtgcccaagccggagcccaagccgcagccccacccggactaccaccccgtccctcccacccccacctacggcggcggcggcggcggcggataccatggacaccactagtgactccgatctaccgcgatccggcacagcaatgaagtgacgctgctatttatgtgcacgagttagcttggtcttctatcactcagaataacagttgtgagggataagtatgtgtgtcaggtaaatgtacgggtgtttgtaatatcggtgtgaatttttgtaatgagaagttcctatatctgagaaaaaaaaaaaaaaaanaaaaa

SEQ ID NO: 23380 - DNA, 616 bp, Triticum aestivum
  unsure (1)..(616): unsure at all n locations
  Clone ID: PAT_TA_23380
ctcgtgccgaattcggcacgagcacaaccgccaacggtggtgggcagtttcgcttggctcctcctgtcttgtagtagttcgcgtgcacaagaggtcgccatgtacccgaagccggaggatggtccggcgacgggcttcccgatgagcggcggcacgggcgtaggcgttggcggcggcggtggcccgggcgcgtactaccaggcggcgccggcgacagcggcgttcgcgatgcaggcgcaggcgccgctgggcggcgtggtcgacggggctgtgcgactgcttcgacgactgcggcaactgctgcatcacgtgcctgtgccccgtgcatcaacgttcgggcaggtggcggagatcatcgaccgcgggtcgacgtcgtgcggggcgagcggcgcgctcctacgcgctcatcaatgctgctcaacggctgccaatgcgtctactcctgcttctaacgctccaagatgcgccgcgcactacggcctgcaagaaagcccctgcgccgactgctgcatccactgggtgctgcaaccctgcgcgctctgcaagaatacgccagctcaanaaaagggttcnaatgaactcggatggacccaaatggagagcaaggaccacncgg

SEQ ID NO: 23381 - DNA, 819 bp, Triticum aestivum
  Clone ID: PAT_TA_23381
ttttttttttaatctgtaaaaaaaaacacttcaatccacatcaaacatgctgacataagttatacatgttgcagtcgcacaaataatggcactgcgaataaatttagcgtgctaatcatggtttaacagaggaaatgctaactaaggtagaaatccagcaagaataatcatttagttccattatcaacatgtatctgtgtaaatcatccatgccaaaatgtgttgctgctgggatagtcactactgaaactttcaagatcaacttctttgaacattttcattgactagctttaggaaaccttatgttttctccttggtagcaattttctccttcaatcagtaaaggccattttctaacagtacattagtaattgatgacttaatagcactgcatcgataatactatcaattggctttgttgtgaggccatgatagttaggtagaaacactactgcaaacgatggatgttctttcgtattggttcttgtgatacaaaactcaaacaggagagagggctcttggatcttggacgaagaggagcatgatctcctggccgtcgtcgtcatcggaaggtgaagatcttgggggcggagacggagatccgggaagtagtaggatggcgaccccggccccgtcaccccatcccgaggggcagagcgtcgaagggaggagggcagggggcgtcgcagtcgccggtcggaggaggcaggagcggtggacggaggagacttgagcggtggacggaggaggtcttccagtcgccgccgccagtcgttcatgagtgcgagacagaagaagcgagggtttcctccccgacgt

SEQ ID NO: 23382 - DNA, 801 bp, Triticum aestivum
  Clone ID: PAT_TA_23382
ttttttttttttgaattcaacatacagcaaacaattcgctgattccaatctccacggaattacaaagtagacaaaaggtatagtaaattcacattgcacaacaggaaaccagtattaaggataagattttgactccatccaggataattcagcatggcaaagcgatgatgaacacagatcacatcagaaacaagctacagaatatatactggacatgctagactcttcacggtgtcacaatgattttgctctgctgaaattgaaatacggaagtttttctgtcattataatatgttgttcttttgttaagatgtcatccgcagcaggatccacaagcagggagggaactctgatcgtttgatcggaggtcagatagtgtgcgaggaccgcgaggtccacctccaccgccgcccccaccaccataaggacccccaccaggacctcccccaccaggtccaccatcccacttcttaccactaccatatcctttcttatagctgtctgttttctcgatagaaaacattgtgaggaagaacattctgatgaagttcacaatagccttaaagaagtcgaggattatgcttagtctccagattgtccgtttgcctttcacaacacctctctcgacgtaggccatggtcgcgctcgcgctatccggatcgcccctccctcttcgatggaacttaggatgaaattttggcccggggtccggagagaagaaataggagagggggaggggcgaagtgaggaggggattcgtgaaccttcctcgtccttccgcgtgggaagacctgacctgac

SEQ ID NO: 23383 - DNA, 1958 bp, Triticum aestivum
  Clone ID: PAT_TA_23383
tccgcagctccattctccctcccctgatcccctcactctctccactcccagactcccagtgcggtcacgatgccagatctgggggagtcacccattccaccccctccgctctcgcccccacagccggcgacctcgtctcgcaccgccgcctcctctcatcccctccccagctcccctccactcatccgacggcggctagatgtgcacacaaccggcgaccaacatcacacaaaggtcgccaccgccggcgggggaaggacagtcttctcccgctgctagccgcagcgtccgcctcgccctgatcctcgccctcctcgaccgccgctcgctctcctcggaagcacctcgccgcctccctgcccatgccgtgttcactggctgccctgctcgcgccgacctcgccaatctcgcggacgcgcttggcagtgctcgacttgtcctcgccgccgccagcggcgacgggtccttcccgtgcctctaccgcctcgtggccgagtcctcctctccccaaatcgacacccgcccctttgtcgagcctgccgtgcatgccatatgagcaggatggtgtacaccggcttcacagacatgtggtcgtcgaggcttcggatgaggtcgacgcggatgagaacagttcatagagccgtaccaggatcctatagagcaaatgggcatcatcgacgtgcagtacacgctctcttaggcagataagtaacctcagacaacttattttgtgaagatcggtggttcatggtctgaaagttttgtttttctctctaaattttgtacttagataatcccttaaatgctttttactgcttgatcacataatacatgtccgtgcaagaaaggagttgttaactgaaacaataatgttaatttttgttgttagctgaaacaataatgttaatttttgttaactacaaacggtcttggacattggttttttcaaattaactccgtgttgaactggttcttcttgttgtgtgctgcagcccagcaatctgttcatgccaaatgattgagtcctggtgaggttcattgctggacatgcacggtctccgcaggcaaggaacacataaaagtaaatcagcgtgttatcagaaactcatgagcatgaaagagaaatttggatcatgtgcgaacatgggtagagagcagatcgatgagaacttgaagattaaaggcaatgaaaggtctatacacattagcatccgaaccagaacaatcaagttcaaagctctcatggttgactggagaaaatcaaaggaggtgtgagttcggaagtaatacctggactacctatggggagttctatggttgacgcagaggggattgttgcttcatgtataatcaggccgtcaatggttgtgggtcagctgcaatggcttgcgaaaggaattgttcaaattggttccgtaaaatggcagcgggtagagttcttgtcctgcacaaaggaaggttactttggtagaacgtcacaaaaattatagacggggttaggatacctctcgagaagcagtatatgcctcgctagcacacaagaacagtgaggaccatgtactaatcggacgaacagttggggctatgtcacaccaccaatcggacagttgtatagttaacccagtctcttcccgcattagtttaaccagaagtgaactgtgtacaggttactaagcgtggagaacctgtgtcacgacatgtcgttggcagccgcgccggcaccgcacacctgatttgacggcaaactttgaagaaactgttcaaatacacatgatccaaacgcaaacctggaagcgtggagaatcaggccttgccagccccgctcggaagataggattttgttgtatatggaaagagcaaaaatattagattaaactattgtttatggaagcttctcgtgacggaatttcccgatatgattccataaaaaaaaaaataaaaaaaaaaaaaaaaaaaaa

SEQ ID NO: 23384 - DNA, 812 bp, Triticum aestivum
  Clone ID: PAT_TA_23384
tttttttttttttttccactggcaatcgaactagtgcgccacttttcatcagagttccgatgcatcgatgagcagataagctctactagagtagtataccatacataacttgttcgaatcctccaaaagacttgtctggtcagcaaggcagtactaataacaacagtattatacagccggtaacagagctagtggcgaaacaactctagcaaccgtttcgatacagctgggacgatacatacgctcagccctgaagcactgcagcgccatcatgcgatgaggaaagggagcacggtcagcatgaacgcctcgtaaccgaaagttgcataccccgagtacgccgtgtccttctccttgaacttctcggtcaggcccttcactgtgagacagcattcaatgaagttgtcatattcaaccgctttgttcttgcccccagtcttgtcaaatttagacacaagcaagtctagcacagttggagaaacggaatatccaagatctagaagagcatcacgcagttctggtgcatcaattctaccacttcggtcacggtcaaacctctcaaatatgcccctccaattctgaagactgtaaaacacagaagtgaactcctttggccctcaagctttcaaggataaacttctgccaaaaaaagctttcgtagaagtagaactaactcaaagcagttccaactttgaagcttggataagcatcaattaaactcacgttttccgtaatggaccaggttaaacgatcttgcggacgttggtgttggtgaagaggtacatgaggaggtggacggtgcggaggctgaa

SEQ ID NO: 23385 - DNA, 1385 bp, Triticum aestivum
  Clone ID: PAT_TA_23385
gagccttgaaaagttgaacacaagtaggagtacgtgcacaactagacttggaacatctttgacatacatttatacattcaaatcgtccaaacgaagagcattacagcgaatgcacgcttccatcttcattttgagtggaacgcccagaaagatacatttctgcggtggcagtatgcaatgcagctccaattggaaggacatcctcatcgacgaagaaatgcgggttgtgagcagagtggaccgaaccgacattttcatttctaataccgataccaaacataacaccaggaactaactgttggtagaatgcaaagtcttcccctgccatgatcttctctccgggcttcaccttgtctggcccaagcaaacttctgcccacattctctacatgctggtgcagtctctcatcattgacgacggcaggatacattgggtgggagggagcccccaatatctccgtaactcccgtgcacctatgtacagctgcctgcccttctactacctccttaagccttttctgtagccgataaagtccttcagtagtgaggctcctcaaagtacctccaaattcaacaactggaggtgtggcatcaacagagttcccacctttaatataggtgacagagagcacttggctgtgaagaggatcatcttctcttgaagtgagctgttgcagggacaggacggtaaatgctgcagcaacgataggatccacatttaagtgtggggtttcagccttcccggttttaccttctattttcactacatagaaacatacagctgcttgtgttggtcctgcgtgagcagctattacccctgttggcatccgataatcgatatgcattgcaaatatagcttcaacaccatcaagaacaccttcttttatcatatgagatgcaccagcaccaccctcctcagcaggttgaaaaaggagtctcaccgttcccttaagctgatccttgcgctcatgaagcaattttgccgctcccaggagcatcgctgtgtgcacatcatgaccacaggcgtgcattacaccatcaactctgctcttatgctcccactccaccaattcctggatgggtagggcatccatgtcggcgcggagggcgacgatcgggggcatgcccgagccaacatcagcgacgacgccggtgccggcaacggcgcgggcggtaacccctagccgctctagcccctcgcggacgagggcgctggtgcggtgctcatggaaggcgagctccgggtgggcgtggatgcgccggcgcacgccgataatccactctcgctcgccctcggcgcgccgaagtagctcctgcgcgtactccgccgaggcggtggagaggaggaggaggagaacgaagaggcaggggagacgaggagtggcc

SEQ ID NO: 23386 - DNA, 1109 bp, Triticum aestivum
  Clone ID: PAT_TA_23386
tgcttcttccctgagtcgattgcagagttgcttctttgaggaagaaaaactcgactccaggaagccttcttcactcctccccgtcccatcgattatctctggcggccatgcgggtagcctccagggtggtcgtcctcgtccgagacgccgcgggctacggcgcagccctcgctgacgcgctccggccgtcgccggggctcacgagggtttcctcgcccttcgatctccctctcgataagtacggcctcaacggcgaaaaggcctccggcgagctcgttagcttctctgactccagtggctctcctcaggtgtcgttttttgttctgcctgactataggcctcctgttgctgcatgtgctatgaatgagattttagcattgatttcttctgaagctccctccatccagccagttctgattgtaccattcatcacaagaccatcaggctgcttccatggaatggttaatgcaacaaaaactgggcagttaactacacttcatgctgctgaaataggggcatcaaatgagtttactcacttgttggttgacggaactattaaacctcggccatctttgcaaatacgtagtgaaccaatacaatgcttgctggaaatagtgcgggtattgaagatacccacagttcttcttgtcacatcaggtgggcagcaccaaggcaaaagttcttcagactctgaccttgaggtgctgcagtgcgtgggagatcacgtagccaagcacatcaacttggagttctccaaagaaactgtcattgagacaggggttgagaaatcagcgagcattcaagaaccctggcgtgaactgtatctgtgacgattctaaaacatatcgtctttgtgcccttataaatagacatattaacattttagattcggatgtactttttttagtactccctccgtacggaaatacttgtcatcaaaatgaatgaaaatggatgtatctacaactaaaatacatctagatacatccatctcaatgacaagtatttccggacggagggagtatgtgatttatgcaaggggcttgtaacacgagccacactttattttcctttacatccaacttgttaagaagtgcaatgtcgcatgt

SEQ ID NO: 23387 - DNA, 608 bp, Triticum aestivum
  Clone ID: PAT_TA_23387
cggacgccgacctcgtcgccgagcacgagatctgggcggccgtcgacccgttcgccaagaacgaggctttcaattgcagcaatggggatgtgttcaagtggaagcagctctggccgatgctggctgagcgcttcggggtggagtgggcagggtacgagggggaggacagccggttctccctcgctgacgccatggccgggaaggaggcggtgtggacggagatcctccaggagaacgagcttgtcacgaccgagctcgaggagatcaccagttggtggttcgtcgatgccatgttcagtatcgacattgagcatttggacaacatgaacaagagcaaggagcatgggttcctccggcttccgtaacaccgtcaactccttcaacgcttggatcgataagatgaaggcttccaaggttgttccgtgatgctcttattgtctagtatctattgttgtttacaagtatgctatcacatcacattttatttctcatttaccaatttactgttgaaattagctacatcccatcatttgtgccaaatgttgtaatctagaataagccagaaccaaataaagctcccaagttgtgaattgattaaaaaaaaaaaa

SEQ ID NO: 23388 - DNA, 618 bp, Triticum aestivum
  Clone ID: PAT_TA_23388
cgcggcggcgcgaagcaggaagtaggacttgatcccgagcacggtggcgatgatgctcaggatggccgccctcctgaacacgccgtccctgacgaagtagcaccccgtgttgacctcgcgcgtcaccggcgcgttccacgccgcgccctgcacgaagtagatctccgcgatcaccgtcgccacccatgagaggacggcgaagacgacgccgatgttccgcctggacgcggagaaggcggcgccccggggcttgcagcagccgcagcagcggccggcggccgagacggtgatctgggccgccagcagcaggagcgccgcgaccagccccagcgcgaacgccgggttgccggggtacacgcactcggtcctggacaccccgatgtcattccgctcgagcttggtgccctcggcgatgaaccccagcacggcgcttccgaccccaaagaatcccaccacgacggacaggacgatcacgctcgtctccatttctccagtaatctttcagccgatgtctcccagaccgagaggctgtgagacggatgggcgaagacttgagaggcgtgatcaaatgcaaatggcctgatgccttaggtagaggacgctgatgaggtcgtctcg

SEQ ID NO: 23389 - DNA, 593 bp, Triticum aestivum
  unsure (1)..(593): unsure at all n locations
  Clone ID: PAT_TA_23389
gcgaacgccctcctcctcccctcctgcccccgagcgccgccgccgccgccgccgccgactgcagccatgtcgctgatcgcgggtgaggagttccagcacatcctgcgtgtgctcaacaccaacgtcgacggtaagcagaagatcatgttcgcgctgacctccatcaagggtgtgggccgccgcttctccaacatcgtctgcaagaaggccgacatcgacatgaacaagagggccggagagctttcctcggaggagatggaccgcctgatggcggtggtgcacaacccgcgccagttcaaggtgccggactggttcctcaacaggaagaaggactacaaggacggcaggttctcccaggtcgtgtccaacgccgtgggacatgaagctcaaggatgaccttgagaggctcaagaagatcaggaaccatcgtggtctgcgtcactactggggcgtgcgtgtccgtggtcaacacaccaagactaccggcaggagaggaaagatgttggtgtctcaagaagcgataagctgctcacaacgatcccatagctttcacacgtgttggncattcaaaatctaaggatgtcttgtaaaca

SEQ ID NO: 23390 - DNA, 893 bp, Triticum aestivum
  Clone ID: PAT_TA_23390
gtttggaaggggcttatatttcaaaaaaaaaaaaaaagctaaaaagggtcttcacaatcaaattttgtgtccattatgaaccttaacagcaaaatatcctgatgcattccacaacacccatgaactggtttgaaactaaactctaggaatgtaaaccacaatgggcctgccaaccccggaatgcaaaacaaaacctccaatcaacctgattaaacagaagacatggacaacacaacagtattgttccgcgattatttgctatctacccatatggcaggaagatatggaccccaactaatagatgcaatgcaagcggcttgaaaaatgatcacaaacgttaccatccgccaggaaaatgtgctcttcagcgctgtaaaccaaatcaggcctcgcctcaagcatgctaacttatttacatctctatgatcacaaatcagagcctaccatcctgagatacccatctccttgcaagatgcagatgaagcttatgggatttcgctcctgtcttctttcatcgtcccagaggatgatggttcaccgctagaatctggggaggcagctgcctgccgtggctcttccttcaaagaggtgggcatccctgaaatttccttcataagatgcaaccggagatcagtcgggcgaactccctcaccaatgcacaccataacaaactgtgaatagttgaaaagaacatctgcagcagcttgcttcttctgctgagtctcatagtcatcctcggtgatcataggagtgtcttgtgcagccattctttatatcttctaatccaagcagagcaggtggaatccggatcgaacgccccaatcagcaggtaggaggcggaggagggctcgacctcaaagaggaacgaggaagacgagcgagctgtgggcctc

SEQ ID NO: 23391 - DNA, 1448 bp, Triticum aestivum
  Clone ID: PAT_TA_23391
gccggccgggtcggaacaaggcttcgagcgtgtgctgtgcctatacgtgagcttcagtgccgagtgagccatagtagcctagcctagctgactcccgcgatgagctggtggtgggcgggcgcggtgggcgccgtcaagaagagccaggaggagcgcaccgagctctccttccagagcgtcgccctcgtcatcggatccaccggcatcgtcggcacatcgctcatcgacatactcccgcgcgacgacacccccggcgggccctggaaggtgtacgccgtctcccgtcgcccgctccctccctggtccccgcagccctcccccgccgtcacgcatctgctcctggacctggccgaccctgtcgccgtggcggaggccctcaagccgctcaccgacatcacccatgtcttctacgctgcgtggtccagccacccgacggaggctcagaaccgggaggccaactccgccatgctccggaacgtgctctccgtcctcgtcccgggctgccccgcgctcgcccacgtctgcctccagaccggccgcaagcactacatcggcccgtacgaggccatcggcaagatccccgtcccagacccgccctacaccgaggatatgccccgcctcgattaccccaacttctactacgaccaggaggacgtcctctttgaggaggtctcccgccgcgacggcgccgtcagctggtctgtgcaccgtccctccgtggtctttgggttctctctccggagcgccatgaatgtcgtggccagcctatccgtctatgccgccatctgccgcaaggagggcgccatgctgaggtggcctgggagcagggttgcatgggagggcttcagcgacgcctccgacgcggatcttgtcgccgagcaggagatctgggcagccatcgatccgttggcaaggaacgaggctttcaattgcagcaatggagatttatacaagtggaagcagctctggccgatggtggctgaccgattcggggtggagtgggcgggatacgagggagaggacagccggttcatgctcgccgacgccatggccgggaaggaggcggtgtgggcagagatcctccaggagaacgagcttgtcacgactgagctccaagagattgccaattggtggttcctcgatgccgtgttcaatgtcaagtgtgagcatttggatagcatgaacaagagcaaggagcatggattccttggattccgtaacacggccaagtccttcaacgcatggattgataagatgaaggttttgaagattgttccatgatgctgccacatcccatttcctttctttgaagttagtttcgttacatcatttctgtgtttgggtttgggaaggtggcatgatgtaaaatgttatagtgcagaataaagtatgacgacaaaataaatctccgcgtaaatgaattacccatgctcctcatgtaaggccct

SEQ ID NO: 23392 - DNA, 1144 bp, Triticum aestivum
  unsure (1)..(1144): unsure at all n locations
  Clone ID: PAT_TA_23392
cggcgatggcgcgcggcggccgctccgagaagagcggcggcgggtgcgggcggtgctgcctggggttcctgctcaagctcctcgccttcctgcaggccttcgccgccctctccgccgtcctctacgccgcctccatcctctcccggtgggcgcgccaccatgagctccacatccaccacctcctcccagacctatggttcgcgtgcgccgtcatggccgccggcctcctctactgcgccatcctcctcgcgggctacgtcgccgccgaggtcagcagcgggtgctgcctctgcttctacaccggcttggcaatggtgatgatgctgctcgaggccgccgtggccggacgcatcctcctcaacgagcactggatccaggatctgccgcatgaccgcaccggagagcttgagaacctcgtctcctttgtcaatgccaacctcgacctctgcaaatgggctgctctcgctaccgttgccactcaggcactctcgcttttcttggcgatggttctacgagccatggtttcacccacgagtggtgactatgacagtgatgaagattttgtggtcataaggaggccgctgcttattgcccgaggagctccatcctatctccctaccaccgccgaccccaggggtggtcatccgaacttatggagctcatcaatgaggcagaagtatggactgaactcctcgggggactacacctacaacacactgggtcaaaatgcagtgccaccgcagtgagaagcttatgtgcgacaggtgatgaaggaagagcatgcatggctttgttggaagcacctgtgcagcatatttgtagtatctggttatattccatggtgtaatgcgcactatataatttgtgcatccagccaatctcgaactcattgtacatagttccatcattagtgaagatcatgtatgtgtgaccctggctggctagttggaaaggacttgttgtcaacatttcgttggatgtttgttaagctagctggtgatagcagtttatgatgtgaaaaaagatcttgtaaagtaatgttactagcacagtttcacttgtgtggtgagatagtattgatatgccgccaagtattacatgctatgtatctgttcttaaacctccncncttgggtgcagcggca

SEQ ID NO: 23393 - DNA, 1618 bp, Triticum aestivum
  unsure (1)..(1618): unsure at all n locations
  Clone ID: PAT_TA_23393
gctctccccctcttcctctcgtcgacgcgcatccatggcggccgccacctcctcctccctcctcggccgccgcttcctcctctcccgccgcttcgtctcttctcctttccgccccttgtcctccaccgcgcccccgtcctcacactcggccgcggtatccgatgccgagccggaccctgagccacccgccgatcagggtaatcagtaccggagccagccgaggcctcccaacacgacccgcaccctcgagaatggcctcgaccacggcatctacaaggctataatggtgggaaaggtgggtcaagagcctatgcagaagcggctgcggagtgggaagaccgtcgtgttgttatcgctgggcaccggcggcatccgcaacaaccgccgcccgttggacaacgaggagccgcatcagtacgcggaacgcagctccgtgcagtggcaccgcgtatgcatctacccggacaggctgggtagcctcgcgctgaagcatgtcaagaccggatctcttctctatttggaaggaaatattgagacaaaggtgttctccgatcctataactgggctcgttagacgcataagagaaatagctgttcgaggaaatggtcggcttctgtttcttggtaacgatggcaatggccccaagataggtgaagtgaagggcgttgggtacttctgaaagtgaggtccaacaaaatccatctgagaactgagactgaggtactgcacgtgtgctacactttggagtattgtcaacatcttagcattggacaaataatggtatgttgttgccgcagtttgttagtttccccttgcctagtcacattcctgtcttcattaagctttcgacgccattgtagatgccatgtactccctctgttccaaattactcgtcgcagaaatggatgtatctagaactaaaatacatctagatacatccatacctgcgacaagtaattcggaacggagggagtataataggagattgatcatcccagaaaatgaggagcaccagaacataattttcaaactctaacttctggacgacaataacattcagcaaaagcttccgagtcaaatattctcaaaccattctttgtgaaccgtaaacatatgttgcggtcttgttaacaagagattacaaagcctccttccaaattcaaattcttattcttcatcatagacactgtgaccctctccaactgctgagaagccatcaaaacatactcaacattaaagcacgttaagaaaatatataatgatgtctagaagtccttgaattgtatccatgacagccgtggaaaaaagtggcaattgttcaatttatggcaacacaaatgtacatcaagaagaaataactaagtcaagaaaacagaatgtaacacatgtaacaagaaaatcttctaagtaacaagggctgcantttggctccataggatacttgctgtacctcacagattctatttagtattcactgcaatcaaaaggtctcagtattttgggtgtaatttacataacttgaaaactgaaatcatttattagcattgccacaaagtactaaaatattagtcacttggacaattcatcagatccaaaaattaaaatatatattcagcct

SEQ ID NO: 23394 - DNA, 1194 bp, Triticum aestivum
  Clone ID: PAT_TA_23394
cggcacgaggcgcaacacaacacagtcctccggcaccgagccctccgccccgccccgccccgcgcccgacccgaaaccccagccgatcggcggcggccggccggcgcagatgtcgctgacggaggtcaggatcggcgaggaggtgtggctcacctgcctctcccacgcgctcaccaccgagaccgaggaggtcatgggcctcctcctcggcgacgtcgagccctccagcaggggcggctccacggcgttcatatggggcgcgtcgccgcagatgaggtgcgagcggaagaaggaccgcgtcgaggtcaaccccgagctgctcgccgccgcgtcggcgcaggccgaggtaatgacggccaccatcgggaagacgacccgggtgatcggctggtaccactcgcacccgcatatcactgtcctgccttcccatgtagatgtgcgtacccaggctatgtttcagttgctagatccaggctttgttgggctgatattttcctgttttagtgaagatgctcaaaaggttgggaaaatccaagtgattgccttccagtcacttgatgggacacagaacacacagcgtgctattgttcctgttattaccaatccagtcgttaaccttgaatcatcttggagttcatccgaaaactcattagcattgattgagggcattgaacaggacactggagattctagagcttcaaacggaagcaaggtctggggaagatctcaggatatggatctgtatccttctttggacacaaatcattcggcaagacatctaccgatagaaaacgctattgttccttttgaactggaaaacagtgctggaccctctattgatcaagatggttcagatttgtccccaagcatacaggaggctttgcaccggtcaaccatggacataagattctgggctttcatgtttcttcgtgagcattaggacaaagaagtcggaggaagcatagttctagctcattagagctagttctgagagtaatgaagccctttatgctgctcctatttgtatgtgtgttatatgatgtagcagaatctggctcatgtgattgtacacttgtggagcttgttatttgattgtaaacttgatgttgatcacatttgtatgtgtgttatatgatgtagcactttgatggttgataatatttgaagtatttcgtgtgttcggtgtgccaattt

SEQ ID NO: 23395 - DNA, 1150 bp, Triticum aestivum
  Clone ID: PAT_TA_23395
cccaaatccagcggagcttcgcttcctcttcctcttcttctcccctcaacccaaacccaaatccaaatcccccaacccaccggcggcgatggcgcgcggcggccgctccgagaagggcggcggcgggtgcgggcggtgctgcctggggttcctgctcaagctcctcgccttcctgcaggccttcgccgccctctccgccgtcctctacgccgcctccatcctctcccggtgggcgcgccaccatgagctccacatccaccacctcctcccagacctctggttcgcgtgcgccgtcatggccgccggcctcctctactgcgccatcctcctcgcgggctacgtcgccgccgagatcagcagcggctgctgcctctgcttctacaccggcttggcaatggtgatgatgctgctcgaggccgccgcggccggacgcatcctcctcaacgagcattggatcaggatctgccgtatgaccgcacaggagactcgagaactcgtctccttcgtcaataacaactcgactctgcaaatgggtggctctcgcaacctttcccatcaaggcactctcgctttttcttggcgatggttctacgagccatggtttcacccacgagtagcgacttatgacagcggatgaagattttgtggtcataaggagaccgctgcttattgcccaaggagctccatcctatctccctaccacggctgaccccaggggtggtcatccgaacttatggagctcatcaatgaggcagaagtatggactgaactcctcaggggactacaactacaacacactggatcaaaatgcagtgcgaccgcagtgagaagcttctgtgtgacaggtgatgaggaaggaagggcatgcatggccttgttggaagcacctgtgcagcatactcgttgtatatcgtaatattccattgtgtaatgcacactatatacatttgtgcacccattcaccctgtcaatctcgaactcattgtacatagttccattgttagtgaagatcggctagttgggaaggacttgttgtcaacatttcgttggatgtttattgagctagttagagatagcagtttatcaagtgatttttttaagtaattttactagcataaaaaaaaaaaaaaaaaaactcagactagttctc

SEQ ID NO: 23396 - DNA, 774 bp, Triticum aestivum
  unsure (1)..(774): unsure at all n locations
  Clone ID: PAT_TA_23396
ggtgacggcaaaggcctcccggctatataacaaggaacattatctaggaaaaacctcctcccgctccagccccctcgcgccccagccgccgccgtcgccgccgccgactgcagccatgtcgctgagcgcgggtgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaagagggccggagagctttccgcggaggagatggaccgtctgatggcggtggtgcacaacccgcgccagttcaaggtgccggactggttcctcaacaggaagaaggactacaaggacggcaggttctcccaggtcgtgtccaacgccgtggacatgaagctcagggatgaccttgagaggctcaagaagatcaggaaccatcgtggtctgcgtcactactggggtgtgcgtgtccgcggtcagcacaccaagactaccggcaggagaggaaagactgttggtgtctccaagaagcgataagctgcttcacaaagatgccgcatagctttgctactactttgttggtccatttccagaatcttaaggagtgttcttatttaggcgattaccttggatgatgtttttcctagataatgttccttgttatatagccgggaggcctttgccgtcaattcttgaaaagcaaaaggaagcttcattttatgctgccctanaatata

SEQ ID NO: 23397 - DNA, 988 bp, Triticum aestivum
  Clone ID: PAT_TA_23397
ccacgcgtccgcgaggagccactccacacaggcaagcaagggtagtgagactcagaggttcaggcatggcagctccaagagcactcgccctcgccgtcctgctggcgatcgctgtcaccaacgccgaggccgcttccgtggtcgtcggcctggccaagtgcgccgactgcaccaggaggaacatcaaggccgaggaagctttcaagggtcttcaggtggcgatcaagtgcaagaacgtccacggcgactacgagagcaaggcagtgggtaccctcgaccgcaccggcgctttcagcgtgcccctggccgccgacctccacggcgccgactgcgtcgcgcagctccacagcgccgcctccagcgccccgtgccctggccaggagccgtctaagatcgtgccggtgtcggagggcaccaccttcggcgtcgtcgccggcgacaacattaccacaccttctgcagcagcgtcgccggagtgcgcgtccatgaccctgtgcgggccgatcaagaagcacatcatcgagcacttccatcacaagaagcccgtgccgcccaagccggagcccaagccccagccccaccctgactacggccccgtgcccaagcccgagcccaagccgcagccccacccggactaccaccccgtccctcccacgcccacctacggcggcggcggtggataccacggacaccactgagtccgatctaccaccgtcctgcccagcgctgaaatctcatcaccgggttcatgggcatgaactcatgatcggcgttgctatttatgatcggtttgcatgtgtgggtatcgttaggtcttctgccattcgctgcagagttgagagttcagaataacagatgtatgtgtgtcactgtgtcaaccgagtgtgaaggtgtgttgctttatcaagattttgtaatttcggtgcgtttaccgaagttattatgaatcaagtaatgtatttaaacaagtcgatttgtcaacccaagt

SEQ ID NO: 23398 - DNA, 1310 bp, Triticum aestivum
  Clone ID: PAT_TA_23398
acacatgcagtagattacttgcccatctcgtaactaacatacacatgcagtagattacatggtcacgtgtgaagaagacttgaaaacctcaaaggaagttatgctttggaaaataacaagcataaagttggacactccctcatagaattcactgtatcagctcaacataatccacataactccagacacaatcatctggtacaaaagaaccaagccctggtggcaacataatcgcggtaagcaccacctatttctgagaatgtttactcaagtaaacccgcatccttgagagcagtctcaaaattgtcctcgcttttccagttggggacctcaggcactttgtgctggaagtagtcctcgatctttgtcatcacaacttcatcagtttgaccacatagcaggttgaacacagctccttttcggccaaagcgtccagctctgccaattctgtgcaggtacacctcataatcaggttcatctctcgtattatacttgattggcatgtcgtagttgatgaccaggttaacctgtgcttggtcaaacccacgagcaagaacatcagttgatataagaaccttggtgtatccatctttgaattcctgaattactttttccctctctgcttggtcaagggatccttgaattgaggagcacacatagtcctcttttgtcaaagcattatgtacattcttagtactatttcttgtcctcacaaagatgataacctgtccaacctttgtgaggacaagaaatagtactaagaatgtacataatgctttgacaaaagaggactatgtgtgctcctcaattcaaggatcccttgaccaagcagagagggaaaaagtaattcaggaattcaaagatggatacaccaaggttcttatatcaactgatgttcttgctcgtgggtttgaccaagcacaggttaacctggtcatcaactacgatatgccaatcaagtataatacgagagatgaacctgattatgaggtgtacctgcacagaattggcagagctggacgctttggccgaaaaggagctgtgttcaacctgctatgtggtcaaactgatgaagttgtgatgacaaagatcgaggactacttccagcacaaagtgcctgaggtccccaactggaaaagcgaggacaattttgagactgctctcaaggatgcgggtttccttgagtaaacattctcagaaataggtggtgcttaccgcgattatgttgccaccagcgcttggttcttttgtaccagatgattgtgtctggagttatgtggattatgttgagctgatacagtgaattctat

SEQ ID NO: 23399 - DNA, 1213 bp, Triticum aestivum
  Clone ID: PAT_TA_23399
ataccatacataacttgttcgaatcctccaaaagacttgtctggtcagcaaggcagtactaataacaacagtattatacagccggtaacagagctagtggcgaaacaactctagcaaccgtttcgatacagctgggacgatacatacgctcagccctgaagcactgcagcgccatcatgcgatgaggaaagggagcacggtcagcatgaacgcctcgtaaccgaaagttgcataccccgagtacgccgtgtccttctccttgaacttctcggtcaggcccttcactgtgagacagcattcaatgaagttgtcatattcaaccgctttgttcttgcccccagtcttgtcaaatttagacacaagcaagtctagcacagttggagaaacggaatatccaagatctagaagagcatcacgcagttctggtgcatcaattctaccacttcggtcacggtcaaacctctcaaatatgcccctccaattctgaagactgtaaaacacagaagtgaactcctttggcccgatcttgcggacgttggtgttggtgaagaggtacatgaggaggtggacggtgcggaggctgaagctctggctgctgaacccagagagcgcggactgcagctccttgtcgtcgatcatcccgctgccgtcgcggtccgccgcctggaagcacgccaccacgttcgggtccgtccccggcgggaaggtcgacggcaccagcgccgcgaacgggctcccgtacccaccgctgccgcctcctgcgtagggctgcgcggcgggtgggcctccgtacggcgcagcggacgaaggcggctgggcgccgtagggctgctgcccgtagccgcctccgccgcccccgccgtaaggctgctgcgggggcggagcgccgtggtaggggtcggagccggaggagtaggaggtcttgccttccttgggaggcttctggccgtaggacggtggggctccgtagccgccgccgccgccgtaaggctgctgcgggggcggagcgccgtggtaggggtcggggccggaggaggaagaggtcttgccttctttggggggcttctggccggagggcggtggggctccgtagccgccagcggcgccgtaggggtagccagagccggggggtggggggtagccagccatggggttagacttggggattggagctgtgtgctcgatcacggcggacgcgtggcggacgcgagga

SEQ ID NO: 23400 - DNA, 927 bp, Triticum aestivum
  Clone ID: PAT_TA_23400
aaaaaacaaaaaaaacagagtccttcccgagcgcggacagcgggctcctaccagcagcgtctccctccgacctccctggagcagccgctcacgcccagcaacgtcgccgcccggatctacgccgtcgaccattccataggcagggcatcaacactgtcaattgcagaggcttggacctgcttcggcatccagtagagcaaacaagaaggtcaagccggaaacaaatatttcatcctcgttcggacttctcatctcgcaatggaagccaagttctttcggttcctgaagcttgttggagttggcttcaaagccaggacagagcgcgaaggccgcgagttgtttctgaaactgggctacagccatgaggtgcagttcaccgctccacctgccgtccgcgtcttctgcttcaagcccaacataatatgctgtactggcattgacaagcatagagtgcaccatttcgctggagctgtccgatgcagtaaacctccagaagtgtacaaggggaagggcatactgtacatcgacgaggtcataaagctgaagccggggaagaaacagcagaagaagtaacacatgggtaaacctccccatttgacttctagcttgtttagacgccccatcacatttgtggtgccgcggatttcatgtggtttttctcgtgccgggttttggctagccctagtaccatgctggacttcgtaataatactctgtatgctatgggaatcatctggtgagcatgtactgtatgacttgcataccgtgggggcggatcagcacatttgaacatttgtgtttttgttttgggctggctagatgcatgtaacagcccaatgtgtttgttgatgtcactactttcttcatattttctctacacaatattagctcgttgctttgtcaaaaaaaaaaaaaaaaaaggccccta

SEQ ID NO: 23401 - DNA, 601 bp, Triticum aestivum
  unsure (1)..(601): unsure at all n locations
  Clone ID: PAT_TA_23401
taaatatcagaaaccctagcattcgccgcgagcttatcacttatcatccccatccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactgggtaagcatggtcatgccaaatgccactttgttgccatagatatattcaacgggaaaaagctcgaagatattgttccttcgtcacacaactgtgatattccgcatgtgaaccgtactgagtatcagctgattgatatatcaagaggatggatttgtgagccttcttacttcagatggcaacactaaggatgatcttagactcccaactgatgagaccctgtgggccagattaaggaagggtttgaaagtggaaaggtcttgttgtgactgtccagtctgctatgggggangagcagatctgcgcgctgaaggatgttggccccaagtaa

SEQ ID NO: 23402 - DNA, 674 bp, Triticum aestivum
  unsure (1)..(674): unsure at all n locations
  Clone ID: PAT_TA_23402
ttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactgggtaagcatgggccacgccaaatgccactttgtcgccatagacatattccaatggggaaaaagcttgaagatattgttccttcatcacacaactgtgacattccgcatgtgaaccgtactgagtatcagctgattgatatttcctgaggatggatttgtgaagccttcttacttcagatggcaacactaaggatgatcttagactcccaactgatgagactcttgtggcccagattaaggaaggttcgaaagcgggaaggatcttgttgtgactgtccagtctgcgatgggggaagagcagatctgcgcgctgaacggatttgggcccaagtaacttcccttggctttggagacggnacccactcnaactcaacttaaatccgnaaagaagtgttcaccaaaaggatgctacggnnacatccacctgncntgagctggctttgc

SEQ ID NO: 23403 - DNA, 1488 bp, Triticum aestivum
  Clone ID: PAT_TA_23403
atcacattggatgttggtacaaataatgaggagcttctgaatgatgaattttacattggcttgaggcaaagaagggtcactggccaggagtatgctgattttctgcatgaatttatggctgctgtgaagcaaaactatggggagaaagttctcattcagttcgaggattttgcaaaccacaatgcctttgatctccttgcaagatacggaacaacccaccttgtattcaatgatgacattcagggaacagcttcggtggtccttgctgggcttgttgcagcactgaaattagttggtggtacattagcagagcacacctacctgttcttgggagctggagaggctgggacaggtattgcagaacttatagctcttgagatgtcaagacagacaaaaacaccaatagacgaatgtcgcaagaaaatctggcttgttgattcaaagggcctgatcgtcagtacgcgaaaggagtcccttcaacacttcaagaaaccatgggctcatgagcatgagcatgtcggcaacctcttagatgcagtgaatgctatcaaaccaacagtgttgattggcacatctggaaaggggcaaactttcacacaggaggttgttgaagcaatttcctcatttaatgagatgcctatcattcttgccctgtccaacccaacgtcgcaggctgagtgcacagctgaacaagcttacacatggagcaagggtcgagcagtgtttgcaactggaagcccatttgatccagtggagtacaatggcaagacacatgtgcctggccaggcaaacaatgcatatatctttccagggtttggccttggagtggtgatgtctggggcaatccgtgtgcatgatgacatgcttcttgcagcctcggaggctctggctcagcaggtcacacaggagaattttgacaaggggctcatttaccctcccttctcaaatatcagaaagatctctgctcacatcgcggccaacgttgcagcaagggcatatgaacttggtttggcgagtaggcgccctcggccaaaggacctggtcaagtatgcggagagctgcatgtacagcccgatttaccgcaattaccggtgaatctgcattcatccggctgtgtacagaaactgtttgtccaactacttgcttcaaaatccctgaagaacaccacttgtggttaagctgtgcaaccggggttggttcaagctctgtttcgtatttacttcctgtgctgcctattatgtagtactccctccgtcccacaatgtaagacgttttgcaagctattttgggacggggggagtatttcgcttgctactactacttggtctgtatactgtagtgcttttgccctggatgtgatgtataaactgcctttgtggcaaggtaagataagtctttgtattctcatcggacaaagttatcgtccagtgcatgtgccggagaaggacaggtttggaataaaagtttctacagtttcttcctcggtcc

SEQ ID NO: 23404 - DNA, 929 bp, Triticum aestivum
  Clone ID: PAT_TA_23404
ttttaggagggaaaagcacgtgggtatgagtaaaattaaatcaccgtgccccgtcttttggcaacaaaagaagcacctgtgtctaaaactcatcaattactcaacccatgatcatcaaaagaaagagttcatgctagcaaaagcttgcgcaactgagataaggcatttggagcatgtgtgcaccacactagaatttaagagtacgctcatgcgacgacagccaagagatccgactctcggcagaagcagtgcttctcttctgttcccaggtccacctcataagcgtttatgtccgagaagagaacctgcaacaatcacaagcagaacatggtcagaaaatcccaggtgctactccctccgtccgaaaaaacttgtcatcaaaatggacaaaaaggaatgtatctagaactaaaatacatctagatacatccatacatgcgacaagtaattcggaacggagggagtatatagcaaattatcctctctgagccatgttcttggtacagattacttcggtagaacgtcagataaattatagccggggttaggatacctctcgagaagcagtaagttttcgaaagggttgaatgtatacatatgtcaagccttgctatgcattggttgtatacttaaagcagttgagtacttactttgaacaggtatatgcctcgctagcacacaagaacagtcagctccatgtatgaatcggacgaacagttggggctatgtcacaccaccaatcgaacagttgtatagttaacccagtctcttcccgcattagtttaaccagaagtgaactatgtacaggttactaacctgtgtctcgctcgcagccgcgccaggacccttgtctcgctcgcagccgcgccggcacccgtggatcgctggaagccaggccggcacccgtgtctagctggcagccgtgcccg

SEQ ID NO: 23405 - DNA, 992 bp, Triticum aestivum
  unsure (1)..(992): unsure at all n locations
  Clone ID: PAT_TA_23405
aggaattcggcaccagagccacttcacacaggcaagcgagtggtaagggttcaggcatggcagctccgagagcgctcgtcctcgccgtcctgctggcgatcgccgtcgccaacgccgaggcagcgtccgtggtcgtcggcctggtcaagtgcgccgactgcacaaggaagaacatgaaggccgaggaagccttcaaaggtctccaggtagcagtcaagtgcaagaacgtccatggcgactacgagagcaaggcactgggtgccctcgacggcaccggggccttccgcatgcccctcgctgctgacctccacggcgccgactgcgtcgcacagctccacagtgcagcctccaacgcgccgtgtcctggccaggagccatccaagatcgtgccggtttccgagggcaccaccttcggtatcgtcgccggcgacagcattgccacgccgtctgcagcgtcgccggagtgcgcatccatgaccctgtgcgggccaatcaagaagcacatcatcgagcacttccaccacaagaagcccgtgccaccgaagccggagcccaagcccccagccccacccggactacggccccgtgcccaagcccgagccaaagccgcagccccacccggactaccaccccatccctcccacgcccacctacggcggcggaggtggcggcggataccacggacaccactgagtctggtctaccaccgtcgtcctgcccagcgatgaaatctcatcaacgggttcaaagtcagtgagtgattgacgttgctatttatgatcggtttgcatgcgtgggtggattgtttggtgttgtgccattcgctgccccgttttagtatctgccccgcagagttgagagttcagaataacagttgtgaggaacacatggatcactgtgtattttgctttttaaagatttgcaatttcggtgtgtgttttgtatacgaagttgtggatcaagtaatttaatcaagtccattattnagccaa

SEQ ID NO: 23406 - DNA, 1051 bp, Triticum aestivum
  Clone ID: PAT_TA_23406
ttttttttttttcgacaaatagcaaacaattcgtcaagtccaatctcaacagattacaaagtatacagaaggtatagtaaattcacattgcacaacaggaaaccagtataaggataagattttgactccatccaggacaattcagtatggcaaagcgatgatgaatacagtgtgcaaatcacatcagaaacaagctatatatactcgacatgctagactcttcacagcgtcgcaatgattttgctctgctgaaattgaaatacggtagttcttctgtcattaatcattgttcttttgttattaggatgtcatccgcagcaggatccacaagcagggagggaactctgatcgtttgatcggaggtcagatagtgtgcgaggaccgcgagggccacctccgccgccgcccccaccaccatatggacccccaccaggacctcccccaccaggtccaccatcccacttcttaccactaccatatcctttcttatagctgtctgttttctcgatagaaaacattgtgaggaagaacattctgatgaagttcacaatagccttaaagaagtcagggattatgcttagtctccagattgtccgtttgcctttcacaacacctctctcgacgtaggccatggtcgcgcttgcgctatccggatcgcccccttgccgccctcttccttgagaggctcaagaagatcaggacccatcgtggtcttcgtcactactggggcgtgcgtgtccgtggtcagcacacaaagactaccggcaggagaggaaagactgttggtgtctccaagaagcgataagctgcttcacaaagatcccgcatagctttgctactactgtgttggtccatttccacatcttaaggagtgttcttgtttagacgattcccttggatgatgttttgccctagataatgttttggttctggaccctttaatatattgtatcttgaattcccttgttgaactcttgagagtttgttttgcccatgggcttagagtcatttccaatggttggcaagagcaaaaaaaaaaaaaaaaaaaaaa

SEQ ID NO: 23407 - DNA, 615 bp, Triticum aestivum
  Clone ID: PAT_TA_23407
gcacgaggagagagaaaaaaatcatccttcgagagatttcgcgggggcgcgggttcgtgaggagctagggtttgggagggagcagcggagaagatgatcgaggtggtgctgaacgacaggctggggaagaaggtgcgggtgaagtgcaacgaggacgacaccatcggcgacctgaagaagctcgtcgcggcgcagacggggaccaggcccgagaagatccgcatccagaagtggtacaccatctacaaggaccacatcaccctcggcgactacgagatccacgacggcatgggcctcgagctctactacaactagaagtatggccgcatttgagtcccgttgtcttaagaagctactccctccgttcggaattacttgtctcggatatggatgtatctagaactaaaatatgtttagatacatccatttctacgacaagtaattccgaacggagggagtacgtactactgtatatggaatccaacgaaccatagaagactgctggatgtaccaatgactgccgacctgaaatactgaatgctacttataattgtgatgtgatgtgacgctactcgtacactacatataacataatgtttgtgacctttgtgcgat

SEQ ID NO: 23408 - DNA, 1165 bp, Triticum aestivum
  Clone ID: PAT_TA_23408
cgcatataacaagaataactgatacaatgtactccctctataaactaatataagaccttttagatcactatattaatttacagaggagtattagtgagtaatatgcttgcaacggtaggctctatgcaatagcgcagcaccatttgttcgtcaaagtttaacagcttcaaacatagacaccacgcaagaacaagctgctaacaatgcattcgagcctgtgcttgtgagccacagcggtagctgaacagttacacgttcgcccgtagagcaacaaataggatgaatggcctgtgccctggatgaactcggggagtaggcacctctcagaaacgaagaaggctgcccatgcgagagaggcactgtctccgttgtccattgagcttttaccagctcaaggtattcttggactgttggagctttgcactataagcggcttccagttcctccttgcaagctttcagcatcggttgaagaaaggacgttctgaaaaatctgatgtacttttcaagggatgttctctccaaatcgttctcagaagcaatctgcataccagccgcattgagctctcctaacagctgtgataaagttggaacagccataggatcaaaatcttcacaattgttgggatcgattggaacacaaacacgccctgtctttgggtgtatgcaaaagggggccttcagtaaatgattcatgtgctttgacacctccatgtcaagtctaggatacgtgtacgagaagacaatctcttctacacatctacgaagcccctgcgtcttgtgctttcctgactgcaaggtcgtctttaactgctcccatcttgctgcattcacatcttcttttgagatggaggatcgtctatttccttgccatttatcatggagctcactagcaacattttcgtctggaataagttcgagtatcttctggcacctctcctcggatgcaaatagttgttggctatgtaacagcttgtcttcaaagaagcatttcagaacatcggtgtatgaccgtgcaaggaaagggtgaaggacaggcccagtcaacgaaactttcttgagtgaattctcgccacccttatagacacggaagtagtcagcaattgcagacctttgttcattgcttagctttcttgctctactatcacaaacccagcaaggacacc

SEQ ID NO: 23409 - DNA, 1007 bp, Triticum aestivum
  Clone ID: PAT_TA_23409
cccacttgtccgaaccgccaacggtgacggtggtgggcagtttcgcttggctcctcctgtcttgtagcagttcgcgtgcacaagaggtcgccatgtacccgaagccggaggacggcccggcgacggggttcccgatgagcggcggcacggcccgcacgggcggcgggccgggcgcgtactaccaggcggcgccggcgacggcggcgttcgcgatgcaggcggcgcaggcgccgctggcggcgtggtcgacggggctgtgcgactgcttcgacgactgcggcaactgctgcatcacgtgcctgtgcccgtgcatcacgttcgggcaggtggcggagatcatcgaccgcgggtcgacgtcgtgcggggcgagcggcgcgctctacgcgctcatcatgctgctcacggggtgccagtgcgtctactcctgcttctaccgcgccaagatgcgcgcccactacggcctccaggagagcccctgcgccgactgctgcatccactggtgctgcgagccatgcgcgctctgccaggagtaccgcgagctcaagaagagaggcttcgacatgaacctcggatggcacgccaacatggagaggcaaggacgcaccccggcgaccatgccgcccctcatgcacccagggatgacccgttgattcatcgctccgtccgtgccttttcctctcaaaacacacatctaaagtgagcgtccttgtgtagtactccctccgttcggaattacttgtcacaaaaatggataaaaatggatgtatctacaactaaaatacatctagatacattcatttcttggacaagtaattccgaacggagggagtacaaataatctccatgctgttcggcgtctttgcggtgtcacagcttgcctagctacttgcaggtttctgtacaattaatacagtgtaacacagaactaccactttctgtaatgttattagaaattatgtatttatagtttgaaaaaaaaaaaaaaaaaactcgagactagacctcgg

SEQ ID NO: 23410 - DNA, 1662 bp, Triticum aestivum
  unsure (1)..(1662): unsure at all n locations
  Clone ID: PAT_TA_23410
ttcttcgcgtccgcggacgcgtgggcgagcccgaccagccctccgcccccgcgaccgcgcccctctccaagcgctgccgtgagcccgccttcgcagtcacggggaacgcgacgagctcccgcggcggcggcggcctccgcgagaaggcgagggccgtcacccgcctcgccggatccggctcccgccatacgcatgccgatgctcagtactccgggggtccggtccccggggtcgcgttcgaccccttcgacatcgaggccgaccctccgccgttggcgctgacacacgagcagatcaagctatgcaaggacgcgctcgcgcatttcgagcggaggagcaagcagctggatgccttgtccgacgagttccaacggcttcagggcatgagaacaatgcatccggagatgatgaaaatgtccactgtagctcgtgatgctgccaatagggagaagaaccgctatattgatgtcttaccatttgatgataccagggtacggctaaaatcatcagcaaccagtcaaatttcaggcaatgattacatcaatgcaagctttgtaaaggctaccgaggacaacagtgttgcaagatttatttccacccaaggaccactagtaaggacatttgatgatttttgggaaatggtttgtgaaaatcagtgtcctgtgattgttatgctcacacagtacgacagtgttaagtgtgatgagtatcttccattgcaaaatggtcaagggacgtatggaaagtatgatgttaagattaggaaggacacaagagataagcatcaattatgtttgcgtgctgtggaggtgcagtgcaatgagtcaggcaaggttcattctgtactccatatagagtatcctgattggcccgaccatggcgtaccagcaaacactgatgctgtgcgacaaattcaaaaacggttacatcacattccgagagaacatcctatagttgcacattgcagtgctggaattgggagaactggtgcttacatcaccatccatagttcaattgagagaattctccttggagacaaaagctcttatgatcttgttgaaactgtaaaaaactttaggtcccagcgaactggaatggttcaaactgagcaacaatacatgttctgctaccgtgcaattgcggatgagctgaaagatctgctgaggtcgtcaggccattgaggtatctctaaggaagaactggactgctaccgtattgtcgcccttctatttccatcgtaaaccgaagcatcttgttgcttgttgcttttgttagggcaccagtgcattaagatcactttgccacatcagtattgttaagacaactgcttgttgaagactcagtagagtttacaacatctggtggaccaaagcatgtaaacagcccattcctcgaccaacagtagcagaatcatgggtccctttcccttgtggatgatttatattgtttcccaagacaccaggaagatgaatgccaggcgtatgtagttagatgagaccaatgcatcgttgattgtatcgaaactgaaaactgggcatctgggacgattatttgattatttattgtgtcccctgtgggagcctttctcagagttattgaaaatgtatccactactgttatccaagtcttctatctatactgaaacataagagcgtttngatc

SEQ ID NO: 23411 - DNA, 974 bp, Triticum aestivum
  unsure (1)..(974): unsure at all n locations
  Clone ID: PAT_TA_23411
agatccgtcggggtaggcaggcccagactagagggacaacccggggatgttcgggatgcgggcatgcggcgcagcggcgtcgtgggtggtggggtggatgggcacggatgcgcacctgtacgacgacccggaggccgtcgccatcccggcgctgctcgactcccacttcaacgtcgacaaggtcgacgcgctcaagcgcctcctcgccctcatcgcccagggggntcgacgtcgcacacctcttcccccaggtggtgaagaacattgtggcacagtcgctcgaggtcaagaatctcgtctacctctacctgctccaccacaccgagacgacaatggaaatcctttgttcggagagcaaaaccaagttgaagtgagtgggattttagcatggctgctgttggccctttgtaccgtgccagttcaaggtgtcggactggttcctgaacaggaagaaggactacaaggacatgaggttctcccaggtcgtctccaacgccatcgacatgaagctcagggatcaccttgagaggctcaagaagatcagggagctccgcatccgagtctcgtccatcctcggcagcaaggagctgggccaagggagcaagcagcgctgctggttacttggggccagatcgagtaagatggcgcaccatggcgtgtggcggcctattttgcttccatgagcagtactgtttatttgaaatgagatgtactcgtctagtgcctagtaaaaagtactgcctagtactgtttattttgcttccaagagcagtaccgtttattttgcttccatggcgtgtggcggcctattttgaatgattgtcatgtactgtgatgtagtgagctgtaggagtaaaatgagataacacttgtggagcttgttatctgattgtaaacttgatgctgatcacatttgtatgtgtgtcatatgatgtagcactttaacggttgataacatttgaagtatttcaaaa

SEQ ID NO: 23412 - DNA, 1333 bp, Triticum aestivum
  Clone ID: PAT_TA_23412
tgctctgacccaaatcccaaatcccgaatcccgaatccccaaacccgccggcgatggctcgcggcagccgctccgggaggaacggcggcggcggcgggtgcgcgagctgctgcctggggttcctgctcaagttcctcgccttcctccaggccttcgccgccgtctccgccgtcctctacgccgcctccatcctctcccgctgggcgcggcaccacgagctgcacttcgaccgcctcctccctgacctctggttcgcgtgcgccgtcatggccgccggcctcctctactgcgccatcctcctcgcgggctacgtcgccgccgaggtcaacagcgggtgctgcctctgcttctataccatcctggccatggcgatgatgctgctagaagctgccgtggccggccacctcctcctcaacgagcactggatgcaggatctgccgtatgaccgcacgagagagctcgagaacctcgtctcctttgtcaacaacaacctcgacctctgcaaatgggctgctctcgctaccgtcgccacacaggcgttctcgcttttcttggcaattactctacgagccatggtttcgtccaccaatgcggactttgacagcgacgaagattttgtggtcataaggaggccgctgcttcttgcccaaggtgctccagcctatctccctaccacggccgaccctagaggtgcccaccctggcctatggagctcatcgatgaggcaaaagtatggattgaactccacaagcgactacacctacaacacactggatcaaaatgcagtaccaccacagtgagaatctgcgtgactgatgacgaagtacatatcatatatgcagtacacaagtcatatgttgcaatatgccatggtgtaatgggcactgtatacatttgtacgcccagttattctgtgaatctcggttgtacatagttccatcattactactccctccgttcggaattacttgtctcggaaatgaatgtatctagaactaaaatacgtctagatacatccattttcgcgacgagtaattccgaacagagggagtagtaaagaacatatgtgtgaatggctgccctggttggctggctgctatttcttcgagatccgcttactagtgctgaatctggagcaaatccacaactcagtcattgtgacagccaggagatggccgtatgtaaaaaaatagtctatcttgttggatgtcttgggttggctggtttcttcaatgtagccaaagagatggatgagcaagaacggcagtatttgcattggatgtgtattaagttagatatagcagttagtaaaaaaatgtaaggtaatgttagt

SEQ ID NO: 23413 - DNA, 894 bp, Triticum aestivum
  Clone ID: PAT_TA_23413
gcttctttgacgaagaaaaactcgagtccaggaagccttcttcactcctccccgtcccatcgattatctgtggcggccatgagggtagcctccagggtggtcgtcctcgtccgagactccgcgggctacggcgcagccctcgctgacgcgctccggccgtcgccggggctcacgaggggttcctcgcccttcgatctccctctcgataagtacggcctcaacggcgagaaggcctctggcgagctcgttagcttctctgactccagtggctctcctcaggtgtccttttttgttctgcctgactataggcctcctgttgctgcatgtgctatgaatgagattttagcattgatttcttctgaagctccctccatccagcccgttctgattgtaccattcatcacaagaccatcaggctgtttccatggaatggttaatgcaaccaaaactgggcagttaactacacttcacgctgctgaaataggggcatcaaatgagtttactcacttgttggttgatggaagtattaaacctcccccatctttgcaaatacgtagtgaaccaatacaatgtttgctggaaatagtgcgggtattgaagatacccacagttcttgtcacatcaggtgggcagcaccaaggcaaaagttcttcagactctgaccttgaggtgctgcagtgcgtgggagatcacgtagccaagcacatcaacttggagttctccaaagaaactgtcattgagacaggggttgagaaatcagcgagcattcaagaaccctggcgtgaactgtatctgtgacgattctaaaacatatcgtctttgtgcccttataaatagatatcttaacattttagattcggatgtactttttttttctttttttagcgggtggaa

SEQ ID NO: 23414 - DNA, 2078 bp, Triticum aestivum
  Clone ID: PAT_TA_23414
gacgcggcgacgggggggggttgtttaaaggacacctacgtttaggaccgcgccaccgaggagcagctcgtcacgccgtggaccgtctctgtcgcgagtggttacaatttgttgagggatccacgctacaacaaggggcttgccttcacagagaaggagcgcgagacacactaccttcgtggccttctgccaccaaccgtcatatcccaggagctgcaggagaggaagatcatgcataatattcgccagtaccagctacctctgcagcgttacatggctatgatggaccttcaagaggggaatgagaggcttttctacaagctcctcattgacaatgttgaggagctgcttcctattgtgtacactccaactgttggtgaggcctgccaaaagtacggatctatatttagtcgtccgcagggtctttacatcagcttgaaagagaagggaaagatccttgaggtgctgaagaactggcctgagaggagcattcaggttattgtcgttactgacggtgaacgtattttggggcttggagatcttggatgccagggaatggggattcctgttggtaagctttccctttacactgctctaggaggggttcgtccatctgcatgcttgccaatcacattggatgttggtacaaataatgaggagcttctgaatgatgaattttacattggcttgaggcaaagaagggccattggccaggagtatgctgattttctgcatgaatttatggctgctgtgaagcaaaactatggggagaaagttctcattcagtttgaggattttgcaaaccacaatgcctttgatctccttgcaagatatggaacaacccacctggtattcaatgatgacattcagggaacagcttcggtggtccttgctgggcttgttgcagcactgaaattagttggtggtacattagcagagcacacctacctgttcttaggagctggagaggctgggacaggtattgcggagcttatagctcttgagatgtcaagacagacaaaaacaccaatagacgaatgccgcaagaaaatctggcttgttgattcaaagggcctgatcgtcagtgcgcgaaaggagtcccttcaacacttcaagaaaccatgggctcatgagcatgagcatgtcggcaacctcttagatgcagtgaatgctatcaaaccaacagtgttgattggcacatctggaaaggggcagactttcacacaggaggttgttgaagccatttcctcatttaatgagatgcctatcattcttgccctgtccaacccaacgtcgcaggctgagtgcactgctgaacaagcttacacatggagcaagggtcgagcagtgtttgcaactggaagcccatttgatccagtgcagtacaatggcaagatatatgttcctggccaggcaaacaatgcatatatctttccagggtttggccttggggtggtgatgtctggggcaatccgtgtgcatgatgacatgcttcttgcagcatcggaggctctggctcagcaggtcacacaggagaattttgacaaggggctcatttatccccccttctcaaatatcagaaagatctgtgctcacatcgcggccaacgttgcagcaaaggcatatgaacttggtttggcgagtaggcgccctcgaccgaaggacctggtcaagtatgcagagagctgcatgtacagcccgatttaccgcaattaccggtgaatccgcattcatccggctgtgtgcagaaactgtttgcccgactacttgcttcaaaatccctgaagaacaccacttgtggttaagctgtgcaaccggagttagttcaagctctgtttcgtatttacttcctgtgctgcctattctgtggtactccctccgtcccataatgcaagacgtttttgcaagctattttgggacggatggagtatttcgcttgccctggatgtgatgtataaactgcctttgtggccagataagataagtctttgtattttcatcggacaaagttatcgtccagtgcatgtggtggagaaagacaggtttggaataaaagtttctacagtttcttcctccgt

SEQ ID NO: 23415 - DNA, 1989 bp, Triticum aestivum
  Clone ID: PAT_TA_23415
ctccggcgacctcaggcgggaatcgacgaccggcgagatccgtgcgcgcgcagcgagatccatctgtctctcacacgagagggaaaatccgcacgactcctccttctcctcctatgtggatcgatcccctccaacccagccgccgtcgccgcagacctcccccaaccccggcctcctccacagccggcgaccccttctcttcctcccccaacccagccacctgcagcagcagatccatgcaggacagatctgagctccactacctccgttgctccctttcccccgaccagatcttcctcttgcgttccggcacctcgccggcgtggctccggcgttgctccggcgactcagatccaacacgccgtcgttgctcgagcaccgggacgctatcgatgggaagtcttcctcctcacctcatcttgtctccctcacatgagcgatgcagcttcaccgctaccctgacgccatcaaggagcagctgcacgcctgcaaggctgcaacatcaccaactcgacttggatgcagggagaggagacgcccaaccatgggcaagctctacgtcggcatctgcctttgtagcttgggcctagggttagctgaatgctcaagacatgggtagttctgggagatggtgattagggactgttttacaacacatcatcctctgtttttacacgtagttgtagaagaaaatacttttacttattgcaagtcacgactgtcatgcgtatgttatgaattcagaaactataacatgttttttttgccatggtgaaggagtaaactgaacaattaagttgctagttcagtatgtgagttgcatcatactgtacatgaatgctagctgaatatcagttctgtatgttacttggtgcataaattttacttatttgcaagtcgtagctgccgtgcacccgttatgaattcagaaactataacatcaattcgtcagcagctttttctcagtggagttgctaatttggcgctggaaagcttgctttgcacatatcccattgtacataattaatactggattagttacttgcttttgtacacatgccagcgggatgttctctagtttctctaaatccagtgattcaaaacttcaatgtagtcattttacaatgcaccatggtttcttgtttcggttgtgaaagtaatgtcaatggtgttgcacagttttgaataaaaatgcaaatggcttgtgaatgtcaatgaacttacaatgtcagtctcttagagttgtttttgcaacctaatattgttgtaaaatcctttccttgagctgcggttgatgtggtggtctgctgttgtggatgatgcatgcaggggctgcttggagaacacggagaaggacggggtccggaggctgataggctcaagcctcccgtggagccgtgattttcccagttgatggatctttcctgtgcacgctggcatccaggtcggcaacgcgtgctgggaactttactgcctcgagcacggcatccagcctgatggccagacgaacggtgacaagaccatccggtgattcgctgcttgcaaacaacagctagtaaatcggtcaccgtgggggcggggacatgagattcagagaagagatgctgctgcctgcctatactagttcatatcaggctcgtccctggaccagatgttcaagtacagccccatccaccacatcgacctggagtcagatgctgggctttcatgtttcttcgtgagcatcagtacaaagaagtcggaggaagaatagttctagctcatttgagctagttctaagagtaatggagtcctttatgctgctcctatttgtatgtgtgttatatgatgtagcagaatctggctcgtgtgattgtacacttgtggagcttgtaattatctgattgtaaacttgatgctgatcacatttgtatgtgtgttatatgatgtagcacttcggatggttgataacatttgaatatttcatgtaaaaaaaaaaaaaaaaaaaaa

SEQ ID NO: 23416 - DNA, 1572 bp, Triticum aestivum
  unsure (1)..(1572): unsure at all n locations
  Clone ID: PAT_TA_23416
attgctcctaaacatgcatatgcgctaccggagagaacagttctattcttcattatggacatacggctgctccaaatgaccggacgctgaatgatggagacatggctctaatggacatgggagctgaatataatttctatggctctgacatcacatgttcataccccataaatgggaagttcaacagcaaccaggcaatagtatacaatgctgtccttaaggctcataatgctgtcatatcacacatgcagcctggattaaaatgggttgatatgcacaagctggccgagcagacaatacttgaatctctcaagaatgaaaagattatccatggtgatattgctgatatgatggctcgaaggttgggtgctgttttcatgcctcatggtcttgggcatttacttggaattgacacccatgatcccggaggctaccctgagggcttagagagaccaaaggagccaggactgagctccttgcggaccataagagaacttaaagaaggcatggttattacggttgagccaggctgttatttcatcgatgctttgctgaggcctgccagggatgatccaatttcctcaaaattcttcaactgggaagagattgagaagtacaaaagttttggtggtgttcgtattgaaagtgatctgtatgtgacggcacaaggatgcaagaacctgacaaactgcccccgggagacctgggaaatcgaagcggtaatggctggcgcgccatggcctccacgtgcttccgtgacaaaagcagagaacggactacccaaagcctgagcattcgcttgttgatgctccctgggcgaaacataaccgtaaaaattgaatgaacgaagtactccatataggatactttaataagtgggtgatggtttcatatgctgtgctgttggtttggtttgagtgaggataaattagcatgttaagttctattccctccgtctcaaaatttttgtcttacatttgactagatacggatgtatctaatactaaaacgtgtcttgatacatccgtatttagacaaatctaggacaagaattttgggacgaagggagtagtcaactagccgagaccttgaaagtggtttggcaccacacactccagttaagcgaaggaaggccaggtagatcatccgggaccttttaaaaagtcccgattaaacgttgcaccatatactccagcaagtagtccaggtagaagatccttgagcttagcatcaagctggggacgcccgacaggatcatgttcgtgataatgggatacggctatttttgcaaagtgtaaggcaccccaagtatttggctcaaacgcattggcccacttattttgtttctgaaaaagcataatctctctaaaaccaaaatctgcatttggatcagcaggatcaactcggacttgccacccttgtgtgttaatgttgttctgcaaccaatctttttgacgttgggtaaaatttcttctaaacaatttcttgtacatgccctccctagcaccggagtttcctaggaatggatgattgaggacatcttctttgcatatatttgnattaaggaggaat

SEQ ID NO: 23417 - DNA, 1203 bp, Triticum aestivum
  unsure (1)..(1203): unsure at all n locations
  Clone ID: PAT_TA_23417
atcccatcctctccatcctaggagagcccgcattcccttcccttcccctccacctcgtcgccctcgcagatcccccaccccccggcgaatggcgtcccgtctcgcgtcccgcctcctcctccgccgccccgccgccgtattaagtttgctccagagttctagacatgctagacatttcagcactcagttacttgaaggtgttccgagacttccaaagccaacatgtgaacgctatttccttcgaaatgcttctccttatcaaatttggagtagatcatttgcttcagagaatggtgacttggttgaagctgttgtgcccttcatgggtgaatctgtcactgatggaacccttgccaatttcttaaagaaacctggtgatagagttgaagctgatgaggcgatagctcagattgaaactgacaaggttacaatagatgtttccagtccagaagctggggtaattgaaaagttcattgccagtgaaggtgacactgttactccaggtaccaaagttgccgtgatatctaagtctgctgctccaagtgaggcccatgttgcaccatctgaagagacctcccagaaggagacccctccaccacctcctccagaaaaacctaaggtcgaggcaaaatcaccaaaagtagaatctgtcaaaccacaggcgtcaaaactagcctccccctcagaacctcagctccctccaaaggaaagagagagacgggtgtcaatgccaaggctcaggaagcgtatagcaaatcgtttgaaggattctcagaacacttttgcactactgactacattcaacgaagttgacatgaccaatttgatgaagctgcggactgactacaaagatgagtttgttaagaagcatggtgtcaaattgggtctgatgtcctgctttgttaaggctgctgtttctgcgcttcaaaatcagccaattgttaatgctgttattgatggcgatgacatcatctacagagactacattgatgttagtgttgctgttggcacttccaagggtcttgtggtgccagttatccgtgatacggaaggaatgaacttgctgacattganaggggataacancttgcananaggcnctgnggggcattacagttgatgagatggnggggggaactcaaanccagngggggttcaaggatctacagnnactacncacccncanancagantctggatcat

SEQ ID NO: 23418 - DNA, 968 bp, Triticum aestivum
  Clone ID: PAT_TA_23418
ctctaatgttcctgcagatgatattgattgggacatttcagtggataataatggtattgactgggacattggtgcggtggaacaacctgtggaagaatctggcaatggttttgggtcttatgaaattattgatgccaatatagagttggcaggctctgaaaattatggtgttggtgcttcagcctatccatctgcagacaaagaaggccttacgtgcgatacatctgagaatcagatttgctgggacatctcaactgataatcctgaagaaagtgctactgtcgagaacgccccaactgaatcagggcaatatgaatgtttaactgaggaaagaagtcagttactggagaaggagtacagaaataatatcctggatgatttacttgaggtaaaatcatttttgatcctgcgctcagcggagatgagaaatgctgatacatcatctctacagcatcaggtgcaagcagtctcacctttcgttctccaacagtatgctcctgaacgtttggagaatatgcttgtagaagtttcctcagcaatctctctgctcaccaaccagaaaactcttgaccttataatgatcctcaactctaaaaggtttttggagagattggtgtcaaccttagaggaaaagaaacatcatgaggtgaaactgcgagaaggcttaggtgatttatcagttaagcgtatggagctgcaaaatgcactatcatcatcctggccgaagcaagaggcagcaattgcaaaaacaagggaactaaagaagctctgtgagatcagttgaccagggggctgaagaccacttttaaatcctaattagatgtgcttttgtatgaggagtactttcaaatcctataaatcaggcccgcatgttatatcaatgttttttccatttaaggttatattcacatggtatgctcaagaaatcacttaactagtattctttaaagaagtggaccggacccgct

SEQ ID NO: 23419 - DNA, 724 bp, Triticum aestivum
  Clone ID: PAT_TA_23419
tagcgtggtcgcggccgaggtacgccgccatctgccgcaaggagggcgccacgctgcggtggccaggctgcaaggtcgcatgggagggcttcaccgacgcctcggacgccgacctcgtcgccgagcacgagatctgggcggccgtcgacccgttcgccaagaacgaggctttcaattgcagcaatggggatgtgttcaagtggaagcagctctggccgatgctggctgagcgcttcggggtggagtgggcagggtatgagggagaggacagccggttcgctctcgccgacgccatgaccgggaaggaggcggtctggaccgagatcctccaggagaacgagcttgtcacgaccgagctcgaggagatcaccagttgggggttcgtcgatgccatgttcaatatcgacattgagcatttggacaacatgaacaagagcaaggagcatgggttcctcggcttccgtaacaccgtcaactccttcaacgcttggatcgataagatgaaggcttccaaggttgttccgtgatgctcttattgtctagtatctactgttgtctacagcatatgctactgcatcccattttatcactcatttataaatttacttctgaaattagttacatcccatcatttgtgccaaatgttgtaatctagaataagccagaaccaaataaagctcccaagttgttaatcgattatctgtgctcgtagtgtcttcattgc

SEQ ID NO: 23420 - DNA, 973 bp, Triticum aestivum
  Clone ID: PAT_TA_23420
cgctatttacttcccacaggcaagtagtggagttcgattcaggggttcagccatggcagctccgagagcactcgtcctcggcgtcctgctgctgatcgccgtctccaacaccgaggcggcgtccgtcgtcgtcggcatggccaagtgcgccgactgcaccaggaagaacatgaaggccgaggaagccttcaagggtcttcaggtggcgatcaagtgcaagagcgtccacggcgactacgagagcaaggcggtgggtgccctcgaccgcagcggcgccttcagcgtgcccctggccgccgacctccacggtgccgactgcgtcgctcagctccacagcgctgcctccaacacgccgtgcctcggccaggagccatccaagatcgcgccggtgtccgagggcaccaccttcggcgttgtcgccggcgccaagaccaatgtgttggcatcgccagagtgtgcgtcggcgaccctactcgggccgatcaagaagcacattatcgagcacttccaccacaagaagcccgtgccaccgaagccggagcccaagccccagccccacccagactacggcccggtacccaagcctgagccgaagccgcagccccacccggactaccaccccatccctcccacgcccacctacggtggcggcggcggtggcggtggataccacggacaccactaactccgatctgccaccgtccggcccaacactgaaatttcatcaccgggttcagtgagtgatcgaggtcgttgctttggtcttctgccattcgctgccccgttttagtatctgcactgcagagttgagagttcagaataaactttgtgaggaacacatgcatggattagtgtgcttcgattgcttttttatgattgtaatttcggtgtgtgctttgtataagaagttattgtggatcaagtaatttaatcaagtccatttgtgtcagtgaaaaacaaaaaaaccgcccgc

SEQ ID NO: 23421 - DNA, 839 bp, Triticum aestivum
  unsure (1)..(839): unsure at all n locations
  Clone ID: PAT_TA_23421
gccggccgggtccgggcgagcttatcacttatcatcatcagcgccccttcctccctccctcctcctcctcgcgcgtcctgatccatcatccagcccaggtgaattcagggtgattaaggtcgccatgtcggactccgaggaccaccacttcgagtccaaggccgatgccggggcgtccaagacctaccctatgcaggccggcgccatccggaagggcggcttcctcgtcatcaagaaccgcccctgcaaggtggtggaggtttctacctcgaagacaggaaagcacggtcatgctaaatgccactttgttgccttagatatattcaatggtaaaaagcttgaggacattgttccttcatcccacaactgtgatgtgccacatgtggaccgtactgagtatcagctgattgacatatcagaggatggatttgtgagccttcttactgataatggtagcactaaggatgatcttaaactcccaactgatgatgctatcctgacccagctcaaggacggatttgctgaggggaaggatctggcgctgacggtcatgtcggccatgggggaggagcagatctgcgcagtcaaggacgtcggccccaggtaacttcctcggattgaggtccaagataaacggagggatccagtatctgtcaaatttaagctaaagaaagacgaagtattaaaggaggaaagctatcgagtgagacattcacctaagccggagtcaagtgcagtgattgctgggtgtagcatatctgcttaccactacctatcatccgtgacatttgngacccttgcttatgtatgtgcttggtgtcataattgattgatttgga

SEQ ID NO: 23422 - DNA, 1117 bp, Triticum aestivum
  Clone ID: PAT_TA_23422
aacacacagatactgaagatgctatccactgttttatctcagcttcaagcttaatctcagttacatcatagaccaaccatctaatgatacgtacagcagtcaacttaatcaattgttcatctgagcacctgctacaggttcctcagcaaccataatctatgtgatgatactctttggcgattgatccgatgctgaccttaaccatccgagttcggaaggtaaatacgatggaagttgttcttcctcagggccttgcggcaagtagggcatttcttctgaaactggatggcttgcttgatgcactctgcgcagaagatatggccacattttgttgtcgaaggctccaccagcttgttaaggcacaccgggcaagtgaaattcggttcctttggaaccaccaccttagcaggctcttggctaatttgcaccgcattgttcgactgcaggctggacccttcttccctttctggggagagacatatcaaaggcgcaaccctttggcgtttgttccacgtgttatgagaaggcatagctgcattatcttccagggcagcatcttcatccagataaagtggtgtcaaaaattgacttctagttctccgattctcttccatggcagcatcttcatcaagacaaaatggtgtcgcacattgccttataattctccaattctcttccaggacagcatcttcatccagagaaaattgtgtcacaggttgccctctagttctccggttcaaccccggggggaggcacttgtgaaggcgatagcgcctgcacttcatcatcgagagcttccacatcaataggcgatgtgcgtgcacccagggaagaccgagagcccatgatggttccccgccaccggcgagcttgcatccaagtccacaacaactttatcagcagatccatccagcgattgcctcccttgcggcacgccgtgcgccgctggtattactcatgctatgtactccctctgatgcttatactcaccttacctcccttcagttctatataaccaactcgagcgcggcgatcgagggacctgacgagggtttgaggcagagtcgcccaggcacgcacgccaccaccaccaacccggacgcgtgggcggacgcgt

SEQ ID NO: 23423 - DNA, 986 bp, Triticum aestivum
  Clone ID: PAT_TA_23423
ggattttcgtttcgttttcgtctgcttccgcctctgctccgtcgtccgcacgcgaccagcttgactccctcgcgcacgagcaacaggagcgcgaggagatgcagatcttcgtcaagaccctcacggggaagaccatcaccctcgaggtcgagagcagcgacaccatcgacaacgtcaaggccaaaatccaggacaaggaagggattcctccggaccagcagcgtttgatatttgctggcaagcagttggaggatggacgcacgcttgctgactacaacattcagaaggagtcgactcttcacttggtcctcaggctcaggggcggcacaatgatcaaggtcaagactctcactgggaaggagatcgaaatcgacattgagcccactgacacgattgataggatcaaggagcgcgttgaggagaaagaaggcattcctcctgtgcagcaaaggctgatttatgctggtaagcagcttgcagatgacaagactgccaaggactacaacatcgaaggtggctcggtcctccatcttgtccttgctctgaggggcggttactagttagttaagctgtaatggaaacgcttgcctcctgagagaagtgaccattggttgcatggaacctgtgttggtgttgcagagagataataacaaactagctttgcttagtgggaggggctgtcttccatgttatctgcctatatgatttgacaaaactactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggtagggcgttctaaataaaaaaaactaacctacgctaaaaaacaaggccattgttaaacaattgggaaaacaaaaataaattcacctgtccgcaaattaaaacttttggcagctggtaaaacattgacgatccccaacttaatcgacttgcccaaatccc

SEQ ID NO: 23424 - DNA, 1031 bp, Triticum aestivum
  Clone ID: PAT_TA_23424
tcgagcagccacttcacaccagctagtggaagtagtgcgatccagaggttcaggcatggcagctccgagagcactcgtcctctgcgtcctgctggcgatcgccgtcgcccacgccgaggcggcgtcagtcgtcgtcggtctggccaagtgcgccgactgcaccaggaagaacatgaaggccggggaagccttcaaggctgtgcaggtggtgatcaagtgcaagaacagcgccggcgagtacgagagcaaggcggtgggcggcctcgatggcaccgggcgccttcagcgtgcccctcgtcgccgaccttcatggcgccgactgcgtcgcgcagctccacaagcgccgcctccaacgcgccctgccccggccaggagccgtccaagatcgtgccgctgtccgagggcaccaccttcggcttcgtcgctggcgagaacaccgccacgccgtccgcggcatcgcctggagtgcgcgtccatgaccctgtgcgggccgatcaagaagcacatcatcgagcacttccaccacaagaagcccgtgccgcccaagccggagctcaagccccagccccacccggactacggccccatgcctaagccggagccgaagccgcagccccacccagactaccaccccgtccctcccacgcccacctacggtagcggtggcggcggtggtggataccacgggcacccactgagtcagttctacccccgtcctgcccagcgatgaaatctcatcatcagcgggttggtgatcagtgagtggtggacggtgctaattatgattggtttgcatgcgtgggtatcgttaggtcttctgccattcccgcgaagccccgtttattatctgcactgcagagttgggagttcagaataacagatgtgcgtgtgtgtgtcgctgtgtcaggcgagtgtgagggtgtgttggtgtgttgctttatcaagattttgtaatttcagtgtgtgttttgtataagaagttattatgaatcaagtaatttaaccaaaaaaaaaaaaaaaaaaaactcgag

SEQ ID NO: 23425 - DNA, 888 bp, Triticum aestivum
  Clone ID: PAT_TA_23425
aactcaagacgcgcgaacgccaacctcctccccctccggcccccctcgcgccccagccgccgccgccgtcgccgccgccgactgcagccatgtcgctgatcgcgggtgaggagttccagcacatcctgcgtgtgctcaacaccaacgtcgacggtaagcagaagatcatgttcgcgctcacctccatcaagggtgtgggccgccgcttctccaacatcgtctgcaagaaggccgacgtcgacatgaacaagagggccggagagctttccgcggaggagatggaccgtctgatggcggtggtgcacaacccgcgccagttcaaggtgcccgactggttcctcaacaggaagaaggactacaaggacggcaggttctcccagcctcccaggtcgtctccaacgccgttgacatgaagctcagggatgaccttgagaggctcaagaagatcaggaaccatcgtggtctgcgtcactactggggcgtgcgtgtccgtggtcagcacaccaagactaccggtaggagaggaaagactgttggtgtctccaagaagcgataagctgcttcacaaagatgctgcatatagctttgcgaaaacgccgaacggcggacgagcactctgtggaccatgtcagcgccgtccgttttctatattgatcagatccctcccggtatttacgggcgctgtcccctgtagatgctcacccacgcttgtatcccggctgccagcgctagctttacctgtcatttaagaacagggcgttagtccagtgtgctgtacagattatgatactagcaacagtcttttacggtcactaaaccaatagtaatcacatgcagatggattttaattagtttattattcggcccgtttcttttgtaaaaaaaaaa

SEQ ID NO: 23426 - DNA, 1491 bp, Triticum aestivum
  Clone ID: PAT_TA_23426
gaaaatggcgaattaatgtccaatgactttcgacgatgttgtgttaggtattcaacggaagtgaacagcaggggaatggaggagatcaacatttccgcggtctccattggcattgggtcttcctcgggggtaataagcgtgacggtggtattcccaggtggtgatcatcggagtttcttgggcacttttgcaagtatgttcccactcagctggcaattcttggttggtgagcgtgggtcttggatccatcagcttgattattggagctatcttgaagtgcattccggttaaatcgggtgagatctctggaagtccgaatggttacaagccgctcgccaacggccctgatgacatatagctggagggtgatttcaggatggatccaggttgcatttgctattttggctctgctaattttcttgaattcatttgtagtgcaagtgtgccctgcaagattgctttttggtgctgcatttgtttggaagtcaactccggcttgagaatcctattgctgcatttggatttatttgcatttgaatgcagtgtaagacttttttttgtctacgattttagcagtaatatgctagcaaaaataataaaacaatttcaggttaatttaggtttgattggtgtaaacaaattttgaactaagcctcatcaaagggaaataaaatatgatcaaaacccaatctcactgaaaacgacaactttcagcgaaggagatcaagcatatgcgacagcattttcagagttccaaaccgtccacaggtcctaccatcatacaccagtttccaatctccagggtatcaccttatcaggaacgcagcaacatcactcgaattcagacaaactacacctccgttggaaaaacgtttcgacataagtcggaacaacacactcaaagctcagtctttgtattgaactgcggagtcatcatgcgatgatgaaagggagcacagtcaacatgaatgcctcgtaactgaaagttgcagacccggaataagctgtgtccttctccttgaacttctcagtcagacccttgactgtaaggcaacactcaataaagttatcatattcaactgctttgctcatgcccccagtcttgtcgaatttagacacgagcaagtctagcacagttggagaaactgaataacccagactgagaagagcatcgcgcagctccgatgcatcaattttaccacttcggtcacggtcaaacctctcgaatatggacctccaattctgaagactgtaaaaaacagaagtaaactccttgggcccgatcctgcggacgttggtgttggtgaagaggtacatgaggaggtggacggtgcggaggctaaagctctggttgtagccggagagcgcggactgcagctccttgtcgtcgatggtcccgctgccgtcgcggtcggcggcctggaagcacgccaccacgttggggtccgtccccggcgggaacgccgacggcacgagcgcggcgaacgggct

SEQ ID NO: 23427 - DNA, 1101 bp, Triticum aestivum
  Clone ID: PAT_TA_23427
ttttttttttttttttcacgttgttccaactatttcctggctgaattcaacatacagcaaacaattcgccaattccaatctccacggaattacaaagtagacaaacggtatacatagtaaattcacattgcacaacaggaagccagtattaaggataagattttgactccatccaggacaattcagcatggcaaagcgatgatgaatacagtatgcaaatcacatcagaaacaagctacagaatatatactggacatgctagactcttcacggcatcacaatgattttgctctgctgaaatgaaatacggaagtttttctgtcattataatatgttgttcttttgttaagatgtcatccgcagcaggatccacaagcagggagggaactctgatcgtttgatcggaggtcagatagtgtgcgaggaccgcgagggccacctccaccgccgcccccaccaccatatggacccccaccaggacctcccccaccaggtccaccatcccacttcttaccactaccatatcctttcttatagctgtctgttttctcgatagaaaacattgtgaggaagaacattctgatgaagttcacaatagccttaaagaagtcggggattatgcttagtctccagattgtccgtttgcctttcacaacacctctctcgacgtaggccatggtcgctcttgcgctatccggatcgccccttgccgccctcttcgatggaacttaggatggaattttggcccggggcccggagagaagaaataggagagggggaggggcgaagtgaggaggggattcgtgaaccttcctcgtccttccgcgtgggaagacctgacctgaccaatgggctcgagagggttgccgtgattgcctcgtttattggctgttggctggtggacccgttgacccggaaactaggggtcgtgtggagccacctgccagtggctttgtaggttccttatgtcacgacctagaggcggtaagaattcgccggcggcgaggaaggggcaaaggaagatctcagagagatagcagagaggagaggagcaaggggggaggcagcgagaggaggaagaggagccccgacccggccggc

SEQ ID NO: 23428 - DNA, 494 bp, Triticum aestivum
  Clone ID: PAT_TA_23428
ttttttttactggcaacgaccttgagaagcattggaacaaaaattatgcacgcatgcgtgcggaatccaccagagtacaagagcaacaaattaatgaatccaaatcgaatctcacacaaccaatctctcaagaatccactagcttatcgaccaacgaacaacagaaagaagaacaaaagaatgagaagcctctgcgcatatacaggctcagaagagcttgtacggggaggaggcgtccaacgggtggatgaggtaggtgagcaccagcgccaggatcatcagaaaataggcaacgccttggtcgaccgaggatgcgtcgctggtgggcgccggcgcgggggcctgcgcggcggcgagggccggcatgaagacggcgaggacgagcgctgcggcgacgacgaaaccaaagagggttctcgccatggcagccgcgtatcttgtgagaatagatgcctctatctctctccttgactctttgccttgtcctcacgttc

SEQ ID NO: 23429 - DNA, 2086 bp, Triticum aestivum
  Clone ID: PAT_TA_23429
gctcacgatcagtagacaaggaacaccaccttggtccactagttagaacagcaggcgcaattcattagtagcacaacaaagatgtacaatttagctaggacgaatcaacatgggcaccgatgcagcaattcagaacattccaaaagcaggatcagcacccaacgggagatactatacacgttcctcgatccattcggactaccaacacagcacattttcaacaaccggctaacactggcgggcgactaccaacacaggaaaaatgtcatcgtgcgagagattagctgcaccttcatagatcagaactccgcttcaggaggtgcacggtaatacgcggggacggtagcagggaagaacatttgcctcacaccttcagctttgatgattgggaagatgataccacatgcacccgaaatcaatctcgctccagtccacattcgtttaggtgaaggaagggggagcatcagtcgtccaacaccgaagatagcaacagcaaagaagtgtgcaaccaaactcaatggccgaggattaagaccagagagtagagcaatgggcccatttgaacagacacctccaaggctcaagtaatcaaaacaagcttggcgcatctcatccctagccttgtcaggtgaggaactgaagactttgtacagagcaccagccaatgtgtttattgtagaagcaaccggcttccgcagagtatagaatgactctaggtatttgcagagggcagaggcatcatgcagattgcgaagaggcttgataagattacgcaggacaactatatctgataatgcaacagtcattcctccaccagttaaagggtgtcgcatattgaaagcgtctcccatcaaaagtgcaccaggtgttgggtgtggtgcagctggcatgctcctatttggcattgttcttatgcttccgcttatcaattgctgctataaaagaatcatagatttgtggaggaatctgaggtgcaaccacggtcttgagataatttgccatttcaccacttgctatggaaggcaccttctgaccagggacatctaccaaacagcgaacctcggtgctgcttatcgggtaaaataggatgggagaaggattggccaagataacatggccatggttcgcatgaggaagttcacaattctccaggaccaggccaacaaagcaagacggcacctcaacctttggggagcaaagggcacgtcttaagttcgaaaagcagccatcacatacaattgtcaatggtgcataagcttttagttcttcacctgacttgatcttgtattgcacacccttaactgtaccattttcttcaagcaaagatgtaactgttccttgctccagttggacattgggcaaagatgcaaccttttcacgcatcctctgtatgaaccgtccattgtgaaagctcctgccagccacatctgaatggaacttctccaaggggtaagaaagttttgtgttcttcccatctttgaataatgcataaccaaggacacgctgtgcatcaatttcatcaacgcagtcctgcagacccaattccatcaatttcaggtagcctccaggttgtaacaattcacccacaattctatcaggctctgtcaggtctctctctatgacatgcacccgtcggccatcctttccgagcgtgtaggcgagggcagatccggcgaccccggctccgacgatgatgacgtccgtcgggccgtcgactgccgcgctccatgcgccgtcagcgacctcgcagccgtcctccggcgcggggatcccttcgaccggagccccacggcggcggcgctggcgctggcgccccagcgcggcggcgacgagggccgccgcgaggagcgtggccgcggcggcgccaacgagctgccagacctcggcggccgcagccatgccgcaatgggggcctgctcctggggtcgtcgttcctcgggggtttctcaacgcggcgccgcgtgttcgttgggtttgcgtgtgggttctctcgggcgaggggagagagggtgatgcgtgcggggaggagacgagcgggggagagtgccgggcgatgggattgggacgagagacgagacgagacgag

SEQ ID NO: 23430 - DNA, 1604 bp, Triticum aestivum
  Clone ID: PAT_TA_23430
tcactaaagggaacaaaagctggagctccaccgcggtggcggccgctctagaactagtggatcccccgggctgcaggaattcggcacgcaacgcgcgcacacacggaagccactctccccccattatccccagatccagccggcgctcccctcccctccctccacctccggcctccgaccaagctgcccgcggccaatccctaagccgcgatgagctggtggtgggcgggcgcggtgggcgcggtcaagaagcggcaggacgagcgggcggcggcggccgagcccaccttccagagcgtggcgctcatcctcggctccacggggatcgtcggcacctccctcctcgacatcctcccgcgggacgacaccccgggcgggccctggaaggtgtacgccgtctcccgccgcgcgccgccgggctggtccaccccgccgccgtccccggccgtcacgcacctccagctcgacctcgccgacccggccgccgtcagggacgccctgacgccgctcaccgacgtcacccacgtcttctacgccgcgtggtccagccacgagaccgaggaccgcaaccgggaggtcaacgccggcatgctccgcaacgtgctctccgtggttgtgcccggctgccccgcgctcgcccacgtctgcctccagaccggccgcaagcactacgtcggcccgtttgatgtcatcggcaagatcccggcccccgacccgccgtacaccgaggacatgccccggttggatcaccccaacttctactacgacctggaggacgtcctcttcgaccacgtctccggccgcgacggcgccgtcacctggtccgtgcaccgccccaccgtcatcttcggcttctccccccgcagcgccatgaacgtggtcggcagcctgtgcgtatacgccgccatctgccgcaaggagggcgccacgctgcggtggcccggctgcaaggtcgcctgggagggcttcaccgacgcctccgacgccgaccttgtcgctgagcatgagatctgggcggccgtcgacccgtttgccaagaacgaggctttcaattgcagcaatggggatgtgttcaagtggaagcaactctggccgctgctggccgaccgcttcggggtggagtgggcagggtatgagggagaggacagccggtttgcgctcgcggatgccatggctgggaaggaggcggtgtggacggagatcatccaggagaacgagcttgtcaccacggagctcgaggagatcaccagttggtggtttgtcgatgccatgctcagtatcgacattgagcatttggacaacatgaacaagagcaaggagcatgggttcctcggcttccgtaacaccatcaactccttcaatgcttggatcgataagatgaaggcttccaaggttgttccttgatgcttttattgtcttgtatctattgttggttacagcatgctatcgcatcccatgttatttctcatttatcaatttatttctgaaattagttacatcccatcatttgtgccaaatgttgtaatctagaataagccagaaccaaataaagctctcaagttgtgaatcaaaaaaaaaaaaaaaaaaaaaaaaaaaaaaaaaaa

SEQ ID NO: 23431 - DNA, 1120 bp, Triticum aestivum
  Clone ID: PAT_TA_23431
ttttttttttttcaaaagaacacagagatactgaagatgctatccactgttttatctcagcttcaaggcttaaactcagttacatagaccaaccatctaatggtacgtacaccagtcaacttaaatcaattgttcatctgagcacctgctacaggttcctcagcaaccataatctatgtgatgatactctttggcgattgatccgctgctgaccttaaccatctgagttcggaagataaatacggtggaagttgttcttcctcagggccttgcggcaagtagggcattttttctgaaactggatggcttgcttgatgcactcggcgcagaagatatggccacattttgttgtcgaaggctccaccagcttgttaaggcacaccgggcaagtgaaattcggttcctttggaaccaccaccttagcaggctcttggctaacttgcatcgcattgttcgactgcaggctggacccttcttccctttctggggagagacatatcaaaggcgcaaccctttggcgtttgttccacatgttatgagaaggcatagctgcattatcttccagggcagcatcttcatccagataaagtggtgtcaaaaattgacttctagttctccgattatcttccatggcagcatcgtcatcgagataaaatggtgtcgcacattgccttataattctccaattctcttccaggacagcatcttcatccagagaaaatggtgccacaggttgccctctagttctcctgttcacccccgggggaggcacttgtgaaggcgatagggcctgcacttcatcatcgagagcttccacatcaataggtgatgtgcgtgcaccagggaagaccgagagcccatgatggttccccgccaccggcgagcttgcatccaagtccacaacaactttatcagcagatccatccagcgattgcctcctcgcggcacgccgtgcgccgctggtattactcatgctatatacctctgatgcttatactcaccttacccttctccagttctacaatcaactcgagcgtggcgatcgagggacctgatgagggtttgaggcagagtcgcccacgcacgcacgccaccaccaccaccaaccgacgaactggac

SEQ ID NO: 23432 - DNA, 1013 bp, Triticum aestivum
  Clone ID: PAT_TA_23432
actctgtcctcgttgtcattattgatcttcgtcctggtcgccctcccttcgcctgcgctcgcacagcagcagccccgccgctccctccggcacgccgtcgtccatcccgctcccggcgcccgcaaatccgtcctcccccctcgacatggcgtcctgcccgtcggtcaagaacatcctcgtgctggacgcggaggggaagcgcgtggccgtcaagtactacgccgacgactggccctccgcgtcctccaagctggctttcgagaagtcgctcttcgtgaagacccagaagaccagcgccagaacagaggctgatgtggtaatgtttgatggctacattattgtgtacaagttcatccaagatctccatttttttgtaactggaggagatgaggagaatgagctcattttagcgtcagttcttcaggggttttctgatgctgttggcattcttctcagaaacagtgtagacaaaaggaccgcacttgaaaatctggatctcatctttttgtgccttgacgaggttgttgatggagggattgttctggaaacagatggaaatgtgatagccgagaaggtgtcaggccatggattggaaggagctgggtcattcactgagcagacgataagccaagccctagcgacagcaagagagcacttcgcgaggtctcttctgaagtagtgtgtgtaggcatctttcgggttggcgatgcacccagcattgaactcctgtgtttcctcttctagcacagtgcacctagtttgcaagaaagaaagaacgagaaaatgacttgatctttgcgtgtgagttcgttcgtctgttgttgtggtgctcgtcgacattttgtcgcagagatgtatgtgcggcctaagtgcctatctggttaccagattcccttctaaggtctgtataagaaacttgtgatggtgcagtcgttggtcttgttgtctcacctctcttttggtgcataataacaatccagcagcagccccatgatgctaccaaaaaaaaaaaa

SEQ ID NO: 23433 - DNA, 1484 bp, Triticum aestivum
  Clone ID: PAT_TA_23433
cccacgcgtccgtgttgttgtattcatctcattacactagctagcataatatattagttaaggcaactctactacatatcaatttcccctactggattggttctatatttttaaagttgcttcgtggtgcatgagcccaacctgaagaaatataggcttatgatgactattttccttcttaagtaatcatagttgttggcttcggtagcttgctgaatatgttttagttatatatagaaatgacgtgccttctatgcttaaatgattgtttggctctatataattgttgacatgaatatcttgacttcccaaacaagtataggactgtacctatgcatacagattgttctaacaaaactgaaaataaaaattgaagcatgaaataagcaataagtggctgatttttatttgcatgttaagcggaaagttgtagccgaggcttatatattacgaaatattgtcacacctctgagcttctactgttgttagggacatcgtagtgtgatcttcatgatttttcacttgacgatgtactgattcattagtcaagcagagaccgaagtcatcttttgctactgctagctctatggatgtttatttacctgcaacttctgctagctctaacttggttatatagcagttccattcattcaatctattggaactagtttgtctactacttgtatccagattttatatcctgccctatgccattgtcgacttgcttaggtacataattgttatgtcttgcaatctggtattgatgattgtcaatgtattcatttatacctttctagtgtaccttgtatgtgacccagctgatttgtatatcaatgctctgtttccaatagatgtatgttgatgcctgatggccgattccttaaaacttcactgttgcagtagcatttttccttagtgcatagatgtatgagcgatcacttacgcttgaaaccttgctctctttcccaggaaccatcgtggtctgcgtcactactggggcaggagaggaaagactgttggtgtctccaggaagcgataaactgcttcacaaagatccccgcatagcttcactactactgtgttggtccatttccagaatcgtaaggagtgttcttgtttatacgattaccttggatgatgcttttgcttaaggagaggctcaagaagatcaaggagtttcgcatccgagtttcagccatcctctacagcaaggagctctgggccaaaggagcaagcagcgctgctagttccttgatgccagatcaagtaagatggcgcaccatggcgtctggtggcgtattttgctttcgagaatagtactgtttatttgaagtgagatgtactcatctagtgcctggcaaaaaaatgaatgatgaagtgtcatgtactgtctatgttgtagtgagctatagcaggagtgaaatgaaaatgtatctactgttgtaaaaaaaaaaaaaaaaaaaaaaaaaaaaaaaaaaaaaaca

SEQ ID NO: 23434 - DNA, 1909 bp, Triticum aestivum
  Clone ID: PAT_TA_23434
tcggtacgacgcggtgcaggtggagctcgggtgcggcgtcggcggggccaagctggaggtgtcgtacgtggtgacgctgtacccgctgagcatggcgacggcggtgatcgtcaagaacaacggggccaagccggtggagctgacgggcgccgtgctgagccacatcaagttcgacaagcgggggggcacggccgtggagggcctccgggggtgcccctactgctcccacccgccgccggcggccgggttcgcgctgctcacccccgccgaggccatgaagcgggaggagtccgggtggttcggcggcggcggcggggaggagccccggcagggcgcctggaccgtggaggagaacctctacaccatcctcaagaagaaggtgagcagggtgtacgcggcgccgccggaggagaggaagaagcgcatctacagcaccgcgccctccaagttcaccaccatcgaccagtctagcgggctggggttcaggctggtgaggatggggttcgaggacctgtacctgagcagcccgggaggactgtacgagaagttcggcaacgactacttcctctgcaccgggccggcgtccatcctcgtgcccgtcgtcgtcggccccggcgaggagtggaggggggcacaggtcatcgagcacgacaacttgtaacacttcctttttcttgcgtgccaacagagttacacaagaaatcaatcatgtacattcttacacatggggatgaatcttgtaactacccattgcgatcaatatgtacacatgggtagtagtacaagtataacatacaaatgaattttcaaacgaaattacatgggcgtgtgtgaagaagacttgaaaacctcaaacgaacgagcataaaaatggacacactctctcatagaattcatcgcatcagctcagcataatccactccagacacaagcatctggtgcaaaggaaagaacccaagtgctggtgacaagataatcaaataagcgcgcatttgccgccacctatttctgccaggaaacgtttactcgagtaaacccgcatccttaagagcagtctcaaaattgtcctcgcttttccagttggggacctcaggcactttgtgctggaagtagtcctcgatctttgtcatcacagcttcatcagtttgaccacatagcaggttgaacacagctccttttcggccaaagcgcccagctctgccaattctgtgcaggtacacctcataatcaggctcatctctcgtattatacttgattggcatgtcgtagttgatgaccaggttaacctgtgcttggtcaaacccacgagcaagaacatcagttgatataagaaccttggtgtacccatctttgaattcctgaattactttttccctctctgcttggtcaagggatccttgaattgaggagcacacatagtcctcttttgtcaaagcattatgtacattcttagtactatttcttgttctcacaaagatgataacctgtccaaccttttgcccaaactcaaagatcttgtcccttataaccttctattttggccgcctcatcagggactcggactttatattgctttactttttccaaagtaagatcttccttcttcacaaatatttggtttccgtccttaatggcctttgtaacaaactccttcactttctcattgaaggtcgcagagaagagaagcacctggcatccgcgagcaatattttgtatatcattcataatcatccatttcaaagtcgagtattcccgaccggagggagtattaatgaattcaggttctaccctcgtgatctgaagtctctgtggagacattgtagtatagtactctgtttacatttttctcgtaatgagtgtgtttaccatgtgatgtttcaaactgattatttcccgcacgcgcgtgggt

SEQ ID NO: 23435 - DNA, 854 bp, Triticum aestivum
  Clone ID: PAT_TA_23435
gaattcggcacgagcaccgcccagcccgcgcacaagagcatcctaaccctagttcggcgacgactcggcgcgcggcggcggttggttcggagccgacgagggccactcggggcacgcgaagggagcgcagccgccggcctccgccgtggttgctcgcggcatcggcgaggacgatctcctcgagggtttcgcagcccaggtaacccggaatcaaacatttcatcctcagacaaacttcccttgttgctatggaatccaagttctttcagttcctgaagcttgtcggagttggtttcaaagcaaggacagagcaaggaggccgcgagttgtttctgaaactaggttacagccatgaggtgcagttcactgctccacccgccgtccgtgtcttctgcttcaaacccaacataatatgctgcactggcatcgacaagcatagagtgcaccatttcgccggagccgtgcgaagcagtaaacctccggaagtgtacaaggggaagggcatactgtacatcgacgaggtcataaagctgaagccggggaagaagcagcagaagaagtaacacatgggtgagcctccccatttgacttctagcctgttgttaaggcgccgcgacgcgtttgttgccgcagaattcatgtggttttctctgtgctgggctagtatggctagccccggtaccaggctggactttgtaataatactccgtatgcgacgtatgtgaatcgtctgatgaacatgcatatcgttgggtgggggtggatcagcggattccaacatttttgttttgttttgagctggctggatgtgacgtatcttcaatagttcaatgtgtttgttgctgccccaaaaa

SEQ ID NO: 23436 - DNA, 932 bp, Triticum aestivum
  Clone ID: PAT_TA_23436
gcacgagggccacttcacacagccaagcaagtggtagtgcgactcagaggttcaggcatggcagctccgagagcatcactcgtcctcgccctcctgctggcgatcgccgttgccaatgctgaggcggcgtcggtcgtcgtcggcctggccaagtgcaccgactgcaccaggaagaacatcaaggccgaggaagccttcaagggtcttcaggtggcgatcaagtgcaagaacgtcaacggcgagtacgagagcaaggcggtgggtgcccttgacggcaccggcgctttcagcgtgcccgtggccgccgacctccacagcgccgactgcgtcgcacagctccacagcgccgcctccaacgcaccgtgctccggccaggagccatcaaagatcgtgccggtgtctgagggcaccaccttcggggtcgttgccggcgccaagacgaacgcgctggcatcgccagagtgcgcgtcggcgaccctgtgcgggccaatcaagaagcacatcatcgagcacttccaccacaagaagcccgtgccaccgaagccggagcccaagcccccagccccacccggactacgggcctgtgcccaagcccgagccgaagccgcagccccacccggactaccaccccgtccctcccacgcccacctacggcggcggtggtggcggtggataccacggacaccactgagtccggtctaccaccctcccgccaagcgacgaaattggtaaagttcctctgtatcttagccatggcttgttgctgttagtgagtgagcgacgttgctatttatgtcacgggttagctttatcttctacgtatcattcagaataacagttgtgagggatgtaaggcaaatgtacgtgtgatggttcagttttttttacaaggtttgtaatatcgatctgtgtgaatttttgtaaaaaaaaaa

SEQ ID NO: 23437 - DNA, 941 bp, Triticum aestivum
  Clone ID: PAT_TA_23437
ccacgcgtccgcacaggctgcgactcagaggttcaggcatggcagctccaagagcactcgtcctcggcttcctgctggtgatcgccatcgccaacgccgaggcggcgtccatcgtcgtcggcctggccaagtgcgccgactgcaccaggaagaacatcaaggcagaggaagcctttaagggtcttcaggtggcgatcaagtgcaagaacgtcaacggcgagtacgagagcaaggcagtaggtacccttgacggcaccggcgctttcagcgtgcccgtggccgccgacctccacagcgccgactgcgtcgcgcagctccacagcgccgcctccaacgcaccgtgctccggccaggagccatcaaagatcgtgccggtgtctgagggcaccaccttcggggtcgttgccggcgccaagacgaacgtgctggcatcgccagagtgtgcgtcggcgaccctgtgcgggccgatcaagaagcacatcatcgagcacttccatcacaagaagcccgtgccgcccaagccggagcccaagccccagccccacccggactacggccccgtgcccaagcccgagcccaagccgcagccccacccggactaccaccccgtccctcccacgcccacctacggcggcggcagcggcggcggtggataccatggacaccactgactccgatctgccaccgtccggcctagcagtgaaatttcatggcttgttgctgtcagtgagtgagcgacgttgctatttatgtcacgggttagcttgatcttctatcattcagaataacagttgtgagggataagtatgtgtgtcaggcaaatgtacgggtaatgggtcagtttttttttacaaggtttgtaatatcggtgtgaatttttgtaatgagaagttcctatatcagtatatcatgatcaatcaagtaaaaaaaaaaaaaaaaaa

SEQ ID NO: 23438 - DNA, 2043 bp, Triticum aestivum
  unsure (1)..(2043): unsure at all n locations
  Clone ID: PAT_TA_23438
gcgcagcacagcacactcctccggcaccgagccctccgccccgccccgcgcccgacccgaaaccccagccgatcggcggcggccggccggcggagatgtcgctgacggaggtcaggatcggcgaggaggtgtggctcacctgcctctcccacgccctcaccaccgagaccgaggaggtcatgggcctcctcctcggcgacgtcgtgtcctccagcaagggcggctccacggcggtgatatggggcgcgtcgccgcagatgaggtgcgagcggaagaaggaccgcgtcgaggtcaaccccgagctgctcgccgccgcgtcggcgcaggccgaggtaatgacggccaccatcgggaagacgacccgggtgatcggctggtaccactcgcacccgcatatcaccgtcctgccttcccatgtagatgtgcgtacccaggctatgtttcagttgctagatccaggctttgttgggctgatattttcctgttttagtgaagatgctcaaaaggttgggaaaatccaagtgattgccttccagtcacttgatgggacacagaacacacagcgtgctattgttcctgttattaccaatccagtcattaaccctgaaccatcttggggttcatccgataactcattagcattgattgagggcattgaacaggacactggagattctagagcttcaaacggaagcaaggtctggggaaggtctcaggatatggatctgtattctcctttggacacaaatcattcggcaagactaccaatagaaaacgctattgttcctttcgaacctgataacagtgctggaccctctgttgatcaagatggttcagatctgtccccaagcatacaggaggctttgcaccggtcaaccatggacataagtggtgcagagtataaaaggaaggaggtgccacttaaagtattccctacaaggcatctgctaaagctggacactacgttgagttcttactgtgatatgcaacgtgtcctgtttgaagaggaacaatcagcatataaccaagctatgcttcagaatatttgtgatgggaagatgcacccacttacatctatgcaccatacctccacatacaatgcttctctatgcaaactgatggaatactgcttgaccccagccataactgtgcttgaggaccgtgtgaaagaaaacgaacttcggttagctatgctagtggaggaggctaaacaactggaggccgagcagagcacgaaaactggctctcctcgccgtgcgatgcccggagggactaccagtggcatcacttcgccaaggggccaggacaagtacccttccggcagacaagggggccctataagccctagcagcagcggccggaggaaggctccttgaatccgaccttgctcgccattctgtgatgatggatagtccgattctcggccctgcctgatgctttctggaaccccaaacctgtcccttcgcgcgaggggtgaagtcgcaatgcaaatgtacatacccatctcctttcagcgcctggcccgccgtccttctgtggaagtaaccaaccaacagtggttcccttttgctttgtgttgtccttgcgccaaatccttttgcctggttgcgctgagcttgtaatgtgtactcactggcgcgacgagtctcggggcagtggttgcgctgagcttgtaatgtgtactcactggcgcgacgagtctcgggcaggctttctagttggaaaaaaaaaaaaaaaaaaaaaaaaaacggtccgcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttncagtcgggnaaacctgtcgtgccagctgcattaaatgaatcgcccaacgcncggggaaaggcggttttgcgt

SEQ ID NO: 23439 - DNA, 1507 bp, Triticum aestivum
  Clone ID: PAT_TA_23439
gggttttgacaaacaaagcaattgaggcaaatgatgggaagccattgccacttgttcagaaagcttttattggtctgactgctggagcgattggcgcatgtgtgggcagtcctgctgatttggcactcattaggatgcaagctgactcgaccctaccagcagcacagcgggcgtcactacaagaatgcattccatgcttgcgtcctatgatcaaagtgttgagctgttcagagacaaattgggtgctggggaatatcagactgttattggagccagtgccatttctggattctgtgcggctgcttgcagtctgccctttgattacgtgaaaacacaaattcaggaagatgcaacctagatgccactggcaagtacccatacactgggtctttggactgcgccatgcaaaccttgaagaccggtggcccatttaagttctactccggcttccctgtatattgtgtcaggatcgccccgcatgtcatgatgacgtggctcttcttgaatcaaatccagaagtaccagaagaagattggcatataagatctccagttggagacgagagtatcaatccttattcgacacatttaataactttccagcagctttgcactcccgtggttgtttttggtagacagagttttaagcgatttttaccgtagcttacatttgctgtggtactcttgacgttgttacaataatcacattatttgttgtaattggggcaatttttttggcgggcatacttctgtaggttgggcacagccatgagacaatattactactcccttcattccaaattactcgtcgttgaaatggatgtatctaaaactaaaatacatctagatacatccatacgtgcgacaagtaattcggaacggagggagtacctccatatgtggaacttgaaaatataacgagtctgctcaccattatgcgttcattaagatgcaatgcaaagtccaaagctggatctacaacacatagagttccgaaggtagggtttcttaacccactagttaaataagggtttcttataaccaactaatagagatgatactacagtgacataaaaagcagaacagtgctaggcaccagcacgatcaaagcaacattgcatgctttctcaatattgtttagcttcttacggaacttctcatagtcctccgcactccgcctctcaatttcatccatagcatccaaattcttgcggatctccagcatgctcgcatcaaactcagcagtcatgcgctttatttcctcacgctgtttggccagcgtttcatcatcatcagaataagccacttgtccccccgtcgttgagaggaggcgcgccgccggcgaaagcccctgcaccaccggcgacatgcggccgagggccggcgacccgcggccgagggacggcgccgccttgcggaggagggaccggatcgccgccgccatcagcacgagcggaggagcggtggttgggggaggagcgtcgacgatgttttctctttgttttccg

SEQ ID NO: 23440 - DNA, 2418 bp, Triticum aestivum
  Clone ID: PAT_TA_23440
tgctgatgtcatagttcttgacgacaacttcacaactataataaacgttgcaaggtggggtcgtgcggtttacataaacatccagaagttcgtgcagtttcagttgaccgtgaacattgttgctttggtgatcaactttgtctcagcgtgcatcacagggagtgctcctctcactgctgtgcagctgctgtgggtgaacatgattatggacacattaggagctttagctctagcaactgagcctccaaatgatgaaatgatgaagaggccgcctactggacgaggggaaagcttcatcaccaaggtcatgtggagaaacatcattgggcaaagtatataccagctggttgtgcttggcgttctcatgttcgccggcgaaaatcttctgaacatcgagggtccagattccaagactgttctcaacacgctcatcttcaactccttcgtgttttgccaggtattcaacgaagtgaacagcagggaaatggagaagatcaacattttccgcggtctcatcggcaattgggtcttcctcggggtaataagcgcgacggtggtattccaggtggtgatcatcgagtttctcggcacttttgcaagtactgttccactcagctggcaattctggttggtgagcgtgggtcttggatccatcagcttgattattggagctatcttgaagtgcattccagttaaatcaggtgaaatctctggaagtccaaatggttacaagccgctcgccaacggccctgatgacatatagctggagaagggtgatttcaggatggatccaggctgcatttgctattttggctctgttgcatcgccagccgctaattttcttgaattcatttgtagtgcgagtgtgcgctgcaggattgctttttggtgctgcatttgtttgggaagtcaactccggcttgagaatcctattgctggatttggatttatttgcatttgaatgcagtgtaagacttttttttgtctacgattttagcagtaatatgctagaaaaataataaaacaattcccagtcgggttaatttaggtttgattgatgtaaacaaattttgaactaagccgcctcatcaaagggaaataaaatatgatcaaaacccaatctcactgaccgtccacaggctctaccatcatacaccagtttccaatctccagggtatcaccttatcaggaacgcagcaacatcactcgaatccaaacaaactacacctccgttggaaaaacatttcaacataagttggaacaacacactcaaagctcagtctttgtattgaactgtggagccatcaagcgatgatgaaagggagcacagtcaacatgaatgcctcgtaactgaaagttgcagacccggagtaagacgtgtccttctccttgaacttctcagtcagacccttgaccgtaaggcaacactcaataaagttgtcatattcaactgctttgctcatgcctccagtcttgtcgaatttagacacgagcaagtctagcacagttggagaaactgaataacccagactgagaagagcatcgcgcagctccgatgcatcaattttaccacttcggtcacggtcaaacctctcaaatatagacctccagttctgaagactgtaaaaaacagaagtaaactccttgggcccgatcctgcggacgttggtgttggtgaagaggtacatgagaaggtggacggtgcggaggctgaagctctggttgtagccggagagcgcggactgcagctccttgtcgtcgatggtcccgctgccgtcgcggtcggcggcctggaagcacgccacgacgttggggtccgtccccggcgggaacgccgacggcacgagcgccgcgaacgggctcccgtacccgccagcggccccatacggcgctgccgcggggggcggggccccgtagggcgccgacgagggaggcggggcgccgtaggactggcccgcgggcggagcaccgtagcctccgccgccgccgtaggactggggctggccggcgggcggggccccgtagccgccgccgccgtaggactggggctgggaggagggcggggccccgtatccgccaccgtaggactggggctgggaggagggcggggccccgtagccgccgctggcgccgtaggtctggggcggggaggcgtagtagggggaggaggccttgccttccttggggggcttatcgccgtagggcggggccgagggggcgggggaggagccgtagggcggaggggccccgtagccgccgcctcctcctcctccggcgccaccgtaggggtagccggacatggtggggcgatcgcgcggcggcggtgctcggggaattgggtgggtgcggggaataatcgcggcggggtcgtctggcctggtgctttgggggaagctctctcaacttttcgcctcgtgc

SEQ ID NO: 23441 - DNA, 1507 bp, Triticum aestivum
  Clone ID: PAT_TA_23441
attcctccctcccacccatccccatcctccctgatgatccctccgctccactagtcgtatctccgctctcctcccaccctcccctctccccgcgcacccgctcctcggccggcggcccctcaaaccctagccccgagcgcgagcgcggcggagatggagcagcacgtgctggtggcgctcgccctctctttcgtcggcggcctcagcacctccctcggtgcgctgcttgtgatcgtcaacccttcccctgacctcaagaggctcggcctcctccagggttttgctgctggacttatgttgagcatctcgtttctagacttggcacacaacgcactcaactccattggcttcttgaaggccaatctatggttttttgcaggagttcttttctttgggttcgttgtcaagtttattccagagccaacctttgtgccaacaactgatgcaagcaagaaaaagactgatgatgacgggtcgggcaaagatatgatgaaaaaacatcgccgccaagtcttattcagtggcatcattactgctgttggaattagcttgcacaattttcccgagggaatggcggtatttcttggatccgtgaagggtcttcgcgtgggagttaacttggctattgctattgctttacataacatacccgagggggttgctgtagctctgccactctattttgctaccaaaagtgtttccttctttcttgcatataaaagcaaatggcaagcatttaaatatgcaacactctctggtttggctgagccactaggggtattttttgtagctgtcttgtttccgagcaacttaaatcctgaaattcttgaaggcctacttgcatcagttggtggtgttatggctttcctcactttgcatgagttgttacctctagcatttgactatgctggtcagaagcaagctgtcaaagcagtctttgttggcatggccgtcatgtctgcgagcttgtatttcctggagatcagcctacccaaggagatcagcttgtaacatatgaccgcaccgctgcaactataccagctgttcatagtgtcctctgaagcctgagaacttcgccatacatcaaccgtttcttgcgatctgcaaggcaaggggcgtggggtttggaaggttcgttgctcagaagcaagaattatggccagaacgttgcattggccacgtgtagcatacactattactcctggtcattgtgtctgacagttttactaggaaaaaacagcagtgtggcgacccgtatgtggtggctggacatccctcactttgttgtttcagaaaaccatatgtggtgacgggtatctgaatacaaccatcgggcttgttgtccagtaacaggatgcaactagaacagatttgcggttcttttgtcaatttgacacgttaaaaacctgcccacaatcatggcctgcaggctgtaattgccctgttaacccttgattctgttccaagtgtatacatattcatttcttttaaaaaaaaaaaaaaaaaa

SEQ ID NO: 23442 - DNA, 687 bp, Triticum aestivum
  Clone ID: PAT_TA_23442
gccggccgggcctgcaccgcccccgattctcaattgaaaagcacaagggcgctgcagctctcgccggggctagggtttggtcggtcgatcgatcaatcgacgcgagcgggagggaagatgatcgaggtggtgctcaacgaccgcctggggaagaaggtgcgcgtcaagtgcaacgaggacgacaccatcggcgacctcaagaagctcgtggcggcgcagaccgggaccagggccgagaagatccgcatccagaagtggtacaccatctacaaggaccacatcacccttggcgactacgagatccacgacggcatgggcctcgagctctactacaactagcctcatcaccccggccattgcaggtttgtcacctatctttgcctgcgatgatagctttggttgcattccagtcccagtgtcttcagagctcaatgtgtgggcagaactccagcgagctactatttaagtagtgcattattgtacccatgatgattattgacagcctgaacatgttttccctatgatcaacctgcaaatctagtgtgctgttactgtgaagtttataaataacataaactgtgttacctggggttgtgataatggcagtgttacaccatgttgttatgttaaagacatttgccctgcttaatttgcactgtgaacggcttttgttttaaaaaaaaaaaa

SEQ ID NO: 23443 - DNA, 478 bp, Triticum aestivum
  Clone ID: PAT_TA_23443
gccccccctcccccggaaccctagctaggctctccccatcggcggcggcggcagcggcagcgaagaagaagagaagaagaaggaagatgatctacgacgtgaactccccactgttccgctccttcctcagccagaagggcggcgcgtcctccgacaagaggaaaatggaagagcagaagccgaaggaccagaggttcaaggccaacgagaacaagcctgtaatgaacgaatgagcgttgtctggacagtcgggtgcctgcaaggcctagctgccaatcatgtgactcctatgttaaaatgagtggtgtgaacatttgtctggtcgttctgaaaaccatccaagtatccagtactgtgtttgaagttcctatatatctgaactgcatgcctggaatgataaattaaaattaggagaaaaaaaaaaaaaaaaaaaaaaaaaaacaaaaaaaaaaaaaaaaaaggcccctaaagaccacga

SEQ ID NO: 23444 - DNA, 1235 bp, Triticum aestivum
  Clone ID: PAT_TA_23444
ttttttttttttttttttattcttcaaggtttctacctatattttcattcttttatgaaattacatatatatagtactctctccgatctaagataagtgtcgtgccacgacagttcatttttgaactaaaaccacgacatttattttggattaaagagagtactatgcatgcatgaattgctagcccacacgggctgatgactagtacgcataattagtggcaacagacctgaggagcattggaacaaaaatatgcacgcgtgcgtgcgaatccaccagagtacaggagcaacaaattaatgaattcaaatcgaatctcacacaaccaatctctcaagaatccactagcttatcgatcgacggacaacagaaagatgaacaaaagaatgagaagcctctgcgcatgtacaggctcagaagagcttgtacggggaggaggcgtccaacgggtggatgaggtaggtgagcaccagcgccaggatcatcagaaagtaggcaacgccctggtcgaccgaggacgcgtcgctggtgggcgccggcgcgggggcctgcgcggcggcgagggccggcatgaagacggcgaggaggagcgcgggggcggcgacgaaaccaaaaaggaaaagcacaaggccgctgcagctctcgccggggctagggtttggtcgatcgatcgatcaatcgacgcgagcgggagcgaagatgatcgaggtggtgctcaacgaccgcctggggaagaaggtgcgcgtcaagtgcaacgaggacgacaccatcggcgacctcaagaagctcgtggcggcgcagaccgggaccagggccgagaagatccgcatccagaagtggtacaccatctacaaggaccacatcaccctcggcgactacgagatccacgacggcatgggcctcgagctctactacaactagcctccggccattgcaggttggtcacctattgttgcctgcgatgatagctttggttgcattccagtcccagtgtcttcagagctcaatgtgtgggctgaacttcagcgagctactatataagtagtgcattattgtacccatgatgattattgacagcctgaacatacttttcctgtgatcgacctgcgaatctaatgtgctgttactgtgaagtttataaataacataaactgtcttacctggggttgtgataaaaaaaaaaaaaaaaactcgagacacctcggccgcgaccacgcctaatcactagtgaattc

SEQ ID NO: 23445 - DNA, 810 bp, Triticum aestivum
  Clone ID: PAT_TA_23445
agaaagaaaggattttcgtttcgttttcgtccgcttccgcctctgctccgtcgtcctcacgcgacctgcagcttgactccctcccgcaccgcacgcacgagcagcaggggcgcgagaagatgcagatcttcgtcaagaccctcacggggaagaccatcaccctcgaggtcgagagcagcgacaccatcgacaacgtcaaggccaaaatccaggacaaggaagggattcctccggatcagcagcgtttgatattcgctggcaagcagttggaagatggacgcacgcttgctgactacaacattcagaaggagtcgactcttcacttggtcctcaggctcaggggcggtactatgatcaaggttaagactctcactgggaaggagatcgaaatcgacattgagcccaccgacacgattgataggatcaaggagcgtgttgaggagaaagaaggcattcctcctgtgcagcaaaggctgatttatgctggtaagcagcttgcagatgacaagactgccaaggactacaacatcgaaggtggctcggtcctccatcttgtccttgctctgaggggtggttactagttaagctgtaatggaaacgcttgcgtcctgagagaagtgaccattggtggcatggaacctgtgttgcaaagagataataacaaactagctttgcttagtgggaggggctgtcttccatgttatctgcctatatgatttgacaaaactactcgcaaaaaaaaaaaaaaaaaactcgagtttttttttttttttttggaccttttaaattggtcccttaatttcatttggg

SEQ ID NO: 23446 - DNA, 996 bp, Triticum aestivum
  Clone ID: PAT_TA_23446
actacccgctgagtttaagcatataaataagcggaggagaagaaacttacaaggattcccctagtaacggcgagcttatcacttatcatcatcagcgccccttcctccctccctcctcctcctcgcgcgtcctgatccatcatccagcccagcaggtgattaaggtcgccatgtcggactccgaggaccaccacttcgagtccaaggccgatgccggggcgtccaagacctaccctatgcaggccggcgccatccggaagggcggcttcctcgtcatcaagaaccgcccctgcaaggtggtggaggtttctacctcgaagacaggaaagcacggtcatgctaaatgccactttgttgccttagatatattcaatggtaaaaagcttgaggacattgttccttcatcccacaactgtgatgtgccacatgtggaccgtactgagtatcagctgattgacatatcagaggatggatttgtgagccttcttactgataatggtagcactaaggatgatcttaaactcccaactgatgatgctatcctgacccagctcaaggacggatttgctgaggggaaggatctggcgctgacggtcatgtcggccatgggggaggagcagatctgcgcagtcaaggacgtcggccccaggtaacttcctcggattgaggtccaagataaacggagggatccagtatctgtcaaatttaagctaaagaaagacgaagtattaaaggaggaaagctatcgagtgagacattcacctaagccggagtcaagtgcagtgattgctgggtgtagcatatctgcttaccactacctatcatccgtgacatttgggacccttgcttatgtatgtgcttggtgtcaataattgattgatttggaatggtgcaaattgtatgccagaaagcacgcctggccattattattgtggattccatgatactataagggtcctgtgttcagtttctcatcaaatctaaaaaaagtagcag

SEQ ID NO: 23447 - DNA, 1757 bp, Triticum aestivum
  Clone ID: PAT_TA_23447
gacccacgcgtccgaaagcgaagggcgaaacagaatagaatcccatccatcctaggagaggccgcattcccttcctcccccaccttgttgccctcgcagatcgacgacccctccccctcccccatccccggcgaatggcgtcccgtctggcgtcccgcctcctcctccgccgccccgccgccgtattaagtttgctccagagttctagacatgccagacatttcagcactcagttacttgaaggtgttccgagacttccaaagccaacatgtgaacgctatttccttcgaaatgcttctccttaccaaatttggagtagatcatttgcttcagagaatggtgacttggttgaagctgttgtgcccttcatgggtgaatctgtaactgatggaacccttgccaatttcttaaagaaacctggtgatagagttgaagctgatgaggcgatagctcagattgaaactgataaggttacaatagatgtttccagtccagaagctggggtaattgaaaagttcattgccagtgaaggtgacactgttactccaggtaccaaaattgccgtgatatctaagtctgctgctccaagtgaggcccatgttgcaccatctgaagagacctcccagaaggagacccctccaccacctcctgcagagaaacctaaggtcgaggcaaaatcaccaaaagtagaatctgtcaaaccacaggcgtcaaaactagcctccccctcagaacctcagctccctccaaaggaaagagagagacgggtgtcaatgccaaggctcaggaagcgtatagcaaatcgtttgaaggattctcagaacacttttgcactactgactacattcaacgaagttgacatgaccaatttgatgaagctgcggactgactacaaagatgagtttgttaagaagcatggtgtcaaattgggtctgatgtcctgctttgttaaggctgctgtttctgcgcttcaaaatcagccaattgtcaatgctgttattgatggtgatgacatcatctacagagactacattgacgttagtgttgctgttggcacttccaagggtcttgtggtgcctgttatccgtgatacagaagggatgaactttgctgacattgagaaggggataaacagccttgcaaagaaggcaactgagggggcattgtcaattgatgagatggcagggggaaccttcacaatctcaaacggtggtgtctatggaagtcttatcagcacacctatcatcaaccctccacagtcagcaattcttggaatgcattctattgtccaacgccctgtggttgtggatggctccatccttgcgaggccaatgatgtaccttgcactgacatatgaccataggctgatagatggcagagaagctgttctgtttctgcgccgcatcaaggacgtggttgaagatccacggaggttgctccttgacatatagttccatttgttacttctggggtaaagattgcttctcatcgatttcggaataattgtacacaaaattttgactcatgccgtagtcgcttctccaacaattgagaattcggttgctggcctctgaattgtagaagaaacatcaacgaaattcgtttcccttttctgaggtgatacttgctgggatgtagtagttccctaaacatattatgatttacaatagcaaatggacaccctcttcaactttgttgtgccatttaacgtgataataattataacatgtgaaaaaaaaaaaaaaaaaaggccccta

SEQ ID NO: 23448 - DNA, 1871 bp, Triticum aestivum
  Clone ID: PAT_TA_23448
cgccagctcgaaattaaccctcactaaagggaacaaaagctggagctccaccgcggtggcggccgctctagaactagtggatcccccgggctgcaggaattcggcaccaggagaggccgaacgcatcgaggaggaggaccaaatccctcattctctcccggccagccagcctttcttctcccgcacgacagccctcccgacgccgccgccgccgccgccggcgaaatggcgtcccgcatcgcctcccgcctcctccgacgctccagccccacattaggcctcctgaggagctacacacatgtcagaaactacagcagtcaactttcaggtcttattccagttggtccccaaagctcaaagctgacaagaaggaacaattacttcccaaatgcctctccataccaactctggagtaggtcattcgcatcagacaatggagacaagtttgaagctgttgtacctttcatgggtgaatctgtaactgatggaactcttgctaacttcttaaagaaacccggcgatagagttgaggctgacgaggccatagcccagattgaaactgataaggtcaccatagatgtttctagtcctgaagctggtgttattgaaaagtttattgctagtgaaggtgatactgttactccaggcaccatagttgctatcgtatcaaagtctgcagcacctgctgaaacacatgttgccccatctgaggaggcgccccaaaaagaatcacctccagtaaaagctgaagagaaatcaccaaaagcagaagagaaaccaacaaaagtagaacctcccaagaagcaggcaccaaagccaactccttcaaaaacctcccctacagaaccgcagctccctccaaaagagcgagagcgacgggtggcaatgcccaggcttaggaaacgcattgccaaccgtttgaaggattcccagaacacatttgcaatgctgaccacattcaatgaagttgacatgaccaatttgatgaagctgcggtctgactacaaggatgaatttgtcaagaagcatggtgtcaaactgggtctgatgtcttgctttgtcaaggctgctgtttctggactgcagaaccagccaatcgtgaatgctgtcattgacggcgatgacatcatatacagagactatgtcgacgttagtgtagctgttggcacatccaagggtcttgtggtgccggttatccgagatgctgatacaatgaactttgctgacatcgagaaagggataaacaaccttgccaagaaggctactgagggggcgctgtcaattgacgagatggcgggaggaacattcaccatctccaacggtggtgtctacggaagccttattagcacgcccatcatcaaccccccacagtcagcgattcttggaatgcattccatcgtgcaacgccccgtggttgtggacggcagcatcctcgccaggcccatgatgtacctcgcgctgacatacgaccacaggctgatcgacggcagagaagccgtctacttcctgcgccgcatcaaggacgtcgtcgaggacccgcggaggctgctccttgacatataagctccatgcgccgatctccttcactgcccaagtgccttgtgcttgtctggaaaataataccgtgcaaatttttgactgatacaacgagttgcgtcctgggaaggatgaagatttgagttgagttgaggatatgataacgcgtttgtcctgttttcgttgagagcttcggggtgtagttcccctaaactaaaaatttgctttaattttcaatgcaagagcaatagatatatggtgcccttttggtcattatttttctgcaaaaaaaaaaaaaaaaaaaacgcgagactagttctctctctctctctctc

SEQ ID NO: 23449 - DNA, 921 bp, Triticum aestivum
  Clone ID: PAT_TA_23449
ctcgtgccgaattcggcacgagcacggcacaaccgccaacggtgttgggcagtttcgcttggctcctcctgtcttgtagcagttcgcgtgcacaagaggtccccatgtacccgaagccggaggacggtccggcgacgggcttcccgatgagcgccggcacggcccgcacgggcggcgggccgggcgcttactaccaggcggcgccgccgacggcggcgttcgcgatgcaggcggggcaggcgccgctggcggcgtggtcgacggggctgtgcgactgcttcgacgactgcggcaactgctgcatcacgtgcctgtgcccgtgcatcacgttcgggcaggtggcggagatcatcgaccgcgggtcgacgtcgtgcggggccagcggcgcgctctacgcgctcatcatgctgctcacgggctgccagtgcgtctactcctgcttctaccgcgccaagatgcgcgcgcactacggcctccaggagagcccctgcgccgactgctgcatccactggtgctgcgagccatgcgcgctctgccaggagtaccgcgagctcaagaagagaggcttcgacatgaacctcggatggcacgccaacatggagaggcaaggacgcactccggcgaccatgccacccctcatgcacccagggatgacccgttgatcgatctgtgcttttgttctctaagacacgcctaaagtgtgcgtccttgtgtagtagaaagaagtaatctctatgctgttcggcgtctttgcggtgccggtgtctacttactttgcaggtttctgtatacaatactgtgtaacacacgactactactttgtgtaatgttactgcaaacgtatttcccttttttatctaaaaaaaaaaaaaaaaaaactcgagaacctcggccgcgaccacgctaatcactagtgaattc

SEQ ID NO: 23450 - DNA, 862 bp, Triticum aestivum
  unsure (1)..(862): unsure at all n locations
  Clone ID: PAT_TA_23450
gaattcactagtgattagcgtggtcgcggccgaggtctccgtcgtcctcacgcgaccagcagcttgactccctcccgcaccgcacgcacgagcagcaggaagatgcagatcttcgtcaagaccctcacggggaagaccatcaccctcgaggtcgagagcagcgacaccgtcgacaacgtcaaggccaaaatccaggacaaggaagggattcctccggaccagcagcgtttgatatttgctggcaagcagttggaggatggacgcacgcttgctgactacaacattcagaaggagtcgactcttcacttggtcctcaggctcaggggcggcacgatgatcaaggtcaagactctcactgggaaggagatcgaaatcgacattgagcccaccgacacgattgacaggatcaaggagcgcgttgaggagaaagaaggcattcctcctgtgcagcaaaggctgatttacgctggtaagcagcttgcagatgacaagactgccaaggactacaacatcgaaggtggctcggtcctccatcttgtccttgctctgaggggtggttactagttaagctgtaatggaaacacttgcctcctgagagaagtgaccattggtggcatggaacctgtgttggtgttgcaaagagataataacaaactagctttgcttagtgggaggggctgtcttccatgttatctgcctatatgatttgacaaaactagtcgcaactttatccgcctctgttattagctctgctgcgtagtaagatccatatatcacctgaattttgattgtgtttcgccactctttcctgaattcaagtttgatgtagggctaaatgcagaaagatnatcggaaaatataa

SEQ ID NO: 23451 - DNA, 1338 bp, Triticum aestivum
  Clone ID: PAT_TA_23451
cgccttccctccgctcgcgtctgctaccttcctctcccagccatctcgccggcaggagatggcggacgcgaagcagcagcaggccgcggcgcccaccggcgtctggaagacgatcaagccattcgtcaatggcggcgcctccgggatgctcgccacctgcgtcatccagcccatcgacatgatcaaggtgaagatccagttgggcgagggatctgcagctcaggtcgcaaagacgatgtatgttaatgagggctttggttccttttataagggtttgtcagccggtttgctaaggcaagcgacctatacgacagctcgtcttggatccttcagggttttgacaaacaaagcaattgaggcaaatgatgggaagccattgccacttgttcagaaagcgtttattggtctgactgctggagcgattggcgcatgtgtgggcagtcctgctgatttggcactcattaggatgcaagctgactctaccctaccagcagcacagcggcgtcactacaagaatgcattccatgcactctaccgtatcactgctgatgaaggcgtccttgcgctttggaagggtgcaggcccaactgtggtgagagccatgtcactgaatatgggtatgcttgcgtcctatgatcaaagtgttgagctgttcagagacaaattgggtgccggagaatatcagactgttattggaggccagtgccatttctggattctgtgcggctgcttgcagtctgccctttgattacgtgaaaacacaaattcagaagatgcaacctgatgccactggcaagtacccatacactgggtctttggactgcgccatgcaaaccttgaagaccggtggcccatttaaattctactccggcttccctgtatattgtgtcaggatcgccccgcatgtcatgatgacgtggctcttcttgaatcaaatccagaagtaccagaagaagatcggcatataagatctccagttggggacaagagtaccaatccttattcaacacatttaataactttccagcagctttgcactcccgtggttgtttttggtagacagagttttaagcaatttttaccgtagcttacatttgctgtggtactcttgacgttgttacaataatcacataatcacattatttgttgtaattggggcaattttattggcgggcatacttctgtaggttgggcacagccatgagacaatactactacctgcttgtgccatcttgtcttgtatggtatgtgctcaattttatctgtggctcgaaaaaataaatcctttctacctgtgccttgcaccatatgctcttaaacaaattttgtgttttttcc

SEQ ID NO: 23452 - DNA, 741 bp, Triticum aestivum
  Clone ID: PAT_TA_23452
cgagggaaaatgcacgtgggtatgagtaaaattaaatcaccgtgccccgtcttttggcaacaaaagaagcacctgtgtctaaaactcatcaattactcaacccatgatcatcaaaagaaagagttcatgctagcaaaagcttgcgcaactgagataaggcatttggagcatgtgtgcaccacactagaatttaagagtacgctcatgcgacgacagccaagagatccgactctcggcagaagcagtgcttctcttctgttcccaggtccacctcataagcgtttatgtccgagaagagaaccttctttccagcttcaacttcactaacatcaacaccgaccgataaaatctcgcccatcaaatatctctcgaatttaacagcagatttcggtagcaggactcccccagcagatttctctgggatagtctcaagacggacgagcacccggtcggactgcggttccaccttggaagggtcgcacttgatggcggcgcgcatgcgcacggaggatgcggcgcggcggccgggggcgacggcggcgaccggcctgcggctggtgcttccggtggcgccgtggatgaggaagggcgaggcggcggcggcgaggagggagggggccattgggaggtggatgctggtggatgcgcccggaaggttctagggaaagaggagggttttgctcggttgcttcgctcagcggggagatgggggaggctcgtcttatctgctttcctttcgca

SEQ ID NO: 23453 - DNA, 1109 bp, Triticum aestivum
  Clone ID: PAT_TA_23453
ccacgcgtccgcgcagcatccatcctcctccctgaccccccacacccgacccccagagtgacacgcgggccacccccacgcacccgacaccgcggccccacatgtccgcgtgccgtggccgcgccccaccctcgcgcgcgcaccaaccagaggccggccaggctggcggcgtgggccaccgccgcggcccgcccgcctaacgccagcggaacggccgttaggttaaccgggggccgcctataaagggggcgagggggccgagcggaggagccactacacatccggcgtcttcacaaacgccggctcgctccccatccttttccgtgctccgcctccccgccccgcgccctccgccgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggtgacaagaccatcggaggtggtgatgacgccttcaacaccttcttcagcgagaccggagccggcaagtacgtgccccgtgcggtcttcgttgatctcgagcccaccgtgattgacgaggtccgcaccagcgcctaccgccagctcttccaccccgagcagctcatcagcggcaaggaggacgcagccaacaacttcgcccgtggtcactacacaatcggcaaggagattgtggatctctgcctcgaccgcatccgcaagctggccgacaactgcactggactgcagggcttcctggtcttcaacgccgtcggcggtggaaccgggtctgggcttgggtcgctcctcctcgagcgcctgtccgtggactatggaaagaagtccaagctcgggttcaccgtgtacccatctcctcaggtgtcgacctctgtgggtcgagccctacaacagtgtgctgtccacccactccctgctggagcacaccgatgtctccatcctgctcgacaacgagggcatctacgacatcttgaagcggctccctggacatcgagaggcccacttacaccaacctgaaccgcctggtctcttagggatctcaaacgtg

SEQ ID NO: 23454 - DNA, 1719 bp, Triticum aestivum
  Clone ID: PAT_TA_23454
ggccgaacgaatcgaggaggaggaggaccaaatccctcattctctctcggccagccagccaagccgccctttcttctcccgcacgacagccctcccgacgccgccgccgccggcgaaatggcgtcccgcatcgcctcccgcctcctccgacgctccagccccacattaggcctcctgaggagctacacacatgtcagaaactacagcagtcaactttcaggtcttattccagctggtccccaaagctcaaagctgacaagaaggaacaattacttcccaaatgcctctccttaccaactctggagtaggtcattcgcatcagacaatggagacaagtttgaagctgttgtacctttcatgggtgaatctgtaactgatggaactcttgctaacttcttaaagaaacccggcgatagagttgaggcggatgaggccatagcccagattgaaactgataaggtgacaatagatgtttctagtcctgaagctggtgttattgaaaagtttattgctagtgaaggtgatacggttactccaggcaccatagttgctatcgtatcaaagtctgcagcacccgctgaaacacatgttgccccatctgaggaggcgccccaaaaagaatcacctccagcaaaagctgaagagaaatcaccaaaagcagaagagaaaccaacaaaagtagaacctcccaagaagcaggcaccaaagccaactccttcgaaaacctcccctacagaaccacagctccctccaaaagagcgagagcgacgggtgccaatgcccaggcttaggaaacgcattgccaaccgtttgaaggattcccagaacacatttgcaatgctgaccacattcaatgaagttgacatgaccaatttgatgaagctgcggtctgactacaaggatgaatttgtcaagaagcatggtgtcaaactaggtctgatgtcttgctttgtcaaggctgctgtttctggactgcagaaccagccaattgtgaatgctgtcattgacggcgatgacatcatatacagagactatgtcgacgttagtgttgctgttggcacttccaagggtcttgtggtgccggttatccgagatgctgatacaatgaactttgctgacatcgagaaagggataaacaaccttgcaaagaaggctactgagggggcgctgtcaattgacgagatggcggggggaacattcaccatctccaacggtggtgtctacggaagccttattagcacgcccatcatcaaccccccacagtcagcgattcttgggatgcactccatcgtgcaacgccccgtggtcgtggacggcagcatcctcgccaggcccatgatgtacctcgcgctgacatacgaccacaggctgatcgacggcagagaagccgtctacttcctgcgccgcatcaaggacgtcgtcgaggacccccggaggctgctcctcgacatataagccccatgcgccccatctccttcgctgccaagtgcctcgtgcttgtctggaaaataataccgtgcaaattttgactgatacaaagagttgcgtcctgagaaggacggagatttgagttgaggatatgataacgcgtttgtcccgttttcgttcagagcttcggggtgtagttcccctacacaaaaaatttgctttaattttcaacgcaagagcaatagatatatggtgcccttttggtcattatttttcttcaaaaaaaaaaaa

SEQ ID NO: 23455 - DNA, 509 bp, Triticum aestivum
  Clone ID: PAT_TA_23455
gccggccggttcgggcccacgaaccctagctaggctcttcacatcggcggcggcggcagcgaagaagaagaagagaagaagaagaaagatgatctacgacgtgaactcccccctgttccgctccttcctcagccagaagggcggcgcgtcctccgacaagaggaaaatggaagagcagaagccgaaagaccagaggttcaaggccaacgagaacaagcctgtaatgaacgaatgagcatcgcctggacagtccggtgcctgcaaggcctagctgccaatcatgtgacactcctatgttaaaatgagtggtgtgaacatctgcttggtcgttctgaaaactatccaagtatccagtactgtgttttaagttcctatatatctgaactgcatgcctggaatgataaattaggagattttatcttgtgatgtcttctcatggagcattcaagttttggaatccacttccagttccatatggtgatttatggagcaccttctttgctgtcaaa

SEQ ID NO: 23456 - DNA, 1703 bp, Triticum aestivum
  Clone ID: PAT_TA_23456
aggaattcggcacgaggcacaaacgccggctctcccccgctccgtctccctcccccctcctcccccgctccgctccctccgccgccagatcccgtcgagcccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgcgcggtcttcgtcgacctcgagcccaccgtgattgacgaggtccgcaccagcgcctaccgccagctcttccaccccgagcagctcatcagcggcaaggaggacgcggccaacaacttcgcccgtggtcactacacaatcggcaaggagattgtggatctctgcctggaccgcatccgcaagctggccgacaactgcactggcctgcagggcttcctggtcttcaacgccgtcggcggtggaaccgggtctgggctcgggtcgctcctcctcgagcgcctgtccgtggactatggaaagaagtccaagctcgggttcaccgtgtacccatcccctcaggtgtcgacctctgtggtcgagccctacaacagtgtgctgtccacccactccctgctggagcacaccgatgtctccatcctgctcgacaacgaggccatctacgacatctgcaggcgctccctggacatcgagaggcccacctacaccaacctgaaccgcctcgtctctcaggtgatctcatcgctgaccacctccctgaggttcgacggtgccctgaacgtggacgtgaccgagttccagaccaacctggtcccgtaccctcggatccacttcatgctctcgtcctacgcgccggtcatctcggcggagaaggcgtaccacgagcagctgtctgtgtcggagatcaccaacagcgcgttcgagccgtcgtccatgatggccaagtgcgaccctcgccacggcaagtacatggcgtgctgcctcatgtaccggggcgacgtggtgcccaaggacgtgaacgcgggcggtggccaccatcaagaccaagcgcaccatccagttcgtggactggtgccccacggggttcaagtgcggcatcaactaccagccgcccaccgtggtgcccggcggcgacctggccaaggtgcagagggccgtctgcatgatctccaactccaccagcgtcgtcgaggtcttctcccgcatcgaccacaagttcgacctcatgtacgcgaagcgtgccttcgtgcactggtacgtgggcgagggcatggaggagggcgagttctccgaggcccggtgaggacctggccgccctggagaaggactacgaggaggtcggcgccgagggcggcgatgatgaggatggcgaggaggacgacgactactgatctgctcgacggctcgacggaggatcagtctcctgccgcctatctttaactacatgttgctgtgctgtcctgtcttggaaacttgtgtctgggtgtttgggttgttaagccatccatcggtgctttctatgtcgctgttgaactgcatcattagtacttcgtggaacaagtgtctcgacttaattgatgttctgtcccgcttgattcgagtgttcttgctcc

SEQ ID NO: 23457 - DNA, 987 bp, Triticum aestivum
  Clone ID: PAT_TA_23457
gccggccggtccggggcgagcttatcacttatcatcatcatcagcgcccctccgtccctcctcgcgcgtcgtgatccatccagcccagcaggtgattaaggtcgccatgtcggactccgaggaccaccacttcgagtccaaggcggacgcgggggcgtccaagacctaccctatgcaggccggcgccatccggaagggcggcttcctcgtcatcaagaaccgcccctgcaaggtggtggaggtttctacctcgaagactggaaagcatggtcatgctaaatgccactttgttgccttagatatattcaatggtaaaaagcttgaggacattgttccttcatcccacaactgtgatgtgccacatgtggaccgtactgagtatcagctgattgacatatcagaggatggatttgtgagccttcttactgataatggtagcactaaggatgatcttaaactcccaactgatgacgctatcctgacccagctcaaggatggatttgctgaggggaaagatctcgcactgacagtcatgtcggccatgggggaggagcagatctgcgcagtcaaggacgtcggccccaggtaacttccttggagcgagggccaagataaacagagggatccattatctgtcaaattaagctaaagaaagacgaagtaaaggaggaatgctatcgagtgagacattcacctaagccggagtcaagtgcagtgattgctgggtgtagcatatctgcttaccactacctatcatccgtgacatttgggacccttgtattccctatggttttatatatgtgcttggtgtcaataattgattgatttggaacggtgcaaactgtatgccagaaagcacgcctggctattattattgtggatcgcatgatactataagggtcggctgttcagtttctcgtcaaataaaaaaaattaggggttaaaaaaaaaaaaaaaaaaaaaaaaaaaaaaaaaaaaaaaaaactc

SEQ ID NO: 23458 - DNA, 1960 bp, Triticum aestivum
  Clone ID: PAT_TA_23458
catcgatcagctacttcacaggcaagcgagtggtagaggttcagacatggcagctccgagagcgctcgtcctcggcctcctgctggcgatcgccgtcgccaacgctgaggcggcgtccgtcgtcgtcggtctggccaagtgcgccgactgcaccaggaagaacatcaaggccgaggaagctttcaaaggtctccaggtggcgatcaagtgtaagaatctccacggcgactatgagagcaaggcggtgggcggcctcgacggcaccggagccttcagcgttcccctggccgccgacctccacggcgccgactgcgtcgcgcagctccacagcaccgcctccaacgcaccgtgttccagccaggagccatctaagatcgtgccggtgtctgagggcaccaccacctttggtgtggtcgccggcgccaagacggacgcggcggcattgccagagtgcgcgtcggcgaccctatgcgggccgatcaagaagcacatcatcgagcacttccaccacaagaagcttgtgccgccgaagccggagcccaagccccagccccaccctgactaccaccccgtgcccaagccggagcccaagccgcagccccaccccgactaccaccccgtccctcccacgcccacctatggcggcggcggtggtggataccacggacaccactgacttcgatctgccaccgtccggcctagcagtgaaatttcatagcttgttgctgtcagtgagtgagcgacgttgctatttatgtcacgggttagcttgatcttctatcattcagaataacagttgtgagggataagtatgtgtgtcaggcaaatgtacgggtgatgggtcagtttttttacaaggtttgtaatatcggtgtgattttttgtaatgagaggttcctatatactccctccgttccaaattactcgtcgtagaaatggatgtatctagaactaaaatacatctagatacatccatacatgcgacaagtaattcggaacggagggagtatatgcctgtatacatatttcaacaaaactgagctgccttcctgctggcttcaacttgctttctctatatgcatgtatgagtaagactggggaatacagaccagaccagtccagaaaaaatgacgatcaggtctgtatcccttttcctatgatgttagtcccctgacgtcccttggaatcagaaacaaaaatccgataggtaagagagtgcccatcagctgaacagttaggctgagcgtcagattgtcaaactgtaccgacgacatgttcaaagctgacgtcaatgcagctccaaggaatgaacctaatgtcgaactgaggttgttaatggacatgaacagagcaaacagtgtgccctcgattccaggtgggcaaagttgtcccgagaggattaggaacggcatcatcttgaattggttgattgcatcagccaaagcagagccccacagcaccatgtattgtctgctattccatactgcatatgtaatcttgacaccagtaaaatgtccagtacagtaattatcgcaaggccaagatgtgcaaacataagaatattcctgagttttttatgctttaagtagcggttgtagatatatgtgccaagcattagactgaaccacccaatcacacgtgcagtccctaagaaggatgcctccagatgtagaacctccgtttgataatagaacattactgttgagatatttggaactgctgcatttgaaaggaaaaaccatgccataggtcgcagaattgctggctgcttaaaagctgtgcataaactgaagaaggctgatttcagagatgagtataaattaactgaattattgtgcttctcatgaccttcaggtcgtttggacaatgttttccttttgttctttttacgagcaccctttcgcctcctagtgctcgcatatttaaaagattcacctgagccttgtcccggacgcgtggg

SEQ ID NO: 23459 - DNA, 773 bp, Triticum aestivum
  Clone ID: PAT_TA_23459
aggccggccgggccggggctctaacgccaatctcctccccctccagccccctcgcgccccagccgacgccgccgccgccgtcgccgccgccgactgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaagagggccggagagctttccgcggaggagatggaccgcctgatggcggtggtgcacaacccgcgccagttcaaggtgccggactggttcctcaacagaaagaaggactacaaggacgggaggttctcccaggtcgtgtccaacgccgtggacatgaagctcagggatgaccttgagaggctcaagaagatcaggaaccatcgtggtctgcgtcactactggggtgtgcgtgtccgcggtcagcacaccaagactaccggcaggagaggaaagactgttggtgtctccaagaagcgataagctgcttcacaaagattcctcatagctttgctactactgtgttggtccatttccagaatcttaagggagtgttcttatttagatgattaccttggatgatgttttgccctagataatgttttggttctggaacctttaatatattgtatcttgaattctttgttaaactcgtacaagagtttgttttgccatgtgcttccagtgaaaaaaaaa

SEQ ID NO: 23460 - DNA, 1806 bp, Triticum aestivum
  Clone ID: PAT_TA_23460
gtggaaaatgagtgcgctttggttgattcagatataggaacttctcattacaaaaaatcacatcggtattacaaacacccgtacatttacctgacacgcatacttatccctcacaactgttattctgaatgatagaagaccaagctaacccgtgcacatatataaatagcagcgtcacttcattgctgtgccggatggtggtagatcggagtcactagtggtgtccgtggtatccaccgccgccgccgccgtaggtgggcgtgggagggacggggtggtagtccggatggggctgcggcttgggctccggcttgggcacggggtgatagtcagggtggggctggggcttgggctccggcttgggcggcacgggctgcttgtggtggaaatgctcgatgatgtgcttcttgatcggcccgcacaaggtcatggacgcgcactccggcgacgctgcagacggcgtggcaatgctgtcgccggcgacgacgccgaaggtggtgccctcagaaacaggcacgatcttggatggctcctggccggggcacggcgcgttggaggcggcgctgtggagctgagcgacgcagtcggcgccgtggaggtcggcggccaggggaacgctgaaggcaccggtgccgtcgagggcacccacggccttgctctcgtagtcgccgtggacgttcttgcacttgatcgccacctggagacccttgaaggcctcctcggccttgaggttcttcctggtgcagtcggcgcacttggccaggccgacgacgacggacgccgcctcggcgttgggcgacgggcgagcgccagcaggacggcgaggacgagcgctctcggagctgccatgcctgaacctctaccacttgcttgcttgtgctcgtgccgaattcggcacgagcggcacgaggcacaaccgccaacggtggtgggcagtttcgcttggctcctcctgtcttgtagtagttcgcgtgcacaagaggtcgccatgtacccgaagccggaggatggtccggcgacgggcttcccgatgagcggcggcacgggcgtaggcgttggcggcggcggtggcccgggcgcgtactaccaggcggcgccggcgacagcggcgttcgcgatgcaggcgcaggcgccgctggcggcgtggtcgacggggctgtgcgactgcttcgacgactgcggcaactgctgcatcacgtgcctgtgcccgtgcatcacgttcgggcaggtggcggagatcatcgaccgcgggtcgacgtcgtgcggggcgagcggcgcgctctacgcgctcatcatgctgctcaccggctgccagtgcgtctactcctgcttctaccgctccaagatgcgcgcgcactacggcctgcaggagagcccctgcgccgactgctgcatccactggtgctgcgagccctgcgcgctctgccaggagtaccgcgagctcaagaagaggggcttcgacatgaacctcggatggcacgccaacatggagaggcaaggacgcactccggcgaccatgccacccctcatgcacccagggatgacccgttgatcgatctgtgcttttgttctccaagacacgtctaaagtgtgcgtccttatgtagtagaagaagtaatctccatgctattcggcgtctttgcggtgccggtgttacctactttgcaggtttctgtacaatactgtgtaacacacgactactactttgtgtaatgttactgcaaacgtattttcccttttttatctagaatatgcatgagtaggggtttttttatattaagaggagaagaggataaaaaaaaaaaa

SEQ ID NO: 23461 - DNA, 972 bp, Triticum aestivum
  Clone ID: PAT_TA_23461
tagtggatcccccgggctgaggcacttatcatcatcagcgcccctccgtccctccctcctcctggcgcgtcgtgatccatccagcccaggggcgagaagctagttagcgggtgattaaggtcgccatgtcggactccgaggaccaccacttcgagtccaaggccgatgcgggggcgtccaagaccttccctatgcaggccggcgccatccggaagggcggctacctcgtcatcaagaaccgcccctgcaaggtggtggaggtttctacctcgaagactggaaagcacggtcatgctaaatgccactttgttgccttagatatattcaatggtaaaaagcttgaggacattgttccttcatcccacaactgtgatgtgccacatgtggaccgtactgagtatcagctgattgacatatcagaggatggatttgtgagccttcttactgataatggtagcactaaggatgatcttaaactcccaactgatgacgctatcctgacccagctcaaggacggatttgctgaggggaaggatctggcgctgacggtcatgtcggccatgggggaggagcagatctgcgcagtcaaggacgtgggccccaggtaacttcctcggagcgagggccaagataaacggagggatccattatctgtcaaatttaagctaaagaaagacaaaagtattaaagaaggaatgctatcgagtgagacattcacctaagccggagtcaagtgcagtgattgctgggtgtagcatatctgcttacctctacctatcatccgtgacatttgggacccttgtaatatttcctatggttttatatatgtgcttggtgtcaataattgattgatttgggacggtgcaaactgtatgccagaaagcacgcctggccattattattgtggatttcatgatactacaaggcttggtgttcagtttctcgttaaatcaaaaaaaatcaagttactac

SEQ ID NO: 23462 - DNA, 1334 bp, Triticum aestivum
  Clone ID: PAT_TA_23462
gtttccaatcttgctggaaagcaaggtctgctgatctgaaggagttcttctcacagtttaacccagtttctgccaatatagtctttgaagatagaaaatcagctgggtatggttttgtatcttttggaacaaaagaggaagcagaggctgctctcactgaactcaatggaaaggaacttatggaaaggcctgttatcctaagatggcgggaggataaagaaagtgtgaaggctgatggtgaagttgaaggcttgaaggttaatgatcaggcagaaggtgtgacggttgatgacagtggtgtggttgaaggtgaagataaacaggagtagtctaatagtactgtgctgggagaaagttgcagtagcttattgataaaagtgcagatgcggaaactcattgtacagatacagaatagaggtgataattgtaatggaagacttcagcaaaggtttctgtcatgatgctgctaagaaaaatggaaacaaagggcattagccgtgatcaaggtgaaacatcatccttgagcatctggcttcagtatttaatacgagtcatgtgcttattgtagtaatcagtactcatttgtactccattgtgaccatgaactgtgtcgttccgagatacttgtagtctcctgattttggacccagttcactgtaatatctcttagcttgctgatcagctttcggcaatgaggcctcaatcgaaaagcacaaggccgctgcagctctcgccggggctagggtttcgtcgatcgatcgatcagtcgacgcgagcgggagcgaagatgatcgaggtggtgctcaacgaccgcctggggaagaaggtgcgcgtcaagtgcaacgaggacgacaccatcggcgacctcaagaagctcgtggcggcgcagaccgggaccagggccgagaagatccgcatccagaagtggtacaccatctacaaggaccacatcaccctcggcgactacgagatccacgacggcatgggcctcgagctctactacaactagcctcatcacccccgccattgcaggttcgtcacctatcgttgcctgtgatgagcgttggttgcattccagtcccagtgtcttcagagctcgatgtgtgggctgaactccagcgagctactatataagtagtgcattattgtacccatgatgattattgacagcctgaacatacttttcctgtgatcgacctgcgaatctaatgtgctgttactgtgaagtttataaataacataaactgtgttacctggggttgtgatgatggcagtattacactgtcacatcatgttgttatgttataaggcatttgctctgcttaattttcact

SEQ ID NO: 23463 - DNA, 1034 bp, Triticum aestivum
  Clone ID: PAT_TA_23463
ctactaaagggaacaaaagctggagctccaccgcggtggcggccgctctagaactagtggatcccccgggctgcaggaattcggcacgaggcctcctcctcccctcctgcccccgagcgccgccgccgccgccgccgccgactgcagccatgtcgctgatcgcgggtgaggagttccagcacatcctgcgtgtgctcaacaccaacgtcgacggtaagcagaagatcatgttcgcgctgacctccatcaagggtgtgggccgccgcttctccaacatcgtctgcaagaaggccgacatcgacatgaacaagagggccggagagctttcctcggaggagatggaccgcctgatggcggtggtgcacaacccgcgccagttcaaggtgccggactggttcctcaacaggaagaaggactacaaggacggcaggttctcccaggtcgtgtccaacgccgtggacatgaagctcagggatgaccttgagaggctcaagaagatcaggaaccatcgtggtctgcgtcactactggggcgtgcgtgtccgtggtcagcacaccaagactaccggcaggagaggaaagactgttggtgtctccaagaagcgataagctgcttcacaacgatcccccatagcttttctactactgtgttggtccatttccagaatcttaaggagtgttcttgtttagacgattaccttggatgatgttttgccctagataatgtctttgttctggaacctttaatatattgtatcttgaattccttcttgaactctttgagagtttgttttgccaaaaaaaaaaaaaaaaaaatctgggggggggccccggcccccatattcctctaatggagggggatttcaaaataccggggggccggtttataacaccgggaagggggaaccaccgtgtgtcccccctaataaccgtgttggacaaattccctttttcgcacgtgggaaaataaaaaaagggcccccacaatgccccttccaaaattgcccccccctttggggcaaggggatcttgtcg

SEQ ID NO: 23464 - DNA, 1474 bp, Triticum aestivum
  Clone ID: PAT_TA_23464
tcgaccccgcgtccggacaagaccatcggaggtggtgatgacgccttcaacaccttcttcagcgagaccggagccggcaagtacgtgccccgtgcggtcttcgttgatctcgagcccaccgtgattgacgaggtccgcaccagcgcctaccgccagctcttccaccccgagcagctcatcagcggcaaggaggacgcagccaacaacttcgcccgtggtcactacacaatcggcaaggagattgtggatctctgcctcgaccgcatccgcaagctggccgacaactgcactggactgcagggcttcctggtcttcaacgccgtcggcggtggaaccgggtctgggcttgggtcgctcctcctcgagcgcctgtccgtggactatggaaagaagtccaagctcgggttcaccgtgtacccatctcctcaggtgtcgacctctgtggtcgagccctacaacagtgtgctgtccacccactccctgctggagcacaccgatgtctccatcctgctcgacaacgaggccatctacgacatctgcaggcgctccctggacatcgagaggcccacctacaccaacctgaaccgcctcgtctctcaggtgatctcatcgctgaccacctccctgaggttcgacggtgccctgaacgtggacgtgaccgagttccagaccaacctggtcccgtaccctcggatccacttcatgctctcgtcctacgcgccggtcatctcggcggagaaggcgtaccacgagcagctgtcggtgtcggagatcaccaacagcgcgttcgagccgtcgtccatgatggccaagtgcgacccgcgccacggcaagtacatggcgtgctgcctcatgtaccggggcgacgtggtgcccaaggacgtgaacgcggcggtggccaccatcaagaccaagcgcaccatccagttcgtggactggtgccccacggggttcaagtgcggcatcaactaccagccgcccaccgtggtgcccggcggcgacctggccaaggtgcagagggccgtctgcatgatctccaactccaccagcgtcgtcgaggtcttctcccgcatcgaccacaagttcgacctcatgtacgccaagcgcgccttcgtgcactggtacgtgggcgagggcatggaggagggcgagttctccgaggcccgtgaggacttggccgccctggagaaggactacgaggaggtcggcgcagagggcggcgacgacgatgatggcgaggaggacgacgactactgatctgctcgtccgctcgacggaggatccgtctcctctgccgcctatctttaactacatgttgctgtgctgtcctgttttggagacttgtgtctgggtgttgggttgttaagccatcggtgctttctatgtcgctgttgaactgcatcattagtacttcgtggaacaagtgtctcgcttaattgatgttctgtcctgcttcattccagtgtttctagcc

SEQ ID NO: 23465 - DNA, 814 bp, Triticum aestivum
  Clone ID: PAT_TA_23465
aaaacctagacgcgaacgcacctcctcccttcctgcccccgaccgccccagccgccgccgccgtcgccgccgccgccgactgcagccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggccggagagctttccgcggaggagatggaccgtctgatggcggtggtgcacaacccgcgccagttcaaggtgccggattggttcctcaacaggaagaaggattacaaggacgggaggttctcccaggtcgtgtccaacgccgtggacatgaagctcagggatgaccttgagaggctcaagaagatcaggaaccatcgcggtctgcggcactactggggcgtgcgtgtccgtggtcagcacaccaagactacaggcaggagaggaaagactgttggtgtctccaagaagcgataagctgcttgacaaagatcctgcatagctttgtattactgtgttggtccatttccagaatcttaaggagtgttcttgtttacatgattaccttggatgatgttttgccctagataatgttttggttctggaacctttaatatattgtatcttgaattccatgttgaactcttcagagtttgttttgccatgggctttaagtcatttgaatggttggcaagattatgtatgttctagcatttctgtgaattacaggtttgttggctaattg

SEQ ID NO: 23466 - DNA, 1784 bp, Triticum aestivum
  Clone ID: PAT_TA_23466
cccacccccactttcccttcactggtcaaaggcaccaccacccacatcacagtactacaagccaagccaagccaatccaagccagagaagagtaccaggcgtaggtggatgcaagtgtgagcccaccgtgtccgccccattcacgccctagccacatggagcattcggcgccggcgccggagccgatgctgctcgacgagcagccccccaccgcagtcgcctgcgagaagaagcagcaggatggcgaggcgccgtatgcggaggggaacgacgccatgaccggtcacatcatctccaccaccatcggcggcaagaacgggcgagcccaagcagacgattacgctacatggcggagcgcgttgtgggcactggttcgtttggcatcgtctttcaggctaaatgcctggaaaccggggagatggtggccattaagaaggtactgcagccaggaccgacggtccaagaaccgtgagctgcagcttatgcgttcgatgatccattccaatgttgtctccctcaagcactgcttcttctcaaccacaagtagagatgagctgtttctgaaccttgtcatggagtatgtcccggagacgctctaccgcgtgcttaagcactacagtaatgccaaacaggggatgccacttatctacgtcaagctttacacctatcagctattcagggggcttggcgtacattcatactgttccaggagtctgtcacagggatgtgaagccacaaaatgttttggttgatcctttaacacatcaagttaagatctgcgactttggaagcgcgaaagttctggtggcggggtgagcccaatatatcatacatatgctcacgctactaccgtgctccggagcttatatttggtgcgactgaatatacaacatcgatagatatatggtcagctggttgtgttcttgcagaactgctccttggtcagccattatttccaggcgagagtgcagtcgatcaactcgtagagataatcaaggttcttggaacgccaactcgggaggaaatacgttgtatgaacccgaattatacggagtttaggtttccgcagataaaagctcatccttggcacaaggttttccacaagaaaatgcctcctgaagccatagatcttgcttcacgtcttcttcaatattcaccaagcctccgttgcactgctcttgacgcatgtgcgcatcctttctttgatgagctacgggagcctaatgcgcgcctgccaaacggacgcccgttcccacctctgttcaacttcaagcatgaactggccaatgcttcacaagacctcatcaacaggcttgtgcctgaacatgttcgccgacaagctggtcttgctttcgtgcatgcggggagctaaatatgcgcaccggtgccctcaaccttgcaccttattgttttgccatgggcagaagggtggtggtttaagatggaggcaggtcagatgatccctgggagcgatatatgccagattccatcatcaggagtaccggtaggagcaccggaggaataacaactgtctagatcatctgccagggaaggagccttgcccagggaaacagcatagccttacgccggtggacccgagttttctttcagtttttgccctattgtaagagttattaatagcttcttaatgtgctgtggctcgtaagttgtcaactattttgttctccattcactgacggaaattgttgctgtaaacttcgctgttcaataagttggtcatggccgaaaaaaaaaaaaaaaaaaaaaaaaaaaaaaaaaaaaaa

SEQ ID NO: 23467 - DNA, 1384 bp, Triticum aestivum
  unsure (1)..(1384): unsure at all n locations
  Clone ID: PAT_TA_23467
ctgctagctacaggcaagtagtggagttcgattcaggggttcaggcatggtggctccgagagcactcgtcctcgccgtcctgctggcgatcgccgtcgccaacgccgaggcggcgtcggtcgtcgtcggcctggccaagtgcgccgattgcaccaggaagaacctcaaggccgaggaggccttcaagggtctccaggtggcgatcaagtgcaagaacgtccacggcgagtacgagagcaaggcggtgggcggcctagacggcaccggtgccttcagcgttcccctggcggctgacctccacggcgctgactgcgtcgcgcagctccacagcgccgcctccaacgcgccgtgctccggccaggagccatccaagatcgtgcctgcttccgagggaaccaccttcggcatcgtcgccggcgacagcattgccacgcggtctgcagcgtcgccagagtgcgcgtccatgaccttgtgcgggccgatcaagaagcacatcatcgagcatttccaccacaagcagcccgtgccgcccaagccggagcccaagccccagccccatcctgactatcaccccgtgcccaagccgccgccgactgcagccatgtcgctgatcgcgggtgaggagttccagcacatccttcgtgtgctcaacaccaacgtcgacggtaagcagaagatcatgttcgcgctgacctccatcaagggtgtgggccgccgcttctccaacatcgtctgcaagaaggccgacatcgacatgaacaagagggctggagagctttccgcggaggagatggaccgcctgatggcggtggtgcacaacccgcgccagttcaaggtgccggactggttcctcaacaggaagaaggattataaggacggcaggttctcccaggtcgtctccaacgccgtggacatgaagctcagggatgaccttgagaggctcaagaagatcaggaaccatcgtggtcttcgtcactactggggcgtgcgtgtccgtggtcagcacacaaagactaccggcaggagaggaaagactgttggtgtctccaagaagcgataagctgcttcacaaagatcccgcatagctttgctactactgtgttggtccatttccacaatcttaaggagtgttcttgtttagacgattaccttggatgatgttttgccctagataatgttttggttctggaacctttaatatattgtatcttgaattccttgttgaactcttgagagtttgttttgccatgggcttagagtcatttcaatggttggcaagagcatgtctactctgtgcatttctgagcattacaggtatcctttttgggtgtgcccattctactgctgtgaatgattgatgacntcttaaaaaaaaaaaaaaaaa

SEQ ID NO: 23468 - DNA, 1893 bp, Triticum aestivum
  Clone ID: PAT_TA_23468
gtttttccctcgctcgaaattaaccctactaaagggaacaaaagctggagctccaccgcggtggcggccgctctagaactagtggatcccccgggctgcaggaattcggcaccagggagccactacacatccggcgtcttcacaaacgccggctcgctctcgctccgtctccctccctcctcccccgctccgcgccctccgccgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgtgcggtcttcgtcgatcttgagcccaccgtgattgacgaggtccgcaccagcgcctaccgccagctcttccaccccgagcagctcatcagcggcaaggaggacgccgccaacaacttcgcccgtggtcactacacaattggcaaggagattgtggatctctgcctcgaccgcatccgcaagctggccgacaactgcactggcctgcagggcttcctggtcttcaacgccgttggtggtggaaccgggtctgggcttgggtcgctcctccttgagcgcctgtccgtggactatggaaagaagtccaagctcgggttcaccgtgtacccatcccctcaggtgtcgacctctgtggtcgagccctacaacagtgtgctgtccacccactccctgctggagcacaccgatgtctccatcctgctcgacaacgaggccatctacgacatctgcaggcgctccctggacatcgagaggcccacctacaccaacctgaaccgcctcgtctctcaggtgatctcatccctgaccacctccctgaggttcgacggtgccctgaacgtggatgtgactgagttccagaccaacctggtcccatacccgaggatccacttcatgctctcgtcctatgcgccggtcatctcggccgagaaggcgtaccacgagcagctgtcggtgtctgagatcaccaacagcgcgttcgagccgtcgtccatgatggccaagtgcgacccgcgccacggcaagtacatggcgtgctgcctcatgtaccggggcgacgtggtgcccaaggacgtgaacgcggcggtggccaccatcaagaccaagcgcaccatccagttcgtggactggtgccccacggggttcaagtgcggcatcaactaccagccgcccaccgtggtgcctggcggcgacctggccaaggtgcagagggccgtctgcatgatctccaactccaccagcgtcgtcgaggtcttctcccgcatcgaccacaagttcgacctcatgtacgccaagcgcgccttcgtgcactggtatgtgggcgagggcatggaggagggcgagttctccgaggcccgtgaggacctggctgccctggagaaggactacgaggaggtcggcgctgagggtggcgacgatgaggatggcgaggaggacgacgactactgatctgctcgttcgctcgacgggggatccgtctcctctgccgcctatctttaactacatgttgccgtgctgtcctgttttggaaacttgtgttgggttgttaagccgtcggtgctttctttgtcgctgttgaactgcatcattagtacttcgtggaacaagtatctcgcttaatttgttctgtcctgcccggtcctgtctttgctcttggtgatcggatcatatttagtagctgaatttgattagcccggacggtggtcgagattctccccgcgcgaacggaccaccggcggggatt

SEQ ID NO: 23469 - DNA, 1088 bp, Triticum aestivum
  unsure (1)..(1088): unsure at all n locations
  Clone ID: PAT_TA_23469
tgggaggtgaggcgtaccaagaaccctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttgggtgaaacaagtttgatccagatttgtgtgttttttacaccgaatgctcgaggtgctgctagtactttgttatctatctatctatctctattataataccctttggaattggaactgagtggttgctggaacttagattccggtttgctcatccgccctatctctatgaatgaattggtttgggttatttgtggttcgactctctgctgcattttctagttctattgtagttggagaagagtagtttagaaattttcgtcatcatttgggctagttatgtatctgggttgatgctatgtttgtggattttctccagaggttagccattgccggtgcctaaaaatacacgatgtgtttactaaanaaaaaaaaaaaaaaaaaaaaaaaaaaaaa

SEQ ID NO: 23470 - DNA, 948 bp, Triticum aestivum
  Clone ID: PAT_TA_23470
gccggccgggctgggctagcctccggatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttgggtgaaacaagtttgatccagatttgtgtgttttttacaccgaatgctcgaggtgctgctagtactttgttatctatctatctatctatctctattataataccctttggaattggaactgagtggtggctggaacttagattccggtttgctcatccgccctatctctatgaatgaattggtttgggttatttgtggttaaaaaaaaaaaaaaaaaaaaaaaaaaaaaaaccaaaaaaaaaaaaaaaaaagccccttagcaa

SEQ ID NO: 23471 - DNA, 1600 bp, Triticum aestivum
  unsure (1)..(1600): unsure at all n locations
  Clone ID: PAT_TA_23471
gccggccggtccgggctagcctccggatccatccatccgcccctcgctgccgctgcgtctcgtctccaccaccccacttgcccccggactcaggaggatcgtcggagatggcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcttcccactgatgatgttctgcttggccagatcaagactggatttgctgatgggaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttggcttttacaagggtttgtcagctggtttactaaggcaagcgacctatacgacagctcgtcttggatccttcagggttttgacaaacaaagcaattgaggcaaatgatgggaagccattgccacttgttcagaaagcttttattggtctgactgctggagcgattggcgcatgtgtgggcagtcctgctgatttggcactcattaggatgcaaaccttgaagaccggtggcccatttaaggtttgcatggcgcagtccaaagacccagtgtatgggtacttgccagtggcatgcaaaccttgaagaccggtggcccatttaagttctactccggcttccctgtatattgtgtcaggatcgccccgcatgtcatgatgacgtggctcttcttgaatcaaatccagaagtaccagaagaagattggcatataagatctccagttggagacgagagtatcaatccttattcgacacatttaataactttccagcagctttgcactcccgtggttgtttttggtagacagagttttaagcgatttttaccgtagcttacatttgctgtggtactcttgacgttgttacaataatcacattatttgttgtaattggggcaattttttttggcgggcatacttctgtaggttgggcacagccatgagacaatattactactccctccgttctaaattactcgtcgcagaaatagatgtatctagaactaaaatacatctaaatatatccatacctacgacaagtaattcggaacaagtaattcggaaggagggagtacctgcttgtgccatcttgttttgtatggtatgtgctcaattttatctgtggctcgaaaaaataaatcctttctacctgtgccttgcaccatattatgctcttaaataaattgtgtttttccnatc

SEQ ID NO: 23472 - DNA, 637 bp, Triticum aestivum
  Clone ID: PAT_TA_23472
tgcaggcagccagctccgcacgaacgcacggtcgcagagacaccgcacgagagcagctccaccacttccctcccacacgagcccaagaagcaaccatggcggcggcgaaggccaccctcgtctgcttcatggtcatggctctcgcgacggcgctgctggcagtgccgggcgcggtggaggcggcgacgtgcagcccgacgcagctgaccccgtgcgcgccggccatcatcgggaacgcggcgccgagcgcggcgtgctgcgggaagctcaaggcgcacccggcgagctgcctgtgcaagtacaagaaggaccccaacctgcagcgctacgtcaactcccccagcggcaagaaggtcttcaccgcgtgcaagctgcgcctgccaagctgctgaactagctattggtgccacgagcttcgtccatgtccctcgcgcgttgcacgtacactacgtacgctggagtaccgagagtgtgtgaggtataataataaaacgaggcgagtgctgtatactttatatattaaacagaaataaattgacagcgctgtactactttggtacggtgcccgttaaaaaaaaaaaaaaaaagcttcatgttctgtgtatgccagcatatacatggtataagtaataaatat

SEQ ID NO: 23473 - DNA, 499 bp, Triticum aestivum
  unsure (1)..(499): unsure at all n locations
  Clone ID: PAT_TA_23473
ccgccgcgagcaccaggccgccgcgctcggggcgacgctgcccgcaccaatccctgcgatgcgcccacctccaacccggcggcgatggcgatgtccgcgaggcccgggcgcgagggaggcgatggcgaccagctgaagcggcggcgccgtcatcctacaccgggaggcggggcctagtggcgcacgaggctgcgggacccggaaagggggagaagcaagggaggtactgttcgagggaggcggggcgccgggagggagagagcagtggaggtgctgacgctgacgccgcggcgcttcatggaggtcaactaggaggtggacgaagccttgcagctcgcaacccgacctgctcgccgatccccaatagggtttgctcccccgcggggacccttttctcctatgatgtccggatggtgaatgctcgcaagatcacccgaccaaggatgggatttcngggaatgtattcatcgacagaggggtggtntacctaagttctgcc

SEQ ID NO: 23474 - DNA, 610 bp, Triticum aestivum
  unsure (1)..(610): unsure at all n locations
  Clone ID: PAT_TA_23474
gaagtgggacgctcacagacatatacaccgactgcagatgatattggccatgttctgagatttgaatgtgcagcggtggatacagaaaagaaagtaccagcaggacctccaacttcaattatgacgtcacgtgtgattccagcaccaaccccctactccacgccgccttatccaagtgaatggagatgttttgggtcacttggatatggacagccagagttcttctttcgggacattcacagtgctgtcttataatattcttgcagatgcatatgctacaagcgatgcatatagctactgcccaacatgggctctttcatggacttaccggagacaaaatttgatgcgtgaaattattgggtatcatgctgacatcatatgtcttcaggaggtacaattgaaccacttcgaggatttttttgcacctgagtttgataaacatggatatcaggcactttacaagaaaaggacaacagaggtgtatgctggagttcctcatgccattgacggggcgccccgcccccgtattcgcagnttcaccntaaagaattaggcgattcaanaggggcangtcttaaagagcatatcactgcaaaaaagggggnttaac

SEQ ID NO: 23475 - DNA, 1784 bp, Triticum aestivum
  Clone ID: PAT_TA_23475
tcggccgcccccccgggctggtgcagccgctagccgcggagcctgccgggggcttcggccggggccatgcggagtgcatcctcgccgacgtcgctctctacaggcctcgggtccgtggggtcgccccgttgcttcacccgcggcgcgcctgcggcaccgaccccggggcgtagtgctccatcggccccggggccgggggggcctgccactgcctgcagagggagacgcatcggcggccgtcgagctgcggagaaacggttctactgagttcattcgaggcgggtctcaatgagggctaagagcatgaagaagaaggcgtctcagaaagaggacgcgcacttgctcacggagggcctgcagttttcgcctgacccggtcatccatagattcgatagccggtcaacgaaccactcggtagcgtcgaatgctagcgggttatgatgcgctttgtattgattctggagaaataaggccgccctgtcgatcggatgagttgtatatagcatagagttgctaatgaggtgatcatcttactaataagtacaggctcacggttgcagtaacaaagaatgacgacattgagctgggtggttcgcctcatatcttcactttcgaggaacttgaagtggctactgatggatttagtgcttcaagggagcttggtgatggtggctttggaactgtttataaaggaaaactcaaggatgggagagtagtagcggtgaaacgcctttacaagaacaactacagacgggttgagcagttcctcaacgaggttgacatcctgtcccgcctgctccatcagaaccttgtcatcctatatggctgcacgtctaggatgagccgtgaccttctcctggtgtacgagttcatcgcaaatgggacggtcgcggaccatcttcacggatcacgttcggcggaacgaggcctcacgtggcctctaagactgaacattgccatagaaacagctgaagcactggcctacctccatgcagtcgagatcatacacagggatgtgaagacaaccaacatattactggacaataacttccatgtcaaagttgcagactttgggctgtcacgcctgttcccgctcgaggtcacccatgtgtcgactgttccacagggcacaccgggctacgtcgacccagtgtaccaccagtgctacaagctgaccgacaagagtgacgtatacagcttcggtgtcgtgctggtggagctgatatcatcgaaacctgctgtggacatgagcaggagccacagtgagatcaacctggcgaacatggctctcaacaggattcagaaccatgaagttgttaagctgattgatccagagctcggctacgacaccgaccccgaaacgaagaggacaatcgatcgcgtcgccgaggtggccttctagtgcttgcagctggagagggatctgaggccgtcgatcaaggaggtggtggagatcctgacttgcgtcagggacggagactgtcgggctaatagcatgaagaagaagaaggcatctcagaaagaggacgcgtctttgctcaaggatggcttgcagttctcgcccgacacagttatacatagattccatagccagtcaactaaccactcggtagcatcaaatgctagcggattatctataacggcaaatgctgaaaagaatgccacataggcccttttggcactctttaacactgacaaaacaaaaaataatattaaagctcggcaaaaaaaaaaaaaaactcgagacacctcggccgcgaccacgcctaatcactagtgaattc

SEQ ID NO: 23476 - DNA, 381 bp, Triticum aestivum
  Clone ID: PAT_TA_23476
gtctcgagttttttttttttttttttttttttttttttttttttcctcgcgccgaattccgcccgagttattccgataatacatgcatgatgcatctcgcagtacgctccccaaagactaatttagcgtgctgcttaacacactagcatgtccatccatctgaacagattcagatggcgcttacttagctagtaaatgtaggagtatatactataatacattacatgccatgaggcatcagcgcttggtggtttacgcagcctcttggggtcgtcagacggccttgccgtactttgcggcggcggcgggggtgtcctgctgctgcatgagcgcgagggcgcgctcgaactgcgcccagcctcgtgccgaattcggcacgag

SEQ ID NO: 23477 - DNA, 470 bp, Triticum aestivum
  Clone ID: PAT_TA_23477
ctaggtcttcctcgccgagcgccgccgccgccgccgcacctcctcccctctgccgcgacctctcctctcctctcccgccgcctgctgcccgagctcacctccgacagccgtccggccgaaccgccgcccactcccagccaatcaaagggcctgcgcgatggaggttggtaacgggggcgattcggcggccatggaggtggaggcggcggcggcggcctccggctccccggtccccggcggcgtggccaggcggctgggcctcaggaacagcatccagaccaacttcggcgacgactacgtcttccaaattgccctcgtgccaggtgttctccgcgcgcgcggtctctctgtcggccaacgcactcaagttctaagctccaacaactgggcagtatctgggggaatgacaaggcatacaaggaagatcatgagattgcctttaactccgtcatcgcgcagtgatatctctt

SEQ ID NO: 23478 - DNA, 557 bp, Triticum aestivum
  unsure (1)..(557): unsure at all n locations
  Clone ID: PAT_TA_23478
gttaaggaacttgtgttcaggaaatctggccctaaaaaaacaaccttcatgatgacacctgggttttcaaagataaacgggagagactgcccagtccaggctccggctgcgaactactgctaacagagctgattctgtgtggcacagagcgcaggagatggacgtggtaaacatatactcactacattagtttccaactgaatagaaattgacaagatagccataggactgttgcacttgtcagtcttctccccaatatcttcactctttctggcatttgccaattcttgtaaataccccccttatggttgcccagcctctttttgtgttgggttagcggaaactatcgttgtgtcttctgctagcttctatacatatttgttcacatggtgttcatgtagtgtagagaaacgtatacaaatcctttataggttttataaccttgtatgaagtattttatcgccaataaacctcatctgcacactacatccacctgaattgcgtaggaaaactgataggagcctggcagcatacacatannggctantagataaaaa

SEQ ID NO: 23479 - DNA, 1879 bp, Triticum aestivum
  Clone ID: PAT_TA_23479
gcacgaggcagaaagacccccaccgaaacccacaaacccgccgccaatcccacacaggttccgcccccccttcctttacagacccccgatcgaaacagatagccagctagagagttagctattcccgcgaaccttccgctcccattccaagcccgtcccgctctcggtcccgtcccacgccccctcccgccgccgtcactccttcttcatcggtatcatggcacccctgcagcggcggcagtcgggggcgaaacgcagctgtcgcttccgtcttcagccaacgcgtgtgcggtgggagggaatgtgagggacgcgcagatgcgaggaggccggcaggatgccgcgatggctgagggatctgtcggagaacaaatggtccataggacttcgacgcaaatcaacggtggggagtggcaatggggaggaagtaggcacaattttgttcccagctatccgctcaggggagaggtcattacattggctggccgtgattacatggaagattcgcatgtctgcatccccaacctagccaagaattttggtgacaacatggtggatgatgaagttattgcgttctatgagggacttggtggacatggtggaaaacagtacgtacgcgacaacttgccgcgggtgatcgtggaagatgctgcttttcctcttgagcttgagaaggcagtcaggaggtcgtttgtgcaaactgacagtcagtttgcagagaagtgctctgtccaggatgggctttcttctggaacaactgcacttacagcaatgatttttgggaggtctcttctggtcgcaaatgctggcgattgccgagctgtcctttcccggcgcggcgccgcaatcgaaatgtccaaggaccacagggcctgctgcctgaatgaaagaaagagagttgaatccctaggcggctacgtcgacgacggctatctgaatggccagctagcggtcaccagagcgctcggcgactggcatctcgatggcctcaaggagatgggcgagcccggaggcccgctgagcgccgagccggagctcaagatgatcacgctgaccaaggacgacgagttcctcatcatcggcagcgacggcatctgggactacttctccaaccagaactcggtggactttgcgcggcggaggctccaggaccacaacgacctccggcggtgctgcaaggagatcgtggaggaggcgatccggcggggcgccaccgacaacctgacggcggtcatggtctcgttccaccaggaggcccctccccagatcagggtgaacaggacgggcagggtcgagcggagcatctcggccgaggggctccatagcctcagggtgctcctggaaggccagtgatctcggcggcgcgccattgtcgccgccttcttcttctgcattgttgagtgtcaactgtaagtaccgatccgccgtcgtcgtcgacatgccagtttgtggctctattgttacctgggaataaaaccaacgaacctgaagaagatctcacccgccattgtgaatcgtgaggcacctgtaaatataagttgggagcttaattagggtggtaagggagtcagtagcgtgcatccagggggctttgaggctcattatgagatgatgagatgtgttgttccccctgtttaagttttgtctgtaaaagaaaccattctctggttattgctattgtatcagtgtaccttgagttgtctcatgtgatgaaccaccaccttgttgatcactgatatgatgagatgtggtcttccccccgtttaagtctgcctgtatttgatcatttgtttaattgccatgtttaagtcttgttatatctatcatcctctacttggaatacaccaagaaactatttccgcctcaaaataagtggtgc

SEQ ID NO: 23480 - DNA, 594 bp, Triticum aestivum
  unsure (1)..(594): unsure at all n locations
  Clone ID: PAT_TA_23480
aagctcgtaattcgcgaccgtaatgttggtttcctgaactacggcactcgcgaccaggccgactataggttcttcgctgctgcgttctacgcagcgcacccactcagacctggcggctccgtgaagttctatatcaacctgttcgactcaagagacctggtaatggaccagaaaggaggtttttgtcaattcacctgacgcttaccgttacaggatcacaaacaaggtgatcactattgggaggacagcatggctcaattgcctgggtcgacctctcacatggtatcctcatctatgacgcgctcctggcacaacaatattctcccgttacatcccgttgccgccttccggagttggcccgacccagaatcaacccgtgcgtgacatggctgccgtcgatggtgcctcagtattcagcatgagctacctcctttgaccaaacccccagcacactcggagatggaagcaagnatggagatggatgatctnaggactgccaatnaagnatgaggggcacatnagactcgaatatatgtaccacacttactcgccgatgcacattacaaacagccgaaaccaaaggatcncgtactt

SEQ ID NO: 23481 - DNA, 367 bp, Triticum aestivum
  Clone ID: PAT_TA_23481
gtactttgtcggatggaagcccgaaatgatttccaactttaaagaactgcaaactcttgagaccgtccatgccagcaaagacttgtcgctagagctgaagaaaatgagcaagttgcagactgtttggattgatgacatcaatgcatctaactgtgatgaccttttcaagaccctctcagatatgcctctactttccagcttacttctctgtgcatgtgatgagaaggagacactttctttccaagcactcaagccaacgtctgaaaagcttcatagactgatcatcagaggcggctgggctgctgggacactcaagtgcccaatatttaagggccatgggaagaacccaaatttctggggctcaaag

SEQ ID NO: 23482 - DNA, 859 bp, Triticum aestivum
  Clone ID: PAT_TA_23482
gagaagagaggtggtggtgaagcgttgcgaggagagccccatccccatcaccgcttcatcgtcccgtcatagcgatttccgcctcccgtcgcagcaaatgccgccgccgtgccagaccctctgccgtctccccgcgactaacctcggtctcccttggtgcccccggtccatacctctccctcgcctcgctcttgccgcgcgccgcgccagggccgtcgctgccagggcctcgtcatcctcttcctcgccggactcctccttcggctcgcggatggaggactctgtcaagaagactctcgccgacaacgccgtcgtcatctactcgaagtcgtggtgctcgtattcaatggaggtcaagggtctcttcaagcggattggcgtggatccacatgtcatcgagctcgaccagctcggtgctcagggaccacaactgcaaaaggtgttagagaggttaactggacagtccaccgtccctaatgttttcattggtggaaagcacattggtggctgtacagatacagtgaaactttatcgcaaaggggagctagcaacaatgctgacggaactggacatcaaagtgaatcatcatgacaagattgagcatgactagatttctgaagtaccggagcagtttgggtttattggtttgagacgttactagcaaattaattttttgtcgcgtatatctgttgctgaaactgtgaaggaagaaaaccctctgaattcgacaaaaaaatccgagttggtgtagtgttatcgcgaatctgagttcctatactgtcaaagtgtcaatgcatattctgatttgatttctacactgaaatgcaataacatgatcgtgtgaaaagcaaaaaaaaaa

SEQ ID NO: 23483 - DNA, 578 bp, Triticum aestivum
  unsure (1)..(578): unsure at all n locations
  Clone ID: PAT_TA_23483
ccgccccccatctccacccccgtcgcgcggccccctcccgtccgcaaccaccaccagatacccaaccctaaccacaaccccgccttccaccgccccccgcacccgcaccacatgcccatgcctccgccggggcccgcctgggccgactcgcccgtctctgcctacatgcgcatcctcgagaactccctcttcagcgccactcctcccggggctgccgccgccgccgccgccgccgctcatgctcacgccgcggctgcagcagcagctgccggacggggccctccgcagcacccttatcacccgcccccgccgccggtgccgtcgcccgggatactcccttcgccgaccggatttctcaatttgctctcgccgacgcccaggtcgccctacccgctcctctcgccggggttccagcaacctcctccgctcacgccgaacttccccatgttgtcgccgctgccaggaacagggattctggggccaaggnccatgccgccgccgccttcgccaagggctatggtccggaatcgccgtcggggctgctctaacgtccggattctttcaattgctgagccang

SEQ ID NO: 23484 - DNA, 780 bp, Triticum aestivum
  unsure (1)..(780): unsure at all n locations
  Clone ID: PAT_TA_23484
gcggcgcgggccgagtactagcccccaagtatggtttgcggtcatactcgaaccaagcttgtaggctatggcttccctctcttcgctcttccttgcgtcggctttcctccttgctggctcagccttcttctaccgctacgacaccggcagcggcaacaagactagcgccacaaccaccacgcacctccacttttacatgcacgacgactacacaggcccacgccccaccgcgatgcgcgtcgtgtccggccgggccatatccaccggcgacgacgccacggcgctgaagacggcgccgcggcagttcggcgacatcgtggtgctcaacaacgcgctgacggtggggcccagcggcggcagcgcgcgggtgggcacggcgcagggctgggccgtccgcgtgtcggagggcggcatcgtatcggacctgacgctgcacctggtcctcgaggcctgcgagcaccacggcagctcgctgacggcgaggggccgcatcgacatggacgcgacggctgcgggagtcggtcctcatcggcggaacccggccggttccggtacgcgcggggctacatgctcaccaagaactacgactacagcctcgccaccggcggcgtcctcgagatcgacctctacgtgcaccacgactagctcgccgcccggctcctcgtccccccttaccgcgttccccgcgggtgccctgatatttgcgcctnaaatttccctgccttctaattgacccctgtgcttgtccaataatcaagtngcnacttttttgttgcaatt

SEQ ID NO: 23485 - DNA, 1428 bp, Triticum aestivum
  unsure (1)..(1428): unsure at all n locations
  Clone ID: PAT_TA_23485
aattgatgatgatgaggataaaagatcagccactgcagttcatgagaaaggattcaacttcgacgacactaanaataatgcgtggtgcatggagaaatgaacctaatcctgaggcctgcatggaattcttcagatgcctggcaatctgtcatacggttcttcctgagggcgaggagacaccggaaaagatcacttatcaagctgcctctcctgatgaggccgcacttgtggctgcagcaaagaatttcggtttctttttttataagacgtacgccgaccacaagtaatggttcgtgaatcacatgttgataggatgggtagtatgcaagacgttgccgatgaaattctgaatgttttgggatttaacagtacaaggaagcgccaatctgtggtttgccgctttccaaatggaaaacttgttctctactgcaagggtgctgataatgtcatctatgaacgtttagctgatggaaattatgacattaaaaagacaagcagagaacatctagagcaatttggatctgctggcttgcgtacactttgccttgcttatcgagatctcagcatggaccaatacaaaagctggaatgagaagttcgtgcaagctaaatcttctttacgtgaccgcgataagaagcttgatgaggtggctgaattgattgagaaggaccttatattgataggttgcactgctattgaagacaaactgcaagaaggggtgccagcctgcatcgaaactctttctgcagctggcataaaaatttgggtgctaactggagataaaatggaaacagcaattaatatagcatacgcatgcagcctggtgaacaacgacacgaaacagttcatcctccgtgctcagacagacacaattagagaggctgaggacaggggtgaccctgtggaaattgcgcgagttatcaaagagtcggtaaaacagagtctaagaagttacctcgaggaagcccgccgttctctaagtagcacaccggagcgaaagttggctttcattattgatggaagatgcttgatgtatgctctagacccagctctgcgtgtgaatcttcttggtttgagtttaatttgtcactcagttgtatgttgtcgagtttctccactgcaaaaggcacaggttactagcttagttaggaagggtgctcgtaagataactctcagcattggcgatggtgctaatgatgtaagcatgattcaagccgctcatgttgggattggcattagtggacaagaaggaatgcaagcattatggctagtgattttgccacgctcaatttcgttacttactgatttactcttgtcatggacggtggcatacttgagattgtgcaagttacacatactcctcacangaactgacattacgctaaccagtccggtcacttccaaactggnttctggcagcgnttataa

SEQ ID NO: 23486 - DNA, 588 bp, Triticum aestivum
  Clone ID: PAT_TA_23486
cgggagcgtgggcggacgcgtgggcggacgcgtgggttcgcctgcccgaacggttatggtgaatcgtgagttcagcggggtggaaaccatggtgatgcgaccgaccgggtaccctcgtcgggctacgccacgaagaggtggcgcggacattgaatcgtctactgacgattcgagtcccttcacccgcgattccggaacaaatcggacatgaatgttaataggtgtgcgtcggtcgcagtctcccgataattgcaggttctgtagctctgtccattggagcttgcttgcgacgggtttgctgaatcgcaaggtgaagcactgcttacaacttcgacgactttgtgctgaataatatgtttgaacgactacatcttctaattgctcaagtgccaatgctctgggcctgtattgtttcacaaaagcacaaatctgctatgaggggatctaccttctgctaatattgctcctaacgctctggccctgtattcagtttggggtatgaagtccttgttgccatcttcatttttgtcacaggaggatgcgaacgatttgttacaatttgtaaccttctcacatggaagagctact

SEQ ID NO: 23487 - DNA, 1977 bp, Triticum aestivum
  Clone ID: PAT_TA_23487
ccattctcctcgccggccggcgcctcccacgtcgttcccccatggaaggggggagccgggccgggaagtttcactttcttcccttggaaccctccctaggcttcctggggtgtttgacagagccccctccctgcctcctggttctgatttcgggaccaacggttgcattcggcgcccccagaacaaggttcccctcaacgtccgcagctccgattcggggagaaggatcttcgcccttcgcccggggctatcccgacaagcaccctctccttgccgggggccgtggacctcctctccgattaggtggccgccgcggtatgggagttcagaccccaccttagtcggaaatgaagaacatccggtacacggtagatacagcagagcatctggtaagagcagtttggatgagatggagatgaagctgacgattaagaaggttccgacggtgctgtcaaactaccatgacgtacgaagcccgccggccggcacgtactgcctcacggggtgctgcgaatccacgtgcgtccccctatgcgtcgtcatcctccgtcccccgagcctcttcacacatgtcggtaggctgccttctccttcagtgagaagagcacaggaaatcgttcaaatcgattccaggcgcgtgggttcgctttatctagtggctgcttcgtgttagcagggatcctggtgcctggccagcttgggtctgttgcacagcttaacgaaggccgactcctcaagaagcgcccgaccgagttccgtgttgaccgtgtgctccagccattcgattctgccaagttcaacttcaccatgggtggcctggaggaggttctctttcgctttgagaaaggtggtggcgacagcagctatttccttgaaaatgccccaagcactgagggtgaccatgctcccagcgttgttgcaatcaatgtgagccctattgagtacggtcatgtgcttctcattccacgtgtccttgaccgcctgcctcagcaaattgatcctgaaagcttcctgcttgcactacacatggcagctgaggctgcaagcccatactttaggcttggttacaacagcttgggtgcctttgccaccatcaatcatctccacttccaggcatactacctgtcagtaccttttcctgttgagaaggcgcctaccaagaagatcccccttgccaagtgtgcgctgaatagtggagtgaaggtgtcaaaactgacaaatttccccgtgagaggtctggtgtttgagagagggaacacactgaaggatttggctgatgtggttaccaacgcttgcatttggctccaggagaacaatgttcctttcaacgtcctcatctctgattccggtagaaggatcttcgtttttcctcagtgctatgccgagaagcaggctctcggtgaagtgagccaggatctgctagacacgcaggtgaaccctgcagtatgggagatcagtggccacattgttctgaaacggaggacggacttcgaggaggcttcagaagcatcagcctggaggcttctcgctgaggtgtctctgtcggaggagcgatttgaggaggtgaaggcatgtatcttcgaggccaccggcctcactgaatctgacgaggaagaggaatccagtgagtctccttatgcatcgtcatcctccgtcccacaagcctcttcacacatgtcggaaggttgccttgtccttcagtgagagagtaaaggaaatctttcaaatcgcaaggttcgcattatctgtggctgcttggtgttagcagggatcccagtaattgtaccgtgtccgctcttgcttgctacttctgcctctgatctttagctaccgttgttggctactagttgctggtgttcatactgtgcagtttattattaagcacaggtatgcgtgttggcttgtttataactgaaatgcattggtgtgttcatcgcccgaccgtgtttctcattctaaactgttactttgtttttc

SEQ ID NO: 23488 - DNA, 1071 bp, Triticum aestivum
  Clone ID: PAT_TA_23488
gtacaccctccagcccggcagcgcccggcgcgggagttttgactcttgaacccgatttcgagcaaccgagcggcgagcggcgcgggcgcgggagcggccaaggagtgcgacagtgcgaccggcaaccggcagccggcgcggcttgctgtcatctcggcgaaggcgcgcccagatctactaaagcaatcacatggcaactctgaaagatgcagtagcacggaagcctatactggcaacaatccgcctgcttgttccagctggtgctgcacgtcctgcaccaccagttggtccggcactcggtttttataggctcaatttgatggcgttctgcaaggatttcaatgcaaggacccagaaatacaaggcagaaactcctatgcaggtcacgctaactgcctacaaagatagcactttcgagtttgtagtcaagtcgccgtccgtttcatggttcctcaagaaggcagcaggaattgagaccgccagcactcgtcctggtcacaacgttgtgtcatccctaacactccgccacgtttacgagattgcaaaacttaaacaagctgaccccttctgcaagcatatgtcactcgaggcgttgtgcaaatctatcattggcacagctaactcaatgggcattgagattgtcaaggatctctgagtggattggctcgtctccaatactaccaagctcctaccttcccaggtgacatttgtgagctgtagtttctcattgatgtgggagaagatgggagtttttcaactgttgatccttactgagctcttcagcccaggcaatattttcattttcttcatacccagtcttcagctgttcctgctgcaatgttgatctcttccatgggagatatttcacggaaaataatgttacttctaagcttgcgccagacgaacaatattatccatttctgttaccttgccaagttgctagttgtttgtttacttttggtatcattgtcattttctcgtgtatattcaaaacacaaatgtgtaatggttaattttgggcgcttttacatgattacaaacttttacttgccccgtgggggggcttatcat

SEQ ID NO: 23489 - DNA, 764 bp, Triticum aestivum
  Clone ID: PAT_TA_23489
ctccgctctcaccatcgcaatgtatgctgcgcccatggtcgcaatgaggacagtggtgaagacccggagcgtggagtacatgcccttctccctgtccttcttcctcttcctcaacggcggcatctggagcgtctactccctgctcgtcaaggactacttcatcgggatccccaacgccatgggttttgtgatgggcacggcgcagctggcgctgtacatggcgtaccggaacaagaagaagctcgtggtgctcaaggaggaggacgaggagaaaggggcggtgcacctgatgggacaggtagagctgggccaggccaaggtgccgtcgttgaagaaggggctgagcctgccgatgccctcgtccctgccgtcgccgttgcacgggtttggcaacctaatcaaggccttgtccgccacccccctggagctgcactctgtcttgagccagcacgagcgcgtcggtgctaaggaggagcaccacgacgacgagcatgcctactcgtccaagtgacacacactaacactaactagtgcgtgtagcagcatttgataaagcctgcacggggtatgcgtaatataatgcgtgtacagtgttcgcactgaaatggagagtatggcgtgacagcatgtatatgacgtgcttattttgcgcataaatagagagggctagtttcttttcaaaaaataataactttatataattttttattattctttattatttattttaatataaaaaaagggcggcccgttctaaaggatcc

SEQ ID NO: 23490 - DNA, 996 bp, Triticum aestivum
  unsure (1)..(996): unsure at all n locations
  Clone ID: PAT_TA_23490
caaaaaagcaaataattatccaccatcaacaacataccaatgtttctagcaaaagtaaagggatagccatgctaccaccatacttatcgttaaaacatgttcaaataaaatatgcagggcactttcactttgttcaaataaattactgtacaagcacagcatttttactcgtccacttctcctgccaagcaaggaggctcgggggggtaacgagacggataaacccagtacgcctcaggcacaggccaactcagaattttagacttgtctgcagtccggacaacatcagcatcatctatagtccgttctgcatcaaaacgcttcatgagtctcaaggattatatcccttgttatgtaaggagttttttccatgtcataaaagttcatgccaacaaaattcccatcacaatcaacaaggggccctccaatcccagcctggctgattttacaggtggacacccaaagctccttgcaatcaaatttactacatttgccagtcacagccccatttgtggccattaacatgcctgacataaaaccacgtcccaggcctattacctcagtttgagacacttcatcaagttttgctgcgcgatgactgcagacacccatgatgctcacaacagcccacattgtagtgtaaaatcacaatgttgcagtgtcccaaacccacacgacgtttacttggaagacacacttcaatctcccaatttaggatgaatgttgctttctttcacccagagttcttaacccaanttgcttgaagtcagtacacttgtagtggatccatcgcattctataaatacacctgagcaagcaaaatgttttcttcttttcttgagttcctcagcagaatcagattctacaatgaatgaagcaagtgccacaacacttcgagacatctttgaagcaactctcctagtgcgttcactccaattctctctgccaaattcatcgtcgaaagtccctttcaagtacatgccatcatcagcaaac

SEQ ID NO: 23491 - DNA, 657 bp, Triticum aestivum
  Clone ID: PAT_TA_23491
gccggccggttcgggcgggcgacgtccggaaggataaagaagatttgaggccacacagctccagcagcggaaggatggaggctgcggccctggcccggctgccggaatatgcctccaccacggccccgctcaccggcaaaagatggtcgttgccccgtgcccagaggcgatcgcccagggcggcagcactggcgcccggagtcgcgagcttctccagcgcatctcccactacgagaccaccgagaattcaacgccgaggccccgggacaaagtgtgcggggcgcaggaggcgggcggacatccagtcggacacgtacgtgctgctggagcccgggatggacgaggagttcgtgtccaaggaggagctggaggttcggctgcgggggtggctggagaggtggccggggggcgcgctgccgccggacctcgcgaggttcgacacggtggacgacgccgtctcgtacctcgtccggtcggtgtgcgagctcgaggtcgacggcgaggtgggctccgtgcagtggtaccaggtccagatcgaatgaatagctagagctagaagtaccatccgaccaatgctgcgtgactgcatgtgtatgtggttcgaacttcgaagggacgaaattttggcctgagatatatagggccctttggcgtcta

SEQ ID NO: 23492 - DNA, 595 bp, Triticum aestivum
  unsure (1)..(595): unsure at all n locations
  Clone ID: PAT_TA_23492
gtgcaaaccaacgactacacccatgtctaccactgataagctcaatgctgttgatggtgtgcttctttcttcttctgatgcgacagagtacaggagtattgttggtgggctccagtacttgacgatcacgcgaccagacatttcctatgctgttaaccgagtctgccagtatctgcagtcaccccgtgacactcattgggtctgctgttaagcggattttgcgctatattccgtttcacggtggctcatggtttgcatattcggccgtctgactctggtttgtctttcagcatattctgatgcagactggggctggcaatcccggatgacaggcgatccacgggggggtatgctgcctcctttgggccctaacctgattgcctggagtgctccggaaacaagctactgtcccccgtacaatactgaggctgagtataaggctgtggccatcgccccgtctgtcatcgtctgccttcttccgtgctgctaccgtcaatcccccctgcggtgccccccggcttggctgcacaatcgggccatgccgaacaacaatgantgcacactggctacttcccaancataagtagtttttcag

SEQ ID NO: 23493 - DNA, 788 bp, Triticum aestivum
  unsure (1)..(788): unsure at all n locations
  Clone ID: PAT_TA_23493
agctctccgtcggcgacaagccacgtaggaagaggcccgacatcgacctgggcgaggggttctactactatgcggggtttggccccggcaccaagaggcgccgcacgtcaagcagcggcagcgtgccggaacctccactgcctgctgaaccactgaaagaggaggcaccagacgagatgcaacttgattttagtgcaggtcaggtgcaggcagcgaatgaatcagaccatcaagtggtgcttgctccatcagcacacatcgtcgacgagcctggcaccgctgggatggtgggctgtgacaaggagagcagtgatgatggcatgcaggaacttccactgcctgctaaacaaccaaaagaggaggcaccgtccgaaatgcaacttaattttagtgcaggtcaggaacaagctgatgactcaaaccatcaagaagcagcggcatcagtacgtgtagtcaacaagcctacgggcaacgacggcaccactgggatcgcaggctgggacgaggagagcagcgatgaggaagcgcttggctgcaatggcgaacaaccctgcgacaccaagcggaagggccccttcaagaagaggtggaggaagcctgtgaaagccaggtcgctcaagtcactgatgatgtcgtagtgcctgactctcagtggtaatttagtctagttagctcagcttagtctgctccagtttaggtgctgagttgcagtgtacaaactgcttgnagcatcttttctgttcgtgtgctgtactgttttagctgtctgtactggccgttagatcgaa

SEQ ID NO: 23494 - DNA, 830 bp, Triticum aestivum
  unsure (1)..(830): unsure at all n locations
  Clone ID: PAT_TA_23494
aggtgcacgctgcggatgtcgcctcgcagcttgtacttgtttacgatcatgtcggtgaaggacggcgtggggttgaagcagctgcagttgacgacgagtatgtcgatagtgtcaagagagacgttcgtcttggaaaacagctcatccatggccgagaagacgacgagctccgcctcctcccgggcggcgtccaatgtgcaatacttgtgcggtgggatgtagcgggccggtgtgggtccgcatgtctcctccccgaggcccgagccctcgagaagccgtgacatgaagcggatgctcccctcgctgaaagtgggtaattggcgtgcgtgctcaacgaatgaggcaaatgggatgcggtagtgatgagtgccatggaagcaagcgtagtcgacgaggtacaccttccgtggccgtgatattagatacatggcgaccgcagagatggggaggaagccgaacaagaagaggtgcgcaggcgtaaggtctcggagctgacccacgatctcctcgggcccgagcctcctccccgccacaaccacggtggctgcggccattggtatggtaatcatggctaggaagttgtctacgaccagcttgtagacacatttgaggtgcttgcaaattcctgatgaactcatggtgtcgaagccaacatgtgtttctatgcgtgtgtatgcgaggagagaccggtcttacatataacaattgattttattgctaccaactaccaactaactaattgtacaaatggaatatggcacatgttgtagcattatgcgatcacatgtntttttctctaatatgtacactcaactaataaccatatagtg

SEQ ID NO: 23495 - DNA, 678 bp, Triticum aestivum
  unsure (1)..(678): unsure at all n locations
  Clone ID: PAT_TA_23495
nnatggaactaagaaagagaaccatcgactataaccccaaaagaaccagatcgaattcgactcagttggctacttcatcttctgatggaactgttcgactatggaatgcagccgagcgaaccggcgcattgcaaatttttcttgggcattcctcccatgtaacatcggtagattttcacccgaaattgacagagattctatgctcgtgtgacgacaatggagagatccggttctggacagttggtcaaaatgcggcttcacgcgtgtccagggtgaaacagggcggtacattagcagcctttctatacttacaatcacccctgccatgattcacaccaaaatccatcgacctcctgcgctcaagctatcatcctgttgttggtcacccccccccgcaaagctcactctaacgcccgacgccccccctgcggggccgggaccggcggatatccggcgccaggtccccctagaatcctgtcgggtggcccgtcgctcggccctacgcttcaacaactgatgcccagcggaacacctcaatcaagnattccacccganaaccnaatttgnccttggggtacaaacgtggncttngactggnggaaacaaagaactgncccgccaaanggttttcggcctgggaaccccctaaggncattnttggaacccaaaaggnaattg

SEQ ID NO: 23496 - DNA, 1147 bp, Triticum aestivum
  Clone ID: PAT_TA_23496
ctggtgcccatgtgcttctaccgggttcagcttcacacttgagctttggtatcctttataagatcctactccttagttttgcatcagatgagaatcatgcagccttctcagatcaaatgcgacccctgctggttcattccaggccacaggacctggtgcagatgtaaatcctttccagcctgcttcatccactagctttggttttgaagatactctcggcgatctcagttttgcatccaatgccgcacctggacaacaggatatttttggaagcaccacctccttaccttccggggtttcacatgcaaccacgtcccagcaaacacccccggccattgtttgctcccccacatctccctcaattactcatgcccaatccatctttctacgctcctacacagtcttctcatcttccaacccaacatgctcctcagcaaagcttgcgccatcatttgctcccccacagccacctcaacatgctgcaccatcatttgctcctccacagccacctcaacatgctgcaccaacttttgctcctccaccgccacctcaacatgcagctccaaatctaccatcaggcccatcaaacttttatatgcaaccggcttcgcagaatggagcaccaccatcctatgctcctccacagtcttctcatctcccacctcaacacgcacctcagcaaagcttcctcccacaaactgctgcaccagcaccacaggcaccatcaatatctcgaggggcatctcagccttttggtgccccaaattcagtgccatctgggtgccagcactcctctgcagtcaagtttatcagctcccccagaaacactaatttcagctttgcaagttagtcagacccagccagtgaagaaatttgagcccaaatctacagtttggtctgatacattgacccggggtctcgttgatttcaacatttctggtgcaaaaaccaatccacacgcagatattggagtggacttcgattcaatcaaccgcaaggataaaagacaagacaagaagatctctcaagcacctgtagtatctacgatcaccatgggcaaggccatgggctctggctctggcattggccgagctggtgcgagtgccgttgcacctccttccaacccaatgggtgcggggcggggtgt

SEQ ID NO: 23497 - DNA, 499 bp, Triticum aestivum
  unsure (1)..(499): unsure at all n locations
  Clone ID: PAT_TA_23497
cggacacggtcccgcctcgcgaaccatcgtcggcctcctctcctctttctctttctctttctcccgcgcgacccacacacaggccagcttgctagccagagagcgcgcccgcacgacgacgtacgtgtcgagctgatcgcggcggccggaggcgctcggtatatgctgcgcggcgacggcgacgttgcgaggtagctatgccgcccgccgggggcgacggggtgatcaangctggcgcaagggagaagtcgtcgtcgccgtnggaggtcgctcctgggcggctgcctgggcggcgcggcgggcgaccacgaagcgaagaagaagtcccnggcgcctccggcggcggcggcggcggcgggctgcngcggctgtcattaacngacctgancgngccgcggacgaagacctnccactccctcctgggnccaacctcacgtgtcaacgttgcngactgcggcggcacggcgatttccggacaaaattcttggcaaggnggttc

SEQ ID NO: 23498 - DNA, 792 bp, Triticum aestivum
  Clone ID: PAT_TA_23498
ttcggcacgagggttgtctcgcgttgagggctttgccgacgcaacacgcacccaaaaatcctaatcctcatcgccgccggcgaccatggtgtcgcagcacggcatcctcctcgccgcgggcctcatatccgaccacttcggccccctcgtagcgatggtgtgcgactgcctcctccgccacggggcgctgcagctgacggagattgtgcgccgtctcaagctcccgcaggggcaagtgaagaactctctcctcgtcctcatccagcacaactgcgttcaggccttctcatcgcccagaggcgataggaccatcacgctctacttggccatcttcgacaatgtcctgcatcggctgcgcttctcaaagttcatctctattatccgcgcggacattccagagtcagaagctcttattgagggattgcttcagaatggtaggctaacatttgaccaacttgtgggacgcacaatctctaaagtgccagaaggcaccatccgaccagcaagggaagaaatacgaatgaacttcaacagacttgtgtatgcacgttatgtggaacgttgcccaaaagctgaaccctatttcaatccacaggaagatgaacaatctacaggtgcaaggagaagagttccaaaaactgccgaggaggttctttcacttgagcagaaagttgtcaatactgcaaccctttctgatccagaaaggttttctgagatcccatacagcatggaggatgcatcaaaaacgaatgatggtcctcataacgctgtggcgggtgctaagcggaaaca

SEQ ID NO: 23499 - DNA, 771 bp, Triticum aestivum
  unsure (1)..(771): unsure at all n locations
  Clone ID: PAT_TA_23499
gggtctgcaacattcaggtccgtatgtacttcgcaaatttctatgtcatcttgtagatgcaactactatgctacatttggaggcatttcaaataactgttctacttggagcttttataaattgttgctccattatatgtatccggtatctctactcagagctacccagataggtgttaatcttgcatcgacgtaactctttacgtcaaactctttatcacctccataatcgagaaacatttccgtattcctctaaggataattttgaccgctatctggtgatccattcctagatcacctttgtaccctcttgccagacatgtggcaaggcacacatcaggtgcggtactcagcatggcataccgtatagagcctatgacaaaagcatagggacgaccttcttccttcctctttcttctgccgtgggccaagctttgagtcttactcaacttcacaccttacaactcaaggtaagaaccccttctttgactggatctatttttgaaccccttcaaaaacatgtcaaggtgtgcgtcctttgaaagtattaccaggcgccttgatctattcctatagatcttgatgcccaatatgtaagcagcttatccggtctcctttggaaacaccctcaaacacggttatgcttccagaattctcattattcgatcattattgcccccactcttcttatgggatgtgagtgtccatattctgtaancagtcngcaacatgntaactaagttgatacncatcagntaatcgcncagagtgn

SEQ ID NO: 23500 - DNA, 638 bp, Triticum aestivum
  unsure (1)..(638): unsure at all n locations
  Clone ID: PAT_TA_23500
ctcgagtttttttttttttgggtctgatctgacggctcttattcatgatatcgggcggctggggctcgaccggccgagcggttcggccggcgcgccggcgcctataagcgcccaatatatttacacggctgattattagccttttaatcaaagcttttaacaaaacctatctccccccctcccccaagaaaaaaaacatccaccgtaagtacctccctacaaaccattttgacaccctagctagaatcacttggcctgaaaaatctaccagcaacatcgattgccttatacacactgggtatacatccgcaaaatgttaaatgcaagtatgccgagcaacctgttttcctagaatcccaaccaagcagaggctcctgcgtcttcttcaccaatgaacacatctccgtagacgaacccgcccaaggggcaccgancaacggaccgaccagtataccagtggttggtccacaccccaaggncaacgcgggacaaaggactaaccgggttatggccaccgagaantaccccgggaatgggttggacgacataagcgtgacatcgacgttccggcacgtgccaaggtcatatgccctaacacaaaggaggaaaggagtgcccagccacctgatggccanccn

SEQ ID NO: 23501 - DNA, 708 bp, Triticum aestivum
  unsure (1)..(708): unsure at all n locations
  Clone ID: PAT_TA_23501
agccgagccagaggaggcgaggaacacatgctccctttcctccccgctgaagagtagctgcagttgttgccaagacggccacggaagcggaagcgcaggccagcgcacccccagccggaccattctcgccgagccctcgccctcccccggccgcggcggcggcgcccctcctccgcgccctcgcctccggggatcgcgggattgggcggcgatggacacctctactagggcggccaagatcccctccctcccccaacagacggagatcaactgggacaacctcgacatgaccaagctctatgtggtgggggccggcatgttcagctgcgtgaccgtggcgctctacccggtgtccgtgatcaagacccggatgcaggttgcctccggggaggccttgaggaggaacgccctggccaccttcaagaacatcctcaaggtggatggggtgcctgggctctaccgagggtttgggaccgtcatcaccggggctatcccggctaggattatcttcctcacggcgctcgagaagacaaaggcgacttcgctcaagcttgttgagccacttcagctgtcagagtcgatggaggctgcccttgctaatggcctcggtggtttgacggcgtctctgtgctcgcaggctgtctttgtgcccattgatgtggttagccagnnnttgatggttcaaggatattctggtcatgtcagata

SEQ ID NO: 23502 - DNA, 1991 bp, Triticum aestivum
  Clone ID: PAT_TA_23502
cccacgcgtccgcccacgcgtccggatcgatatccgctcgagcttccgtgcgggagtgttcctcggccagtatacagagaggcatcgcacactctgacacatactgctgactcctgggcccaccggtgggtccatcgtcatcgtctgccggagatgctcagtcgattggccgcacggcggccccgcccaggcagcacccgggccgctgcctaccgctcctcggcggcagcctcctcctcggtcctgcccgacgcgctcgaccggagctccgacgcctacgcccgcaacgccgccggcgtcggcggccttctctccgacctgcgctcccgcgtctcccaggtgctgggcggcggaggcgcgggggcggtgaagcggaacgaggggcggggggagctgctcgccaggccccgcatcgatcgactgctcccttcagaggcctacttcctccgaggctctcagcaaggaaggaagcccgtattacaggaagcattaccctctgggggaataggtactggcatcccgcgggttcatggacggttataagtgtttgcctctctgctcccgccaacccggttgggtacatactaaaatatcgcgtgtttcgaatgttgctattatgtaaatcatgtatagtacgtaaattgccctgcatatatcttagttgacagtggaggcgctaatctccccaagcaggcagaagttttccccgaccgtgataattttggtcgaatattctacaatcaggctaagatgtctgcagatggtattcctcagattgcagtagttttaggttcttgtactgctggcggggcttatattcctgcaatggctgatgaaagtataatagttaagggaaatggaacaatatttctagctggtccaccccttgtaaaggctgctacaggggaggagatatctgctgaggaccttggtggagcatcagtgcattgtaaagtatcaggagtctctgatcattttgcacaagatgaacgccatggtcttgcgctgggaaggaacattgtgaagaacctccatttggccgctaaagaaacaagtatacacaattctgcttgtgattaccaagaaccattgtatgatgtacaggaacttcgctcaattgcaccagctgatacgaagcaatcttttgatattcgctcaataatagctcgtatagtcgatggaagtgaatttgatgaattcaaaaaattgtacggaacaacactagtgactggttttgcaaggatatgcgggcagccagttggaattattggaaacaatggcattttatttaccgagtcgtcactaatgctcctaagctaaagcatcaagcctacccaacgcaatattcctctgatattcattcaaaatactttcgcctgtatggttgggtcgaaatctgaagcaagtggaattgcgaaagctggagcaaaaatggttatggcagtttcctgttcaaaggttcctaaaattaccataattgtcggtggaagttttggtgctgggaattatggaatgtgtggacgtgcatacagcccgaattttttgttcatgtggccaactgctaggatatctgttatgggtggcattcaggcagctggtgttctcgcccaaatagagaagaacaacaggaaaaggcaaggagtggagtggaccaaagatgatgaagaagccttcaaagccaaagtcgtcgaggcatatgacaaggaaggaagcccgtattactcgaccgctaggctttgggacgacgggatcatagatcccgcggataccagacgggttctaagcctttgcctctctgcttcggccaagccggttccagaagacacgaaatatggcgtgtttcgaatgtaattattatgtaaatcatgtatagtacacatgtcacagacctgtaaaataaaacctgctttactgcttccaataaattgaaatgaggtgcttattcaaaaaaaagggggggaacaaaaaatgttccctagtgccgtcatttt

SEQ ID NO: 23503 - DNA, 878 bp, Triticum aestivum
  Clone ID: PAT_TA_23503
ggcaaaaaacacccccagccctccgccgagggcaagatctcgccggggcgcggcgccgacgtcgccaaccccagcccacgaggcctcatcccccgtcgagcacccatgcgtcacgctgtgggaatggtggccggtgagggtggaaggggaggagcggaaactcgcggtttccggcttcactgaaaggaatgacgcattcacttctgcacccatagcacatcgttatgagcctctcacgctccaggatgaaggtggggttgtggtgctccttcatggttcaattagcttgttgcgaatgcgtcaaaatggattttctgtgcagatatgcgaacaattcatgattggatttccgtcctggtgggagacttgggattcgcacatggagtcttacccaaactgttttattgatccacgagagggttcagctcagttttacctggagaaattccagctaggcaattttattcaaaagtttggaccctcgttcatcgaggaccttcttaataatgctaaaaatttcccaatcgaccatctcgatgcattcacagagagttcaagattccaggaacacaactgtggaaatgatgcttcaaccaacgaaaattctgctgcttcagatgatgccagacccgcaactgtagctaatgtggaaataggcttgactacgagcagcacttcacaagaaagagatcatgtggacattgagtgtaatgtatctcttgctcctgcagaaacatatactggtgatgaaacttgcaaagaggcaggaaatcagaatgacactacgcatccagatgcaagggaagacaatgctggtagccatcttttcaactccgattggacttgcactatgtgccctgatcatatgcccaatgact

SEQ ID NO: 23504 - DNA, 443 bp, Triticum aestivum
  unsure (1)..(443): unsure at all n locations
  Clone ID: PAT_TA_23504
gctgagtccgttcgtcatcagcaacaagaacagggagctgctcgtcctcgacaactgcagcaagcaggtgacgccgccgggatttaaccgcacgcgtggtgagacggcgcgcccccggcccagatccgggcacgtcggcccccatctgggcccctgggggccggccccccggcatggtctcgttgtctgcggcgcgagaaangaaggatgagcggnctcggacttgtgggcgtcggcgccgaatggcgttcctggcagcagcgcctaaggtcgggagctttacggtgcccacgagggcccggcncgggctgtgggcctacgggctgcgtgcgccccctcttccgtcccggcccggcttcccnacgtggangttngggcctccgcnnccnatggtgctatccctatcccggtctgatcttctctgctttctnacttcnnggtcc

SEQ ID NO: 23505 - DNA, 681 bp, Triticum aestivum
  unsure (1)..(681): unsure at all n locations
  Clone ID: PAT_TA_23505
cgagatagattctggtctggtccagtgtgtgtaagcttctcccttcttctgatcgtgtgtgtgttagagagcttgggtggttgcacgtacgaggtacgtgcgtgtcgatcgggtggtcgatcatggcgatggcgcaggggcaggggcagggggcggcgacgtcgctgccgccggggttccggttccacccgacggacgaggagctcatcctgcactaccttcgcaaccgcgccgccgccgcgccgtgcccggtctccatcatcgccgacgtagacatctacaagttcgatccgtgggacctcccttcccaggcggtgtacggcgactgcgagtgggtactccttcagccccgcgggattcgcaattaccccaacggcatcccgccccaaccgcgccgccggtcccggtactgggaaggcaaccggaccggacaagcccatccacaccccgccaccggcaaggcgtcggcgttcaagaaggctcncttcntanaaaggcgccccccaaaggcacaagatgctggttaatcacatacggtcccgcgaccctcacacgcgtcaaaactacaaccannattcgcaactctcaanaggtaatatgnaaggtacacactccatgaagaaagnggaaaaccaagtaacnttttttgactaatatnnagtgtaacttgtgcccntttng

SEQ ID NO: 23506 - DNA, 645 bp, Triticum aestivum
  unsure (1)..(645): unsure at all n locations
  Clone ID: PAT_TA_23506
tagatcacaacaacaccaccaccagcagcagcaccagcacgcacgtagaactagcgacatggccgacgaggagggttgcatgtacgcggtgcagctggcgttgtcgtcggtgctgccgatgacgctcaaagccgccatcgagctgggcctgctggagaccctggtgggtgccggcgaggggacgctgagtccggaggaggtggccgcaaagctgccggccaaggccaacccggaggcggcggccatggtagaccgcatgctgcgggttgctaagcctcccacgagatcgtgtcctgcgtgggtagaggagggcaaggacggcacctctccccgtcgctatggcgccgcgccggtgtgcaagtgggtcaaccccaacgaggaaggcgtctccatggccccctggggcatcatcgcccaagacaaattttcaatggacacttggtgctacttttaagatcctcctttaagggtggaaccccttcaaaaagcctccggattcatgttccctaacccggaccaattgcttcaaaactctaaacaggcatgaacacatccggatatacaagantcgccgcgtcttgctcggcgtcgtcgctcgctcgatgactngcggngganggacacatcagcatactcaattccngn

SEQ ID NO: 23507 - DNA, 839 bp, Triticum aestivum
  Clone ID: PAT_TA_23507
ctggcgcgtacactgccccccccctcgtttcgagtccgctcttcctccccgccccgccctgccgtccgaggagaggagaggagaggagaccaaggtagggagatttgccgttttttttcttcacgagggagccgctgccgctgcgaggaaacaaaacaatcccgtgaggcaaggacggttgtgaagcaaagtgatcaaatggcagccgagtcctctgttccacaaacttcctctgaatcggctgctcacaagatgggcttcttcagagtccctgatcttcttgtcaaactgagcaccaaatgtttgattgagttggatgctgtccgcagcccaacatcccccttagacctgaaattgttcacaggccttgctaccaaatcacccagatcgtctttccttgatgccggcgcagccagccagaaccaaaagatcttgcttggggacagggttggccttggactggtggattctctcagtgatgaaaacaaccccacacccttgggcagcaggaaggttctcggatctgagatgaggattactgaagatattgacacccaaaaggaaattgcagtgatcaaatggcagccgagtcctctgttccacaaacttcctcggaagtcggctgctcctacaagatgggctgcttcagagtctctgatcttctgtcaaactgagcacaaatgtttgattgacttggatgccgtccgcagcctaacttctccctttagacctgaaattgttcagaggcaagccgagcaactgatccctgatcgtctttccttgatgccggcgcagcccctcatctgaatggggataccatgagcttctgttgtttttgc

SEQ ID NO: 23508 - DNA, 723 bp, Triticum aestivum
  unsure (1)..(723): unsure at all n locations
  Clone ID: PAT_TA_23508
tttttttttttttttttgagtaaactggcgttgttatcattactcgatttggcgatctataacagattcttgcacaaacacacagcttggcgtacgtatacatatgctgatctttaccaaccttttgtaatctacagaatatcagttgtgcactggttattatctaaaagtacagttgcacactggttagattcatgcgcatgcacgcatcatgcacgggatgctatatgcaatgcatgcatgcttgcatgcaagtgaagtgatggatggaaccaccggaaaaaaaggattcaatcccttgtcatggatcgaacaggaaaaaatcgtcatttccgatgctgcccagagagcccaccacgaacccgaggctgctcggcgacgacgggaaactgcccgtgccgccaccctggccgcctcccgccatgtcgccgatcccactcccgctgtggtccggcaccgaccccaccgtccaggacgtcctccccggccgattccacgacgggcggcgagctcctgcccctggcacgaacgggccggacgaggagctgaacactcgtcaacgctgggtgcacaagaggagacactgattatggccggccaactgangaaactcngggaaacnacaagtttctcccgtctcctccaacggaatgtaatgggtatngaggagcttcaagtgtcnccntatactnactcactnattgtggccccaatttgntnccc

SEQ ID NO: 23509 - DNA, 864 bp, Triticum aestivum
  unsure (1)..(864): unsure at all n locations
  Clone ID: PAT_TA_23509
tncctgctnaacnggnagtgccagctcgcgtcagctgccccttatccgggaccccacgtccccaacgcagctttatttccccacaggaggggttctagctgtgtatttgcacagcagcaactgggtacatcttgaagcatggctcttgggacgatgtcttctacttgtctccacctcgtgtacttcctatctgcacaagaactagtttcttttcaaccggccagaaatggatcgattgatatgtatagggcgttgctgggtagcggctagatcgagcgggtggcggcaagtacgcgtgagcaattcaattgcttgttcctacgtggtttcgatgacattcttggatgtgacacaagtcatccaggaggacctgagggaatgacagcctgggaaggacttggcgaagtgactaagacgacataccctgaagttactcatgggttggagaagtcaacgggaatttgcgggagaagttgctttctttgatgcaaaggtagcaacttgctgcttttgataaagagaaggcagcaccgctattgtacttggccaattatattgcctatcggcagaactaaggtgatggttattctgttgtttgttgttgatctgtaactttgtaagaccatcaagtctgggatttgaggaatatctgaattcttcccctcatatatactagtttagttttctaaaaatgtgcaatgagaatattcaggtgacaaaagccacatgagttaggtggcaaataccaatgtcccattgagatagccaagacattataatgggaatcagcctttatgtcttatactgtctggatgataataaatcaattgatttcgaaagaaaaaaaaaaaaaaaaaaaaaaaa

SEQ ID NO: 23510 - DNA, 646 bp, Triticum aestivum
  unsure (1)..(646): unsure at all n locations
  Clone ID: PAT_TA_23510
gccggcggccgccccggcccggcttgtctcgagttttttttttttgttttttttttctttttttttttttttttttttttagatgataataatgattgatgatccatatatgtttgggctactagtttcggccatccaaaaataaacgagcatattggccaaagtactactactgttacagtttacagtattactagtacatcactagccgcgatcgaactagcccaggaggagtacatggaacctcggccgcccccccgcggcgccgggccggcggatcaagaaggacggcacgacgccgtagccaaagtcgagcaagtagtgacgtggaagacggcacggcatgggcctccgcgtccacgtcgtcgccgtcggcgtcctggtcggtgcgcttgggcgaagcgggccttgacgcgcggccgcnactcngcgtangccttcctggacgccgtcgcggggcggcgcctcccgcgtcggccgcgctccccccccgctcccccgcgcaacctgcctcccggtcacgccacggagcccggnacatcaatacccatgtcaacggcaactgctcaatcaccctgctcggggccccgttagcggcattacctgcgnttggcggtaatcattcaggggccgtacattcccaatt

SEQ ID NO: 23511 - DNA, 567 bp, Triticum aestivum
  unsure (1)..(567): unsure at all n locations
  Clone ID: PAT_TA_23511
cagatagagatatcactaagattccaagaacccactcttcttcaacactaacctcaatccagaggcagacacgcctaacgcaacccatcttggggagctactagcagcagcaccaacctaactagatcaccgctgaccgaacaagaaacacaaagaagtccaccagatcaacggtctttcctcataacgccagtacaatgtttcggtaacagtggggctaccgatgaatttcctctcgagttacgaacgcaggaggttgcctcatcctattccaccgtcaaggattacacccaggccccatctaacattatttcctgccgccggctactcatcatcatccggtttttccacctcttcaatccccgtactccggaaccaggagcctctatatccgccaatggatcccgtcactggtatcatcatcctcatccccggaaggtcctcgagaccttctgggtgggcgcggtctccggcttcgggtcatcccggtctcgaggctcgcgactacatcctactatccctccacatgggcaaccgccactgccccccggttngnccacccncctg

SEQ ID NO: 23512 - DNA, 1053 bp, Triticum aestivum
  unsure (1)..(1053): unsure at all n locations
  Clone ID: PAT_TA_23512
tttcattccccnccngacttgctgattattacccaaagcagattccctttgagatcgcttccccacccaggaatgcaaggacctttcctcttctccaggaattgtacctaattgatgcttggncaacctccagtcacttcccatatctgccctcctcccttgaaggccctcagactttccaggatgccatccggacctgaagaagaagattacccaaacatggaagccccgaatggaacaagattgctcacatcccttatgcggaaataggagattcgcttttcatcagtggcaagaagaaacacaaaaggccttcaccaaactaagtgatagtgaccgcaacagacttatgtccaagtaaccgctgcactagtggaagaaacggttctgtctcaagaatgcttcgtatccccagcctgttgttgttcaacagaatgctgacacgaagctacagtgccatctgatgaaaggtcttccagactcttaatttacttcaattcaactccttgttcatcagatgccaatgttctgccggatgacactttctgaattgaagaatccgagggaacgaagaattcatgttcagctcaattcagttgtcaggttacaagttaggattcggagttgtaatatgaacagggtaaagtctgtgctgcttatttctgcaaatgtcttcagttcagtacagataccgcctcgtgagagattgttggaggcatcaattgctgaatgaatgatccgcgaacacatttcaatcagtacatgcaaacttgcgtgctgcaacaactcttcaaattaatctggattaantgggtgattgatgatgatnaagtactancaagtancctactgagacagatacccgttggtgatgtcaacnntgtacttgtcatggctgatgntcncnaaatgcagcatatgatgatgttccaagtgacgacaatnaatgtggtcagggcgcacnaatatcngtctgaancctgaatatcatgtgaagtaacagggnaaaaagggggncgtancaatcnccaaaggatcttacccccacgggtc

SEQ ID NO: 23513 - DNA, 629 bp, Triticum aestivum
  unsure (1)..(629): unsure at all n locations
  Clone ID: PAT_TA_23513
gcaatctgctctggttcaatcccaagagaaggagagaggtggtgcagatatggcgcagtggaacggcatggagcaggcagcgaccatcgcgcagctggtgggagtggatgcgttggggctcatctcgacgattgtacaggcagcacagacagttcagcgcaacaaggagacctgccaggagcttgtgcaggatgtgcagttgataaatggcctgctacggatgctgcaaaacccagagatgatgcagcgagaagagattgtaaacgcactcaatggactggaggggacgctccgggaggcgtacagcctcgtcagctcctgccaagactgcagcaccacatatcgcatattcatgggatggnaacacactgaccagttccgacgtgtgaagaagaagattgccaagcactccgcttctacctatgatctccatgctgacataactgtcgtcccaaaaaataacatggncctgtcacnnccatccagtanatcagttgtctcacngtaanacacangntttcaatgtncaaggttcacttanctatccggaanaatanaccccgaaangtctttntaagtaacttanttctnccgctntaagganccaaaattcacggcaatttnaacng

SEQ ID NO: 23514 - DNA, 1044 bp, Triticum aestivum
  unsure (1)..(1044): unsure at all n locations
  Clone ID: PAT_TA_23514
ngccggccgggcttcaactccttccccacctcaagttcttgcaagccctaattttccaacgcaccttctcggcaaacttctctaaatcgatctatcgcgacacggacggtgacaggtcgaggctgatattttcccaaaacactcgtcgacacacttcgcacaccacttcgaagctattcaagatgtcgtcgggcaaggtcaaggctggagagctctggaataagtccaaggatgatttgacaaagcagctcgctgagctcaagactgagcttggtcagctccgcattcagaaggtcgcttcttccggctccaagctgaacagaatccacgacatccgcaagtcgatcgctcgtgtcctgaccgtcatcaacgccaagcaaagggcccagctccgtctgttctacaagaacaagaagtacgctcccctcgatctccgagccaagcagacccgtgctatccgccgccgcctatcacccgatgagaagtcccgcgtgctcgagaagaccaagaagcgcactgtccacttccctcagcgcaagttcgccatcaaggcttaagttaaaaatgctggtagttcttggcgtgtgacggacactgggtagaagggaaacggggtatggagggcgtcgcgtgctttttctttgaaaaaacttcgaaatctgcatcgcatggctcagggaatctcggtctgacttgtacttatttcccggtttgggcctcgatctgggacgggatatgtccacaatgggctgcccgtaggcagtcttaaaaaacaaaaatgaggtcatgatcaacaagtccttgtaagattgagacacgcgagagcagtgatcgtgatgttttgtgtccatattatggcttgctatcgagttgtacagcattcccggatgtactttcggaatgaacaactgccaacaagctttggtgccttacgaacctgtaattgacaaggcataaacttgtaattgccagggccatgagaaaaaaaaaaaaaaaaaaaaaaaaaaaaaaaaaaaataaaaaaaaaaaaaaaaagggccccta

SEQ ID NO: 23515 - DNA, 1023 bp, Triticum aestivum
  Clone ID: PAT_TA_23515
gccggcccggttccgggaaaaaaaaaaaaaaaaaatgattgattgatgcgtctgtacaaaaaaaaaaaaaaacgcggcgccggccgggccgggaaaatcgatctatcgcgacacggacggtgacaggtcgaggctgatattttcccaaaacactcgtcgacacacttcgcacaccacttcgaagctattcaagatgtcgtcgggcaaggtcaaggctggagagctctggaataagtccaaggatgatttgacaaagcagctcgctgagctcaagactgagcttggtcagctccgcattcagaaggtcgcttcttccggctccaagctgaacagaatccacgacatccgcaagtcgatcgctcgtgtcctgaccgtcatcaacgccaagcaaagggcccagctccgtctgttctacaagaacaagaagtacgctcccctcgatctccgagccaagcagacccgtgctatccgccgccgcctatcacccgatgagaagtcccgcgtgctcgagaagaccaagaagcgcactgtccacttccctcagcgcaagttcgccatcaaggcttaagttaaaaatgctggtagttcttggcgtgtgacggacactgggtagaagggaaacggggtatggagggcgtcgcgtgctttttctttgaaaaaacttcgaaatctgcatcgcatggctcagggaatctcggtctgacttgtacttatttcccggtttgggcctcgatctgggacgggatatgtccacaatgggctgcccgtaggcagtcttaaaaaacaaaaatgaggtcatgatcaaaaaaaaaaaaaaaaactgagcaaaaaaaaaaaaaaaaatgttggggggtataatttttatcactattctttttcctatccatcccatgttggatatactgtatctactgaaatgtatcgacatggcactgccacaactgccgcgttgtgtttggatgcaaagccacatgatattacaagcttggttggttgtaaaaaaaaaaaaaaaaaaggccccta

SEQ ID NO: 23516 - DNA, 1710 bp, Triticum aestivum
  unsure (1)..(1710): unsure at all n locations
  Clone ID: PAT_TA_23516
ctgagacaaacacatcatcattaaatttcacgatctatgtgatcgatctgatcaaacaaaaattaagtgtgatgcacagattactaaggtttttcgagctcagacaaaagaatagcaccgtttttttttttgatagttttggcaccagttacaacggacgttttgcacttccataccacagcagtcacaggtatggcttactctattaccaactgtagctcgcaaaactaggataagtacttaaaagctaacctgccacgcaaacagcttacaaatacggaaacagaatcaagagcaacacacaataaaaccgaccgacactgaatttgcaagtctgcagccaagttaacactcacgacccgaccaggatttacaacatggatgatctgaattcactaatactcccacttcttgagctccattccatcaggagggcttccttcaaccgtctttttcccgacatccttccagttggttgagagaacggttccattagactccacaaaagacttcatcattgctctacgcatatcttcatcagcatcactgtaaatttcacggaaaaatttgttcaatgcagcatcgccatcaagtttttcatccttctcctgttttttcacttcagcttcaagcttatcccagtcctttttggattttgatgatggataagatggcctctgggctgattcagctggtacatttatcttctgaggagcctttggtttaccagtataatccaatgatgtccaagttactggctcagcttttgcaaggcgcatttcaacctttgtagacaacacagtatacttgcacttatctgggacgatctttgaaaacagacgaggctgaaaatggtatggttcctcaccgggaagttcaattgagacactcagcatctgttcaccaaagtcaacaaccacgctgtcagctggaacacccttagcaaatatagtcagtaccacttctgtaggagtattgtagtagtcatgcctgtatttgggcttgcttggcacttctatcgttggctgtgcattctccatatttgcaccatcctggtcctcagcttcagtagccacagttgtagccccggaagatgcccccgaagatgtagctgaagcaacagccgcagcggcattctttactggcacctggctagcctcctcagcaatacgatcatcacactccttcatcagacgagtaaacctcgagtcaccagatgcataagaagaacccacttcaagagcagcctttgcagtttggtattcctccagcttgatgcaagcagagcccttccgaaggtatgctttatgcatcgaaggatcaagttcaattgctttgttggcatcagctacagcctcagtgtaactgcccagcttgatgtgcgcctgggctcggtcggcgtagagttccgcggtggccggccccgcctcgatggcctgggtgtagagctcggcggccagctcgaagtcgtcgtcgacgaaggcctccttggccttgctctccagatccgacgcggcggcggcggcccatgtctgcgtcgaggtggagaagaccagacgaagactttgggagaggtgaatagagatcgacggtatttggtggggaggggatggatggatccaaccccaggtcgtgccccctttagtgagggttaatttcgagcgggaggatcagaacgagctggcgnatcanaannnnnnnnnnnnncnc

SEQ ID NO: 23517 - DNA, 593 bp, Triticum aestivum
  unsure (1)..(593): unsure at all n locations
  Clone ID: PAT_TA_23517
cccacgcgtccgctgatggagcggctgcatacacaaaagcacttggtcttgagcttgatcttacggagaaaggattgggtcttcgttcgaggcggtttgctctccttgctgacgacctcaaggtcaccgtcgcaaacgtcgaggaaggtggccagttcacaatctctggtgccgaggagatcctcaaggcactgtaggggcttcagcgcttcggaatcgcagcgatcacccaaaccttgtgtcatatcgatgtagtttgaacttgtctgccaaactgctagtgggaataaattgtcgatgtgcatttcttcatgtactttatgtgcggtgcaagtgacttaaagttttccagtcattgtggtgcgttgcaaacattctgaattggtgaaagaaaatggtgtgggtggatttgtgtgaatcgtcattaccttgtgaaatccnnnaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccctttaaagagatccaaatttacttacccgggctgggcaaaggaaaaaatttttt

SEQ ID NO: 23518 - DNA, 851 bp, Triticum aestivum
  Clone ID: PAT_TA_23518
gccggccgggccttgacattgttttctatatatcccttttcgaccccctccctgtcgtctgccttccgttctagacccctccttctcccctccccaaaccagaccaagcaagagcaaccatggctccgattggcgtgggcagcaccctccccgacggccagctcgcgtggttcgacgagaacgaccagatgcagcaggtctccatccactcgttggccgccggcaagaaggtcatcctcttcggcgtccccggtgccttcacccccacctgcagcaatcagcatgtaccaggcttcattactcaggccgaggagctcaaagccaagggtgtagatgagatcctgcttgtcagcgttaatgacccctttgtcatgaaagcatgggcgaagacatacccagataacaagcatgtgaagttccttgctgatggagcggctgcatacacaaaagcacttggtcttgagcttgatcttacggagaaaggattgggtcttcgttcgaggcggtttgctctccttgctgacgacctcaaggtcaccgtcgcaaacgtcgaggaaggtggccagttcacaatctctggtgccgaggagatcctcaaggcactgtaggggcttcagcgcttcggaatcgcagcgatcacccaaaccttgtgtcatatcgatgtagtttgaacttgtctgccaaactgctagtgggaataaattgtcgatgtgcatttcttcatgtactttatgtgcggtgcaagtgacttaagagttttccagtcattgttggttgcgttgcaaacattctgagattgttgaaggaaaatggtgtgggtggtatttgtgtgaaaaaaaaaaaaggcccta

SEQ ID NO: 23519 - DNA, 1217 bp, Triticum aestivum
  unsure (1)..(1217): unsure at all n locations
  Clone ID: PAT_TA_23519
gcccgaccgaccgctagcaagcctccccaaggcattcaaaaccccgtttgcctcggccccctcgctgtctcctgcccttccttctagaactccctccttctcccctccccaaacccagcagcaagcaagcgcaagcatggccctgatcggcgtccccagcccgtccccagacggccaggctcgcctggttcgaccagagggaacagatctcccagcgtccccagcccgcccgtggccaggccggccagaagggcatcctcttcggcgtcccccgccgcctgcacgccctcactgaagtcaatcaggcatgtatcctcgctgcattactcacggacgagcaggtctaaagccaagggtgcagatgatctcctgtttgtcaagcgttaatgacccctttgtcggtgaaagcatgagcgaccgacatacccagagtacaaggccctgtgaagttcgtagctgatggacgcagcaagcaaacacaaatgcactggattcttaagggcttgatctttagggagaaagtacttgggtctccattccagggcggctttgctcctccttcgctgacgaccacaaggtcaccgtcgcaaacgtcgaaggaagggttgccatgttcacaatcgactggctgccgaggaagatcctcaaagggcactggtaaggtagcttcagcgcttctcgaatcgcacgcgatcaccctgaccttgtgtcatatcgatgtagtttgaaccttgtcttggccaaactgcgtgggaaataaattcgtcgatgtgcatttcttcatgtactttatgtgtggtgcaagtgactaaagaatttttccatgtccaattgttggttgtgttgcaaacattgtagcaagttacttaagagttttccggtcaattggttgatcatttcctaaacatactgagattgtttaaggaaaatggtgtgggtggtatttgtgtgaaaaaacattaccttgtgaaatcaaaacgcacctcgaccgcgcccaccttaaaccacggggcgtactcactacccggccctgccnancggcctttccaaaantngncaanctnnatgggnaaaggcaaatntaaccntnaaaatttgnnaaaannnngnnaaantttgnnaaannncncantttttaaccaannggccnaaanggnaaaacccttttaatnaaanaannncccnnaaagggnnnnngtnnnccnnttnnaanaaaa

SEQ ID NO: 23520 - DNA, 948 bp, Triticum aestivum
  Clone ID: PAT_TA_23520
gcacgaggcgtgggccggtgaaccctgagcgcgcggcggctccacccaccgatcacaggaaccactgtatacccggataacaaaaggttgttccagtagcagagatggttcatcatatatctgacgaggcagcagatgaacctagcatcaccacacagacaccctccaatgacccatctcaagcaccgctggtgtacaaagtgggctatccccctcccaagaacttggccacagaatttacagaaacattgagagagactttcttccacgacaacccgctgcgtcagtacaagggccaatccggaccgaggaggtcatgatggggctggagttcttgtttcccaatatttgggtggggtagggattacagtctcaacaagttcaaaggcgatctgattgccggattgaccatcgcaagcctctgcatcctcacggacattggctattcgaagcttgctaatttggatccgcagtatgggctttactccagcttcattcccccattgatctatgctgcaatgggtagctcaagggatatagcgattggcccggttgccgtggtttctcttttgataggttcacttctacaagctgaggttgaccatgtcaaaaacaaggaggaatacatgcgcctcgctttcacggcaaccctcttcgctggcatcactcaagcagccttaggatttctaaggttagggttccttatagagttcttgtcacatgctgcaattgtcggattcatggggggagctgccattactattgccctgcagcagctgaaatacgtgttgggtatcgcaaactttacaaggaaaaccgacatagtttctgttatggaatctgtctggagatcagttcatcacgggtggaactggcagacaattgtgattggcgtatctttcctggttttccttctgtttgcgaagtacctcggccgcgaccacgcta

SEQ ID NO: 23521 - DNA, 1039 bp, Triticum aestivum
  unsure (1)..(1039): unsure at all n locations
  Clone ID: PAT_TA_23521
cctctttctccttcccctcgatccccatgagccgccgcgcccctccctcgatccccagttccccacgatcctctcctagcccgcagccaccggccttgtctctccactcgcctcctcctttcctctaccatgtcgttgtcgatcccaccgccggccttctcctctgcttgcctcctccagtcctcttccatgtcaccgtcgatccagatcggaccctctccttgcgcgccccgtgttcccccttccagccgattgggcacagccgcaccaaccctagcccccgatgcagccatccactcctccctcctccccctccccctcccacagccatcgcacccatcacttggccccctggcgacgcccgggtcgggcctgggaagaaggtccgggcctgcgagggaaagcagcgagggttggtgcaacggcaaatgcaggcgggatctgccgtggagggaggctcgtcagccggaacaacaggagcaaggaggtcgtgcaggcgcaaatgctggcggggtcggccatggaagaaggctcgctggacggagcatcaagaccagggaaagtcgagggtggttcaggtttgccttctatctcctccccactctatctttgccctctctcttattttcccctttgtcttgtggataagggcgtcagtgcaccacgaggagtagagcgagcgtggaacatagcagcaggatcaaggagctgctggtggttctggcaacaaggaggatgatcaagaaggattggggaacaccagcaaaaaaatactggggaanacgggcgggacgaaggcatggagatcttgtttggcgccaactncctttggtgttaatgctggctggctactgcgtgtgctaccgcgataaatcaagangaagttgcngcgacaagaaacaagaccttttgctgcatccctgtcntttggaaagngaaatttcattngagggaaaanccctnaaacatcaagaatttatcaattgaaaccttaattcttaanaaattaatgggaaaancaaattttggtaaggttggc

SEQ ID NO: 23522 - DNA, 676 bp, Triticum aestivum
  unsure (1)..(676): unsure at all n locations
  Clone ID: PAT_TA_23522
aacacagcacgagccgaaaatgtggcagtccaagccagtcctggtcctcctcctgctcgccgtctccacggcggcgaccgtcggcaagccgctgctcacgaaggtcaccaagggcgtaacgtccaccgcgctctacacggcgccgctcagcgccggccgcccgctggtcctcgacctctccgctccggccatcacgacgccgtgcagcggccagacgacgaccgtgacagtctccgccaactctaccgacggcagcaacccgatatccccgggctccttcgctgccaccgcgacatgcgcggcggccccgtccggcgccgtcggcgtggcggggctcgcacgctccagcgcatcgttcccggccaggtagcgagcacgcagaaggtggcaactcgttcgcgctctgcctcccgagcaacggcgtgggcgcggcatcttcgcggcggtcaattttcctaactcccccggcggacggcggcataacacgctctctccgacgggtccgctcgcaacctctccgggaaccggtactcttaacaccaaggatccatcacggacccctgccgcccggtcgggggtatgtggctccaaaaatcctaggnaatccacacttacgcctnacagcttacgcctggncccgcgaggcttgcctnattgaaacnaattccanttggnc

SEQ ID NO: 23523 - DNA, 1324 bp, Triticum aestivum
  Clone ID: PAT_TA_23523
gcccacagagcaagccgataagttggtgagggcctctccctatactggcttcgtctggatagagtacagggcatttttgttagaccttgcggatgtcgcgaaagcacgttccagtagctgaaagggctttgagaactttaatcgtccgagaggaggaggagaaactcaatgtatgggttcgaagggctttgagaacaatgaactgcagagaggtgcagcagaaactcaaggtatgggtagcatacttcaacctgcaaaatgaatacgggggtcgacgggaggatgctgtcaagaagatattccaaagagccttgcagtattgtgatcccaaaaaggtgcacttggctcttcttggaatgtacgagaggactaaacagaatgaactggcagatgaactttttgatagaatgaccaaaagattcaaaacttcgtgcaagatctggttgcgccgcattcagttttctctcactcaaggcaaggatgttgaatacatcaaatctgtcgtaaaccgtgcgcttcttagtctaccacaaagcaagcgtataaagtttctaacgcagactgctatcctggagttcaagtgtggggtggctgaggaagggagatccagatttgagctgatcctaagggagtatccgaaaagaacagatatttggagcgtttacctagaccaggaaattcgacttggtgacacgcgaaataatacgggcattgtttgatagggtgacatgccttagtcttcctccaagaaagatgaagttcttgttcaagaaatacctgcgatatgagaaggctcagggcgatgaagaaagaatcaagcatgtgaagcagaaggcaatggagttcgttgagatttgtagagcctgatgtgcaaaaccttgctacacatgcaggaggcactgctcctgctcctgctcctgcaacgcgcaggaggcgtctgcttgctggggtaaactattcatgtgatcttgtcaggtgatcagcaggcggggggtcattcaacttcttgaaatgctgctaatcagaggtctgcgttctttcttatttgtgcgatgtgattgtggcagagaatgtgccagtcagggctgcagcttttacgcagacgtgcagtccgccaattttggtgttgttacacttgtgatatatgtattgctattaataggaaagatagatcattcgattttgtggcaaacacctcgctcactattcgagttgtttaggttttgttttcaatttgtaaacactcatcgttagagattgtgagtgcagactgagaagttccttggctacaaatgtgtagtgcttgggcattgttgacgttcaa

SEQ ID NO: 23524 - DNA, 1026 bp, Triticum aestivum
  unsure (1)..(1026): unsure at all n locations
  Clone ID: PAT_TA_23524
cccagcgtccggnagctccaccgtcccctgtttccaccccctcccctgtcccattcgacaaaacacgccaagcacgcgcaccgaatccatcgccgagcaagcgaagcagacaccacctgtccagaccgccgcccaccgtctcccaggagctcagaggcgccaccaagaaccgcacggaagcagccggagcaagcggcacgtgagaggatcgatggcgatggccggcggagccccgccggcgccgctgccggtggtggggcaccagttctgcgcgccctacgtggtgccgctcacggtgaccaagaaggccctcagcctctccgacggcgacttcgccatcacggacgccaacggcgccgtcgtgctcaaggtcaagggcgccatcttcagcatccggagccgccgcaccatcctcgacggcgccgggctgcccctcctcaccatgcaggaaaaggtgttcagcatgcaccaccgatgggaggtgttcagagggtacagcaccaactcaggcgacctgctcttcaccgtgaagacaacttcgctgatccaactcaagacggagatggatgtcttcttggccgggaacaccgcgcagcaggtctgcgacttcaagatcaagggcagctacttcgacaggtcctgcgtcttctaccttggcgactccaacaacatggtagctcaaatgagccgtaagctgactgtttccaatgtgctgctggggagggacacgttcagtgtgaccgtgttcccgcacgtcgactacgtgttcatcgcgagccttgttgtgatcctggatgaggttcacagggacaagcgcgaagattgatgagtgagttatatacactcctggatcctgagcgttcctggagttctactactgtggtgtcatttcaagttgatgtgttgtcacttgtcactgatgttatctgcatttcttgtagcatggtgaaccatgctgaattgtgatgttgtgcaataatgtttatgcagcttacatttgtatttaccgcagtgattgattgttta

SEQ ID NO: 23525 - DNA, 1124 bp, Triticum aestivum
  Clone ID: PAT_TA_23525
ttgttgtgccaccgcaggcgccctgcgcgggagggagctccaccgtcccctgtttcacaccccctcccctgtcccagtcgacaaaacacgccaagcacgcgcaccgaatccatcgcccgagcaagcgaagcagacgccacctgccctgcccagaccgccgcccaccgtctcccaggagctcagaggcgccaccaagaaccgcacggaagagagcggatcgatggcgatggccggcggagccccgccggcgccgctgccggtggtggggcaccagttctgcgcgccctacgtggtgccgctgacggtgaccaagaaggcgctcagcctctccgacggcgacttcgccatcacggacgccaacggcgccgtcgtgctcaaggtcaagggcgccatcttcagcatccggagccgccgcaccatcctcgacggcgccgggatgcccctcctcaccatgcaggaaaaggtgttcagcatgcaccaccgatgggaggttttcagaggggacagcaccaacgcaggtgacctgctcttcaccgtgaagacaacttcgctgatccaactcaagaccgagatggatgtcttcttggcagggaacaccgcgcagcaggtctgcgacttcaagatcaagggcagctacttcgacaggtcctgcgtcttctaccttggcgactccaacaacatggtagctcaaatgagccgtaaactgactgtttccaatgtgctgctggggagggacacgttcagtgtgaccgtgttcccgcacgtcgactacgtgttcatcgcgagccttgttgtgatcctggatgaggttcacagggacaagcgcgacgattgatgagtgagttatatacgctcctcgatcctaagcgttcctggagttctactactgtcgtgtcatctcaagttgatatgttgtcactgtaagtcactggtgttatctgcatttcttgtagcattatgcgtgcatggtgagccatgctgaattgtgatgttgtggaataatgttcatgcaccttacatttgatccctggcctgccagtgtatcattcgtatttactgcagtgatggattgtttgcttgagatgaaatgttgagctataaaaaaaaaaaaaaaaaaataaaaa

SEQ ID NO: 23526 - DNA, 580 bp, Triticum aestivum
  Clone ID: PAT_TA_23526
gtcagcagaatcgctgtactataatccagcttggcacataatcgtttcatcctgggaaaccatcgtgtacagtccacttctcgatctggacagatgggccatccccatagcctcgttgctattattttggcttttttactggcgttgctttgctagaaggaaacgtggcagccgctcggtgctgccactgtacaagaactctcacaagaactcgagtcgccctagatcagactgatcacatacatggctttgttgcggcagtggaggtacaaaatatcaccccccaaaagagatagaagaccaagaggatagccctgcgtctttgatccatgtggttggatgggcttcctttggacgacgggtcgccgcaacccctgtgctgcgtctcgtgattcgttttggctgatgaaaatgtgcgggacgtggcgccggctctgcgctcgcggtcctgccgcttgctgtgttaattgctcgcttggcgaacgtgcctctttgttgaattggttttcttaagccatagtgggcataatttctgaacagactgtgatggaccttacatttttgccgtaatgggcaatgg

SEQ ID NO: 23527 - DNA, 750 bp, Triticum aestivum
  unsure (1)..(750): unsure at all n locations
  Clone ID: PAT_TA_23527
ctcgtgccgaacccgccccccgagccgccgcggttgcttccggttcgccaccactcgctccgctcgctgtaccgccctccctcccccttcccttccccatggccgcctcgccttccctccacgccccccgcctcctcccgctgctcccgaaccccgccccgagcctcgccaggccccggcgtcgcttcacggcggcgtcggcggtgccgccgtcgcggaacgggagctcggcggggacggactggtgccccgtgcccccggagcagcggcccgtgaacgagtacgaggcgctggccgcgtcgcagcccttctcctgggcggcgggggacctgcgcctctactgctcccgcctcgccttcacgggggccgccttcgcgctcttcgtcggcctccccgtcgcggccttcggcggccgcgggggcgttcggcggcgacgccctgcacctcgcgctcggggccaccggctccgggatcctcgccgtcacgctcgccgtcgtaaggatgttcctcgggcgggccctcggccggaaccgcctgcccatcgncaacggccagtatgangatannggatngtangacgggnacatatgggttaaaatcccngaatttctaacccnggantcnaccttcncggntcattttctgtgnanccggtgntgntcagngttncttcaccctgggtgggccttgangttncctnacttntgcacctcctcannccaanccatntccttggaccntggagaaccc

SEQ ID NO: 23528 - DNA, 581 bp, Triticum aestivum
  unsure (1)..(581): unsure at all n locations
  Clone ID: PAT_TA_23528
ttttaccgccagaagcaatagtccctttattattaggtacaaacatgtacaacgcctcaaatttttgggatgtctgtgtgatgtactgtccttcctaaaccatgatcaagttcaaataatgttactacatggcaaacaantatatagccacaaggggccatacacaatttaatcaccagacaccggcacatcataagtaacccttcaatctgagcccccaattcccccctagcacaggcgcttttttctcccggcaaatcaaatgcagaagtctattatttgtccagcattggtgtaagacggtaggtccttgaccgccaatacatcctcctaaaaccanttcacgctccaactggantctccgtggtttcatcacctcattggaactccatatatgaacacgttcaacgaccactgggcatccaancatcccgaaagntacacatagaggngatnaaaaccatttcatctcgtccgagtattccaaggaaacggtcctgattttnaaggggggcccgtaccattcgncctanagngaccgattaccncgccaatggcctcgtttnaactccngacgggaa

SEQ ID NO: 23529 - DNA, 488 bp, Triticum aestivum
  Clone ID: PAT_TA_23529
gcaaagttgaccgcaaggattgtgcaggagtgatcctctttgctgctgaaagggcaacacaagttgcacttgaggtcagaacactctcctcagttcattagaatttttgttgcatgtgttgtttttacatgatttctttggaatgcagtcaaatatcgtggaatgttgctcttaattttttttcctctttgctggacatataagatataactgtttagatttctcaaattctgcacttctgtcatcccaagatctcttactttgttgtccttggacaaagctcttaccaacttcacatttgtacctgtttttaagcttaagtaagttgcaagtattggtcaaagttcctttctgggccaccaaattgattttaaaccttccccctatggcaaggcaatccaagtgtccttggggggcaatgggatacaataaatgagtacccaactgggcgtcccccgagagatcaaaacctgggagattggagctgg

SEQ ID NO: 23530 - DNA, 793 bp, Triticum aestivum
  unsure (1)..(793): unsure at all n locations
  Clone ID: PAT_TA_23530
ggcaaaaaaagctaaatctgccttttccacattcggagacgcccaagggatttcgtgggtttgcggtcaacttgatcaatctttctgcagagaacttggagataatcacaagtagtggacatggtctccgtgaaaccttattttataggctctttggagagcttcaagtttatgaaacacggaatgacatgcggcaagcaatgcctcatttgaggaatganggctatatctttggatggtgggattataaagggtgatggtatgctgctgcttggttacagtgacccggagatcatatttcccgtcatgcctgatgctcctgacattctggaagaccctgaggatgtgttcaccaaagtaaaaaagatgaacgcagagaagaatgttctggaaacggtggagaacaagataagaagagctgaagagaatcggcagaaattggtcatgaagnanaacaagaagaaacgcaaattcgacgagatggcggaggtaatgagccagcccagtggcagccagcttgatcagtatcacccagtgtcacagtagacgaatgggcttgtagcaatctaacaatgtggtctacaaagatggtcacatggcatcatattaactgctgaactgttctagttgtttatgaatcttgttactctagttttctatgggattagctgatggactgattaacatgctactagcaatgcaactaggcagtgtttgactaaatctaatgcttatcattttactgcgttcaaaaaaaaaaacaaaaaaaaaaaaaaaaaactacaactcaaaa

SEQ ID NO: 23531 - DNA, 657 bp, Triticum aestivum
  unsure (1)..(657): unsure at all n locations
  Clone ID: PAT_TA_23531
gtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtgggcgctccgggagattncgcaagtaccaagaagagcacggagctgctgattccgcaagttgcctttccaacgcctggtcccgcgaaatttcgcaagacttctaaagaacgcactcccgcttccatcccaagcccttgctggccctccaaagaaggcggcccaaggctactccgtccggtgtttcgaagacacaactttncgccatccacgccaangcnttacatcatcccaaaggacatccactcccccgccgnatcccttgcgaaaaggctaagcttcctctccgtntaacaccgtatggtgtggganaatgatccggtgtaattggtccaaatgcgttcaagtctaagctttgtgtaaanaatatggtgttagtatagtagacaacaactttanagttatgtcctttggtttcataacaactnttcttttaagctccgccctttccctaaccctttttcccccn

SEQ ID NO: 23532 - DNA, 598 bp, Triticum aestivum
  unsure (1)..(598): unsure at all n locations
  Clone ID: PAT_TA_23532
gctcacctgtcacctcaccttgtagttgtacacccacgcagcattctccattctagccggcaccaactgtttgctcaacaccagcgaattctaaagtctagcgatggcagacgcgactgcgccgcgaccgctcctccgccgcgcgctctcgttccgggagccgctgctgctcatcccccacctcgtcggtttcctcggcaccgtcgcgtccgccttcttccacagctacgcctccttcctgcagtcctttgccaggtcgatcctcgtcccgtcgccggccgcttaccgccaagtgcgcttacgcaacgtcctcggcggcgcacgtcgcgccgtgctgcgaggacgtccgcgccgaggaggaggaggacaacgagctgcggaaggaagaggtggaggcgatcatggctaggatcgggctgggagtggccggctccggcgaggggctgaaggccacctggggcacccgagtgtcccggtgttcnacccgaggagcgactcccggaggtccgccncgttcccgtttcacgngacccgacggtcatcngcgcggngactgcaggcgcctggcagctcggctcccggagtcacncgcnctnca

SEQ ID NO: 23533 - DNA, 645 bp, Triticum aestivum
  unsure (1)..(645): unsure at all n locations
  Clone ID: PAT_TA_23533
aaatccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagtccgaggatggccgcaccctgggctgactacaacatccaagaaggaatccacactccacctggtgctcaagactccgtgggtggcatgcagttcttccgtcaaagaccctgaccggcaaagacatcacctggaggttgagtcctctgacacatccgacaactcaaggcaaagttccaagacaaggaggcattcccccggacaacacgtccattttgctgggaacactccaggatggcgcacgtcctgatacaacatccagaaggaccaaatccactggtctcaagcccttggtggagcatttcctcaagacctgacggaagacatcacctggagtcaatctcggaaacatcaaactaaggcaagttaagaaaggaggatccacgccaaacgcccacttgngaanacttagangccacttggggaaaatcaagggncaattn

SEQ ID NO: 23534 - DNA, 868 bp, Triticum aestivum
  Clone ID: PAT_TA_23534
ccactccactcagcccaaaatccgatccccccccatccgccggagccagagatcggagagggagaagatggtgcgggtggcgaccttcttcgggatgaccttcggcgcgttcctcttctgggagtccatggacaaggtccacgtctggatcgccctccaccaggacgagaagcaagaaaggatggaaagggagatggagataaagaagatgcaagcagacctaattgctcaagcaaaagagagtgaatcatgattgtcttttcgccaatggtttcaactagttgctttgtcatatttttactttccaagtgataagccttggctgatgtatgcttgacacctccaataaaccaaatccgccggagctagagatcggagagggagaagatggtgcgggtggcgaccttcttcgggatgaccttcggcgcgttcctcttctgggagtccatggacaaggtccacgtctggatcgccctccaccaggacgagaagcaagaaaggatggaaagggagatggagataaagaagatgcaagcagacctaattgctcaagcaaaagagagtgaatcatgattgtcttttcgccaatggtttcaactagttgctttgtcatgtttttactttccaagtgataagccttggctgatgtatgcttgacacctctaataaaccaagttgttataactttgttgaatccaagaggcaatgctcatggtaaatcatgttcagtttataaaacagcacaacacaacttcattgccttggttatgaggtgttgttttgaatagcttatacaatatttgtaatgaaggtgctatttttctttgtcgaaaaaaggggtggtggtgaaaaaaaaaaaaggccccta

SEQ ID NO: 23535 - DNA, 566 bp, Triticum aestivum
  unsure (1)..(566): unsure at all n locations
  Clone ID: PAT_TA_23535
ctcgtgccgaattcgccacgggccgaagcccacgccagccccagcgctccagctttgatccgaatattgcacagcccactccaccccgcccctaccttgatcactgctcctgtgaccatggagatgttcctgcctgcgatcctgagcgacctgctcggcaggtccgtgtcgttcctggtccagaggtacctgcagcagggcagcgcggaggacagcgtccagcagctgcgcctcgcgctgctgcgcgccgagcgtcaccgtcgaggaggccgagggccggcgcatcaccaaccaaggccatgctccggcagctcgacgtgctcaagagaggccatgtacggcggccactacatgctcgacgccctcacctgcggccgcgggcacgccgccgccgacgacgcgccggcgccgggcccccgccccctccctgcgggccgtcgcgctaacccccccaagcgccccgcctcctgccgcgccggcccggcgcccccggccgtgcgcgggcctcggcccatagccccccgcggcgattctccctccncanggcancccnctttgcngcagcc

SEQ ID NO: 23536 - DNA, 555 bp, Triticum aestivum
  Clone ID: PAT_TA_23536
tttttttttttttttttgcagattgttgaaattgttcttcgccagggtttagttcatccaattacttgtgttccacaccttatagcacttgaaactgaccctgtggaggggaactcaaagttggctcatcatttgctcatcgcgtccgatgaaaagtatccttcattttttgaaagccgcttaggtgatggcctacaaatgtcgttcagattcttcgagaccatagtcagcaaccataacgtggtggcaaccaacatgaaatcaaatccgattgcatttgttaaacctggcatatccagaatatatcgtcttatccgtgcaaatcgaaattcaagaaacaaatttgtacactcaatagtccgcaaatttatatctgacagccggagttaccccacaattggttttcttgtttactgtgtagaagttcttgcatctctacctttcaccttttctgatgaaccactttacttggtctatgatataaaccgagttatttcaaattagagccggagcaattgtggctaatttgaagaacgggactttcatggatctgca

SEQ ID NO: 23537 - DNA, 1467 bp, Triticum aestivum
  unsure (1)..(1467): unsure at all n locations
  Clone ID: PAT_TA_23537
cggagtcggagcatggcgtctgcagtggtggtggacgccggcgacgccccggtgcccccggctcctagccgccgcccccccctccccccccagtgggccctcgtccgcccgcggcgcgccgccgccccgactaccgcccgccccgcccccgccgtccgccgcgcccgcgtccgcgccgccctccgcggcggcgccgcccgccccccgcccggacccggcgacgccttccagcagcgcttcaccaagttccccacgctcgtccgcggattcaccaacctctacgccatggaaattgacccaaaggtagaaaatgatgatttatccaatgaaggaatggacggattcctttcagaactgacaaatgcgattccacctctgcgacgccctccggctgcgcctcacctggttccccaccctcgtcacgggcgtctcctccctcgacgccttggatactgatcccaaggtagaaaatgatgagttcggcaatgaagcaagagaaggatttatttcagtattgactaatgcaattccaggagtcgatgaagctatgagttttgctgaaatgctgaaattagttcaaacaatggattactctgttgtagtttttgatactgctcctacagggcatactttacggtcgctgccgtgcccggcaacacgcgagttggggctccagacttggctgcacttgtaggtgtttgtatgccgtgaatttcctttcattgtatgaaacggagagattggtgcaagagttagcgaagttcgagatcgatgcacacaatattataatcaatcaagttatttttgacgaggaagccgtcgagtcgaaactgctaagagcgcgggtaaaaatgcaacagaagtacgtcgatcagttccatatgttatacgacgacttcaacatcaccaagttgcccttgctcccggaggaggtatgtggtgtgcaagctctgcagaacttctccaagcacttcctggcaccgtacagagcgtcgctgaaaaggggcagcgtggaggagctagaagagagagtagccacactgaaatcagcgctgcaagaagccgagtcggagctagatagagttaggaaagggaagcaggcagcatgagcctttttcacctgtcagaagttgttgcactcggcggacaccagttatagagattttgtttgtcctgcattctccggttgatttcctccatttcctgtttcctcagtcgaaaattttagatttgttgttatagtcatgagaagagaagtgcactgtaagcacgtgatatataggtgtctttttttgccctcctgttagcgctggttgggaaggttctccagattcctggctactgttgtttaggagttgctttgggttgagcatgggaattgattacctagaaacccttgtgcactgctgtagtatctcgttaaacataagttngaaaatcaataaaggatgncttagagcagcaagt

SEQ ID NO: 23538 - DNA, 895 bp, Triticum aestivum
  Clone ID: PAT_TA_23538
gaagcatatccatatattgcacagaggctgctaacagatgaatcacctcgactaaggagtgccttgcgttacacaatatacggcaaaacaggtgtctttgacgcagagaggttcattgacgtcatgcaagctttcgagaatttcattagtgcagcaaagagtggtggtggggaggacatgaagggtaacatggctgagctgggtgctatagggattccaacctagcaccagtttagttcctgcattcccaatggccatctcccaacccggaggaacccaatcaaagctcgggctgctctctcttttctactctctgacaggggtgacttcttccgggagttcattcttgacgagattgtgaaagccatcgacgcggtttcaagggagcaattgctacaaattgcttcatcttttggggtcagaaatcccgtcccggttttcggcatggttcctgtgaggtccggagcattgcttcctacaatcacagaggaagacaggatcatcttgaacaacgtcgagaaggtcgtcaagtttctatcggctgggacggcaaatccaacagtcaacggggacgtaaatgtcgtgtctctggtgcaagagcttctacccgtgttgccgagcatcacgtcgaagatcctaccagatgtcctgagccggttgtcatctcgtgtattcgcacgggtgatccgggaatcatttttgtgaagcgctctcagttttgttttcttcttttgacaggaaattagagagttatttctccttttcctttcatgcaaaccacacacacatacaagatgatagaatgatgtacagaaacatgatgtatatataatctgtgcctgcctacatatatgtagattaaccaatgtttaaccagcaaaaaaaaaaaaaaaaa

SEQ ID NO: 23539 - DNA, 404 bp, Triticum aestivum
  Clone ID: PAT_TA_23539
gggccgacggggaacgccaggagttactgagcaggcatggatggatggatgtttggagcgcgagcatcaactgtggttgtgcataattatggttatgtcagacgtgttaattgtcgcaatttccaattggtggtactatatatatgtttgccaaataatgtgtgcaccgtgtgcaactatggaacagcgaagtggtaatcattttgtgagctttggaacagtgaagtgacacatatttgtcctaaaaaaaaaaaaaaaaaaaaaaaaaaaaaaaaaaaaaaaaaaaaaaaaacaaaaaaaaaaaaaaaaaaaatagaaccactcataaataataaaacaccacatccagaaatcagaaaaaaaaaccccctccaattctgccatcaagacacattgcggacccc

SEQ ID NO: 23540 - DNA, 515 bp, Triticum aestivum
  unsure (1)..(515): unsure at all n locations
  Clone ID: PAT_TA_23540
gcagcagagccatgtttaatgaaccgtgagctcgatcccttccttgtcatctcatcaaggtcgaccaatggcgtttctaggaggttcattgcgcatgacgaggagcatcgacagtcaagaaagatgatggagaagaagagccacggcgggtcagggtcatggcgtcaggcgccggcacccgtgaggcagctcttctggagagtgaggcgcgccatgctgaggccgaagcgctgtgccctgagtttcgggtacgaccacaagaggtactccccagaactttcgatgacggcctcgccactgcccactgcctctagctagccacacccgcaggggcttctacttctccttctcaattttacttgccgcctggccggcaccccccgcccgagggctgggagaaccttcgtgtgccgcccccccccattgtcgacctggctcctcctctcgttcaacctacgtcgtcggtgtatctggactggttctggtncaanacaataaaagttgncttancngtt

SEQ ID NO: 23541 - DNA, 659 bp, Triticum aestivum
  Clone ID: PAT_TA_23541
gcacgaggattttctccaggcctcatcagcccacgacaacgagacccgcgtccgtccgataaaaccctagcctcctctgccttcactggcctctcatcatcctataatccgcgaatcacccaacgcaccgcaccgcagccgcaccgcgcacaccaacaaccagagcgcgccgcagaacacccgacgacatggccgtcgcctccgcctgggccaagcccggctcatgggctctcgccgccgaggagcaggacgacctccccccgccgccgccccccgtcccagcctccgacttccccgacctcgccaccgccgccaccaccaaggtccccaagaagaagaaggtccagccagtctccctcgcctcgttcaacagcgccaagttcgtcctcccctcctcccgtgggcccaccccagacatgctgctaagcctccccaccggcccccgcgagcgcactgaggaggagctcggcggggcacgctggggcaacgtgtctcgcggctccgacgagatgcgacgtggcggatctggcacggaggactacggcccgtcccgcgccgacgaagcggatgattggggtgtcaagaagccgatggagaggagggagcggatgggagggtttggtggtgattcgatttcgtcgcgtgctgatgacgtcaac

SEQ ID NO: 23542 - DNA, 849 bp, Triticum aestivum
  unsure (1)..(849): unsure at all n locations
  Clone ID: PAT_TA_23542
agttcccccnggngttggggggnaanccttgcggggcgttggccggctcatgaccgcgggtgagcagggaaggagggccccctcctggcggcgggtgatggtcctcctgtcgacccctgtgagcccggtgtacgcgctagcgcttcgtgtacgcccaagaagagcatggcggtggggctgtgcctgctgtttgggtatgcttcttctgtcttgctgcggtggagctgttctacatggcggcggccacggtgtacttgctatgaggccatggagagcaaggaggtggtcctggcttttgatggctactatgccgagataccttcccgtgaggcaaatgtctgattgatcggccggcaccgtataatgagtcatatactttgtggtgcttcctagctgttcattatcattgtactactacgtgtatatgttactacgtcagtcctccgaccagagatacacaaaagtaggcaaaatcaagcagccatccgcccctccatccaggcaagatgtttgttctcaaaggacgccattcacttttgggtgcttcccgctttccggcggagaggatcacccatggttctgccgtggccgggaatggatcccaattccgattaattctgagtggccaggtatccctgatttaccctcccttgatttttgggattaaccactcttggggggtgagtccccctcaacttccttcccttcgtcgggcccgttccccttgcctgcgaattgggggcgatgagtacacaccgggggcgcaaccccgtggganatctgctgaacaaggtaaccnaatccggcattggnaaagttgggagttgtgttgaaanattgtgtacaang

SEQ ID NO: 23543 - DNA, 704 bp, Triticum aestivum
  unsure (1)..(704): unsure at all n locations
  Clone ID: PAT_TA_23543
gntgagattgaccagtttatcaacgaggntgccatcctatcacaaatcattcatcggaatgtggncaagctttttggttgttgtctcgaaacagaagtgcctttgctagtttatgagttcatatccaatggcacactatatgatcttcttcacattgatgtaagtgctaaatgcttacttttatgggaagatcgcattagaattgcagtagaagctgcaggtgctcttgcttatctccactcaagctgctgcaataccaattttccatagagatgtcaaatcttctaatatactcctaagatggcaactttactaccaaagtttctgacttcggtgcttcaaggtctttatcacttgatcaagacacatgtagtgacaattgtacaagggaacttttggttacttagaccctgagtactaccacactggtgagctgagtgaagaagaagtgatgtttatagctttggaattatactgggggagcttttgatgagaaagaagccaatttttattaatgaacaaggtataaaacaaagcttggctcattactttgtggaaggacttcagcagggagttctcatggaaatcatggatccccaagttgtagaagaagcgaaccagaatgaaattgatgaaattgcctcagttgcggaagcatgcttgaaaacaaaggaagagaaagactaccaagaaagaagtgggaa

SEQ ID NO: 23544 - DNA, 860 bp, Triticum aestivum
  unsure (1)..(860): unsure at all n locations
  Clone ID: PAT_TA_23544
ccttaacatgcatcaaaatctgcagaattctcagcaaatggctactgctgttcaacaacagaacttcatgccacagaaccagccacctctctctcatttgccatcagagaagttgcttgctgagatatctcaagacccacaactcttgcacatgtttcaacaacagtatctgctatcacaactacagttgcaatcacagccgccagtggcacctcaacctcagccacaactctcaatgttggacaagatgatattgcttcagcagcagcagcaacaacaacagcagcagcagcagctgcaacaacgactacagcttgagcaacagcagttgctgctgcaacaacagcacctagtttctcacgttgcacctcatggacatcccaaccaacagcttgatgatccttatgggtcgaagcatactacattgccagctggcgattctatgaatcttggtgttcgaacaattcaagaggttcttgaagctgatcgtattttgactaaccatggtacatcccaggtatctagtcaagcatttatgagtatgaggggtatggagggtgttggaacatcacaaagctctgtacctactgtgccattgcctcatgaattttttatgggcgcaccttcgaaagaacggtttccccatactcagaagttgggaaactcggcaagtgataacacccaacttagtgcaagtatggtcaatacgattncaaacagaagttgcagaaaggtacgaggaggcttctggaaactatcagcaagttggaataagtaaagttgaaagtaagcctgcaaatattttaagtttaagatctacaganggcaacaattcaactctaagtgaagctaaggnttcc

SEQ ID NO: 23545 - DNA, 795 bp, Triticum aestivum
  unsure (1)..(795): unsure at all n locations
  Clone ID: PAT_TA_23545
gcacgaggatatacaggtctatatagtgtatctgggcgagcacgccggagcgaagtcgaagggggcgatccttgatgaccaccatgccctcctcctctccgtcaagggcaggtaccgaggaggaggcacgggcgtcgctgctgtacagctacaagcacaccctgaatggcttcgcggctcttctctccgaggaagaagccacaaagctttcagagaagactgaggtagtgtccacctttcggagcgacgggaggtggtccccccacaccacgaggtcttgggagtttgtgggcttggaggaagggctcagcaagggctggcagccgtccggcgctcacgccggcgagaatgtcatcgtaggcatgctggactccgggatctggccggagtcgaggagcttcagcgacgaggggctaggaccagtgcccgcgcggtggaagggagtgtgccaaggaggagattccttcaattcctccgcctgcaataggaaggtcatcggcgcgcggtgctacctcaaggcgtacgatgcccaccacggcaggctgaacaccaccaacgcgtaccgctcgccgcgcgaccacgacggccacggnacccacaccgcgtccaccgtcngnggccgcaccgttcgggcgtggncncgctcggtnnnttctcagtcggtacgnctcgggcggtgagccnntcgcngcctcgtcatctaaaangtgngctgggncatactgagcccacccatnatncagaacactgcttnacgcnacatctcncngcatggacaacccgtcngcgatgcct

SEQ ID NO: 23546 - DNA, 1128 bp, Triticum aestivum
  unsure (1)..(1128): unsure at all n locations
  Clone ID: PAT_TA_23546
actccccgcgccagcgcgtcctgaaccctagcccctttccccgatccccacagcagccgcaccctctcctcgctcacagccgcctcctctcctctcccccacgtcgccggccttgtctctcccccacgccgcggccttgtctcttcgctcgtctcctcctctcttccatgcctccttggttccagattgggatctggtcgccgtcgtgcgagagcagggcaacagggtcttcgcggaggagtggagggggaggatgcggacgacagggcgaaggaggtggctggcaaggaggacaagcagcagggggggagaagggtgacgcctcgcacaccgtctcctccccgcggcggttggccggtcgactcgtcgcgccaccgcgtcctcacctcccctgcgccatgagaggcgccgtctctgcttccacccccgcttcctgcttccttcctccttggcaccacagctgccgctctactccctcccttgtcagccaccggctcaggaacctccctcggttgggccagggcagaaggccatggcgaatcttgcgcccctggaagaagcagcagggttggtggagcgtcgaatacgggcggggtcaacggttgagggagggtcgcccaccggagcagtaggagaaagaccttgagtgaagttgcatcatccaacatagcaagatgaagtactcagaaaaaattgcagcaagtgcgattgatactcagggaattgatctgattctgaatcttcccttcttccgagttgtctgaagtggaatggattgtcgtcacctttgactaagctgtcgagcccaagaactgtggcagactggtggcccagctgttcaacttctcaacaccgtttaattttgtctttggctgtccttgcgtccactcagcagagaagtatctatactgaatttctgctctagataacttatactcatataatttatctctaatacccagtccaaaacattagtttcaaaatgtaactctttgcggccctaattcgacagtacttntgagtgcttcctataggacccaggagtgagcaagaacgaagtcacctgagatgggaaaaacagaagtatatgttaataaccagattttcaaaaaaaaaaaaaaagggcgg

SEQ ID NO: 23547 - DNA, 1026 bp, Triticum aestivum
  Clone ID: PAT_TA_23547
gcagggctccacgcccctgccgacccagccgccaccgacgacccgcaaccagctgtccccacgacggccaccgcgggagctcaccgtcgccccgacgacggttctgaccgcttcgactgcccgacagccctcccctgaatccaccaggacgccggtggggcaccgcgctgtcgccaccatcagggtgttccacatagccagattcagacccagcccccaacaacagatcataaggttggggggtacatccacgactaccagattcagcgcgtgcttgagatcaagtctgaggccgactcggtgactcgtgataagaagttccaggagctcatgaaggtcctcgcaaggcaagtggtggcatgcccacaggttgaatatgtctcaatggacgacataccagagagtgttgtcagcaaggagaaggagattgagatgcagagggaggacctgcagtcgaaacccgacaacatcagggagaagctcggggaagggcggatatcaaagaggctcggagtgatggccctcctcgagcagcccttcatcaaggatgacagcaagacggtgaaggatctcgttaaggagacgatcgccggcctgggggagaacatcaaggtacggaggtttgtcaggtataccctcggcgagaactgataaatgagacagtgacctccgctacaatccatggcatcaggagtcgggcacattttgattcatcgtggtgcatagctgctgctagtttgtactgagttccatgtataattttgtatcacttgttaccattgttcctggttacaaacaacacacttttttgcacaccttcaatgtagatgagaggagagatcaatatattgtcccatgcaagggattacggcaaattaaattgggttcttgttccatgttttaagtgatggccctcctggagcagcccttcatcaaggatgacagcaagacggtgaaggatctcgttaaggagacgatcgccggcctgggggagaacatcaaggtacctcggccgcgaccacgcta

SEQ ID NO: 23548 - DNA, 502 bp, Triticum aestivum
  unsure (1)..(502): unsure at all n locations
  Clone ID: PAT_TA_23548
gtcgccctcacgctcttcgtgctcgccgcctcccttcgcgtgctgcctcatggcttccatcgccggatctgccgtgtccttcgccaagcccgtcaaggcaatcaacacgaactcgctctctttctctggtccaaggaggggcaatgcatttcttcgcctgcagccagtgccgatgagatttgctgtttgctgctcagcaaagcaggatacagtggagaaggtttgtgaaattgttaagaagcagcttgctgttcctgaaggcactgaantttgcggtaccaccaagttctctgaccttgggagctgattcactgggacacggtcngagattgtgatgggccccnaggaggagtccaagatcaagtgtggaggagacgagtgcgcangcattgcgacagttgaagatgctgccacctcatccgacaacttgtctctgcgaatcancttgaaggaggcctaacctatgatggacccnaagnacagcctacttgggttgtcnttg

SEQ ID NO: 23549 - DNA, 679 bp, Triticum aestivum
  unsure (1)..(679): unsure at all n locations
  Clone ID: PAT_TA_23549
cccnccccaagttccgcgttngtcntggtgtcttccncccttggcccagcttttccaaccgccccggcctgcccgtggaccccgtcgccccgggctccccccccggcgcccccggggcgcgccgcacggaggccccgcgggcggcggcgcgtgcggcgcacgcgccgtacagcggctgcccgtcgggcttcgcgttgccggacgtcgaagggaaggtgtaccccgggggctgcttggagtccgcggcgtacaacccgacgttggcccccgtgcagacggccatcattgcgatgattgccgcctccggcggctccgccggcgatgtggtggcggcagcgctggtagagaaggagggggcggtggcggcgcaggaggcgacggccagggtcttcctggccgctgtggcgccgcaggcgagcttccacgtgtacaagtacaggtcgtccgatgtgtgatgcgcagcagcaggcgagatcggacgagataatgttcataatcttcaagaaagaataatatgacgggaaataatcttgtgcagatgggtgagctgtaaattccacatggcgctcgtgattcgctgatgggacaccgagagccggggcctacttaccattcttgtgttcatgtgtgtattattatgaggaaaatataatactcctagaagtaaaaattctctgaa

SEQ ID NO: 23550 - DNA, 1067 bp, Triticum aestivum
  unsure (1)..(1067): unsure at all n locations
  Clone ID: PAT_TA_23550
caggtcgattagaacaaggcataattgtttatgccagatgtgcatgctcaaagattttggtcggcaacttatagtgtgtatcaaagaattctgaagaaaaaggttcttgcggttgttgttcccacgactgccgttcgcgtttgtacaaggtgagctctcttatgttcgtctgtttactcggtcgttcctagagaatatatttcatgtgctctgtcttggttgatagtgtatcccgctattgctttcttacagtcaaggagatggatagatatagattctaggcgtgtccttggtccctgcaaaaggagtgtttttgttcccttccttgctttatttggtatgctgctcttttccactatcgatcgggagacgaatttggtatcaacccctgtccttgctctttgcaaaagnnntttttattcttttgttaaatatagaggtctaaaagtcgagtactgagtcattggcatggtagtcgggatggatctatgtaagtacttatacangtatgttnnnggtctgcttgatttggtttatcctgattttgcatttaaatgaattaactcaaattcgtatttatgcttgatgggtgattggattgtccatttgtgtgatcttataaaagtgcacatgtttttggtctataactttctgcaataggactatggcttgataatacgatatacatgatattatgcatgtcctgtgacagtttaaattggtagtattccactaggactggaaatactcccgaaaagaatgttgtgctacctctcttttgttagttaatattaatatttgtgtagtgtgattgactgactatgcaacagaatcttgggtattattcatatagcttggggtttaagtttacttaatgcttaggcctttcacctgaacatattgttacttttggactgacgacaattcagtaattgttgctgataataccctagataattcaatcctatggnttggatgctgaaaatctctatgacctatacaaaaatattggttggtaaataagcacacatagttttttctgcncaataatataaatggtgcaagng

SEQ ID NO: 23551 - DNA, 549 bp, Triticum aestivum
  unsure (1)..(549): unsure at all n locations
  Clone ID: PAT_TA_23551
gatattctgttggctgatccacttgatctatctcctatttaagcgagaccaccagactagccagaactccacaggacacagccaaaatgacgaggagctcttgcatgtgcctcctcctcgtcctcctgtgatattattctcatggccgtccagccccccaacccggcttctcctgttcccctcgtccgggcagccaacctcggcggctggctcgtcacagagggctggatcctgccctccctcttcgacggcatccccaacaatgatctgcaggatgacacgcagctgcagttcaggtccgtcacgcaagaatgcgttcatagccgtccagaatggcggcggggcggcactggtcgccaaccgggcctcggcctccggctgggagtccttcaagctcgggcgaaccgacacaaatacgttcaacttcaaggtgttcnaatgaccaattcgttaccaccgccggtgttaacccggggcgcaccgccgccccgggcgggaagcctcagctcgtccgnctagtggcgcaacgaacgtttgaaaaaatangat

SEQ ID NO: 23552 - DNA, 640 bp, Triticum aestivum
  unsure (1)..(640): unsure at all n locations
  Clone ID: PAT_TA_23552
tttttttttgcaatgtttgatacttttcatatttgccaaattgtttggcccaaaacggtgcgaacaaatagtggggtcaaaaccttaattaaattccaaaaagtagcataccgacacacattgttcttacaacagtttataacggcttattttacacaaacaaaaacattctggttaactaaacagcattctccatcatccttctaaactctatgaagctgatcttgccatctccatcctcatcgaaggggtggatcatcctcacacagtcctcatacatggccccttctttccacccaagcctcctcatcacgttccacaactcaccggcgcatatgaacccgtcctcatcacggtcaaaaacatagaaggcctcctccagctcgcccccgcttgcatgcttaccgtccatcaactcatctacgacactaattccttcacaccctgggtacctccacctgggtaagacctagcctccgtcgtgacaatttctatgtcaccagatgttaatcctacacaacaggctactttcgcgggngatgcggggctntcancaagcacacggagtcgacacgaggggtcncatgcgccaagtatttgtnagtgtgncagnagntccagatcttttgctacangatnn

SEQ ID NO: 23553 - DNA, 400 bp, Triticum aestivum
  Clone ID: PAT_TA_23553
cactcctcctcgaggcgcacgcgcctgtctcctccgagccttctgcgcagttctcccgcctctcctttggcaaccgccgccggctgctggacgctctcgtggcctcgtgtcgtgtcatgctcccgccggagctcgcggcggccccgctctttgcgcgctccgatgaggacctgccgatgctcgccgcccgtcgtgaggcgatgttgcgtctgcacattgagtccagcgggggcatggtgcgcaggccggagctcgaggcgctgctgggggccaagaaggtgccaccgtcgctgccggtggacagcgctggtgagagggtgcggctgcggaggagtctctctgcgatggctgggtacgtcagggacgggctgcggcagatggtgacgcgctctgcatcagc

SEQ ID NO: 23554 - DNA, 855 bp, Triticum aestivum
  Clone ID: PAT_TA_23554
ttcagactaatccacaagaaattaagaggggactcccacgcgtggggaatgagaaagagagatctattacttagacgatattggaggagagaagaagatggcacttatgttatcctgtaccactctgttttccacaacagatgcagtcctgagaaaggctacatccgtgcatgtcttaaaagtggaggatatgtaatatcaccagttagccaaggaagacaatcagttgtgaagcatatgcttgctatagactggaaattctggaagtcatatctccttacctcatccgcaaaatacatcaccatacgtatgctaggaagagtagcagccctacgggaattattccgagcaaaaaatggaaactgcgcttgtatggaattctcatcgggtgagctgatgagggatatgggactgccgcagggtggaaatgagccaacaaaaatagaaacgcagtcagcaaatgagtgtgagagacttgagggtcctgtagaaggaccacagggtggttctaagcggcacttaagcagtactggttcccttgttcaacttaatgatgcaacggatgagttctttgatgtcccagatgaatcagaatatgatcagagagaagccatgtggtcttctgatgagagcacacatgctgcggaccaacgacatgctaaattatccagtgctgctgtctttgtacggaagttgcatgatcttgcagttcaaaagagagggtacattgatttacagggagctgcagatgctgataatggaccatgttactatggacatactctcccaaaagattctagctgtacaatgccttctagttggtcaatgacagacccgacaacatttttaatacgg

SEQ ID NO: 23555 - DNA, 474 bp, Triticum aestivum
  Clone ID: PAT_TA_23555
atggaggacggcgcccggcgcgcgagtattctcgccaaggatgatgcaacatgccatggcgaagaatcacagtctctactggaagtatctcaacagccagagcttaaacctagaggttctgactggagaccacctgcaatcattcttggacttgaatgcttggagagcatggctttcaatggcatcgcgacaaacctagttgtgtatatccgctcagttctccatggtggcattgcctcaagtgcttcaattgtttctctttggtatgggactagcttctttgtgcctatacttggagcaggcatagcggatgcttactggggaaattacaagactgtcttgatctcccttgttatgtacctacttggcatggtactcattacagttggatcatttataccttctgctccagccttatgcaactttggctcatgctcgtcatcaaaaggaactgagaatctaattttcttctca

SEQ ID NO: 23556 - DNA, 624 bp, Triticum aestivum
  Clone ID: PAT_TA_23556
tcagcttaaacccattcaagtaaacccgtggcgatggctccacgactaagtcctttcactaggacatctgccgtgacaaatccacgacagttggcgcccatcgtggggctatcgcacgatggtttgacgatcttggagggcaagctcaagggactcgaaggctatgttgtgggccggatgaccaagggtcgtcggggcaggatctacatcgatgatgcaggatggggtcccgaggccgattcgatcgagtatgggtaccgggtcccctttggcagcatacacgtcttcatcggcaagatcggtgagcctgggcctgagccggacatctacaccgaccccgtcgagacggctcagcgtgcgagatctacccaggttaaaccggccatgaagcgtgccttcgttggagtcatctacggaggagagcgtgaggacgaatcagagcacggtaacgagaccgtcgtctattccggcgacgagtcctcgaccggagagaccgagtcgctataccggatgcaagacgatcaggttaggggttgttccgatggcgacagtattccggaccccccagggccagatcaaccgggttggaatattcatggccggcacacatgcggcgaatcactc

SEQ ID NO: 23557 - DNA, 791 bp, Triticum aestivum
  Clone ID: PAT_TA_23557
tggtcttgtatgttccagtaaaagacaagaaatgtttgaataaagtctaaaatggtagaatgggagtctattatgaccatgactatccttcaatactgtaacttagaccacctgtgctgtaatcatagattttcttcttgattaaaatcttcctgtagccatctcttacaatcacggaaaagattttgtgatatttatgatgaaagcacaaaggttaacgtcgtatcatttcctcacaagtgttcccgtacgtacatctataacatctactcagggtttcttgaaattccgatataggagagtatttttttcttgcagagctaactgcatcctaatctttcttgtggtagtttactttatcattcccagaagagagttttatcaccatctcccccagaagaagtttttggtcccgaatattctgatacggatactctactctctcttctagagttggtaggtgttcccagtgctcccaatgctcatcccataggatccaagtattgacaccggcgataatcaatgcaggaattgttgcgtagattgacagtttacgccagaggtcacttgtcgcagcagcgtgatccttgactgcctttctttcgcggttgaaggcattatcttctacgccctgaaatccggaactctgcgtgctggtaagacgtctttggaacggagtgcggataaggttgttgcgtggtgagatggcgaggctccaagagggccgggaaacggatcgtaggcacgacattctgtccgtcaatggttgctcgtgccgaattcggcacgag

SEQ ID NO: 23558 - DNA, 504 bp, Triticum aestivum
  unsure (1)..(504): unsure at all n locations
  Clone ID: PAT_TA_23558
cttgatcttatcggtggcagtactacaagcgagtgacacaagttcttgcaccgatcagatccaacttctgcgcaagatgctggacaagctgtgggacgacgtggtgggccgggcctcgcccggagacgggcctcgacaaagctccgccgcgccgccgccacccaacccctccgccatcaacacagctgcaggggaaggcgattaagcagtcgccgtccgatgccgaacgaccccgaccacccgggtgacgcgtctccntcgaacgncccgnccgcgttggcggcagcgtgtggcgggagcgtttttccaccccggggagcaaccttggcaacaaaagccccgggccaacttcttcnaacggcccgcaaccaatcccccaacgtccaacgacggttttacacgaccagacaagaccaaggacaacaccgctaataagaccgacggcaaagttttanacaggattctgcgacccgcattttgctgcctttggtatctaacctgcaa

SEQ ID NO: 23559 - DNA, 980 bp, Triticum aestivum
  Clone ID: PAT_TA_23559
ctctgcagcctctgctggttccactccatccaatcgtccgtgctccatccatggccgcgccagctctcccccttgccaaccacgccgcgcccacggccacggccaggtacctccaccgcagccagcagttgctgcagcccaagaggcagctcccgcccggcttcctcgccgctcggcctctccggcagccgcgccggccgctctccgccgtgccggaaaccaaggaggaggacgccaagacggccgaggagatcaccgagaagtacggcctcgaggtcggcctctggaagatatttagctccaaggaggaggagggaggcgaggaagggtaggaggggaagccgaggaagtcgagaacggagcaggccaaggagctcctgggcaagtacggcggcgcgtacctggccacctcgatcacgctctcgctcatctccttcaccgcctgctacctcctcatcaacgccggcgtcgacgtccagcagctgctcggcaagattgggatcgccacggacgagaccggagggaaggtggggacattcgcgctggcctacgccgcgcataaggccgcgtcgccgataaggttcccgccgactgtggcgctcacgccggtggtggccaactggatagggaagatcaccaagggaggcgactgactagactgatgcagcagtcaagtgtaggcacttcgatccaagtgcacttgctgttttagatgttctgctagtgtaaatgaaatctggctaaagtacgattttgcctacttgttttgtatgtttgctgctcttgtaaaacaggatagtaatcccaatgtatcagagacaaactagtactagtaactgggaatatatcgatttttagctagtaataaaaataaaacatcgaaccagaatccttcactgcttgcgaaatggcctttaaactcttctgcatagaaaaaaaaaaaaaacctgcccgggcggccgctcgaatcgaattccccg

SEQ ID NO: 23560 - DNA, 647 bp, Triticum aestivum
  unsure (1)..(647): unsure at all n locations
  Clone ID: PAT_TA_23560
gcacgaggatccacacctcagcctcagctcacctgctcctgctctccttgcctccctccatccgtcctccttgggattgggagagaagagaccacgagcaactcatccaaacaatgaagagcaggacgcagagcggccgcggaggagccatggtcgccgacgggggcagcaagatggagcgcaaggaggtggagaagaaccgccggctgcacatgaagggcctctgcctcaagctctcctccctcctccccgcctcctcctcagcccaccacctccgccattattccacctcttcctcttcctcgccgccgtccagcaacaaggacgcggcgacgcagctggaccagcttggacagcgcggcggcgtacatcaagcagctcccgggccgggtcgaacgacctcaagcgccgcaagcaggccgccgcctccggcaccgctggctgctcgtcctccgtctccgccggcgactacaagggaccccctctgccccccactgcgctgcctgtggtcgacgggccgcgccgggtcgggacgcggcccggggccctggccggcggggccgggcggccgttccggctgcangnnnngatcgccgtcctggagcnnnnnnncgccgnnnnngtcagcgcnagcnnntcnnncnnng

SEQ ID NO: 23561 - DNA, 574 bp, Triticum aestivum
  unsure (1)..(574): unsure at all n locations
  Clone ID: PAT_TA_23561
ctgatcccttccttgatcctgattcccaccttccctatggtcaagttcaatgccacccggacaccggtcccaaagaagccttcctggcagctgccaccgcagcctgtcaccccaacccagacgctcaagtaaagtttctcacttcgtgtaaggaggtgctggagactgccttgtctttgctgcgtcgggactctcacaagctctccactcaagatgttcaagcagcttgccaggttgctatctccggaatccccctatgatcatgactctggagatggcacttcctccactccccctcaaatcttacccccttggtggggcctagcggatctgtatacagtagtctccaagggggtcaatattttgttgaataaatatgaacagatgccaaatggggatcccaggtacgaagcttcatacgatttgtggtgtgaatgagcgggtttggcggtcctgctcaatggcctcctcaatgaccgttggccgctttcaagtcaacttcctggctactcccaaaaaggcccctgtggtgggaaaccaacgtttgggctgtgctgaaanttaaaacgaangg

SEQ ID NO: 23562 - DNA, 673 bp, Triticum aestivum
  Clone ID: PAT_TA_23562
ttcggcacgagcgggtacgtcacgaccgatgagcgcctcggcaaggcactgttctattggttcttcgaggctatggagaagcctgacgagaagccactggtcctatggttaaatgcaggacccgggtgttcttctgtagggtttgggcaggcgcaggagctcgggccatttcttgtgaagaaagatgtgcctgagctcgagctcaatccgtatgcctggaaccaagctgccaacttgctgttcctggactctccagcgggtgttggattttcgtacacgaacacgtctttcgaaatagatccaccgggagacaattccacggcacacggttcatacgctttcctcgtcaggtggtttcaaaggttcccccagcacaaaatgaaagagttctacatagctggagagagctatgcaggacactacattccacagttagcgaatgtcatcgtggaggagaacaagaaggcctccaaagaaaactacataaacttcaaaggcatcctgatcgggaacgcgtacgtggacggggacacagacttgcaggggatcgtggactcggcgtggcaccacgccatcatctccgacacgctctacagcgccttcctcaagtcctgcgacttcagcattgagatcctgtctccggagtgcgacgcggcactgagcgagttctttc

SEQ ID NO: 23563 - DNA, 769 bp, Triticum aestivum
  Clone ID: PAT_TA_23563
gatgtgaggctccttatataggacagccgaaccgacctaagcaaaatatcagctagcagtgaggtaagcacttgcgtcactagctagcttaccaagcaagctacgtttctactactactaaacttcactagtaaggcatgcagcctttgttgctgccgacatgcatactacaagctagtaagtaaatactgctacagctacatgcatgttgtgccgctacatgcatgttgtagaccatccggagaccaaggttgactcaacaatctcctcctcaaccttgtcgaaggagcttgatgtcgatgatgccgaccttctcgcactgctcctggaatcagacatgaccaagtgccttcgttgggatgtccgccttctcaggctatgtatggcccgtacaccctgctcgcgcttcttgatctcgggtgctgcgatcgtctcgcaggctcgagaaggttcctctagtcttcggaacctgtgtggatcgccaccatttttgttggcatcgaacaagtccgaccacgctgttggcggggacatgaactgcccgggaaccacctcgctcgtgggcgtcagtgttcctggggtcgtagttcctgatgtcacactgcccgggaactcccttcccggggtcgtcgtgccggacgccgcactgcccgggaactcccttcccggggatgacttgtcggacatcgcactacccaggaactcccttcctggggtcgttgtgccggacgccgcactgcccggagtggctcctctcagggtagcgaag

SEQ ID NO: 23564 - DNA, 836 bp, Triticum aestivum
  unsure (1)..(836): unsure at all n locations
  Clone ID: PAT_TA_23564
ccctacccttctcgcaccagctataaatttcaccctctctctaccctccccctctcccgccgccgcccctcttctctcctctgcccacaaaaccctagccgtcgcctcacagctcgccgccgacgcagcgagctctccctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggccgagtcactccgctacaagctcctcggaggccttgccgtccgcagggcttgctatggtgttcttcgctttgttatggagagtggtgctaagggttgtgaggtcattgtgagtggcaagctcanggcccagagagccaagtcgatgaagttcaaggacggctacatgatctcatctggtcagcccgtcaacgagtacatggatgctgcagttaggcacgttcttcttagacagggcgttcttggtttcaaggtgaagatatgcctgactgggaccccaaggcaagcttggccctacactccgttgcctgaccctgcaccatccaccccccgaaggaggaggacgagctgccccccccggctttggtgaggtctaaagt

SEQ ID NO: 23565 - DNA, 682 bp, Triticum aestivum
  Clone ID: PAT_TA_23565
actagaaggaggaaatgccttgtaatgaaattggaatggcctgagttttacaaccgggatgcagctccttttataggtagctgaaccgactaactatacgtatgagcttacgtcaagctcctagattacatcactgctgacgactagcttgctcagcttttaccatagtaaattactactagtagtagtttccttaactaccaaggcatgcagccgctactgcttttcttgccgacatgcagctgcatgtcatttccacctcctggctaagtaactgctactgctgccgctgtaaccaagcatgcatagccatgcatgcatcgaagacaggtttgactcaacaatctccccctcaaacctataggagggtcttgatgatcccgctcctgtcgtgcggctcttggaactcgacgcaaccaagtgccttcgttgggatgtccgccttctcggcggcctgtatgccctgttcgtgcttcttgatctcggcttttctatccctgtgataagcgagggctatgcaacgcttggttacctaccttaccttttaatggacaaaagtttctgtgtaatgcttctatgttaatttcgtttaaactaagttttgccgagacaagttacttatgtatgccagaaacctttgtttggaaaaaaaaaaaaaaaaaaaaaaaaaactggagactag

SEQ ID NO: 23566 - DNA, 1302 bp, Triticum aestivum
  Clone ID: PAT_TA_23566
cgaattcgcggccgcgtcgacggaggaggacgagctgcgcccccctgctttggttgaggtctgaagtcccaatagagcaagcagaccatgaaacgtcacatcattttggtcctagctagttttctatccctgtgataagcgagggctatgcaacgcttggttacctatcttactttttaatggacaaaagtttctgtgtaatgctgctatgttaatttcgtttaaactgaaaaaaaaaaaaaaaaaaacccagcgacccggagagagacgcacgcaggcgccgaaacctagcgacgccgccgacgacccccggatccgcccgccatggcgacccccaacccgccgccccagcaggacgagccctcctcctccgccgatcccaaggcgaagaaggactactcgacggcgatcctggagcggaagaagtcccccaaccgcctcgtggtcgacgaggccaccaatgacgacaactccgtcgtcgccctccaccccgacaccatggagaggctccagctcttccgcggcgacaccgtcctcctcaagggtaaaaagaggaaggacaccatctgcattgttcttgctgatgacacatgtgaggagccgaaggtcagaatgaacaaaaccgtcaggaagaacttgagagtgagacttggtgatgtggtgtctgttcaccaatgccctgatgtgaaatacgggaagcgggttcacatacttcctattgatgacacagttgaagggattacaggaaacttgtttgacgccttcttgaaaccatacttccttgaagcttaccgtcctttgagaaagggagaccttttccttgtgaggggtggcatgagaagtgtggagttcaaagttatagagactgacccggcagagtattgcattgtggcaccagacactgagatcttctgcgatggtgagcctgttaagagggaggatgaggagaggcttgacgatgttggctacgatgatgttggtggagtcaggaagcaaatggcccagatcagagaactggttgaactcccactgcgtcaccctcaactttttaagtctatcggtgtgaagcctccaaagggcatattgctgtttggaccacctggctctggcaaaacccttattgcgagggctgttgccaatgagacgggtgcattcttctttctgatcaatggcccagaaattatgtccaagttagcaggagaaagtgagagcaatctcaggaaggcatctgaagaagcagagaagaatgcaccatcaatcatcttcattgatgagattgattcaatgtcgacgcggccgcga

SEQ ID NO: 23567 - DNA, 991 bp, Triticum aestivum
  Clone ID: PAT_TA_23567
cctaagcagggcagggtctatgatgtttggcctgttggtagcaccaatgatgaagacggttttcttagcattcatgccatccatctcagtcagcagctggttcagcactctattgctacccagagaggaagcagcagtggggatgctggaggtgctgctgatagagtgctgaaccagctgctgactgagatggatggcatgaatgctaaaaaaaccgttttcatcattggtgctaccaacaggccagacattatagaccctgccctccttaggccagggcgtcttgatcagcttatctacatccctcttcctgatgtcgagtcgaggcaccagatcttcaaagcttgcctcagaaagtctcctttggccaaggatattgatctgagtgctcttgccaagtacactcaagggttcagcggtgctgatatcactgaaatttgccagcgtgcttgcaagtatgccatcagggagaacatcgagaaggacatcgagagggagaggcggaggaaggacaaccctgaagccatggaggaggacgaggttgatgaggttgctgagatcagggctgcccactttgaggagtcgatgaagtatgctcgccggagcgtgagcgacgctgacatccgcaagtaccaggcctttgctcagactctgcagcagtctcgtggattcggcagcggagttccggttccctgatcagccggctgcgggcgcttcctctgccgctgcggccgacccttttgcttccgctgctgcagcagccgacgatgatgatttatatagctaaatcctttcgctgtgtgatttcgttctttgacagtacacgggaaaactatgttcttaagttaatattgtgatgcacagttaatcgttctgcccgttatttccagctgcatcttttttctgtgatgttgcgtagagtagctttgcatttgtcatgccgtgttcatctgtgctggaaatagtgcttgagattattggatggggacgc

SEQ ID NO: 23568 - DNA, 1502 bp, Triticum aestivum
  Clone ID: PAT_TA_23568
ccacgcgtccgacctccttcacttcccaaggcggaacgaaggatatccgcaaccccccgcagcagcagccccgccgagagacctagcggcgccggcgaaccccggatccgcccgccatggccgccccgacgccgcagggcgaggcctcctcctccgatcccaagtcgaagaaggactactcgacggcgattctagagcggaagaagtcccccaaccgcctccgtcgtcgacgaggccaccaacgatgacaactccgtcgtcgccctccaccccgacaccatggagaagctccagctcttccgcggcgacacggtccttcttaagggtaagaaaaggaaggacacaatctgcattgtgcttgcagatgacacatgtgaggagccaaagatcagaatgaacaagaccgtcaggaagaacttgagagtgcgacttggtgacgtggtgtctgttcaccaatgccctgatgtcaaatacgggaagcgggtgcacacacttcctattgatgacacagttgaaggcattactggaaacttgtttgacgcgttcttgaaaccatacttccttgaagcttaccgtcctttgagaaagggagaccttttccttgtgaggggtggtatgagaagtgtggagttcaaggttattgagactgacccggcagagtattgcattgttgcaccagacactgagatcttctgtgatggtgagcctgttaagagggaggatgaggagaggcttgatgatgttggctacgatgatgtaggtggagtcaggaagcaaatggcccagatcagagaactggttgaactcccactgcgtcaccctcaacttttcaagtctatcggcgtgaagcctccaaagggcatattgctgtttggaccacctggctctgggaagacccttattgcaagggctgttgccaatgagacgggtgcgttcttctttctgattaatggcccagaaattatgtccaagttagcaggagaaagcgagagcaatctcaggaaggcatttgaagaagcagagaagaatgcaccatcaatcatcttcattgatgagattgattcaatagccccgaagagagagaagaccaatggagaagttgaaaggcgtattgtttcacagctgttgactcttatggatgggcttaaatcccgtgcacatgttattgtcatgggtgctacaaaccgcccaaacagtattgatcctgccctcagaagatttggtaggtttgaccgcgagatcgacattggagtccctgatgaagttgggcgccttgaggttctcaggattcacaccaaaaacatgaagttggctgaagatgtggaactggaacatatttcaagggatactcatggggtatgttggtgctgatcttgctgctctttgcaccgaggctgctctccaatgcattcgtgagaagatggatattattgatcttgaggacgagacaatagatgctgagatactcaactctatggctgtgacaaatgaccatttcaaga

SEQ ID NO: 23569 - DNA, 1269 bp, Triticum aestivum
  Clone ID: PAT_TA_23569
ggctgtgacaaatgaccatttcaagaccgccctgacgacaagcaacccgtctgctctccgtgaaactgttgttgaagttcccaatgtttcttgggaagatattggtgggctggagaatgtcaaaagggagttgcaggagactgttcaataccctgtggagcatccggagaaatttgagaagtttggcatgtctccttccaagggtgttttgttctatggccctcctggttgtggtaaaaccttattggccaaggcaattgcaaatgagtgccaggctaacttcatcagtatcaaggggcctgagctgcttaccatgtggtttggtgagagtgaggccaatgtgcgtgagattttcgacaaggctagggggtcagcaccatgtgtgctcttctttgatgagcttgactctattgctacccagagaggaagcagcagtggggatgctggaggtgctgctgatagagtgctgaaccagctgctgactgagatggatggcatgaatgctaagaaaaccgtcttcatcattggtgctaccaacaggccagacatcatagaccctgccctgcttaggccagggcgtcttgatcagcttatttacatccctcttcctgatgtcgagtcaaggcaccagatcttcaaagcttgcctcagaaagtctcctttggccaaggatattgatctgagtgctcttgccaagtacactcaagggttcagcggtgctgatatcactgaaatttgccagcgtgcttgcaagtatgccatcagggagaacatcgagaaggacatcgagagggataggcggaggaaggacaaccctgaagccatggaggaggacgatgttgatgaggttgctgagatcagggctgcccacttcgaggagtcgatgaagtatgcgcgccggagcgtgagcgacgccgacatccgcaagtaccaggcctttgcccagactctgcagcagtctcgtggattcggcagcgagttccgtttccctgatcagccggctgcgggcgcttcctctgccgctgcggccgacccttttgcttccgctgctgcagcagctgacgatgatgatttatatagctaaatcctttcgcgttcgtagatgttgtgctccggtacgcagtacacggaagaactatgttcttaagttaatattgtgatgcacagttaatcgttctgcccgttatttccagctttatctttttttctgtgatgttgctttgagtagctttgcatttgtcatgccgtgttcatgtgcgctaaaatagt

SEQ ID NO: 23570 - DNA, 2734 bp, Triticum aestivum
  Clone ID: PAT_TA_23570
gctataaataatggcgaactaatcccctctctctcgcccacctccttcacttcccaaggcggaacgaaggatatccgcaaccccccgcagcagccccgccgagagacctagcggcgccggcgaaccccggatccgcccgccatggccgccccgacgccgcagggcgaggcctcctcctccgatcccaagtcgaagaaggactactcgacggcgattctagagcggaagaagtcccccaaccgcctcgtcgtcgacgaggccacaaacgatgacaactccgtcgtcgccctccaccccgacaccatggagaggctccagctcttccgcggcgacacggtccttcttaagggtaagaaaaggaaggacacaatctgcactgtgcttgcagatgacacttgtgaggagccaaagatcagaatgaacaagaccgtcaggaagaacttgagagtgcgacttggtgacgtggtgtctgttcaccaatgccctgatgtcaaatatgggaagcgggtgcacacgcttcctattgatgacacagttgaaggcattactggaaacttgtttgatgccttcttgaaaccatacttcctagaagcttaccgtcctttgaggaagggagatcttttccttgtgaggggtggaatgagaagtgtggaattcaaagttatagagacagaccctgcagagtattgcatcgtcgcaccagacactgagatattctgtgatggtgagcctgttaagagggaggatgaagaaaggcttgacgatgttggctatgatgatgttggtggagttaggaagcaaatggcccagatcagagaactggttgaactcccactgcgtcaccctcagcttttcaagtctattggtgtgaagcctccaaagggcatattgctgtttggaccacctggctctggcaagacccttattgctagagctgttgccaatgaaacaggtgcattcttctttctgattaatggcccagaaattatgtccaagttagcaggagaaagtgagagcaatctcagaaaggcatttgaagaagctgagaagaatgctccgtccatcatttttattgatgagattgattcaatagccccaaagagagagaagaccaatggagaagttgaaaggcgtattgtttcacagctgttgactcttatggatgggcttaaatcccgtgcacatgttattgtcatgggtgctacaaaccgcccaaacagtattgatcctgccctcagaagatttggtaggtttgaccgggagattgacattggagtccctgatgaagttgggcgccttgaggttctccggattcacaccaaaaacatgaagttggctgaagatgtggaactggaacatatttcaagagatactcatgggtatgttggtgctgatcttgctgctctttgcaccgaggctgctctccaatgcattcgtgagaagatggatattattgatcttgaggacgagacaatagatgctgagatactcaactctatggctgtgacaaatgaccatttcaagaccgccctgacgacaagcaacccgtctgctctccgtgaaactgttgttgaagttcccaatgtttcttgggaagatattggtgggctggagaatgtcaaaagggagttgcaggagactgttcaataccctgtggagcatccggagaaatttgagaagtttggcatgtctccttccaagggtgttttgttctatggccctcctggctgtggtaaaaccttattagccaaggcaattgcaaatgagtgccaggctaacttcatcagtatcaagggacctgagctgcttaccatgtggtttggtgagagtgaggccaatgtgcgtgagattttcgacaaggctagggggtcagcaccatgtgtgctcttctttgatgagcttgactctattgctacccagagaggaagcagcagtggggatgctggaggtgctgctgatagagtgctgaaccagctgctgactgagatggatggcatgaatgctaagaaaaccgtcttcatcattggtgctaccaacaggccagacatcatagaccctgccctgcttaggccagggcgtcttgatcagcttatctacatccctcttcctgatgttgagtcgaggcaccagatcttcaaagcttgcctcagaaagtctcctttggccaaggatattgatctgagtgctcttgccaagtacactcaagggttcagcggtgctgatatcactgaaatttgccagcgtgcttgcaagtatgccatcagggagaacatcgagaaggacatcgagagggagaggcggaggaaggacaaccctgaagccatggaggaggacgaggttgatgaggttgctgagatcagggctgcccactttgaggagtcgatgaagtatgcgcgccggagtgtgagcgatgccggacatccgcaagtaccaggcctttgccccagactctgcagcagtctcgtggatttggcagcgagttccggttccctgatcagccggctgcgggtgcttcctctgccgctgcggccgacccttttgcttccgctgctgcagcagctgacgatgatgatttatatagctaaatcctttcgctttgttgatttcgttcgtagatgttgtgctccggtacgcagtacacgggaaaactatgttcttaagttaatattgtgatgcacagttaatcgttctgcccgttatttccaagcttcaaaaaaaaagggggggcccggta

SEQ ID NO: 23571 - DNA, 1561 bp, Triticum aestivum
  Clone ID: PAT_TA_23571
ccacgcgtccgaccgcccaaacagtattgatcctgctctcataagattggtaggtttgatcgtgagattgacattggagtccctgatgaagttggccgccttgaagttctcaggattcacaccaaaaacatgaagttagctgaagatgttgagctggaacacatttcacgagacacccatgggtatgttggtgctgatcttgctgctctttgtactgaggctgctcttcagtgcattcgcgagaagatggatattatagatcttgaggatgagaccatagatgctgagatactgaattctatggctgtgacaaacgaccatttcaagactgcactaacgacaagcaacccatctgctctccgtgaaactgttgttgaagttcccaatgtctcttgggaagatattggtggtctggagaatgtcaagcgggagttgcaggagactgtccaataccctgtggagcatccagagaaattcgagaagtttggcatgtctccttccaaaggtgttcttttctatggccctcctggctgtggtaaaaccttgttggccaaggcaattgcaaatgagtgccaggcgaacttcatcagtatcaagggacctgagctgcttaccatgtggtttggtgagagtgaggctaatgtgcgtgagatctttgacaaggctagggggtcagcaccatgtgtcctcttctttgatgagcttgactccattgctacccagagaggaagcagtgttggggatgctggaggtgcagctgatagagtgctgaaccagctgctgactgagatggatggcatgaacgccaagaaaactgtcttcatcattggtgctaccaacaggccggacatcatagaccctgccttgcttaggccagggcgtcttgatcagcttatctacatccctcttcctgatgtcgagtcgaggcaccagatcttcaaagcctgcctcaggaagtctcctttggccaaggatattgatctgagtgctcttgccaagtacacccaagggttcagcggtgctgatatcacggaaatttgccagcgtgcttgcaaatacgccatcagggagaacattgagaaggacattgagagggagaggcggaggaaggacaaccctgaagccatggaggaggatgaggtggacgaggtcgctgagatcagggctgctcactttgaggagtcgatgaagtatgcacgcaggagtgtgagcgatgccgacatccgcaagtaccaggcctttgcgcagactctgcagcagtctcgtggtttcggcagcgagttccggttccctgatcaaccggccgcaggcgccgcctctgctgctgccgccgacccttttgcatccgctgccgcagcagctgaagatgacgacttatatagctaaattctcgttgttgtgccattgacttacccgtgatttccttcgtatactgttatgttttgctctggtacgcaagacacggtcaaactatgtacttaaaattattattgggatgcactgatattcgttacctgccagttatttgcagctgtatcttttcaaaaaaaaaaaaaaaaaa

SEQ ID NO: 23572 - DNA, 2707 bp, Triticum aestivum
  Clone ID: PAT_TA_23572
ggcgacccggagagagacgccgaaacctagcgacgccgccgacgacccccggatccgcccgccatggcgacccccaacccgccgccgccccagcaggacgagccctcctcctccgccgatcccaaggcgaagaaggactactcgacggcgatcctcgagaggaagaagtcccccaaccgcctcgtggtcgacgaggccaccaatgacgacaactccgtcgtcgccctccaccccgacaccatggagaggctccagctcttccgcggcgacaccgtcctcctcaagggtaaaaagaggaaggacaccatctgcattgttcttgctgatgacacatgtgaggagccgaaggtcagaatgaacaaaactgtcaggaagaacttgagagtgagacttggtgatgtggtgtctgttcatcaatgccccgatgtgaaatacgggaagcgggtgcacatacttcctattgatgacacagttgaagggattacaggaaacttgtttgacgccttcttgaaaccatacttccttgaagcctaccgccctttgagaaagggagaccttttccttgttaggggtggaatgagaagcgtggagttcaaagttatagagactgacccggcagagtattgcattgttgcaccagacactgagatcttctgtgatggtgagcctgttaagagggaggatgaggagaggcttgacgatgttggctacgatgatgttggtggagtcaggaagcaaatggcccagatcagagaactggttgaactcccactgcgtcaccctcaacttttcaagtctattggtgtgaagcctccaaagggcatattgctgtttggaccacctggctctggcaagacccttattgcgagggctgttgccaatgagacgggcgcattcttcttcctgatcaatggcccagaaattatgtccaagttagcaggagaaagtgagagcaatctcaggaaggcatttgaagaagcagagaagaatgcaccatcaatcatcttcattgatgagattgattcaatagccccaaagagagagaagaccaatggagaagttgaaaggcgtattgtgtctcagctgttgacccttatggatgggcttaagtcccgtgcgcatgttattgttatgggtgctacaaaccgcccaaacagtattgatcccgctctcagaagatttggtaggtttgatcgtgagattgacattggagtccctgatgaagttggccgccttgaagttctcaggattcacgccaaaaacatgaagttagctgaagatgttgaactggaacacatttctcgagacacccatgggtatgttggtgctgatcttgctgctctttgtactgaggctgctcttcagtgcattcgtgagaagatggatattatagatcttgaggatgagaccatagatgctgagatactgaattctatggctgtgacaaacgaccatttcaagactgcactaacgacaagcaacccatctgctctccgtgaaactgttgttgaagttcccaatgtctcttgggaagatattggtggtctggagaatgtcaagcgggagttgcaggagactgtccaataccctgtggagcatccagagaaattcgagaagtttggcatgtctccatccaaaggtgttctgttctatggccctcctggctgtggtaaaaccttgttggccaaggcaattgcaaatgagtgccaggctaacttcatcagtatcaagggacctgagctgcttaccatgtggtttggtgagagcgaggctaatgtgcgtgagatctttgacaaggctagagggtcagcaccatgtgtcctcttctttgatgagcttgactctattgccacccagagaggaagcagtgttggggatgctggaggtgcagctgatagagtgctaaaccagctattgactgagatggatggcatgaacgccaagaaaactgtcttcatcattggtgctaccaacaggccagacatcatagaccctgccttgctgaggccagggcgtcttgatcagcttatctacatccctcttcctgatgtcgagtcgaggcaccagatcttcaaggcttgcctcaggaagtctcctttggccaaggatattgatctgagtgctctggccaagtacacccaagggttcagcgggtgctgatatcacagaaatttgccagcgtgcttgcaaatacgccatcagggagaacatcgagaaggacatcgagagggagaggcggaggaaggacaaccctgaagctatggaggaggatgaggtggatgaggtcgctgagatcagggctgctcactttgaggagtcgatgaagtatgcacgcaggagtgtgagcgatgcagacatccgcaagtaccaggcctttgcccagactctgcaacagtcccgtggattcggcagcgagttccggttccctgatcagccggccgcgggcgccgcctctgctgctgccgcggacccttttgcatccgctgccgcagcagctgaagatgacgacttatatagctaaattctcgttgttgtgccatcgacttacccgtgatttccttcgtatactgttatgttttgctctggtatgcaagacacggtcaaactatgtacttaaaaaattattattgggatgcactgatattcgttaaaaaaaaaaaaaaaaaactcgagactagttctctcacctcggccgcgaccacgctaa

SEQ ID NO: 23573 - DNA, 2813 bp, Triticum aestivum
  Clone ID: PAT_TA_23573
gcaagaagagtctttatagctaaactaatcccctctggccctgcctcttcctcctcatcacttcgcctgctgcccacccagcgacccggagagagacgccgaaacctagcgacgccgccgacgacccccccggatccgccggccatggcgacccccaacccgccgccgccccagcaggacgagccctcctcctccgccgatcccaaggcgaagaaggactactcgacagcgatcctggagcggaagaagtcccccaaccgcctcgtggtcgacgaggccaccaatgacgacaactccgtcgtcgccctccaccccgacaccatggagaggctccagctcttccgcggcgacaccgtcctcctcaagggaaaaaagaggaaggacaccatctgcattgttcttgctgatgacacatgtgatgagccgaagatcagaatgaacaaaactgtcaggaagaacttgagagtgagacttggtgacgtggtgtctgttcaccaatgcccggatgtgaaatacgggaagcgggtgcacatacttcctattgatgacacagttgaagggattacaggaaacttgtttgacgccttcttgaaaccatacttccttgaagcttaccgtcctttgagaaagggagaccttttccttgtgaggggtggaatgagaagtgtggagttcaaagttatagagactgacccggcagagtattgcattgttgcaccagacactgagatcttctgcgatggtgaacctgttaagagggaggacgaggagaggcttgacgatgttggctacgatgatgttggtggagtcaggaagcaaatggcccagatcagagaactggttgaactcccactgcgtcaccctcaacttttcaagtctatcggtgttaagcctccaaagggcatattgctgtttggaccacctggctccggcaagacccttattgccagggctgttgccaatgagacgggtgcattcttctttctgatcaatggcccagaaattatgtccaagttagcaggagaaagtgagagcaatctcaggaaggcatttgaagaagcagagaagaatgcaccatcaatcatcttcattgatgagattgattcaatagccccaaagagagagaagaccaatggagaagttgaaaggcgtattgtgtctcagctgttgacccttatggatgggcttaagtcccgtgcgcatgttattgttatgggtgctacaaaccgcccaaacagtattgatcctgctctcagaagatttggtaggtttgatcgtgagattgacattggagtccctgatgaagttggccgtcttgaagttctcaggattcacaccaaaaacatgaagttagctgaagatgttgaactggaacacatttcacgggacacccatgggtatgttggtgctgatcttgctgctctttgtactgaggctgctcttcagtgcattcgtgagaagatggatattatagatcttgaggatgagaccatagatgctgagatactgaattctatggctgtgacaaacgaccatttcaagactgcactaacgacaagcaacccatctgctctccgtgaaactgttgttgaagttcccaatgtctcttgggaagatattggtggtccggagaatgtcaagcgggaattgcaggagactgtccaataccctgtggagcatccagagaaattcgagaagtttggcatgtctccttccaaaggtgttctgttctatggtcctcctggctgtggtaaaaccttgttggccaaggcaattgcaaatgagtgccaggctaacttcatcagtatcaagggacctgagctgctgaccatgtggtttggtgagagtgaggctaatgtgcgtgagatctttgacaaggctagagggtcagcaccatgtgtcctcttctttgatgagcttgactctattgccacccagagaggaagcagcgtcggcgatgctggaggtgcagctgatagagtgctgaaccaactgctgactgagatggatggcatgaacgccaagaaaactgtcttcatcattggtgctaccaacaggccagacatcatcgaccctgccctgcttaggccagggcgtcttgatcagcttatctacatccctcttcctgatgtcgagtcgaggcaccagatcttcaaagcttgcctcaggaagtctcctctggccaaggatattgatctgagtgctctggccaagtacacccaagggttcagcggtgctgatatcacggaaatttgccagcgtgcttgcaaatacgccatcagggagaacatcgagaaggacatcgagagggagaggaggaggaaggacaaccctgaagccatggaggaggatgaggtggatgaggtcgctgagatcagggctgctcacttcgaggagtcgatgaagtatgcacgcaggagtgtgagcgatgccgacatccgcaagtaccaggcctttgcccagactctgcagcagtctcgtggtttcggcagcgagttccggttccctgatcagccggccgcgggcgccgcctcttctgctgccgccgacccttttgcatccgctgccgcagcagctgaagatcacgacttatatagctaaattctcgttgttgtgcccttcacttacccgtgatttccttcgtatactgttatgttttgctctggtatgcaagacacggtcaaactatgtacttaaaattattattgggatgcactgatattcgttacctgctggttatttgaagctgtatcttttcatccgtcatactatgttgttttgcatcttgaatccttaaaaaaaaaaaaaaaaaa

SEQ ID NO: 23574 - DNA, 1135 bp, Triticum aestivum
  Clone ID: PAT_TA_23574
aggagagagagatagagagagagagagagagagagagagagagagagagagagagagagagagagagagagagagagagagagagagagagagagagagagagagagagagagagagcttcctctgcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggccgagtcactccgctacaagctcctcggtggccttgccgtccgcagggcatgctatggtgttcttcgctttgttatggagagtggtgctaagggttgtgaggtcattgtgagcggcaagctcagggcccagagagccaagtcgatgaagttcaaggacgggtacatgatctcatctggtcagcccgttaacgagtacattgatgctgcagttaggcacgttcttctcagacagggcgttcttggtatcaaggtgaagattatgcttgactgggaccccaagggcaagcttggccctaccaccccgctgcctgaccttgtcaccatccaccccccgaaggaggaggacgagctgcgcccaccggctttggttgaggtctaaagtcccaatagagcaagcagaccatgaaacggcacatcattttggtcctagctacttttctatccctgtgataagcgagggctatgcaacgcttggttacctaccttaccttttaatggacaaaagtttctgtgtaatgcttctatgttaatttcgtttaaactaagttttgccgagacaagttacttatgtatgccagaaacctttgtttggattgattctgcccagctagtttgttgctcttcgtttgtgcc

SEQ ID NO: 23575 - DNA, 1729 bp, Triticum aestivum
  Clone ID: PAT_TA_23575
tcctcctttgggggggttgatgtgacaaggtcaggcagcgggtggtaggccaagttgccctttggggtccccagtccaagcatatcttcaccttgataccaagaacgccctgtctgagaagaacgtgcctaactgcagcatcaatgtactcgttaacgggctgaccagatgagatcatgtacccgtccttgaacttcatcgacttggctctctgggccctgagcttgccgctcacaatgacctcacaacccttagcaccactctccataacaaagcgaagaacaccatagcatgccctgcggacggcaaggccaccgaggagcttgtagcggagtgactcggcctgggcgatggcgcagaggccacggttgacgaccttctcggcgtaaagttcaacgccgttctccgggaagttgaagcgcttctggacgacggaggtgagctccctgatcctgcggcccttctcaccaagcacgttctgcgtccgcgtggccctgatgatgatctccgtgcgcatcggcgtcacgcgtacctccacgccggagtagccgtcctcggcaagctcccgggtcagcatctcgttcagctcggcgtagaaaacgccatcgctcacaaacttcctcttctcttcctctgcccacaaaaccctagccgtcgcctcacagctcgccgccgacgcagcgagctcttcctccaccgccgcaaccatggcgacccagatcagcaagaagaagaaggtaaggaaccacctagacccagcatattccgccgtccccagcacgatctatcggtgcatcaaccgatctaacgatttcccgtttgcgcttgcgtagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggctgagtcactccgctacaagctcctcggaggccttgccgtccgcagggcatgctatggtgttcttcgctttgttatggagagtggtgctaagggttgtgaggtcattgtgagcggcaagctcagggcccagagagccaagtcgatgaagttcaaggacgggtacatgatctcatctggtaagcccgtcaacgagtacattgatgctgcagttaggcacgttcttctcagacagggcgttcttggtatcaaggtgaagattatgcttgactgggaccccaagggcaagcttggccctaccaccccgctgcctgacctcgtcaccatccacccccctaaggaggaggacgagctgcgcccccctgctttggttgaggtctgaagtcccaatagagcaagcagaccatgaaacgtcacatcattttggtcctagctagttttctatccctgtgataagcgagggctatgcaacgcttggttacctatcttactttttaatggacaaaagtttctgtgtaatgctgctatgttaatttcgtttaaactaagttttgccgagacgagctatgtattgcctgaaacctttgtttggattgattctgcccagctagtttgttgctaaaa

SEQ ID NO: 23576 - DNA, 613 bp, Triticum aestivum
  Clone ID: PAT_TA_23576
ggtcttgatttttcaaggcgtcagtaaaaaagcaaactcgctcaaggtgtgagacgatgcaggcgaggtggcggacgaggagctggacgcgacggtgctgactggtggtggttgcggtctgcagagctgggcggcgacggatctgggagttctttgcccagatttggcactggtggtgctcggggctgtgaatcggggcagaggcccagctaggcatgttcacggatgcgcgttaggaggtacgtggacgccggggcggcggccccgggatggcggcaatggcatggagctcgtcgtggcttgaggtgctacgttcaggttcgtgcagtggtggtggttggcggcagctggtggtggaggtgtgttctccagtgatcccgacgccatccggtgctctggatccgcaagttctgttatatggcgaggagctccggcgaaagcactgccttgaccaaggtcaggccgacgacggcggcgctactggcatcgtctaccttcttggaggcgtcgttgtggagctccgtcgacatcatgactgatttggctctccggatgaaaatgtttgcctcggtattccgaagcgggcggcggcggcgtctacgatcgtgacctc

SEQ ID NO: 23577 - DNA, 508 bp, Triticum aestivum
  unsure (1)..(508): unsure at all n locations
  Clone ID: PAT_TA_23577
cgcaggggtttccttcgcccttcaggcttcagagagactagtacggttcctagccaagggtcaaaaaaataatattagggttcctagccgccgccgtcccgccgccattactgccggccgtccgccgcggagcgcccagccggccgtccgccgcggagcgcccagccggccgaagaagcctccgctgccccgacgtcggtacaggatcccagcagcgcctccctccgtcgagcagctgctcccaccagcagcgcctccctccctggagcagccgaccccgcccagcaagcgccaccgcccggagctacgcgggcgaccaagtccatagatttccgctctttggttggcaatggtccgaatggaggtcaaactagcatttcccccaggacagaccggccactttccatcatttcggcttctaagattgcaggtggtttccgtaatcaattggatcccgacccttgcctcanggttcagtgcccaacactaanactttcaagttcctggg

SEQ ID NO: 23578 - DNA, 295 bp, Triticum aestivum
  Clone ID: PAT_TA_23578
acacacacacacacacacacacacacacacacacacacacaatctagtctcctgatctcgtctctcaatcccgtagatcacttccacagtagttagccagctagccagctgcctggattagccatgtcctgcttcgccgtgcccgtgcgcacctcgtcgtcgtcgttgaggataagcggcagcaggcagccgtggcggtggtggcgcaagtgcgcgggcctcgccgccgcggcgcacaccaagctccgccgcaccgtcttacgcgtccggtggtcggcgacggggcggctgggcg

SEQ ID NO: 23579 - DNA, 697 bp, Triticum aestivum
  Clone ID: PAT_TA_23579
aagccggggcgcgccgcgaagctagcttcaacttgaagatggaggagggctactacttctcgtacgcatccctctgcggcgcccttgcggtgattgtggcaggctggctcgtgtacaggtggatgaatcctccctgcaacaccgggaggctccctcccggatccatgggcttccccctcgtcggcgagaccttccgcttcttcaagccaagcccttctatcgacatcccagccttctacaagcaaaggctcaaaagatacggcccgttgttcaagacgaacctcggtggggcagccgttggtggtgtccatggacgccgaggtgaaccgcttcatcttccagcaggaaggcaagctgttcccggagctggtacccggacaccaccaacatcatcttcggaaaggagagcctcgcctcctgcgacggctccctccataagtttgtccgcagcttcgccgccaggctcggcggcgtcgacagcctccgggacgtgctcctcgccgaaatggagcagaacgtggcgcggagcttcgccgcgtgggccgcggagcctgcaggaatcgaggtcaaggacgcggtgtccacgatgatcttcgaccttatggccaagaagctgattggttttggccccgacagtcaaggaaacttaggaagaatttggatgtcttctttcagggaatggtctcttcccgctgtt

SEQ ID NO: 23580 - DNA, 739 bp, Triticum aestivum
  unsure (1)..(739): unsure at all n locations
  Clone ID: PAT_TA_23580
ctggtgccgaattcggcacnaggccattttacctcctcgagttcaccatggagatcagcacgagcgtggcaaggtgcactcgcatgccgtgcagcctccaagccctcgtgcccacgaaggcgaggcagacgcggcgcctgacgtgcaaggcaaccggcggccgcgtcgaccgccgcgacgtgctcctcggcctcggcagcgccgcggcggccgggctgggcgcgcagcggggccgaggggcgattgccgcgcccatccaaggccccggacctcggcaactgcaacccgcccgacctcccgaacacggcgcctgacaccaactgctgcccgacgtccggcaccggcatcatcgacttcgtgctgccgccggcctccctcgggcgccgctccgcgtgcgcccggccgcgcaactgggcaaaacgcggagtacctggccaagtacaagcgggccggggccctnatgaagcagctgcccgccgacgacccgcgcagcttccaagcagcaatggcgcgtgcactgcgcctactgcgaacggccctaacgacaagttnggttccccggacctggagattcaaagtncacaacttctggtcttcttcccaatggacaagttctactctacttcaacaagcggttctcggcaanttatcggnaacacccttcggctnccttctggaactggnaccccccggacggatacctccggnatttaanccacangcgtccccctntaaacaa

SEQ ID NO: 23581 - DNA, 737 bp, Triticum aestivum
  unsure (1)..(737): unsure at all n locations
  Clone ID: PAT_TA_23581
cccacgcgtccggttttttgttaaaaaaaaacagacaaatacgccgtccattcggatcggtccgaagttaaaatccctttgagaggagatgatccatcgtttttctacagccggcagcttgcttgcagcgttgatacaaaccgtcattatcaacgtccactcctaacagtggacgctacctaggcaagctaggaaaagcaactttccgatgaacaacacatgcatctatctatctatctgtctacagcactagttctacgcctacagattcgatgggaaatctgaagcaaaccagtcggcaactactaaataataaatgcttcctagatatatacaatcaacagcgacatctccctcccctcgctccgtagcacctccaccggccggctgatcctttccgcgcctctgtaagcacaagaacatattcttgggcctctatggttggccgccattggctcttccaggccgacaatccatctctggaatggaaaaaaaactatgttggcaatctaacttcttcctttgncgaatatatctatcttctcttggagtgtgagaggttttctgtacttctagttccagttgctcctttctgtcggtgcgtatatctcctccggggatccaatcttaaattgagaaacacaagagaaacccccatacgcaacccgagattagcctaaaggtccaaaatcccatcaatttccttgaagtggaaaaggcttgcaaagagggcattc

SEQ ID NO: 23582 - DNA, 523 bp, Triticum aestivum
  unsure (1)..(523): unsure at all n locations
  Clone ID: PAT_TA_23582
gaagaaggtaccatttgagtgcgggccatcaggcgtcatggacatcacagacagcgaagataatgtgaatgattgtttatcacaccctacagcaatacgttcaacttctgccctggaagatggcaacccggaagacagctcgcctgtcgtcaacatcgcactagacagcttgataagagaagcagagaggtacagcaggtcaggcaagcagattgttgacggttccactgcaaccagggattccatcctgggaacttgcaagtagaggtcaatcatctggcgcaaaagatgtcgaggatggtgcagcaacatactctgtttgttgtgctcaaagaccccaacttcgacaacaggcgtcaatgggcctaccctctgggcaccacttntcgagggagacccctcantttacctgggctcntcanactccntgcaataaacaaaagaactactcnttgagcattgggtccaataaagggnatcacnccggaaanactgttccgngctggggatttccacnaaaanc

SEQ ID NO: 23583 - DNA, 1381 bp, Triticum aestivum
  Clone ID: PAT_TA_23583
gcacgaggtgccttcaccgcgcgccgtcctgccggctgagggggaggcgttcctccgttcccccggagccaggacccctgggagggcgaggctggggcctgcagccgcgctaagggaagcaatttgctcgatgaagtttcatgatattaaggagttctcttacaaaccgccacctgcttcagaggacatttttgctgtatttgaggagctcagacagagggaagacaccgaggagaaggagattgggcagtgtaacggagatatccccatcggtcatgcaacaaagatccacacagttagtcctgaaaatgacatcttcctggaaaaaccatcaaagaggtatccccatcaaccctgtgccagaaatgaagacgaagatgacagcggatgggagactgtcagccatgtcgatgagcacggctcgcgcagcccgccgggtgggtctgggccttctgtgagccgttctgtggaggagacggcgcatcggtgagtggaccggactgcgacgacaattctgaaaactgcaggtccattagcggtatcagcgaagtatgttcgaccacagcagagttggaccggaagagagggccttctttcgccaggctctggagatcatcaaacaacgacaatggccgcaagaaaacaggatcagggttgttgttcgggatgctctccagtggcagaatgtcgaactccgctctttcgcccactctgaagggcagcgaggtgtgcacggtttcgccgagcgtgggcgagtggagcccggagctggtgaaccctcacgtggtccgcgcgatgaaaggtcgcatcgaatggccccagggcgcgaagaagcagagcctgaagtcaaagcctctggattcgagattcgacggctgcaaggtccagctgcgccaagcattgaagcagaagatataggatggcccgtccacacgctgtatccaatttctgaatataggacgatcttgccttggaagggtgcctgatctggaagaagaaatcacttgtagtaacattggtccctgaaatgggtgctatcatcggctgtacctaattgatgttctgatagccctttagctcgcatagaaaatttcacgacgcccttgtaatcaaatgtagtatcagtagtatttttcaatcaaacgcattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaggggggcccccaaagggttacaagtttattttcgcggaaaagagttgtaaaaccccttcaaaggggcccccaaatttaattac

SEQ ID NO: 23584 - DNA, 495 bp, Triticum aestivum
  Clone ID: PAT_TA_23584
gtcgtgcttaccaactaaacttactatcccttgcgtatgtaaattacaaaaaagacgcaaatctcaaacgttcgggacttatcgtagggcgataaattcccagccacttcgcctatgcctagttttcctttttaatcattgtgctggttgacggagacgagctgggcagggacggctgcctgtgactctgcgtagctgcagcaactaggtggcgagctttgcacacaagagagatgccacccctgcatagccctgtggatggagtcgctgtcctggtagtcgtcgcggaaggtctcgaggttctccatcatgccgcgcacgaacgaccccagcagctcgtgcctccacccctccacgcgagggaagtcgcagtacttctccccgaaatcgtccatgtacgtgggctcccgcctgccgatctcgtgggtgtacttgcggggcacgccggcggcgtccctggcgcggtagaactcctccacggaccgacgcatctcc

SEQ ID NO: 23585 - DNA, 591 bp, Triticum aestivum
  unsure (1)..(591): unsure at all n locations
  Clone ID: PAT_TA_23585
ctccgcccaacaccgacaccttgcgctcccttttctcgttcttcgtcttccatcctcgacccatttgcatttgcgtcgagtgagcgctaattttgggccgtttctatattaagcacggcaaaatatcgtttccgtccccgacgactatataattcccgcggaggcggtcaccgactcaccgtaataccagtgctcgatcgctcgcttcacgagctccctgggtctgggtggggaggttgaccagggcacctcccggatcctgaattaaggccaccgttcgtttcccctcccatcccttcccctcccttgcatttagcctctctccgttgtggggcgagccgcgcgcggtccattttcccaaccgtcgttccggtggcggccgggcgccaggttgcggtgagtgactcatgggcatccaggtcgcgcccccctccccatcctctctgggcgccggctgcgtgaggctgtcgagggccccgtcgtcgtcgtcgctgggcgaacctntagcgccggnatcggcccgccggcgctccggggcacccatggtgaaccncgcctcagcgcaagcatcgacagcgtcngangcaaggg

SEQ ID NO: 23586 - DNA, 784 bp, Triticum aestivum
  Clone ID: PAT_TA_23586
ttttttttttgtgacagcactcttccaatagtacagttatcatttacattctaggagcttttgtttgttctgactgaaaattcaatctttacatagcatgagatgagctcttgtcataatgagctacatcaaggggagacatggatagtgtacataatactataaaaaggtaaaataattggatgtctaagacataagggtaatgctagctatcagctccagacgagccggaaaatatcgtcaaggcagtggacataacatgtcaggtagaaacatggcccatttaaatagataacgtatgtgtcatgttggttcctccatgaagctggtgtgcccttttgttctgcttatatgtagatgcatcttgtttccaacatcaattgatttatgtttgactagcctttctctcctttcattttccgatcaaatggctatctgcgaatacattctctcaacgcaataactgagcttgtttcaagggtccacctaccctcatcacagcaagttctacgtcttaagctgatttcttcttggaaaagcaccttcagatcaactactttggtaggaaccattaggtcttacgttccttttccagattttacacccatctattggtaaattaaccatccaaaccatgacaagcaaatagatggttcttgtatgaagtgcatgcttgcactcctccaactaatactccaattgatcatgaaatccttctatgcaggttaagaatgggcactggttcatataccatcaccaacgtacctcggccgcgaccacgcta

SEQ ID NO: 23587 - DNA, 1077 bp, Triticum aestivum
  unsure (1)..(1077): unsure at all n locations
  Clone ID: PAT_TA_23587
gcctcgtccccgcgcacgcgcttgctcctggtgctcccgcgccccccgtactcccgtttcttcttcctctcgcgcgcggtcgctgcatattctcccacaccccaatttctgcatctacttcgtgtcctccgatcgcacccaacttcagcaagttaaagccgtgggttgtctctaccctacggcctcgtcaccggagggaggcggtgagatctcccggcggcatgtcgttggattcggactcctcttcgcagggaggcgaccgccggagcttccggcagatcacacgagaccgattattatttgaaatgctcaggtcgactaggaaggattcaaaatcagcatggaaggttcttatcatggataagtttacggtcaagataatgtcctactcatgtaagatggcagacatcacagaagaaggggtttcattggttgaagatctatacaaacggagacagccattgccttcactggatgctatatatttcatccaaccaactaaagaaaatgttgttatgttcctctctgacatgtcaggaagaagcccgttatacaagaaggcgtatgtgtttttcagttctcccatacagaaagacttagttgctcaaataaaaagggattcaagtatattacctcgtattggtgcacttagtgagatgaatttggagtacttccctattgattcccagggtttgataactgaccatgaaatgtcatttgaggagcttttctgggagagtgcagaaggcttcaacgaatacaatgcttgtttgaatgcaatggctactcgtatatctacagtatttgcatctatgagggaatttccccgtgtgcactaccgcattgccaagaccattgatgcttctacaatngacaacactaaggggacatggtgcccacaaaagattgctgctggtgtatggaatttcccctccccctatttaacgtcaccgcctgattccccgcagtcccccgcttcggcacgtctccctggagacccttcccccgatcagatcgcaccaataattcatgaatggacttatgatgccatgtgccatgatctgctatgcatgggtg

SEQ ID NO: 23588 - DNA, 551 bp, Triticum aestivum
  unsure (1)..(551): unsure at all n locations
  Clone ID: PAT_TA_23588
aaacacaacngaagcccacacaaacaggncggggaaaccaantacactagcatacccgaacgtgacacaaagtctcgagttttctttgctttcccttgaaaaaacccaaacttatgagtaaattttaatgaggacggggcgttcacccattggctgggcagctggggtagcttgccaccccactcgagttcaagccgcggctttaacgtgtggtgctcgggggagtaaattttagtagctcacgtgaacccgccattgaccctgatgacctgaccgttcacccacccggcggcgtcgctggccaggaaggccaccaccggcgccacgtccgtcgtctcggcgatgcgccccatggactgggcctccactctcttgaggaacgcctcgtccttgccggcgaggaacagctccgtgcgcacgggccctggagccaccacgttggccgtgatccccttggacgccacccccttggccaggatcctcgtcatggcctccaacggcgccgttggtcgccgtgtacgccgcgtagcccggcaggaacgtgcccatat

SEQ ID NO: 23589 - DNA, 937 bp, Triticum aestivum
  Clone ID: PAT_TA_23589
accaccgcgggtggagcgagctcattcagacttgaagaaagcagcagatcaacattggagtgatggtgctttggaggcagatctgcgacgagctgacacggcgcgtccgcgacgtgccatggaggatgctttcatggctttaaagtttgttcgggatattcatgacatgatggcaaccaaactacaatatcagttcatcacactggagaaaaatgggaagattcttaagttgttccctcgtgaagtttctactgatcaaatcgctgccatagaggatgcatatcttaatatggcatctgccttatctgaggctgatggtatcgactacaccaatcctgaggagcttgaattattagtagcggctcttattgacctggatgctatggatgggaaaaagagtgtttccttgatagttgaatgttcaagttctccagatgttaataccaggaaagctttggctaatgcattggctgcagctccatccatgtggaccctagggaatgctgggatgggcgcattacagagattggctcaagattccaatcccgctgtagctagctctgcagcaagagccattggcgaactcagaaagcagtgggagcttgaagagggtgacagtctgaggtttgtcatgaaccaaaacttgatttccgaagagactgacagcgagagttgagtagcagatgatatcaccacgtgaggtgtaaatcagatgaatgactcaacacgtacagactgtaataggaaccgaaaaacgtgtaactgagtcgactgcatttctctgtgttacgtcgcagcataaaatgtgctgcttgttaactacctcacgagaaggcatgtcaaggtacctggtaagtgctaaacaaatgtgaagtggtgtaatgcgaactcatttcctccgacccaattattatatactccctacgtcccataatat

SEQ ID NO: 23590 - DNA, 893 bp, Triticum aestivum
  unsure (1)..(893): unsure at all n locations
  Clone ID: PAT_TA_23590
caagcttcctatatttgttgttaagacaaatacgatggccccgagagtaaaggctggcaaaatgattgttggaagagataaacttgatgcaccatcacgcaagcaacctaaagttttggaaggagagatagagattgaagacgatgctccgaaacggaagccatcattggaggaaattgatgcattggaggaggcccggttggcaattgaatacattgtaatcccgggcggggagcccgtcgaactcctcccaaggtgttcagaaattgttgctcgtcagctggagctcgttgagagctaccagctcctcgccgagaccttcggaaccgaccccaattcgaggctgcagattcttccagtgaaaatagcaaagaagagctcggatcagggcgctcaggggccgacgtccaccaagaagaacggctcggatctgatcgtcagcgagaatggtggaggcttcagcttctcccggctgccatttctgccgaagtgacaccttagtttgacactctgatcaccgttgccggaaatgtaaaacaccattcttctcccttcttccccttgttgttgttgttgttgttgttgtacagcgctgtgcacagtggtgtaaatagtgttttaatgtccaagaatcgaaagagcaaagctaattgtaattgccttccattcttttaccaaataaagctcctcacatcctgtaatctgtagttgtgtatagctcagctggatttggtctgttgactgcaacctacattggggatgatgatgtaaaaaacagtttatgaagttttagtataacattcatataaagttatagcagcanaaaaaaaaaaaaaaaaaaaaaaaaaaaaaaacaaaaaaaaaaaaaaaaaaaaacaaaaaaaaaaaaataa

SEQ ID NO: 23591 - DNA, 487 bp, Triticum aestivum
  Clone ID: PAT_TA_23591
gaagttcctcattgacacgacgaagttgctcacaccgctggtgctgtagtgcatgaccaaggaccacgaggcgcctgacatgtctttggtcaccgccaaggtctacaagctcttcttggaggtgtagaactccgccgacaatgttccgcatccctgccaacatctccgtctccatggcccaggctgcaacacctaccaggaagcttcagcgcctgctgctagcacatgaagcgctcgtgcattgaattgttttagtcagagttcagataactgaatcagagaggttgctctagagctgcagtagtatacttcaaagttcggataactgaatgctacttcagatttcagctgactgaatgctcggccactggaagctgaacgctagaagctctaaaaagatattcagaagttcgaagaatactttcatagaagttcaaaattaagaaagagcattagaaaagcagttattaaaataaaaattaatgcg

SEQ ID NO: 23592 - DNA, 653 bp, Triticum aestivum
  unsure (1)..(653): unsure at all n locations
  Clone ID: PAT_TA_23592
atgaattacatcgcatttccaaagttgaccttctccccttctgcatactgaccttcttcctctcgcagcacacgcggggagcaggatacagagcggcatctcctccacgccggtgttcgcacaaaaccgaactaccccagtctcctcctcaacaccgctgtttcgccctcaatttccttcggcctcttctacatcggcgtcagctctctccgaccttcctcgtcaactctctctgaccttccccgcacctttcctctgctgccgcgcatggtgcttcgtggcatcccaagtgcctctccaaaacagtcgtgtgtagtgctcccctgaaatcctcatgtgtggaaagctatggcatccagctactacggctgtttctatttagcatttttcttcttctctttggaactagctgccgatttgccccggtctctctgacgtgctgctacatatagatgtgttgctcatgtggaaaatgtgttaactggaatttaacagccttgnacagaactgcangtgtgtgtgtgtcctaatttaacggtaaatttctcattttccccttttaanaaccattgagatcttcaaagacgtccaaggagttctacaacaactatacccaanccaacaaaacccccgngttctaaanggggttccat

SEQ ID NO: 23593 - DNA, 599 bp, Triticum aestivum
  unsure (1)..(599): unsure at all n locations
  Clone ID: PAT_TA_23593
gagatttgtccctcgccgccgccactctctccaaaatcccacctcgggatcctcccagatccccttctcctcggtttcctcctctacccaatcccgaaggcactgcggtctcctctgcttccctcgtccttgtttgatcccaggggcagccaccgcatcgctgttcccctgcctcggcctcgcgatcccgcgcctccctcctacagcccatgcaagtcaccaaggaggtgggttcccgtgctgcacagggagctcctcgatcgcccgggatccggttccccaggccgccggaccttcctgcaaagcgtncctcgccgggtgcccccagctaccgtcccaccctcagcccctccggcccaccacgccgcctctccgcgcccccccgctccccccccccccggccccgccccccttccggcgccaaccgcccccgccgccgccccgcccagaggaggctctccgccgatcggtcgctcacccgtctcttgggcgacgccggcngatctggccagcncccttctctttcccgcgctcacagctcaacaagctntcntcaacgccgcgtnacgtcantggctcgctgccaggaactccgaaca

SEQ ID NO: 23594 - DNA, 565 bp, Triticum aestivum
  unsure (1)..(565): unsure at all n locations
  Clone ID: PAT_TA_23594
cgtaacaaggggacgagactttacttccgcaggtgagccaaatattactacaacaaacatggaccagaaggggcgcggtattactgtatcatgtctgcgtatcgggaatcatcttccgctatacatcaagaggccagcgcaatgaaactgaacctgaagtctatgcaaagcacgatccatcggtgaagtccaagaaactgaagttcgtcaggcaggatgatcggtttgtgctgctctcttctgcaagtaccgcggccccctccccgctgctgtcccaaagcctgaagaaacactgacctaagttgcctcaattgtcccaataattcctcanctgcgacatatggangagcaacccgtcncgggctaatcctgtggtgctgctcctcatgatcangggaggaggcttggntaannccaaccgatttctncaaggaacactttgatgtttcaanaaggcgaccccnttgccttccttaacttngcncacttggnaacacaangttanccgacttntntcaacaagccatttgaaatcaaggcaattgttatttggancngcacaaca

SEQ ID NO: 23595 - DNA, 1632 bp, Triticum aestivum
  Clone ID: PAT_TA_23595
gtccctgccggctcccggccggcgcccccaaaacccctgatctgtcgccagtacgcacacatccccacccccaacctctcctccccagcccgacgccgccccgagcgagccaggggcgccggagacgcgccctacaagagccacggaatcatcggcgaggaaggggcttcaacagtggtggaccagcttgctggacatctcccctccaatccccctgctattaacgtcacaggatccggcatcaatctcggttggatctgattcagatgtaacggctgaccagactgatacttctggtgtagcgcattagcagctggttgcgatgtgcacagatactactcttcgctgctgtttcttttctctgctcttcaacggacatccaaatgttgccatttgggactcttcgggacccagttagggataagtatgggacccgtccgtctctttctcctgaggatcgttcttgccacaactacatctcttttccatctcatcggcgccttcttggtggattaaaatcctttataccatgtctcatatcttgtggatgaatgttcgattggcttttctggagttataatttcaatgatagtaattgagacgagcctgagtggagtgcaatatcgaagtgtcttcggtctcttcaatgtccctgcaaaatggtatgcatggattttgctgatactgtttcagtttctcgctagtaatgtttcattactggggcacctctctggcatcttgtctggatttgcatacacttatgggctgttcaactacttgctgcctggaccatcattttactcttctattgaaggcttgtccatgctatctgtttgtgttaggcgtcctggctttattctctgtactggaggaacaacatatggccagcttcctacacattctaacatgtccactccacccagcgctctgataaatgcaaatttcttgagaaatatttcgtcatggatgccaagtaggcggacatccactgttcagacgtctactaatcaggaacaagaagacccgagatttccagggagagggcggacgcttgcttctacaggaactgaaccaactgcaagggaggccaatgcaaatttgcatgctaggcatacggcagcaaacactgtccgagctgatgcaacagtaacagctgaccagactgatacatttgatgaagagcttaagaagctggttgggatgggctttgaaaggactcaggctgaagttgctcttgccgctgcggacggagatccaaatgttgccattgagattctcatgagccagcaggattagggattagccacacaattctatatcaaagtgagtgcagttatcgagcagcatatctcttgcttatctggaggttaggttcagactgtggatggatagtggactttgtagaggagatgttggtgacagagtggttttcagaaaatgtgccattgattatgcagtttgtataggcgcagaagctactgcgtagtgcctgcttgcatttgtccaagcttatgtagtacttgaacatggaagtgtcaagggctccagttccaggcatcagttgactgatttcatcaccgcgcgcgtataacctcagactcgaaagtattgtccaaaatgatgacgctgatt

SEQ ID NO: 23596 - DNA, 556 bp, Triticum aestivum
  unsure (1)..(556): unsure at all n locations
  Clone ID: PAT_TA_23596
cgccaacgccgtcgtctaccgcgcaatcttcctccccgccaaccgcaccatcgccgtcaagtgcctcgatctcgatcgaatcaacagtaacctcgatgatgttcgcaaggaggctcagatcatgaaattgatagaccatcctaacgtcatcaaggcttattgctcatttgttgtcgaccacaacctttgggtcataatgcccttcatggcagagggttcatgtttacaccttatgaaggtcgcacatcctgacggcctggaggagcctgtcatctgctctattcttaaaagaaacactcaaggctctcgcttacctccatggccaaggacatatccaccgagatgtttaggcgggcaatatccttgttgatagccctggtgtagtgaagctgggggactttggcgtaacctcttgcttgtttgacaaangcaatngcaaagttcaagaataatttntgggaaaacctgcttgatgtccagaattctccacccggaacggttataatcnaagctatattggcnttggaaaactcactggagctgnnatggcacctcc

SEQ ID NO: 23597 - DNA, 559 bp, Triticum aestivum
  unsure (1)..(559): unsure at all n locations
  Clone ID: PAT_TA_23597
ctaagccagttttctttaattgatcaacataaccagttcattacaaatttacaatacaacagtagagggaatggaaatgaagatagcaagtttgggcactaataggaaacccgctgctgagtgctgctctcgagcacccactacggggcaaaaacctattagcactacccaaaagagtctagagcagcatgacagaaaaattaaggattacagcaaagtacagccctccagcagcagaagacaacgggaggacacgaaaagagcatgactaggcacggagctctaggacatgcttcatcttgttgtgcatctccttctgatcccagtcatccttggagcccttgtgcgaggtgcaacatccaagagcttcttgagagatccaagggcttcgatgccacgaagggaccatactcaagctccgaagagtgacacgatgtagattccatcaaatgcatggaatggcgcctctttaatctcagttgcttgacatcaagcatgttctcaaagacaaggtcctcagctcaagagaanaccagcagaangacaatgtcctgcacgc

SEQ ID NO: 23598 - DNA, 294 bp, Triticum aestivum
  unsure (1)..(294): unsure at all n locations
  Clone ID: PAT_TA_23598
catgtccacactgccgccacgtcactgcaccgccgccgggacagcttgcttccccactgcctcgcgccgcctagagctcgtcctccccgccgccggcggcagtcgctcgctcgcccgctcgccaggaaccccatctcccgccggccgccgcaccgttctccgccgaggaaagcagcaggcagcagcagccaaagcggaacagcgcgggccgagggaggggtaggtgaggggggagatggnnggcgccgggaggaaggtggcngtcgccncnntgcagttngcctgnancgacac

SEQ ID NO: 23599 - DNA, 984 bp, Triticum aestivum
  Clone ID: PAT_TA_23599
tcgccccgagatccatctgctccgtttcttgggtttctcggcgctttggtgcttcgctacgcatcccgttgcccttgttgacaccaggagaatccgggggcttcacgaggggactagctagctggagtttggaagcgatcattctatgacgatctgcgcgggcttcgattcctaccgggcgtcgccggcggacatgcgagtcgtgacgtcggacgggcagagcatcgccgcgcattcctacgttcttgcctcggcgtcgccggtgctggagcggatgatcgacagggcgcagcgcgggtggggcgccgagtgcaccatccccgtcctcggcgtctccttcgacgccgtccacgccttcatccacttcctctactcctccaagtccaaggtggtgcccgcggaggaggaggcggtgggcgccaactgggcgcagctgctggcgctggcgcacgcgtaccgggtggggtggctgaagcgggcggcggaggcggccgtgtcggcgcgcctgacgccggagcgcgccgtggacatgctgaagctggcgaggctctgcgacgcgccgcggctgtacatgcggtgcgcgcgcctcgcggccaaggagttcgcctccgtggagcagtccgacgggtggcgcttcgcgcggcgccacgacgccgcgctggagctcgagctcctcacgctcctcgaggacgccgaccagcggaatgagcggtgggcgcgcgagcgggccgcgcaggaggcgtgccggcagctgggcgaggccatggcctccctcgagcacatcttccccggcgactccggcgccaaggccggctgcgcggacgcggacgcgccgtgcgcgagggcagggtgcacgtgccggggcctgcaggtgctgatgcggcacttcgcgacgtgcccgaaaaagatggcgcccggtgggtgcgcgcggtgcaagcgcatgctgcagctccctcgtgccgaattcggcacgaggcctcgtgc

SEQ ID NO: 23600 - DNA, 830 bp, Triticum aestivum
  unsure (1)..(830): unsure at all n locations
  Clone ID: PAT_TA_23600
cttgccggtcacaaagtgctggaagtattcaatcaggtgttatagctcctgttgttagctacatggtcgatccaagaaagggaaagaaaaatgccagccaaattgaaaatatccatcagctgcgtttgctgcataatagatacttgcaattgcgtcttgtaaatgctcgttcggaagatgttctatcttaccaaaaggccactgctgagaataccatatataatgtttggaggaatacttcaaacttgagggatgctgttaatttgcgaagaatcatggtgcagcatcatcgacaagagttgaagctgtatggcattctgcaagagcagattgcttgcctcgaacaatggccagcacttgaagacgagaataacctttccttttctcgggcaacagaggctctaaaaagcaagtacactgcgccttccagtcacttcaggggcaagggtggatgcagttagtcctaagaatgctgtaagctcagctgttgatgtcatgcaanggttggggaccgcagtttggtccatgctttccaaggcccaanaccgggcatgtttgatctcggantttcantcgtancaacacaagaaaaggtatgctttgacaatgcaaanaactnttactntggccgaaactggaggtacaggagtntacctgcggcacatntatgcaagtaangacttggcaaatgaantaccacctgggtaagctttccaaaacccaatntttttgataggcncctggcaagtggcctggntttaaacatctgngcaacaaaaggacccnnngaaaaaacaaacgacngtttactccccgccaaagggggantt

SEQ ID NO: 23601 - DNA, 489 bp, Triticum aestivum
  unsure (1)..(489): unsure at all n locations
  Clone ID: PAT_TA_23601
cttgctcgcccccctcgctcctctcctgcacccccacgctcttcccttccttccccagatccgccgtcgagcgccaccatcgccatggctccggcgtagccgcgcctaccgtcatccccgcgtctcgcctccctgtccattcgcctcgcgggcgtcttcttcaccgtctacgccaagcgcctggagccggggagcacggcaagcgctcgctccaccgtcggacgcaccggagctcaccgtcgatccacgccgccccgagaacctcgagtcatccccgggcctcctctgcaacgccacgctggtgacggctgtcgatgccattgtgatcgactacctcgacgacgacccctcctttctcgcctgaagcaaccaagattgggggattccttgggagccaagatgctaccatccgcgcgggctactacttggaggcgcggggcacacgggtagttcggagggctgggcangaggcttgcctcntcgattgtg

SEQ ID NO: 23602 - DNA, 813 bp, Triticum aestivum
  unsure (1)..(813): unsure at all n locations
  Clone ID: PAT_TA_23602
ctcgcgtcgtgggaccccgccgcccacgccaaccactgcaactggaccggcgtcgcctgcgagggcgccggcgccgggcgcgtggtcacgggggtatccttgccggggctgaacattagcggcaacgtgccggcgtccgtgtgcgacctggcgaacctgacccgcctcgacctctccaacaacaacctcaccggcggcttccccgcgctgtaccgctgctcccagctccagttcctcgacctctccaacaacggattcgacggggtcctcccggatgacatcggccggctgtcgcgggcgatggagcgcctcaacctgtcggctaaccacttctccggcgccgtgccaacggcggtagcggggctaacggcgctgaagtcgctgattcttgacacgaaccagttcaaccggggcgtatccggcggccgagataagcaagctcgccggccttgaggagctgacgcttgcctcgaaccctttcgcgccggcgccggcgccgcgcgagttcgccaatctaaccaacctgagctacctctggatgtccggcatgaacatgaccggcgagtccccgaagcactacccgtgccttctgatgccccagatgcgcgctacgacggcgatcgaccgccccggcgagaccccggcctgggcctggccgcgccctcccctcgccgggttgtacctgttcaccaacggactcaccggngaagcttccgcgcaatatctcggnggtgaatttatagagattgatgtttccgtgaanaactccgccggngaaataaccgggagacaatggnaacctcaaaaaacncn

SEQ ID NO: 23603 - DNA, 625 bp, Triticum aestivum
  Clone ID: PAT_TA_23603
ccatcgtctcacatcgctgccacccttccccttctcgcctccctccaatagctcgccgccggccctccacctcccctgctctcacctcgtagcaccggtagctgccagatccgctgaatcccccagccatccatccctctccaacccatgcctagggttttttcctccattagattggtccctcctgcacgctcatcttttccgggatccgtcgcaacctcgcctcacctactccccctcgctctcagatcaaccagaccaggctcctcccgtgggatccatggcgtgggttgccctattgtagctgatttgtgatgagcgaggctgggaagaggtgttccttttggtgtgccgcacggttcgcgttccacgacgtccttggctagatgtatgtcacttcttcagcacgtacaaattcacagggtagtgaagatcaagaagctgcaagctgtacgaccacggtggtggctgctaggggaccttggaggtgttgcttgaagtcgtcccgggggcacaactaggaataaagatgatggattttgtactactgtatttctgaaaatgcgtgtacacagaattgcaatccgaaggagcaatgtttgacacttagtctgtgttattggag

SEQ ID NO: 23604 - DNA, 628 bp, Triticum aestivum
  Clone ID: PAT_TA_23604
cgtgtgcgtgcttaggccacagcaaagcaatcactcggccggccgtctcatctcatggagatagaagcgacaccgctgagcccgcagcagcaagcatacaatgacggtggcggttcggaccaacgggccggcgccggcaccggcgctaaaccactctaccgcaaccccgtcgtggtcgtcaacttcctcctgatggctgttggcacggtgtgtggcccgctcctctttcgcgcctacttcctccacggcggcacgcgcaagtggctcacctgcctgctccagaccgctgcgtggccgctcctgctcccgccgctctgcgtctccttcttctcccggcgccgccggcagcgcgaagagagcgccacggaggccgctcctctctccctcatgtcgggccgcctcctggccgccaccgtggccatcggcctcgtgatcgggatcatcgacttcctctacgcgtacgggctggcctacctcccggtgtccacctcgtccatcctcgtctccacgcagctggccttcacggccgtgttcgcgctggtggtggtgcgccatcggttcaccgctttctccgtgaacgcggtggtgctgctcgtcgtgggcgccgccatgctggggctgaacggcg

SEQ ID NO: 23605 - DNA, 595 bp, Triticum aestivum
  unsure (1)..(595): unsure at all n locations
  Clone ID: PAT_TA_23605
tttttttttgaggggggtgggggtgtctagcctttgtcatgaaacagtcgatattgttcttacattatcaacatcaggatatcccggataccacttctttcctgtcagcatctctataattatgacaccaagactatatatgtctgattggtatgtgatcgtgcatttgtctcctctatgaaactctggtgccatataccccaatgttccagccatattttcggtaataacttggctttgcttttcatcgaagcaccttgacagaccaaagtcagcaatttttgggtgtcatgttgtcatccaacagaatgtttgctgggcttgagatctaagtgaacaatgcaattctggtgaaggtaatgttaaccctcacaaatacctttattatccggatagctctttaccaatcaagtctagaagatgtaccttgatatacccatgaagactcctttaggtacatacccaagaaacaaagaactttgatgtatactgcatgacaaaactcatgtagtttcatttggcctgtagtagcacataccaaaacggcnngttgtgtgcttacccacaacaatgattctcattaattatacaggag

SEQ ID NO: 23606 - DNA, 683 bp, Triticum aestivum
  unsure (1)..(683): unsure at all n locations
  Clone ID: PAT_TA_23606
gaaggacggcgcctccggctgggctgagcagttgaggaacctgtggtccagagagcgcaagaccgccgggatgcagagggtgagcaccaagctgcacatctcgctggcggagctcaaggccgccacggacaacttccaccaccgcaacctcatcggcgtcggcgggttcggcaacgtgtacaagggcgcgctcgcggacggcacgcccgtggcggtgaagcgcgccacccgcgcctcccagcagggcctgccggagttccacacggagatcgtggtgctgtccggcatccggcaccggcacctggtgtcgctcatcggctactgcaacgagcaggcggagatgatcctggtgtacgagtacatggagaagggcacgctgcggagccacctgtacggctccgacgagccggcgctgtcgtggaagcagcggctcgagatctgcatcggcgccgccaggggcctgcactacctgcacagcggctactccgaagaaatatccaccgcgacgtcaagtcaaccaacatcctcctcggcaccgacggcggcggcagcaccggcggcgggccgttccgcgccccggcgcctcgtcccgcgctcgcccgcttcgggccaccgctggggggctcgcgcgaattcgtactcaccnatatnaaaacanaataagacgtcgannaacctnggng

SEQ ID NO: 23607 - DNA, 506 bp, Triticum aestivum
  unsure (1)..(506): unsure at all n locations
  Clone ID: PAT_TA_23607
gtttcatggaaggcccggtcagagagaagccagcggaagacccacgcgtccgggagaaaggaattctcgcgtggctggacaagaacatgtagctagtgttgaacatgggaggtgcacgccaaccaaatagctgaaacagctttttctgtaggaaaattccttccgcggtgaagttctcaatgagttaataagcttagcatatagcacctcacttgcctcttaaacctgatgcaacttgttctgtttcatcattgtcatctcatctgtgcagtagcacaaatctttgcttgatctgacagtatgttacattttttgtaaaatcanannaaccacataaaatggataccatttatnatatacattgtactattaatttgtacagttacctgacagtggncaagngaacttttccctgcccggnnatttcctttttaatcagatggntnactanaaatttgttgnggaaaaaaaacanaaaaacccaggggggccnggtccaattcccc

SEQ ID NO: 23608 - DNA, 544 bp, Triticum aestivum
  unsure (1)..(544): unsure at all n locations
  Clone ID: PAT_TA_23608
cggtcgatcgtcggaaaaccaaaaacagacgaggaaatctgtcccgaaacctagatacatacagccggttcccaacttgaccctgatctcggcccagagtaaacgcacgcgtcgtctgctctcgatccatataagctacgcctatcccccgtctctgcgatccacacgcgcgcgcgcaccgatcgatccaactcatcgctgcaaccaccagccatggagctcaagggtacaccactgccgcccaaggacgagttcgccgcggagaggtcgtcgtcctcctttaccgtggaggtgaccgtgctttccgcggaggaagtcctcatccggggacgccttgcgccgcccgctggaccccgggcggccgccgccctcgctcgggggcggggcggggccgcacgcgtccaccgcgtccagccgctgcacggggcccggctgcggctaccctcccggggcctgccggggcccatggccgcgcccgggatcaacgcnaaaggaccntgcnaaggaangtncggtcccnantanctcgtcccagcactgattn

SEQ ID NO: 23609 - DNA, 444 bp, Triticum aestivum
  Clone ID: PAT_TA_23609
aggcacagcaactcgcgcgagtcttcgaaaccattggggcgttcaaggtgccacgtaaaggtggcaaaggaaagcagatcttcgggagcgtcacggcgcaagatctcgtcgacatcatcaagtcgcagcttaacagggacgtggacaagcggctggtggaggtcccggagatccgcgaggtcggggagtacgtcgcggagatcaagctccaccccgacgtcacagccaaggtgaggctgactgtgtatgccaagtgagcagtctgatctcgccatatactccgaacgtcctgcaactgttgtgcctgggagctatagaggatgggttttacaaaaatgttgttcatggccttgtatgcattaggagaagcgtggagaaagcgaaagctgttgaaatatttacaagtgaatatatgaaatccttttttgttcccccccccccacc

SEQ ID NO: 23610 - DNA, 1009 bp, Triticum aestivum
  Clone ID: PAT_TA_23610
cgtccgcggcggcggggacgcacaccgcaatggcgtcgccgtcgtgtgcctccacgctgccctggacccgccgccgccccccccccctcctccgccttctcctccccgctccgcctccagacgcgccgcgccccctcgctggtcatcgtcgcccagggcagggtcaagaagtaccgccaggtcatacttaaggacgacatcgatgagataagtggcaagaagggcgacacgatgaaggtccgggccgggttctaccgcaacttcctgctccccaagggcaaggccacgctgctcaccccggacgtcctcaaggaaatgcaagtggagcaggagagaatcgaggctgaaaagaagagggtaaaagaagaggcacagcaactcgcgcgagtcttcgaaaccatcggggcgttcaaggtgccacgtaaaggtggcaaaggaaagcagatcttcgggagcgtcacggcgcaagatctcgtcgacatcatcaagtcgcagcttaacagggacgtcgacaagcggctggtggaggtcccggagatccgcgaggtcggggagtatgttgcggagatcaagctccaccccgatgtcacagccaaggtgaggctgactgtgtatgccaagtgagccggtcgcaaggagggcattcagtggatggtgaggtctgatctcgccatatactctgaacatcctgcaactgttgtgcctgggagctagcgaggatgggttttacaaaaatgttgttcatggccttgtatacattaggagaagcatggagaatttttaccaagtgaatatgtgaaatccttttttgttcatttgccggcagagatccattttgctaaataattagattttccatccattggttgacgccaaaatcatcatggtcctctttccttttgcgggtgcctcgtcatgatcctacttgtattgtgtacccaccccgggggtccttttcctccctgtaataatactattaaaaccaaagaggcacacgtcggggttgggg

SEQ ID NO: 23611 - DNA, 618 bp, Triticum aestivum
  Clone ID: PAT_TA_23611
gagctcggggggatatctccagcagagcccccggctccaccccagaatccccccacagacccccctccgtctccctgcgcgtcgcagccgcatcctcgtgcttaagcttctcgccatcagctgggagagatatcttgagcagagcagcaggaggagccacagcttcagccttcaggtcgcgcgtcagagcaccagcagccggcaagatgcagatggtactgataatctcgctgcccctcgtggcgctggtggtgatcatcgccatcatcctttgcatcgtctgccgttaaccagccagccagctcgcctcgccggatgttgcgtatcatgtagcctcgtagtagtagtgttgttgctgcgtctgtctcatactgtcatcgtgtattttgtctgcagctcttgctcggtgtgatcgctatccccttttctcctactagcttctcgacatgaaatgtactattgagtattgattgatccatgtgtctgttcgtgtgtgtgcgggtgtcagtacagtgcatactgccgtgtaatgtaagctcttgactttgtcgcaaaaaaaggaagctcctgaagaattcttcaaaaaaaaaaaaaaaaaaggcccctaaaaaaaaaaaa

SEQ ID NO: 23612 - DNA, 656 bp, Triticum aestivum
  unsure (1)..(656): unsure at all n locations
  Clone ID: PAT_TA_23612
ttttttttttttttttagtttcaacgtctgcacacttacgtatacggaacttaccaaatatacaggcttattctggctagctactatactagcacgtagacatagacacatagtattgacttagtaatgatcgatcagccttatagctcctggcactcgtgccggtttccgcacgtgcgtaagtcggtcttgtcgtgtcgtcgtctcgtgatcaggtctggctccgctcggccgatcagctgctggggccgccggtccaccacggcgcgctgggcacgtacgggccaggcggagccgtcgccggaaaagggtggccgtatggtattggtgcccangcagggggcggcgggcccgggtagtaggacggcaccggaggagggtacccctcgacgtagctgctcccggaccaaggatggcccggcggcggcgcctggtcctggacccgcgcggcgcgcccctggccccggcgccgcggcgagcgtcggcctcccccgccgccctccgcgcccgcccccccctgccgggccggatcgcccctcgctctccgcggcctcgggcggctccgaggcccgaagggccaatcttcttcnttgccctgtgggcngtccttggaaggctntttccgggaaggcggctccgggggtcccgctgtggnn

SEQ ID NO: 23613 - DNA, 444 bp, Triticum aestivum
  Clone ID: PAT_TA_23613
cccacgcgtccgcggacgcgtggggcagcagcgagctgtgagctctagctctgaagctcaagctcgagcttgctagcagagcgccacgcagcaataccatggcggcatcggtggcctgcgccttcttcttcgacgccgagccggccggcgagcccggcaagcacgcgctggacgcgtgcgcgctctgcgccaagcggctggcgcgcgacagcgacgtcttcatgtaccgaggggacacgcccttctgcagcgaggagtgccgccacgagcagatgcacctcgacgccgtctccgccaggcaggccgcgcggaggctgcagcgcttctcggcggagacggagtcccagtcccaccgtgggcagcggccgtccaggaagtttgcagggcacggcagcatcaggtggcaggtgcctgcagcttcccgtatgtgtccatggcaagcta

SEQ ID NO: 23614 - DNA, 765 bp, Triticum aestivum
  unsure (1)..(765): unsure at all n locations
  Clone ID: PAT_TA_23614
aactcccatcccggcgcccaaagcacacgtcctcaggccacacgaaaacacatggcctgcgccttcttcttcgacgcagaaccggtcgacgagcccggcgtgcactccctggacgcgtgcgcgctctgcaccaagccgctggcgcgcgacagcgacatcttcatgtacagaggggacacgcccttctgcagcgaggagtgccgccacgagcagatgcaactcgacgccgcctgcgccaggcaggcggccagggcggctgcccggaggcagaagcagttctcctcaggaacgggggccgggcgcgcgcaccgggagtcctgggaggtgtccgtcgcaagctaagcggcgagagtggcagagtgcgtatgtacttgagctaacaagctctgcgcgcaagaagccaccattgcccgtgggccgtggacaactgatcagcgcgagatcgagaagactcaccttggttgaagaagcaaaacgcgtgtcaccggagttgctcgcggcaggccggtgctgcatgtgccgccggtcaggtgatttgggcatggacgacgcggaaaaggagctggactggatctgaagaagtcaatcaaacaagattcagtgattcaccatgcaattaggcggccatgtgtgcccctcccagtccctcggccctcttttctcctgcgtcagtgccacttctgtatgatagcaagtttgctttaggcaatagcactttcacagggtaaaccatcaagcgaatcggcatataacatgtntttgtgc

SEQ ID NO: 23615 - DNA, 675 bp, Triticum aestivum
  Clone ID: PAT_TA_23615
cccacgcgtccgcttccccccgagcagcagtgaactgtgaatctagctctgaagcagctcaagatcgggcttgctagaagaagccattcgcccattcctagtctcttcccagccatacaggctacagcaataccatggcggcaccagtagcatgcgccttcttcttcgacgccgagccggtgggcgagcccggcatgccggcgctggacgcgtgcgcgctctgcgccaagccgctggcacgcgacagcgacgtcttcatgtacagaggggacacgcccttctgcagcaaggagtgccggcacgagcagatgcacctcgacgccgtcttcgccaggcaggccacccggaggctgcagcggttctcgtcgggagcagagtccgggcgtgcacacccagggggtgtccgtctcgagctaaccggcgagagtgccaagcgacatacgtgcctgacgaagaaaggttattatgcttgagccagcatgatctccgtgcaccaagccgctggtgtcccgtggttagctgatcgagcagcgcgcgaggtcgaggagacttgccatgcttgaagaagcaaggggcgggtcgcaggagtcgctcacggcaggccggcgctgcatgtgccgcctgtcaagtgatttgggcataaacgcagcggaaaaggggctggattggatctga

SEQ ID NO: 23616 - DNA, 810 bp, Triticum aestivum
  unsure (1)..(810): unsure at all n locations
  Clone ID: PAT_TA_23616
gncggncgggttccgggcaccaaactcacccatctctttcccccgccaagagcagcaacgagctgtgtgttcttgctagctctgaagctcaagcgcgagcttgctagaagaagcatctctccccagtctgccatatagcagtaccatggcggcatcggtggcctgcgccttcttcttcgacgccgagccggtgggcgagcccggcatgccggcgctggacgcgtgcgcgctctgcgccaagccgctggcgcgtgacagcgacgtcttcatgtacagaggggacacgcccttctgcagcgaggagtgccgccacgagcagatgcacctcgacgccgtctccgccaggcaggccgcccggagggtgcagcggttctccgcggaggcggagtgccaccgtgggcagcggcagtccaggaaggtgtccatcgccagctagccgcggaaagtctttgtttggatcgacaagatctgaatgaattctgaagaaaacgacctctgtattctgaagaaccatcgatgtctcttgggaggcgtctgatgtttccgtctctccgggtaccagatgcagcctggcgccgcctacgagaggcaaggcagccaggcagggcagcatcagtcggcaccaagcatcataggagactgtagctttccccatgtgtccatggcaagctaattaagctgcccggataggaggaaattctacttgttcttgatcgatctgtgctgtgccgatgaagtgttatttgattagaaatgaaaacagaaaagtaaaccccatggatctgaagagagcaatcagacttgattccc

SEQ ID NO: 23617 - DNA, 772 bp, Triticum aestivum
  Clone ID: PAT_TA_23617
gccggccgggtccgggcggacacgtgggcggtttccttcctcccgccatgagcagcagcgaacgcaacctgtgagctctagctctgaagctcaagctcgagcttgctagcagagccacgtagcaataccatggcggcatcggtggcctgcgccttcttcttcgacgccgagccggccggcgagcccggcaagcacgcgctggacgcgtgcgcgctctgcgctaagcggctggcgcgcgacagcgacgtcttcatgtaccgaggggacacgcccttctgcagcgaggagtgccgccacgagcagatgcacctcgacgccgtctccgccaggcaggccgcgcggaggctgcagcgcttctcgccggagacggagtcccagtcccaccgtgggcagcggccgtccaggaaggtgtccatcgccagctagccgcggaaagttttgtttggatctacaatatctgtattctgaagaaaacaacatctgtattctgaagaaccatcgttgttgttttggaacgcagtgcagggcaaggcagcatcaggtggcaggtgcctgcagcttcccatatgtgtccatggcaagctaattaagctggccgggtgcctgtagattcttggttgatctgtgctgtgccgttgatttgattttgttggaaagaaaatagaaaacgccatggatctgaaggaagcaatcaaacatgattcacgatttgttcccacttcggtgtaggccacccgtgtgcgccgtctcttttttctttcttgaaagaaaa

SEQ ID NO: 23618 - DNA, 762 bp, Triticum aestivum
  Clone ID: PAT_TA_23618
gccggccgggttccaacaaactcacccaccttttcccctttacagcagcagcgagctctgagttctactagctcaagcacaagcccgagctagctgcctacaagaagcctctgttgaaccatggcggcatcagtagcttgcgccttcttcttcgacgccgagccggccggcgagcccggcaagcacgcgctggacgcgtgcgcgctctgcgccaagcggctggcgcgcgacagcgacgtcttcatgtacagaggggacacgcccttctgcagcgaggagtgccgccacgagcagatgcacctcgacgccgtctgcgccaggcaggccgcgcggagactgcagcgcttctcggcggagacggagtcccagtcccaccgtgggcagcggcagtcccggaaggtgtccatcgccggctagccgcggaaagttttgtttggatcgacaagataaccatcgatgttgttttgaagaaacgaccgctgtattctgaagaaacgactgctgtattctgaagaaccatcgatgttgttttgggaggcagtgcagggcacgagcatccggtggtaggtgcctgttgcttcccatatgtgtccatggcaagctaattatgctggccgggtgcctgtagattcttggttgatctgtgctgtgccgttgattcgattttgttggaaacgaagtagaaaaccccatggatttgaaggaagcaatcaaacccgattcccgatttgttccatttcaaaaaaaaaaaaaaaagcccct

SEQ ID NO: 23619 - DNA, 711 bp, Triticum aestivum
  Clone ID: PAT_TA_23619
acctactcatttgctcgctctcctcttcctccctctcccccccacgcgtccggcaagctctgctcagcattttgctcgaaagaaacctacacacacataccatggcggcatcagcggcctgctccttcttcttcttcgacgccgagccgctcagcgagcccggcatgccggcgcaggacgcgtgcgcgctctgcgccaagccgttcgcgcgcgacagcgacatcttcatgtacaagggcgacacgcccttctgcagcgaggagtgccgcgacgagcagatgcagctcgacgccatctccgccaggcaggccgcacggaggcagcagcggttctcgtcgggaacggaggcccgcagcgggcaccaggagtccaggaaggtgtccgtcgcgagctagccggcgaagctcgccgcccagtagagtagagctcggcttgaatcaacgggatcccaagaatcgccgatctggcgagaccaaggagattgatctctccgcttcgtctcgcccgagccggaggagcagtgaaggatctgagaaagttcatgcgctgaggctccggccatctgggtcgcccgccagacgcatccttctcctggctcttttttgcctctgtgtgcgtgtttgttcgaggcttttgagccgcggttgtcgcaacaccatatgtaaatccaaaccatctggaagtccctgtttcaacacaaaattttgccca

SEQ ID NO: 23620 - DNA, 1048 bp, Triticum aestivum
  Clone ID: PAT_TA_23620
gccccccccccccccaccagcctcctgcaccgccctcccccacccagagcttcccaagccgcaccagctacccacacccacccgaacaaccgccgccctccgcctccgcccccgcctcctcgccgggcggcgagcgcggggccccggccgcgcccggctgcgcgccccggccctcgccgcgggcggggggcagcgcccccgcgacgtacggcgggcccgcgacgagcggcaccgccgcgtccaggcgcggcccgatgcgccgcgacggcgcgtgccccgcccaggccggcggccgccggcggcccgggcggcggccgggcgcgggcgccgggggcgcgcgggcgggccccggggtggcgggcgccgggaggtcagcggcggcggccggggccaggcagtgcgcgtgtgcgagcaagaggtcattgcgcgtgaccaaggacaatcctccttggccaaatgaagcaaggtccgtgtcgtcgtagtgggtcaccgccagcccgccggcgccgcgctggatgggccgcccaaggagcggccgcgggggcagaaacccgggcgggaagagcagctagacgggtgggtgacgggagttaatccgcggcaaaaatcgaccaggcaatgaaagctgacatgtgttggccacagatgtattttttttccgctgtcgatgaatttttatgtgcgtcatgacgagcgatttggcactatcacttttgacttagtatatatacgagggtattctcacatgtgggactttaactgtcaagcgaaagctaataagcaatatctttgtgcaaaaaagcagagagcctgggtacgactccccctgggcaacgcccccaacctccactggctaccgccgtagccgcccgtgcctcccccccgcccaaccctgtttctcccgccccccggccgcctgccccccgcgggcggcgtccacctccatctgctcctggcggcactcgtcgctgcaaaagggcgtgtctcctctgtacatgaagatgtcgctgtcccgcgccagcggcttggtgcagagcgcgcacgcgtc

SEQ ID NO: 23621 - DNA, 564 bp, Triticum aestivum
  unsure (1)..(564): unsure at all n locations
  Clone ID: PAT_TA_23621
caccattccaccaatggagctctcatccctcctgccctccctgtccccgcgccgcgccctccggctctccttctccaccgcgtccaagacgccccggcggccgcggccggccgccttcgcctgccgcgcggacgcctccccggaaggaccaatcacccggcgatggttcgcctcgctagccgccgccaccgcagccgtggggatcagcgtcgccggaggagggggagctggcgccgtgtcgaccagcaggaganttttaggagcagcaagatccggagagcgactcatcactctgcctaatggcatcaattactatgacatcaaattangaggtggggctaaagcattaaggatccgcgtcgcagtacatacgtggcaatggaaggcataacattcatgacaattagcaggctccgttactgggtggacccgtatggtttgatgttggaatctaaagaggatgtcaaaagatggatccgggttaaggatgaaattgagcaaagttggtatgtcccctactacttaggaaaaagggtnanaatccccaagaacatgacggttcca

SEQ ID NO: 23622 - DNA, 565 bp, Triticum aestivum
  Clone ID: PAT_TA_23622
gcaccgctcctcccatttgcgaaacgtctgcagtgcagatcgatcagagggttgggacggcaatgggggcacaccgcctcgcactgctcgtgttccttgccaccttgccacagctgctgctcgccggcacgaccagatactacaccttcaatgtgacaatgcagaaggtgacacggctatgcaccacccgcgccatcccgacggtgaacggcaagttccccggccccaaaatcgtcacaagggaaggcgaccgcgtcgtcgtcaaggtggttaacaatgtgaagcacaacgttaccatccactggcacggggtgaggcaactgcggacggggtggtcggacgggccggcgtacatcacgcagtgcccgatccagacggggcagagctacgtgtacaacttcaccatcaccgggcagagaggcacactgttctggcacgcccacgtctcctggatgcgcgccacgctctacggccccatcgtcatcctccccaagtccggcgtgccgttccccttcccaaaaccctacaaggacgtccccgtcgtcttcggcgagtggtttaacgc

SEQ ID NO: 23623 - DNA, 454 bp, Triticum aestivum
  unsure (1)..(454): unsure at all n locations
  Clone ID: PAT_TA_23623
cacagcttcagtaatttacaacgccatctccacgtgtcgtccgtcgatctgcatagtactgtaactctgtaggtgcctgccgcgaccgcaagcatgtgccaagccgcgagagtgtcccacaacaatggcctggtcgcgtcggtgtcgtctctcctgatctcgttcgtcatcaagcccctggccaagaacgccatcctcacgggcaggagcgtcctcgccctcctcgccggcgacggcaccggcaacgccagcgccgcggccgctccacgtgggcagcattgcgaggagtgcgccgcgagggacggcgcgcgcctgtccagctccgacgcggcggcggtcatggcgacctgggcctggttcacgccggcnangcagtgacaacaacnacaacaacgggatggttgtgtgtggcgggtgcaagcaattggggtgttgaggaggtggttgngganca

SEQ ID NO: 23624 - DNA, 739 bp, Triticum aestivum
  Clone ID: PAT_TA_23624
tgggccgtgcgagcacccgttgcgccggacgccgacgcaacgaagcggttcgagggacgggccgaggcggcggtggagcacgctgctgccggagggattcttggacaggacgagggcacgcgggatggtggtttcttcctgggcgccgcaagtggaggtgctccggcacacggcgaccggcgcgttcgtgacgcgctgcggatggaactcgacgcttgaggctgttgtcgccggggtgacgatgctgagctggaccatgtactcggagcaggggatgaacaaggtgttggtggtggagcacatgaagcttgaggtggccatggacggttcccacgagtggaccgtgaaatctaggaaggtagaggcgaaagtgaggctggtcatggagtccgagcatgggaagcagatcagggagaggatggcgatagcgaaagtgattgcagccgatgcgctggagaccggtgggtcctcagcggcagcatttgttgacttcctggatgatctcaagatttccatgctagatgttatttaacctttagtgttcgccttgttcagcttggtggaatttgttttctaaatgtttaaaaacatccggctgattacagcgcggtgtaaacctcctccaatgcgcgccacgcctccagtacagagccaccaccgcttttgcttttcacttagagcatgggtaataatatgctcccctcgtggttaaatagactcgactcaaccttgtactaac

SEQ ID NO: 23625 - DNA, 643 bp, Triticum aestivum
  unsure (1)..(643): unsure at all n locations
  Clone ID: PAT_TA_23625
ctcgtgccgaattcggcacgcccacgcgtccgcttcacctacgacttttcccccaccggcgcggcggcgcttgcgccgaagtctcccgccagtctacggccgcgcgccgccctgccggtttctttggaagggaatggcgggaggcgaggctaggggcggggagtgcggctactacacgacggacgacgcgctgtcccaggtgggcttcgggaggttccaggcgctggtgctggcctacgccggcgtgggctggaccgcggaggccatggagatcatgatgctgtccttcgtcggcccgtccgtgaaggacgagtggggaatctccggccagcaggaggggctcatcaccagcgtcgtcttcgccgggatgatcatcgggggctgcctcgggggcgtcatctcggactcatatggcagaaggtcgggcgcgctttggctcttgtctcttgataagtaattgtatatctgccctcttctaaattccaattgaatggtcaaagcaaacaaacctggatttgcaatcttcaaggcataatgtgctgtggtttggctaattaatccncctccgtcanaaatataagtgtttgggattccgtaaagtagatatagtcantaacccttgtcnntaccttgncaagggttc

SEQ ID NO: 23626 - DNA, 990 bp, Triticum aestivum
  unsure (1)..(990): unsure at all n locations
  Clone ID: PAT_TA_23626
cccacgcgtccgcaaagaaaaaagagaaagataaaaagaaaagagcagcgactggtcaggcgcgttctcttccccgggcggacctagggttgccgccgtcgccgccgtccgcacatcccatgctcccagctccggcagcgcccgctcctccgtcgagagggcaggaacatggtggcggcgacctgtgtggacggggcgagggggtcaatgagacgttgtggtacgaggtgaatcagcggctagcccggcgccagcacgacgcgccgcctcaccggctcctcattcagtcctcgtccacaatggccgctgccgccctcacctgcgctcgtgccctcttcatctccggccgtgagctccgtcccgtccaacctcatcttcccggatcttcttggttttggtccgggagcatccgggtgcgggtcaaagcgttgatggacaggttcgtgaaggagttgcagaaggcgctggacgcggacatccaggatcgcatcatgaaggagcgggagatgccagctacatcaggaacgcaaacgcgaggtcgccgagagggaggccgtttggaaggccgagctctcccgccgcgagatggcaacttctttggggtcgtgtcagcaagccttattcaacttctttggaatgtcgtatctgaattgccatgacttagcgttggattcccacatgtttcttgatctgagtgtacgctcatgtggtagttaattatttggttccatgacgaggaatatggagatcaagttgcacactatcaagaggccttctccagaggtattctacaagttatcggaatagatcctcctcattccctgtaccttgcagcatctccatctaaggctgggagttctgcacctacctacctgttggtgtaataaattccaactatgaaactaagcatcaatttatgtcctacacatagtgttggcagtgtgtcattggtgctaagttaantggtgggtagatgtcaaaaaaaaaaaa

SEQ ID NO: 23627 - DNA, 633 bp, Triticum aestivum
  unsure (1)..(633): unsure at all n locations
  Clone ID: PAT_TA_23627
ccgaccatgagcgccgcggcggccaacgtcgccgtcatcggagccggaatgacgggcgccgtgtgcgcctcgctcctggccgcgcgcggagtggcggtgacgctcttcgactccggccgcggccccggcggccgcaggcgtgcgttcagagaggtgatggacgacggcacggagctgcggttcgaccacggcgcgccctacttcaccgtcagcaacgacgaggtcgtccgggtcgtgggcggatgggaggcgcggggcctcgtcgccgagtggaaggccatgttcgcctgcttcgatcgggagaccggcaaattcagagacttcgataaggagggaaccatgaagaagtatgttggagttcctggcatgaactcaatatgcaaatctctgtgtcaagaggatggtgtggtgtccaaatttggtgtcactattggaaagatggattggcttcaagataggagctcatggtcgttggctagcttggatggcaaagatcttggcagttttgattttgttgtggcaacagataagaacatagcatcacaaaaagtttctgggttgactggaaagccaccgcctcttgatttgtcagtatttcnacacttgtcagcaatgattcaagatntcccagtt

SEQ ID NO: 23628 - DNA, 627 bp, Triticum aestivum
  unsure (1)..(627): unsure at all n locations
  Clone ID: PAT_TA_23628
ccccgcgtccgcccacgagccatccggtcctcccttcctgcccctagccgaactcctccgctttcccccaaatcagaatctcggcacgccatgacctcctcttaccggccggccgccacgacgagcccggaggcgacggcgccagtacccaaggtggaggccgaggcggcggcgacggcggcccgaaaccctagctcccccagcggcccgccgtcgccggagatggaggccacggcggaggcgctcacgcgggaggaggtgctacgcaggaggcgccgacgcacggcgcggctcgttggcgtgtaccgacggctgtactgggcgatggcagaggaggtgcgcgcgcggcaccggcagtacgtctgggagctcggccgcagtccgctcgaggccgagcagcccccgtcggccgcgtgctcggaggcgaagcctgggccggcggcggtgccgaggaggaagaagtgtgggttcacgggctgcaaggtgcgggcgatgcctatggccatgtactgccactcccacatcctatccgatcccaatcaggccctgtacaagggatgtggtcaaatcatcaagtgtaatgcacagttttgtnaaaatnatcaaanangtggtgcnanaaaattg

SEQ ID NO: 23629 - DNA, 654 bp, Triticum aestivum
  unsure (1)..(654): unsure at all n locations
  Clone ID: PAT_TA_23629
gaaacaacacatgaaactagctattttccatttctcttattctcttttgaacgagtatttgacaaaaaactaccacatatttaaggttgttgtcccactgaactacaactttttaaaaaataaccaaaaactacccccttttctaataccccgcaccacccctacgacaccgtcgtcaaccgcccgggcttagcccgatggcttcctcaagcggcggcgaagtgaagggatagatgtgcagccgggcgaccttgggcggctagggctggggttccgccccagtccgtttgagcgggtggagcgacgttagtggcaggctgtttgatgttgatcagctcccaagagataggatgccatggtgggataatatgtactcctaactttcctgacccaatgtgatgnaaggtgcgtgcacatgcactccggctaaatcactggacatacattcctatttttancacagcggacagcagtatgaatccaggttggtaccaattatacatacatgccctccggcatccagaaagtgtcaactacggttgtaaagtaccgcgagtaccatcaatgcttcaantcacacccccccagcgtgagtgggtccttccgatagcataggctgcctgtccattcactgctggtcgttgatgaccatgg

SEQ ID NO: 23630 - DNA, 863 bp, Triticum aestivum
  unsure (1)..(863): unsure at all n locations
  Clone ID: PAT_TA_23630
ctcgtgccgaattcggcacgagagtattcataaaaattaatcatccaattccctgtatgtgtccttggtcacattttttgtctgttcaatttttggaaacccacatcttatttgaattgaaactgctgactgctttgactgatcctgaccgagtccacacaccatcacttacagaatactggaagccacttgcagaagatgtaaactctttaccttttctttcatagttactccctccgtcccaaaataagtgactcaactttgtactagctttagtacaaagttagtacaaagttgaatcacttattttgggatggaggtagtactttgcaccaatggttctaatattggggttttcaaggtaaacttgcagatggacacatctgccagagagacggcggccatgagagccggaagatcacaagagatcgaccttttggggtagtctaatacttcctatatggggcacatagaaaagcactacgtaagtagtccagcctttctttaaaacccgctcccctcactccacagcctcggtcattccaagacgtttctcaatctctcccccactcctggccttcccccctcctgggctggtctctcctcccgggcaacctccgagcttcttgcgtgagaccgccgcacacccaattcccggtagtccgtacgtgctcgtcgccaaaccttgaaacttgactcnacgaatatgaaggctngggttgganaaaccttatccaaangggcgnanaaaaccacagggatcanggtccatnagcaaaaaaaggacctttccgaacaagggggttaaaagttttnaagnngttcgcngaaanaaggtngcnagggngacggncctgtaaggg

SEQ ID NO: 23631 - DNA, 1095 bp, Triticum aestivum
  Clone ID: PAT_TA_23631
ggcacgagaaggaaaacaggtgtttcaggagaaagacatgatgaaaactttgagcaaatcagcttgtgtgccagaagttttatgtacttgtgcggatcaatcataccttggaatactgctgaattgttgcctttgttgctcactggcttcaatacttaatgcaccactaagtgagtcatccgcacgattctatgcagcttcagttgttgttgctctagaagaacttcatcggaggtctattctttacagaggtgtttcagcagatattcttatgctcgaccgatcgggatatctgcagatagttgacttcaggtttgcgaagaatttggaaggtgaaaggacttacacaatatgtggcatcgctgactctctacctccagagattgttcttggcagggggcatgggtttactgctgactggtgggcgcttggagtattgatttatttcatgctgcaatcagacatgccatttgggtcctggagggagagcgagctagaacctttcggtaagattgcgaaaggtcgcctaattataccatcagctttcagtgtggaagttggtgaccttataaccaagctacttgtggtagatgaaaatacacgccttggagccacaggtgctgacgctgtgaaggaacatccctggtttgatggcattgactggaaacaaatagcagatggcacttcaagagtacctcaagaaatctctaatcgcatcgacatatatgtagaaactcttcagcaggatttaacagtgcccccttccatcctgactgaagatcctgctgatatgactactccagagtggatcaaagattggtaatttcagatgaatgctgacagattggtgctatttaagaaaacttttgattttttgcgagcattttcatatcttgtgaaaacaagaatctaagttttgtcaaaaagataaatggtcaagctgcaatcatttattcagtgccatcaaaacgagaaaatagtgataaattggtttctaataaggcaccaacattggattgtaagttggctaataatccatgtgatacatatgtatggatatccatctttcatttgtcaattattttgcaattttca

SEQ ID NO: 23632 - DNA, 1031 bp, Triticum aestivum
  unsure (1)..(1031): unsure at all n locations
  Clone ID: PAT_TA_23632
cccacgcgtccggtgggtcgaaaactcccgaaccccctagaacaggacacgcccccaccgaccggcggcgaggaagaggaggaggacatggcggcggcgcggggacaaaaggcgctggcgacgctggtgaggtcgctgcggagcgattccatctccaactccaatgctcccaggctcaggcacctcccgtctctcaggaggaccttctcgctctacgaccagatcaacctcatcgacaacgtccccgaagaccagctccgcttccaaacttacgatgacactggattcaagattaacaatgtaaagtatgaagggagcttgctgatagtagaaaacaagatactgacctggacacccaaaacatttgcggatataactgctgaaagtttatcaatcttcaaaattgtgcacccaatcccagagattctgattcttggttgcgggaaatacgtccagccagtcagtcctgagctgcgcaagttcattcggtcaactgggatgaaactggaggccatcgattcgaggaatgcggcttcgacctataatattctgaacgaagaggggagggcagtggcagccgcagctcgtaccttggcagtggactctgaatcgctggctgccgagcggtgtgccccccccttgaagtccatagagctgacatgagacctctcttgcacctcaggcgtctgaaacctgtaacgatcggtggcaagtgttgttccccactcctttttctgttgtcccttaaggaagcatcaccctggttgtgaagtgtgttttcttgtgaccgcgaaaacaaaaacaaaagcagtctaccttgtgtacatcagaataatctgcacgagccgaacggtgttttccgtattaaccagggtttatttatccgtccttgtccggccctgggattcatcctgccaatgaggccagattctgatgaaccgacgaacaaacggcgtgtgcactgatgtttgggtacttgtcccgtactccccataactangaagntccattcacacaatacataattgtgg

SEQ ID NO: 23633 - DNA, 600 bp, Triticum aestivum
  Clone ID: PAT_TA_23633
ggcaccatccgccgtcgcgtcgcgagctccgcttggccgcgcactgcggtagtcacacgtgagctctgccgacacccagtgcgtacggtcgacctgcgagccacctgcaccgcgttgaacctctccatggcctcgtgctcgctaccgcagtgtcgcgcgtggccagcgttggctgtcgccatggctgcggagcggggcaagatccacagagctgcgcatggggtgagcatatcggccccatgttgctaaattctggccggctatagtttgggttgagcggcggagatggcaaatttcaacaccgcaggtggctcagcaatgacatgtgaagaaggatatgtgggagcttttggatggtgattgacaaaggcaccaacaaggaagatcagagagttgcatttccttagtagcagttctaactgtctcttctataccttgtagaccataatgaaataattaggacgctacggaactggagttctaccactatatgtatctttactgtctgcgaccaagatgtgtgttttctcccgtttgtatatttatttgtatcgtgtgatccacttgcgtagtgatgacatgcttgctctaaaaaaaaaa

SEQ ID NO: 23634 - DNA, 438 bp, Triticum aestivum
  Clone ID: PAT_TA_23634
gtaagctctcagttcttcacctcctctctcgtctctctttttcagttattcattaattcccaagtttgaggtggtacgtactaattcctctttatccctaccgcccagatcccttcttggatctcttctgtccagatctcaaccacacagttttgagatggttggactattgaaccgttcccgtggattggcggaaggagtggcggttatgatatgcccaatgcttctcgcacttgctctaaacatagttgacctcaatgatgaagtgtacggacatggagtccccattgccttgattgccatggcaggctttactttgatcaccggcatttgctccttcatggtgtgctgcttcatacaagggttcccgagaagtagcgtgatcctggcaatcatttcgtctgcttgcctcatcatgctcgcctacttcattgcaca

SEQ ID NO: 23635 - DNA, 623 bp, Triticum aestivum
  unsure (1)..(623): unsure at all n locations
  Clone ID: PAT_TA_23635
tgcagctgagacgcgctgcaccagcccagccgcccactgctgagaatgccgtcggtcaaacatggtgtgcatgcaactatatacaaaggaaattgaatgtcgtccaggagcttcctctgcagcatctattctctcacgaaatgtacaaactcatggacttgattccaagaaatctggtggagtgaaggatcttgttcggaaaatttgcgcatggagggatttaatggctcgcatgcatgatgaaagcttgcggtatatcctgtcagaccaggctattgctgcccttgctgtaagagttccaaaaggtcgaacggagatgtgtgctgtcatagcagaaactgagccaagtgcttcaactatgcatccttccttgtcgtcacatcccctgtagtttcgctcacattgaagaactccgctatctaatttaggatacactgtcaacaaggataactaattacaacttgcttgggaagataaagaacaaatgggtaagtccacacagtttataattatacctgtacncanctagttgaacaacaataattctttcacaatgggaaatnncacacacactacaaaaggtcccggaacatcattaaantcatnatcccattacaaatncg

SEQ ID NO: 23636 - DNA, 2323 bp, Triticum aestivum
  unsure (1)..(2323): unsure at all n locations
  Clone ID: PAT_TA_23636
cctccgcccccccctccccgccgtcggtgttcttgcgcttccgctctggaggccagctaggacatcacacgtgagctggggataatggcgggtggtggcactcagcagagcctcaggaagtacctcggcgccctcaaggacaccacaactgtgagcctggccaaagtgaacagcgattacaaggagctggacattgcaattgtgaaggccaccaaccatagcgagcgtccatcaagggagaagtacataagagagattttcctctccatttctgctgcaaggccaaggtgctgatgtagcttactgcattcatgctctagcgaggcgtctttcgaagacacgaaactgggcggttgcgctgaagacattaattgtcatacatcgtgcccttcgcgaagttgatcccacgtttcgtgaagagcttattaattatggcagatctagatcacatatgctaaacatggcctactttaaggatgattctagttcaggagcttgggattattctgcatgggtacgcacttatgcttcatatttggaagagagacttgaatgtttccgagtgctgaagtatgatgtggagttcggatcctccgaggactcgggatcttgatactgtaggtgtgctagatcacctgccaccactgcagcaacttcttttccggcttcttgcttgccagccacaaggggcatcatcttataatgttataatccagcatgcgctttcaatggttgctctggagagtgtcaagatctacactgccattagtgatgggacaataaatcttgttgacaagttctttgaaatgcaaagaaatgacgctgttagggcccttgatatatacaaaagagcaactaaccagtctgagagattgtcagaattttatgaagtgtgtaaaacaatacacgtggcacgtggtgagaagttcttgaaaattgaacagcctccggcatcattcatgcaaactatggaggaatatgtgagggatgctcccgcgatgaaagataaggccatactggctatagaatacaacaaagagccagaggaggaagtcaagccaacttcaccgcctccggtttcagaacccgaagtggaacaagagccggagcccgaaccagaaccagagccagtaaaagaggaagcacctgctgctgaaccaacagacttgctgggtctgaatgaaacacaccctgctgtggccgagatagacgagaggaacgctctagcgctggcaattgttccaatagatgacgtgcccaaggccgctcctgcttttgaaaatggagtcacaggctgggaactggcccttgtcactgcacccagttcaaatgaaactgctgtcgcttcaggcaaaaaattggctggtggactggacttgctcacccttgacagcctatacgaagacgcgaaccgacgagcgagccagcccgcaagctacaacccctgggagaccaccggtgccgccccggccccgatgatgcaacagccagcagcaatgcaggacccgttctacggctcgaacgggtacgcggcgccccatgcggtgcagatggccgccatggcccaccagcagcaggctttcatgcttcagcagcagatgatgatggccagccaccaccctcaggcacaacaataccaccaggcacaggcggccccagcgaacccattcggcgcgaacccgtttgcgcccgccggagcccaacacccttacggtggcgctggcactgggatgatgcccctccacgctgtccagggcaatgcgtacaccgggctgatctagccggtggttcacagatgaaaactttgttctgcccatgttcatttttcttggctgccattgtgacggctttgtagctcaggtaggaaggggggagtgacacggccgttgatcgggagcaaaggagtgtagctggttcgtcggattcggatcggtccgtgtaggcgcttgtgtattttgtatatggcgtttttcgtatgtgcaggtgagtctgggggatatatatacgtcgggggattggattattcatggatgtttggtgcgatgatgaacaataatgtgacgattctttgtagtgtaattggaagaactgtgatgttcttgtgcaacatatgttttgcctcccgttgctccgcgaaccactgttttcttttctagattcaattacgaacgaatatgttgattcatttgtggatttgctagcggtcacttagttgattccaattcgtgaacaattggtttcacttacaaaatagttctcttgttgcaacattggatnattttgttttcacgggcatcaacttgtacccctatactaacagttt

SEQ ID NO: 23637 - DNA, 184 bp, Triticum aestivum
  Clone ID: PAT_TA_23637
cccacgcgtccggatataggcaagtttatgtactttggtgtggatcgttttggtgttgaagacttgtgtcaaattcatttgttatggagtcactcatctgtacctagattgaacatgcatgtactggctagtactatttgttatatcagcaaagggaggggatctagaacccatatttttatgg

SEQ ID NO: 23638 - DNA, 1180 bp, Triticum aestivum
  Clone ID: PAT_TA_23638
gaattcggcccggcccgcacacgagcccacctagagcccctactaccccccgcagatcggcgtcggcggcgcccgcgcccgctccgaccacagtagcaggccagagagtcgtcgtcgtcgtggtcaccgccggaccggagacatgtcgaagctgcagctgccggcggacgacagcgtggcgctgcgcgtgacgcactccaacctcgcctccttggcctccgacatccgcgtctcgcagcagaccacggtggaggcgctgaaggagaagctgtggaagaagacgggcacggccgtgggctccatgcggctggagctccgggacgaggccggcgccagggtcgccgacctcgaccgcgacgccgcgcccctcgccgcctactccccctacgacgggtaccggctgcacatcatcgacctcgacccgtcgtcggtgacctccggcgggtggctggaggacacctcgctcgtcgagaagtacaccatctcggacgaagcgtacgacaagctcggcacaaacttccggaagttcaaagagaagatggtgtcgaaaaaccctgtatcggacgataagcaatcagacaatcagatggaggaattgtgtgccaacatcaaggtgggagacagatgtgaagtcgagccaggtgccaagaggggcaccgtgaaattcgttggcaaagctgaagcccttgggcgtggattttgggttggcgtgcaatacgatgagccacttggaaagcacgatggcatggtgaaaggagtccgcttcttcgagtgccctcaagggcatggagtaattgttaggccagagaaagtgaaggttggtgactttccggagagggacccattcgatgatgaagaagatgagatataggcaagtttatgtactttggtgtggatcgttttggtgtctcttcaacttgtgtcaaattcatttgttatgtagtcgcttatctgtacctagtgagatgattgagcatgcatgtactggctagtgtatcagcaaaggaaggggatctagaacccatatttttatggagattagtttgggttcaagcagtcgctggattactaaaaagctcataccccaagaaccaatgaccaagattgtgggtgtaatgggtatataaacttgatgtcattggatttgtatccagtacccgaaaaaaaaaaaaaaaaaaaa

SEQ ID NO: 23639 - DNA, 1603 bp, Triticum aestivum
  Clone ID: PAT_TA_23639
ctgcctttcatccttgttttgcacatcaacttcagttggttctcatagctgtggcaaaggacaatgaaccatgtttgtggttctttgatcacgtttcttacttgctcaatattgttggagtttcttgtaagcgccacgacatgcttcgagatgttagagttcaaaagtgttggaagcacttgaaatgggtgagattgaaagtggaagtgggctaaatcaagagatgggactagctagacccggcgacactcgttggggttctcattttaaaaccattatgcacattgttagcatgtattccacaatccttgaagtacttgatgctattggaaaagatccttcacaaaaaggtgagtggacaagaatacgtggagttgctcaagcctttgcatcaagtgaagtttgaaaacaaatcacatgatgcttgttattcttggctatacaaatgagttgtccaaatctttgcaaaagagagatcaagatattgtcaatgcaatgacacttgttagtttggcaaagagtagaatgcaacacatgaggtctcatggttgggaagattttcttgcaaagctaaccttattttgcaacaaacatgacattcaagttcctttgtgggaggatatttatgagcctaatcgaagatcacgtcggtattatgaagtacaaacaaatgatgatcgttacagaagagaagtatatcttggtgtcattgatcaaaccattcaagagcttgactcgaagttgccccacctggactcgctgccgccgccgccggcgactcctggattcgacggcgactcctccatccagcaccagcagcagcagtctctcctcgcctcctcggctcctcgcagctaaccaaagatgaagatgaatggtgacattcagtccttttttcggaattatgaggctgctaaaagaaagagggttgcagccgaagagcaacctgaagatacagtgtcaaatattgaagatgaagcagtccataatccacctccagtccattctgcagagattgaatttgatattgaagatgaagcagtccattccgatgcagagactgaaagtgattgtgaagatgaagcagtccattctccgtgtgcaaggccatataatattcaaaggcttcctcctgatccaggggagaggattcctatttcagagtttgatgaggttaatacggagttgcttatttgcatgtcggctttgaatcccctcaattcatttgcttcttatgatgcacttaaggtagcaactagcaagtggcatggcatctgggagcgccacagctggtagccaatcgtccgtgggtgagagtgaaggccgtcttggtcctggtgctgtagatcctgggtggcctctgtgggcccttgtccaggagctcgtccctgttgtggcgtatggtgatggtgcagctgttgcctctggtagccgtggaggaaacgccaagttccgctgcaatttctgcaagaaaatttacccaggcagctattcaagagtgaagcctcatcttcttcagataacaaagaaagatgtagctacatggacaaaataccacatgctgccttgagcaacttgcaaggaagatagagcagcgctcaac

SEQ ID NO: 23640 - DNA, 335 bp, Triticum aestivum
  Clone ID: PAT_TA_23640
tcacgacgcactgcatttcccacagcgtttacacacgctcgtacgtacgcacagagactagctagctacctcgcttcgaatcgatggcatcgtcgctcctcccggcgttcacggtgcggcggggcgagccggtgctggtggccccggcggagcagacgccgcgggagaccaagacgctgtcgcggacgtacatcgtgtcggacgtgagccacgccgggttcaagagcgtggacttcgggtggggtgaggccgtgtacgtgcggccggccaagggcggcgaggggccgatccccggcgtgaccaactacttttccaggtccaagaacggcaagggg

SEQ ID NO: 23641 - DNA, 1484 bp, Triticum aestivum
  Clone ID: PAT_TA_23641
aatacccaacttgtcccaccatcctctcctcctcctcctcctctatccagtgagctcgagtcggcactgcactctctctgccagctccggatcgatctcggcttcttgatcgatccatcgtttgttgtctggcctagcacactcgggttcttggtccagtcgatcatggtgcagccggtgttcgacgcggcggtgctgagcggccgggcggacatcccgtcgcagttcatctggcccgagggcgagagcccgaccccggacgccgccgaggagctgcacgtcccgctcatcgacatcggcggcatgctctccggcgaccccgccgcggccgccgaggtgacgcgcctcgtgggcgaggcctgcgagcggcacggcttcttccaggtcgtgaaccacggtatcgacgccgagctgctggccgacgcgcaccgctgcgtggacaacttcttcacgatgcccctcccggagaagcagcgcgcgctgcgccaccccggcgagtcgtgcggctacgccagcagcttcaccggccggttcgcgtccaagctgccgtggaaggagaccctgtccttccgctcctgcccctccgaccccgccctcgtcgtcgactacatcgtcgccaccctcggcgaggaccaccgccgcctcggggaggtgtacgctcggtactgctcggagatgagccgtctgtcgctggagatcatggaggtgctcggggagagcctgggcgtcggccgcgcccactaccggcgcttcttcgagggcaacgactccatcatgcgcctcaactactacccgccgtgccagcggccgttggagacgctgggcacgggcccgcattgcgacccgacgtccctgaccatcctccaccaggacaacgtcggcggcctgcaggtgcacacggagggccggtggcgctccatccgaccccgcgccgacgccttcgtggtcaacatcggcgacaccttcatggcgctgtctaacggacggtacaagagctgcctccacagagcggtggtgaacagccgggtcccgaggaagtcgctggccttcttcctgtgcccggagatggacaaggtggtggcgccgccggggacgctggtggacgccgccaacccgcgcgcctacccggacttcacgtggcggtcgctgctggacttcacgcagaagcactaccgggccgacatgaagaccctcgaggtcttctcctcctggatcgtccagcagcagcagccccagcccgccaggacatgatggattgctctgctcctcccaccattagccagccattgattcagcttagctgctgagactgagaaaagagagacatcgtcatccgtcgatcgaatgttattattacagcttaattggttgatctagtggtagcacgtacgtacgaagaagcatggatggatggcaggatttcctagatgataatttcctaaaaccgagtcgtcgtcaaaaaaaaaaaaaaaaaaaaaaaaaaa

SEQ ID NO: 23642 - DNA, 604 bp, Triticum aestivum
  unsure (1)..(604): unsure at all n locations
  Clone ID: PAT_TA_23642
ctcgcgagctggtacgcgtcaaagaaacctccagctcccgattcgccatggctcaagaacaacccaatcccgacgaggtcgttctcgggcaggagatcaacggcgcgagggtggtcaccctcaaccgcccgcgccagctgaacggcatcaacgacagagtggtctatatcctagctcagctcttggagaaatgggagaaagatgacgatgccaagctggtcatcttcaagggagctggacgcgcattttctgctggtggggacctaaagatgttctacgaagggagatcatcggatgattcctgcctcgaggttgtgtacaggatgtactggctctgctatcacattcatacatataagaaaaccatggtggctcttgttaatggacttgttatgggtggaggtgcagccatggttgctccactgaaatttgcagttgtcacagagaaaacagtttttgccacccccgaggcaagtgttggactacacacagattgtagcttttcttatatccattctcggctccctggatatttaggggagtatctggctttgactggtgctagactgaatgcanaagaaatgattgctgccgggcttgctac

SEQ ID NO: 23643 - DNA, 736 bp, Triticum aestivum
  unsure (1)..(736): unsure at all n locations
  Clone ID: PAT_TA_23643
gccccgggccccactgggccgcgcctaccctccgaacttgcacgcggcaaagaaatctccagctcccgattcgccatggctcacgcgtattttaaacaagcttccaactatcgacaaatgtttctcagccgagactgttgaggagatcttgaaagcacttgattcagaagtgagtgtggacggaaatcaatggatagctccagtcctgaagagtatgagaagatcatctcctactggattgaagatcacactgcgatcggttagagaaggtcggaagcagagtctgcaggagtgtttgaagaaggaattcggactaacaatgaacatcctccgatctgtcattactggtgatgtgtatgagggtattagagctctgagcatcgacaaagacaatgcacctaagtggagtcctgcaaccgttgaagaggtgaagaatgaagacattgaccgtgttttcgaaccattcacctcgggacacgagctccaagtcccatctgatgattccaacaggtggagcggcaaacacgagcacacggtctatgcgaaatcttcacagtaatcaccacatagccaggctctggagcagcagccctttgtactggtgttgctgtatgacatgcatgtttgagtgcaaatgcactacctgtgtgtaacattatgccaactgttgagaactactgtactataaaggaagcaataaagcaactgaggtttcattacgacaacacaagtnnna

SEQ ID NO: 23644 - DNA, 547 bp, Triticum aestivum
  unsure (1)..(547): unsure at all n locations
  Clone ID: PAT_TA_23644
catctctctctctccctcacccctccttctccacctccggccgccgccgcggccaggccggcgtggcggtgcgccacccaaccatcagcgccaccagctccaccactccaccacaaccagcatcgctatccttctccgccacccatccattcatacgtaccaaatccacctcatgcaactcaccagacagagggccggcagtgtctaatccatcgcgcgcccgatgtcggtgcctccttcttcaacctactgctgctcgctgtcaaccctctctgctgcttctttctccccacacctcacttgttgctgctcttctccaacctgctgcttcttcttcctcacctccgctgctgctgtccctgctcttcttgcgctcatgttgctgctcctctgaacccctcgtacggctgctcctaatcttctctgaaacccctcctactgctggctcctaaaccttctccaaacttgctgccggcccctcccctcgcaagnggccccttttcngcttctcaagngtttctngccggctgaaaccaaacccccggtt

SEQ ID NO: 23645 - DNA, 852 bp, Triticum aestivum
  unsure (1)..(852): unsure at all n locations
  Clone ID: PAT_TA_23645
tcgagagccctcaccctcccaatcccgccgcgctccagggatggccgccgccgccgccaccaccaccaccaccgccaccgccgccacaccctcctcccgtcccctccgcgcgccccccgcgccgtccaccgtccatcgacagctcaggtgccacgccggccccagcccctcgctcctcgcgctgcgccaccgcgccgcccgcgccccgccggcccgggccctgctcgacaaggtcacgcccttcaacttcggcgaggaggaggacgacggcggcgacgaccacccccgcgaggagtgcggcgtgttcggcgtcgtgggcgacccggaggcgtcctcgctctgctatctcggcctgcagaacctgccccatcgcggggaggagggcgccggcatctgcgccgccggggacgacggcaagctcaagtccgtgacggggctggggctcgtcagcgacgtgttcagggacccggcgcacctcgggagcctccccgggcaggccgccatcggccacgtncgctactccacctccggcggccaggcccagctgtgcaacgtgcagccgttcctcgcccggtaccgggtcgggcagctcgccgtggcgcacaacggcaacctggtgaactacctgccgctgcgcaacaagctggaggcgcagggctccatcttaaacacttcgtcgaacggaggtaatctccacctattngcactnntttcgcgcccgtggttgccgcatctgcgagcctggagcccctcagggcgctactcgtgcttttcctagggcgaaaagtttttgcggccgacccttcggtccgcccttggtatgggccgcgccaacgggccgtntgttcctta

SEQ ID NO: 23646 - DNA, 599 bp, Triticum aestivum
  Clone ID: PAT_TA_23646
atctgtcctttgagtaaaccgtgcaggcagctagcacaccgattccatgaggggaagcgcgaggtctctagttgaaaccgcaaccagacaaatcaaacctggcaatggactcgcaagtatgtcagcatccaccttcagtttgctttgcttgagaatttcaagaatcagctgtcggtgtctcggtttaccttgtgttgaacaggggtgatgacgattaccactcccaagaagcacgagaaggagatcagccctactgaatctgccctcccaaaggatgaaaacgtcgagcccctcgtcgctttcagccggccgcctcctttgccaccggttctaggccccttgatcgcgctctcgctttttcagacttcttctagtgatgaagacagcaaatgagtcgccagggggcttgcttgtttgatcgctgagttggttacttttcggagcctggccgtgtatatagtcggaggttgtagacatcatgttgctgtagttgtctggcaagtactacgaaatctgaataatgtagtagtcttttgtgtgacaacttttcagactgaacaaatttcgaagtctgtcactgtgcaaaaaaaaaaaaaaaa

SEQ ID NO: 23647 - DNA, 728 bp, Triticum aestivum
  unsure (1)..(728): unsure at all n locations
  Clone ID: PAT_TA_23647
gccaaaatcatactccggcgcttcctttctctcccttgtcgtgctcccggtagctgccgtcctctgatttcgctggccgcatggtggtgtagggctctgtgggtgggcgccgctcgcgcgcgcctgttgggccccgccccctcggcgcgcccgagtgtagtgtgatcatccatggggaagaaaggtatagtggtggcgaccaccgtcgtcgccgtgatgactgtcatcttcggagtcatcggcgcgggtttcttgggactgagacgctatgaggatgaccgcggtgaccgcagcgtgtgcaagtacgcccgatcgccggcgacggcttgcggcgtcntggcggccgtgctggcgctaacgacacaagttctcgccagcgtggccatctgctgctgttggggcatggcagaatcccaagagggccaatcgcgtncgccgccgtcgtcgtcttgtcgtcccacggctcctggcgggcgttgcgcggccctcttccggggaggcgcccgaattctggggtgaaggttctcgggtgaatactgttggagnatnattgttccgnggagtctntttgnnnnnncctnnggncccnattttnttaaananacccccacncnnggaantctttnnccacnnnttnttggaaannnactnaaannncnccnccncccccnaaaaannnnntnttnaannnnngnntttnntnaaannaaanntttnccnnnnnngaa

SEQ ID NO: 23648 - DNA, 471 bp, Triticum aestivum
  unsure (1)..(471): unsure at all n locations
  Clone ID: PAT_TA_23648
cgacgtcgcgccgccagagcctttctctgactgtttggcgcatgagcaggggaggcttctccgttgtctccggcggcggcgcgtcgcgttggtgtttggctgtgctagctagctcgctagccagacccgagatgccgccggccgccgcgtcgtggtcgtgggcgtgctgcggccgccggaggaagaagcgccggggacggcgacggccccggcgcgtccgggccgggaaanggggaccagtggactctcttcatcgacctgcccgtgctggaaggccgccaccgccggcttctcccacgggaaacctgctcggccgcggnggcttcnggccccttgtacaagggcgtgctggattggcgggcaagaaattccggtgaaaccgctgtccctggagtcccgaaaggggttcgggaattccccaacaagggcgggtgntgcccaaggggaaaacccgcacctggtctccctccn

SEQ ID NO: 23649 - DNA, 344 bp, Triticum aestivum
  Clone ID: PAT_TA_23649
ggaaaaaatccccaattccccgttgtcccattcttccccggcaacctagctcggcgacggcggccggcggccggcgcgggcgtgcagcgtcgcggcgttaagttcaagcgagcagcgtgccagcggcagggcgtcgctgtgccgcgctgcagccgcgcggcagggacggcgcgaaagctgaagctaagcgcagactgaggtccgaacagcactaggattaagtcatgtcctcttcgtcatctttccccggctcccgcttccccttcgccgccggtgggggcggtgctggagcctgcggtggaggcggaggcggcggcagtgggagcagcgtgcggccctggggg

SEQ ID NO: 23650 - DNA, 908 bp, Triticum aestivum
  Clone ID: PAT_TA_23650
accattgccttccccggcaacctacctcggcgacggcggccggcggccggcgcgggcgggcgttaagttcaagctagcctgccagcggcagggcgtcgctgtgccgcgctgcagggacggcgcggaagctgaagctaagcgtagactgacgtccgaacagcactaggattaagacatgtcctcttcatcatcgcaacccggcctccactggcgcggcgccggcgctagttctgatggcgggctggagtccggctttgattatttcaaaggtgctactggcgatcaaagccatcatcacaaatccggatccatacaacccgcgtgtggagagcattgcacgtctgtacctgactaagagagctaatcatgatgaagtcgcagcggaaacaacattgacgtctggatctcaaggattcctttgtcccacgtgaattcatgggacatacagccacgcgctgccgaaatcctggatgtccgtctgcgcatcatgattactactttttatagccttgtttgcaatacgcgacacgttaatctaccagctttcgccgaataccacttggtatacgccacatcagtggcctatgcgtcattcaattcttcatagttgaatatgacgatcaaagccttgatcagaaatccggatccatgcaatccacttggggagagcattattggtttgtacctgactgttagagctaagcatgatgaaatagctgctgaatggacattgaggtttgcaagatagggagtcctttgtgtaactaaataagaaaaattgactctgtaaatgaataatcttgtatgtatcctgagatataagttggaaaatgaccaatacattaatctgagttgtgccctaaagatgtgtttgcaaaaaaaaaaaaaaaaaaaaaaaaaaaaaaaaa

SEQ ID NO: 23651 - DNA, 522 bp, Triticum aestivum
  unsure (1)..(522): unsure at all n locations
  Clone ID: PAT_TA_23651
tagcgtggtcgcggccgaggtacataaatttgacaacatcgcaatggaacatcgggtcccctgttgtttttttgccttgtcttgtaaactaatgttcgaagccggcacttgcaccttttattcctgtaataatgtataaatagaaccaaggccattggttggttgcgagcacggacggaccaggcaccactagtggtggtggtggtgcatcaattaagtgtagcaggtggagtcacaagggtaggggccggcccgcgccgccgccccgctgcggctgtagaaccagtccccaaccgcgtccgctatcctctgtccccgaacgccgggaaagccnggcgccaacagatgtcctgcgcctccngactggaattcgccaaanaacaanttnaccaacaaccccctggtttcggcgaaccgtcgncccaacgcgccaaggaatcctcccctgaaccctggcaagnctccaactntcctnggacactgggtatgtcctcccggaantcccaatcaagattgggcctc

SEQ ID NO: 23652 - DNA, 674 bp, Triticum aestivum
  unsure (1)..(674): unsure at all n locations
  Clone ID: PAT_TA_23652
attcggcacgaggctgatgccgtgattgggtttgggtttctttcaaggtgatatactagatctcatctcatcgcccggggatgagatttgagggggaggcagaccttgtgcggagggcctgaggcagcagagcttctctccggttgatggggccgcctgctccgccgacgtcgtcgccggcacggctcgccggggagctccgttgttctctggcgcgctgctgactggggaggcaggtgctccgggcctgcgggaggaggaagagttctgctggttgcctgttattttcttggggagggaggagaaagaagtgaagggaagatatcaacttgatctttggtccctcatcaagtggcagcagctttgacgtgcgagtaggagcagcggcaccggagatctcgggctctggcatgggctcgttcgggatggagtggaaccagaggagctcggtgctgtgggactgggagaatttcccgccgataggcgagaaccccaagaacgcgatgcaggccgatccaagatttgccgncgttgcggctaccatggnnnaatgaaccgctccattcttctggcggtagcggcaccttctcttccagctcagngatngggtatggctcttccangnnctccatgtccgcgtcgatcgattcttcgancnnnnctgggaacacatn

SEQ ID NO: 23653 - DNA, 1372 bp, Triticum aestivum
  Clone ID: PAT_TA_23653
ccaccgtcgggactggcctcacgcgccgcccgctccccgccctccccaccagccccggcggcgaccccccccggaaacttgtggccgtctctctggatgatcccaaagcctcccttgtgactggtgtcaacgatgtggagccccagtgtccgcgggcactgactcgaagctccacttgcctcaccgcagtgaacgccgccgccgccacctccacccgctcctcacctaccccggcggcgaccccccagggacaccccgaatggcgacggcggtcacggcgtcggccaccgcggcgacccgcttcacgcgcctggcgggcgtcgccctccggcgcagcagctgccgcccccgcaccgcggtgcgcttccagcgcccggggctcaccaccaccgcgctcctcaggcccaccgagctcaagcccaaggaccagggccagcccgagacgctcgactaccgcgtcttcctcgtcgacggcgccgaccgcaaggtgtccccgtggcacgacgtgccgctccgcgccggggacggggcgttccacttcatcgtggagatccccaaggagagcagcgccaagatggaggtcgccaccgacgaggcctacacgcccatcaagcaggacaccaagaagggcaaccttcgttactacccgtacaacatcaactggaactacgggttacttccccagacatgggaggacccgacagctgcaaatgctgatgttgaaggagcacttggagacaatgatcctgttgatgttgtcgagattggtgaaagacgggccaatattggggatgttcttagggtgaaaccattggcagctttagcaatgatcgacgagggagagcttgactggaaaattgtggccatctctctggatgatcccaaagcatctcttgtgaatgatgtagatgatgtcgaggagcattttccgggaacattgactgcaatcagagactggttcagagactacaagataccagacggaaagcccgccaacagattcggcctcggcaacaagcccacaagcaaggaatatgccctgaaggtgatagaagaaaccaacgagtcatgggagaaattggtgaagaggaaaatcccggcgggagagctctcgctagcctagccttttataggcccatgagaagccaacaacacattctttcagtgacatacctcctaagcgtgccgctcttttgtgatatatacctatgaacatgcttctcttcatctgcagaacattccgcgtacctgtgtgtaacaacaggaataaatgaataatctggtggagcgaataaggatttctgagcaagtttttcgcaatgaaactgaatgctcttttgtccagttaattaattaatacgcagatccgcag

SEQ ID NO: 23654 - DNA, 746 bp, Triticum aestivum
  Clone ID: PAT_TA_23654
ggaagaagtcggtctcaggctcagaccaccgagcgcatctcaagctcaaactcgtactgctcctgctctgatttgtcccctctcgctctgtattgagctcacacgagcagggaaaggagctccatcgatctgagagagagctgctctgccgttccggccatggctgcacgagcgctgaccgctgccggccgccgggtggccggccagagccagaccaggccgacgcctcttctcgcctcctccaggagcggggccagcatgaaccactcctcggccagcgcgcagcctgaggaatagcgcggggacgcccatggtccggcggcggaggcgatgaccggggcgcaggtggaggccgcgctgaacccaggagcacgtccccacggccacggtgctgccagatgccggccgccacgccgtcggcgcgctggacggcggcgaggacgcctcgtgggtgcccgaccaggacacaggcgtcttcgtccctgccgatgccggcgctgatgcccactgcgggggcgcgcatcccgccccaccgcagcgcctgtacggaggcgtgggcgggccggcgtcggtgctcggcctcgcggcgggcgtccgggaggaggagatggaggacgtggaaaggcccgccatgggtctcaccgatgccaacgacggcagcaacaacaactagcagctgcaagtagctccatgcctccatcaatcagaggcctgtagtagtttcagtaagctagctagtgtcactg

SEQ ID NO: 23655 - DNA, 463 bp, Triticum aestivum
  unsure (1)..(463): unsure at all n locations
  Clone ID: PAT_TA_23655
agactttccaaggcccaaaatcccatcctccctcctccgatccccctcttcttcctttcctcgcggccgagggggtcgtccatcgatggcgacaatgggcgcgggcggagcggtgaagatgatcggcggggcgaaggtggagcgggtgctggccacggccaaggcgcccggcgcttgcccgtcctgcggcggccccgtggtggccaccgacgtggagagcgagcggcgcatcctctgcctcccgctgtgcctcaagaacaagcgcaagtacccctgcaccaggtgcttccgccgcctcgtcaccgtctacaagctaacccggcccctgccgccggggccggcggccccccttccgtccaccccgcatcgacccacgctgtnccccctccaatccttgggccgcccggcgcgtggtacggcctaaatacttgctggctggncaatgtaagggatccgtgtnatc

SEQ ID NO: 23656 - DNA, 493 bp, Triticum aestivum
  unsure (1)..(493): unsure at all n locations
  Clone ID: PAT_TA_23656
gtttagtggtaaaagtgtgattcgttctattaataactgaatttgaaatgatatacttaaggcatccttaagttttttatttttatattccgatgaaaactttagttcttataaaggattaaatccttttcctctcaatagcatattgaggaagaatatacattctggcgatttgtatccaaagactaatttaaattgcatccaaaataaaaattgggattatgagtacagagtccgcgaagcataattttgcattgggattaagtattccaattttgaaaatatgagtaaaggatctatgggatgaagatacaaaaaagtgattccaatcgtaactaaatccttcttaaaataaggataaggaagccaaatagctaaaaaacgatagttttggtttactaagaacaaccngcatattgttcaactcnggtgggaaaccnatncttttcctcaggatncctggatgaaatttagggaacgannaagtagatna

SEQ ID NO: 23657 - DNA, 421 bp, Triticum aestivum
  Clone ID: PAT_TA_23657
cggtctagatccgggcgacggcaaagcatagttcctacatgaccactagcatctccagctatctcatgccagctgctgcagtttcaaaggagaaggagagtatgaaacggcgtgcgccaaagtctatgggatccgctcgcaagaagcagcctgccatcgctaacccagcagcggtaggaggaaagggtgatgtcggggatgcaatggacttgtcacagtaggtggtttgtttggtggtttgtttgggtacgagtgccctttgagatgactaccatcatggattctttgctctcacaagtttcaaaccatgccatccaccatcgcaggacgtagtatggatcaaaattttatttactaagtttatgatggaggttaatttaggagatgattatttaaagttagagctccctccaggtgcccg

SEQ ID NO: 23658 - DNA, 445 bp, Triticum aestivum
  unsure (1)..(445): unsure at all n locations
  Clone ID: PAT_TA_23658
gaagatacacacagggccaacagctatacagctatacaactatacaagggattctcatttcgcgtgctcgcggccgaggtacggccatatatttacatcacttttcaccctgacgaacaagatggatatgaagacatccggtcgtcaccttccatccactaggaacgccatttgcagttacagttccgactggtcgccgaggtcgggctccccgcagaaggcctcccccgccggccgcctcgcggcggtgtcgctgtacaccccggggatggccctcccgccggcngggttctccagcggctccctcggcttctcggtgttggcgtanangaggatgcncanggtcaagcgacaccgccaaggccaacaaggtgaactcactcggtcaacaacggcttcncagaaatgttcgnngaagacgatnacgaantaaactctggggttt

SEQ ID NO: 23659 - DNA, 440 bp, Triticum aestivum
  unsure (1)..(440): unsure at all n locations
  Clone ID: PAT_TA_23659
aaaaaaacaaaacaaaaaatgcctttctttattaataacagcaggagcatttacatcactcatactcactacaacggcatcgctgaagcaggaccccgaacaacagtcagacaagcacactgccgtcaccatttgttgttaggtcagcccaaaaattgtgcttccagcagcaaaaaaagagaaaaaaaacatttggttacatggcgcctcgataatcagttaattctaagcaaaacaatgaactttgtcaggtaacaagaacaacacatgtcaaccaaaatcggtaaaaaaaacatttctttactgtgatgttctatgtaaatgtacacaggtatggggcaaaaatgggcagcaatttagcttaaggtgatgcatatgtncacaagtttaaggatcaggtggttgccgacgtcctcgtccaacctctgcgagttgctcaa

SEQ ID NO: 23660 - DNA, 282 bp, Triticum aestivum
  unsure (1)..(282): unsure at all n locations
  Clone ID: PAT_TA_23660
ccacgcgtccggcctcgctcgtgcggttccacactactcgcatctccaccacgaccccggcggtggcaccgttcccctgccacggacatgtgggccctcaacatgaaggccggcgggccgtgcctcacgccgattcgccccgcccccgccgcccgggccgggaagcccttcgccgccgccggcaaggcgggcccgtggtccgcgtggcggaggcgcggcctggcggtgaggccgctcgtggcggtgcgcacgnnagggaggatatntaatngnagnnnnnna

SEQ ID NO: 23661 - DNA, 1291 bp, Triticum aestivum
  unsure (1)..(1291): unsure at all n locations
  Clone ID: PAT_TA_23661
gggcgagacggcggtaaccagcgaaagcactggttcggcaagggagatcttacctgggcgcggcattcgacgagaccgaagaacattcttccgttttgcaagcgcaggcatgcatggtattgcctgtccgatcagtgtaccgaccagcaccaggcatgcgttattcgtttctcggttatctttagttcgaacaccacacgcttcacatttagtgattaaagtttcagatccattattcccttgctctaagattttgaaaccgcgtgctcttatggcaggaagaatggagggctccaaggcaccttccttttcttgttttgcaaaccgccagccatgctaagaggttcttgaaacattgcggaattccaatgcgggtgtgcttcgatgtggatagcactgtatgcttggatgagggtattgacgagcttgctgatttctgtggggctgggcaggcagttgccgagtggacgacaaaggcgatgacctggagccgtgccctttgtagaggttcttgttgcgcggatctttctaatattgtcatatctctgtcaatttaacaactgtttttagaagaggatacacccaatatttcttcttatctcattttttttaattacattaaaatatattaatatacatgtgtttcctgtgtcacaagatgtttcggacaaaagctcgagcctgtggcatttgactttggcattcctattgaaaacatcttagcgaacagactcctatttggtacttccggagggtatgctggatttggtaccacagaacccactcctcgaagtgggggtaaaccggtggcagggcacaaattaaacaaggtcgtggtatcaagacactggttatgattggagatggtgccactgatcttgaggcttggcaacctggtggagcagacttgttcatctgttacgccggtgtccagatgagagaagcagttgcaaccaaagctgactggaccgtctttggactgcctgtgcttttttcgggcttgtctctagtattgtccctctcagtgttcctcactcttatgctgttccctccgtggttcacgccgggatggactcatgcttgtgctcagccgtgtctcttgcttccttacttttcgctattcgttcctcatttccatcatgccgttcatgagctggtgctggagctgtagctcaaatttaatggtcatgtgtatgctgatttggaaacctgtatagttatgtattaatattaatggtggtggtgtatctgatacggaaacctgagggtttgtatcaatattaaatttnag

SEQ ID NO: 23662 - DNA, 603 bp, Triticum aestivum
  unsure (1)..(603): unsure at all n locations
  Clone ID: PAT_TA_23662
ctccggatccatccatccgcccctcgctgccgctgcgtctcgtctccaccaccccacttgcccccggacccaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactggggaagcatggtcacgcaaagtgtcactttgttgccattgacatctttaatggaaaagaacttgaggatatcgttccttcatcccacaactggtgacttccccatgttgaccgccaaagattatcaactgattgacataactgatgatggtattcaancttctcaactgaagagtggctacactaagggtgacctgaacttccacggataagttctgcttggcaanttaaagacgggttnctgatggaaggactgatctncgtattcccatggtgaagaaaaattgccttnaagaacgtggtggaatagagtgtctgttccactcatacttgacatgctcggtntngaaaatatggatagaa

SEQ ID NO: 23663 - DNA, 629 bp, Triticum aestivum
  unsure (1)..(629): unsure at all n locations
  Clone ID: PAT_TA_23663
cttgaagaagcttcaacaactggccatggctgccaaaaccccaagctcgtggtgctttagtttcctaaaggaagctctgatcctccccacgcgaaaccctaagctcttcacgccggtgttccttgtgttggccgtcgccaccttccttgcccgctcagtccatgtcgtgttcatccagcctctcgccgacgacatggtcaggtccatctatctcatcgagatgaaggaacaccggcttctcctgcgcagagggtgccaagctcgaaagagggcgccataaagatcatgctaatctccatcgcccaagtgtatcctcatgctgggcgcttggcttcctcaagaaaggtctcgccttcttcggcggctccaccacctatccgggcaccgctatccctggccgaactcctccgcaagtgatttgcaaggggaaaacctgaaagggcctgctataacttcnccgtggtcaccgcgctcgactgcgtggacggcgtatggccccagctgctggtcccccttatatcccgtnggnatccggtctcncgtcaaggctctttctcctnaagtctcccaactagctcccntcccccctgggaacttcccctcgtgtcacgggaaccccgggtcacccn

SEQ ID NO: 23664 - DNA, 609 bp, Triticum aestivum
  Clone ID: PAT_TA_23664
aaatgccctacattggcaaataaattaaataaccaagctcactcaagaaaaacaaatcgatttgcgcacggagaaggactgctcattacatatcttacacgcgggcggtaattatacaatacatcactcagcatatgcgtacataatcctgacatgtcatttaggctagtgcacttctcccagttcctacatgatgcgcaaacaggctacttctcacaacctatgtacatataaacatatcgtacaaagcggtacattgcatggcggctaagcgtactcaggcggagatgttgacgatctcctttgccctgccgagggtgaggcgcagggaggctggggactcgacctcgtcctcactaataggctccatacgtggggtgcggccccccgccggttggccgcgcgcccgtggccgggctccacgcacggggctgcgcgctcggcgtggtgcagtgcatgctggaatgggcgcaatgacttggttgaactcttcggtggtaggcaggcgacgagcagtggcgagagtggtaggtgcagtgtgcaggagctccctcctgttggcagcacagccctggaccgagtccatgcgggcagccacgaagtcgtcca

SEQ ID NO: 23665 - DNA, 480 bp, Triticum aestivum
  Clone ID: PAT_TA_23665
cctaacccgccgccgccgccgccatgtcgccgccgacgcagccgcagctgaaggacaaggcggcgcacggggtgccgcgcgcgacggcggccagcgccgtggcgtccctcaccaagtggatgcgcgagcgcgccgcggaggcgccgcccaacctgctcgccgacgagcgcgacgacctcgtcgtgctccaagctctcgctccgccgcgtcccgcccaggcccaccaccaaagccgcacctcctcccgctcccgcacccgttcgtcgcccactcggccgcctccgtctgcgtcatctccgaacgaccgcgccgggtcccggtcccccgccgccgccggcatcctcgacgccgccaagtcctcaagctgccctctcggaggtcgtcccttctccgcctggcgacgactaacggcctacaatcccgccgccgttcgccggctcctaagactcttctcgccgacgggcctgtccatctgcccgc

SEQ ID NO: 23666 - DNA, 630 bp, Triticum aestivum
  unsure (1)..(630): unsure at all n locations
  Clone ID: PAT_TA_23666
ggctagtggtgtagctagcgccttgtacaagctaggactagtgcttctccagtcctcctcttctccctctacctagcttgcttctgctataaagggcgccggcggaggcagggtaatcgatagggagggaagcgagatgactcgatctcggccgacgcccaccaccaccatggggggatccgtaccagaccaccaccaccaccagcacgacggggaggtggacggcgggcagctgcagcacggcggcgagcacgtggagacggtgatgcccgggttccgtttccacccgacggaggaggagctgatcgagttctacccccgtcgcaaggtggacggcaagcgcttcaacatcgacctcatcgcctccgttcgacctctaccgctacgaccatgggatctccccgcactgggcgtccattcgggggacaaggagttggttcttccaacgtgcctccgggaccgcaagttaccggaacggcgaccggccgaaccgggtgaccccttcaggtaactggaangcaacgggggcggcaagattgtgaaatctccgggaacgtcaccgcccgtcggctctctcaccgcccgcttcnaagtncggnaaggaccaanggctccnaaaaagtgtttatg

SEQ ID NO: 23667 - DNA, 531 bp, Triticum aestivum
  Clone ID: PAT_TA_23667
ggggcgactacgtgccgcgcccgaggccgctcactgccccatcttgggcgactacgtgccgcgcccgaggccgctcactgccccgcatccgcccggcggcgaggagaagtgcaccacgtacgcctcgacggtgttcgggccgacctgcgactctcgtgacaaggtggtgaccgggcaccagctgccggagatgaaggtgggggactggctcgtgttcgacggcataggcgcttacgccgcctcgtcgggctccaacttcaacggattcttgatctcggacataaagacgcacttggcctactccacctagcccccaacgtccagctagggaaggaacatgcacgtgcacatgcatgcatgggcgcatgcatgggcacgtctgaaatccttgccgtcgattggtctctgtattgtacgtgcatgtttctttcttctttcttttttacggtgttgcatgaataacgcggttttttcttctcgatcggctgtatcttattgtattgccaggaaaataaattatgtttttatatt

SEQ ID NO: 23668 - DNA, 1622 bp, Triticum aestivum
  Clone ID: PAT_TA_23668
tcgtctgcagagcggtggagcagaccccacacacgccaagaggcattccccgagccagcgatcttctcgccgcacttcacacagttgctcgtgcacgtgccacgccccgagaaaccgtaacttaccacgcagagctaggctctcattgtttaagtgagatattcacagtcgcatccgtcgtcgagatggttgggagcagcccgatgcaggcggtgctggtggcgccgggggtgaaggacaagaaggtgctcgcgttccgccaggacgcgctcaaggagaaggacgccgtcgccgcgctcatgcgcaccatcgcggccggcggcgtgcggagcgccttctacgtcttcgacctcgcccaggtcgtcgacctgtaagcgtcggctgtcgtcgcgcgctccccggagtgcgcgcctgctacgccgtcaagtgcaacccggagccggcgctacttggcgcgctggccgctctcggggccggcttcgactgcgccagccgcagggagatcgaggctgtgctcgctctcggcgtgcagcccggcagcatcgtgtacgccaacccgtgcaagcccgaggcgcacctcgagtacgccgctgaggtgggcgtcaacctcaccacctatgactccgaggaggaggtggtaaaggtcaagcgctgccacccgggctgcgagctcatcctccgcatcaagggccccgacggcggcgaggcccgggtggacctcggcaccaagtacggcgcgcacgaggacgaggtcctgccgctcctccgcgccgcccagcgcgagggtctcaacgtggccggcgtgtcgttccacgtcggcagcggcgcgtccaacacggacgtgtaccggggcgccattgaggccgcgcgcggggtcttcgacgcggcagccgcgctcggcatgccgcccatgcgcgtgctcgacatcggcggcgggttcatggccggctccgcgttcgacgaggcggccacggtcatcaacgcggcgctcgagcgctacttcggggagcttccctgcgtggaggtgataggcgagccggggaggtacttcgccgagaccgccttcacgatggcggcgcgggtcatcgggaagcgcactcgcggcgaggtacgcgagtactggatcgacgatggcctctacgggaccctcagctgcatccccatggaccactacgtgccgcacccgaggccgctcgccgtgccgcgcgccggcgagaaggcgtacacgtcgacggtgttcgggccgacgtgcgactccctcgacacggtggtgaccgggtaccagctgccagagatgaacgtgggggactggctcgtgttcgacgacatgggcgcctacaccaccgcctccggctccaacttcaacggcttctccacctcggacatcaagacttacttggcctactccagctgatatggaacctatgatgtggcgacgtactacgtagcacacgccattcgatttgttttcgcagtacacaaaacgaagagttgtaattaagctcgtacacaatgtatgtgcttttgtttgttctattttttattttaattaggtatatatatatgtatccaatgtggctattcttttgtttcctgaaacgaaactttcttttcaaaaaatc

SEQ ID NO: 23669 - DNA, 452 bp, Triticum aestivum
  unsure (1)..(452): unsure at all n locations
  Clone ID: PAT_TA_23669
gaattcactagtgatttcgggaggcggccgcccgggcaggttttttttttttgaccgtgtagacttaattgtatttcgagcttcgtttttaagtcctcngttgagaagttactcattccgcattaatcatattttcttacactcgttgcccacaacagaaacccaaactataacctaatggagcaactttcctgttatcaacgccgagtaatagagtgtgttgcctgctagtagatttacgttcgaaatctcaatcactatcagatgacgatgacgatccctttgatccgctcctcttatgatgcttatccttcttgtgtttcttatctttcttatctttcttgtgtttgccgtgttttccttcaaacttgttctcaatcaagttcgcgccaatagctcctgcgactgatcctagcaaagaggctgcaattccgccacctgcccttgtgcgg

SEQ ID NO: 23670 - DNA, 635 bp, Triticum aestivum
  unsure (1)..(635): unsure at all n locations
  Clone ID: PAT_TA_23670
gaattcactagtgattagcgtggtcgcggccgaggttttttttacaaatgcttggtttgatcattggacaattgcagtatgcactacagagcaacaagaacttcaggaagtagtttcaggctttcattcagccaataacaacacactagatgtggatctcttcaacagctaccactgggtttctagtcttttatccatctccttttcctaggatgtccttgcttcaccatataaacacggccataaacccaacttcttctaggtccagaaagagatctctcgactttagtacggtactccagtgggcactcgcagacatggcattctgccttgtggggtgctttaatggatttatccgtcttcacgaatgcaaagacctgctcaccacaatttggggcaaagattcttttagtgcaaccacattgttttgtcagcaaggccttgcagtgcaccaaactgacgcggatgcaaccgggatagccaatcagatagcctaaccgatgaaaacatgtgggtcaccctcggtatcccgtcaagcgactagcaccggagaagagaaccttgctccgaatgcgcccgaacgcaggccaaatgtaaagcccgaacaggaccccggggccagtnggacacacgtc

SEQ ID NO: 23671 - DNA, 318 bp, Triticum aestivum
  Clone ID: PAT_TA_23671
gaattcactagtgattagcgtggtcgcggccgaggtttttttttttttttgaaacaaatatctatattggtaagagggcacatattacaatttacaaatgagagatgcaacacaaatattttagttgagaggtttatattttttgtaaacaaacactgcatttttcttttgtacaaggggcactagtgaacaagctagttcctttttttcttttgcctcctttcttgatgtaacttcacttgtcaccttccttgatgtctccattggcttccttcggtacctgcccgggcggccgctcgaaatcactagtgaattcgc

SEQ ID NO: 23672 - DNA, 770 bp, Triticum aestivum
  Clone ID: PAT_TA_23672
atctcacgctaggaacgccactcatccgacacgctctccactagacagtgcaggtcgggctcgtcggggttctgccggagcaccgatcttttcatattgatccgcctctctcccctctggtcgtctcctccgtcggcgcggcactgaagcaaggccgagcggacacgttctgcttcggtggcgagaaacgcaaaaaaggacttcagctgtgagcacttgctctcctgttcagccttggccatggaaatcgcctgcacagacctcacccatgtcttgcgctcggaacggcggttcaagtacaccgggtatagcaagagctttcacatgccgggcagggacaaacacatcaaacgcagatggaatttcggtgggcatgactgggaaatccgtgtatatccgcatggcggtgagccatcggctccctcctgggtggcaatcaatgttgtccctctcagcgagtgcgctgtggctgtggtgacgactatacgtggttgcttggttgacccggagggagttcgtgaaccatccgaggaaatttgtcagtcagtagcattcaggaaaccccaagataaatcatcacaaatgcttctcatgccatggtataccctgaataaatcgcgttatctcaaggatgattctttcattgtgcaatgcacccttgaagttctcaaggagctgccagatataccagaaccagaagtgcatgtgccagtgccaacctctaacctgcaccagcacttcgctgaactcctgcagagccagatgggagc

SEQ ID NO: 23673 - DNA, 471 bp, Triticum aestivum
  Clone ID: PAT_TA_23673
cccgcagcctcttcaactggggcagaggcgcaaaagaagccgagacgccgccgccgcagttccagtaccacggcgtggagccgccgttccccatgtcgctcgtggccaacacgcacctcataggacgcgagctcagctgctgttacagggccaccgttgacggcttcagcgcgacggacttccaccggcggtgcgacttcaagggcccctgcgtcgtcgtcggctacacggcgggaggctccttcaggttcggcgggttcagcccggaggggtaccgcagcacggacgactactacgacacgctcgacgccttcctcttctactggccgccggcagcgccggaggacaccgccgctgccgttccggtggtgctgcccaaagtgggcgggaacggcgctgcacctgttcgactactcgccggggcggggccgcaatttcgggcggccgacggggctgctcatccgggccgcc

SEQ ID NO: 23674 - DNA, 503 bp, Triticum aestivum
  unsure (1)..(503): unsure at all n locations
  Clone ID: PAT_TA_23674
cttgccgaaanggggggattntttntgcaagggcngattaaatttgggtaancccccaagggtttttccccggtcangnacggtttntaaaaacgacggcccagntgaatttgtaataaggactcccctattagggcgaatttgggccnggacgttcgcatgctccccggcccgcccatggcgcccgcgggaattcgatttcggagcgnccgcccgggcaggtgtctatgtaacagctctagtgtgatagcgatgaatatggttcataattatagggtcgatgatgcttatatagggaacgatgaaaattgtgtcctgctttggacgacattaacgcaaatataggaagaatcatacacgtgcaagaaaacaaaatgataatcgagcttgacaaaaaatattgcattgagtttgataatgccgctcttctacattgtaacccaactttactcaagcaagcttaccgaaggtgattatttacacctcggccgcgaccacgctaa

SEQ ID NO: 23675 - DNA, 346 bp, Triticum aestivum
  unsure (1)..(346): unsure at all n locations
  Clone ID: PAT_TA_23675
angttcgcattgcttccccgcccncccttggcggccgcggggatttggtttaggcgtggtcgcggccgaggttgaaagcccaaactagccctgagattcccagattttcataggactttatacaaccaataatgtacattgttatccctgcactgaatgtatatcccggttgtattttgggatacaaaatgtatatctgggttattatttttgaccagatatacttagcacgttgtacacttgtactggacagaaagttaatagtccccttttgcctgtgttctaaaaaaaaaaaaaaaaactcgagacacctgcccgggcggccgctcaaatcactagtgaattc

SEQ ID NO: 23676 - DNA, 837 bp, Triticum aestivum
  Clone ID: PAT_TA_23676
ccattagcaacaagcgccacagctctcaggaggcttcggctcctatctcagaggaagctccaccgtctcttctctggtcgctctgatcgcgcgaacaagttaattaggtgtgcttgccgatctggtcgtggtgtgcttgccgatcgccatggccgacgactcatcgtccccggcgtcttacatccggctggtgcagcatctgatcgagaagtgcatctgctacgacatgaacaaggaggagtgcgtggaggcgctggagaagcacgccaacatcatgcccgccgtcacatcccacgcgtccgaggagctggagaaagagaacagggagttcttcgagacgtacaagaaggacagaggcggtgagtcgccgtcgcagaagggcagtccttcagaccaggcgtcgacctcaaggagctcagacgacaacgacgactagaggccggccggatccatgcatatatgcatggcactacacaaaactaaaatatatgagggtgtgtgtgtgtaaataaatcgcagctagccacgccacgccacgcacgtacccctggctcagctccagctggatgatccaccgagcagacactccttcagttggttggtccaaaatagaaaagattcagaatcaccaatccacaggagcgtctggaatcttgtatggatactagtaagccatgctgtacacgtggaggaggagaatggacgtccgtccggaggagacgacggacgtacgcgggcgttgcggtctataatttgtacccatctgtacatactccttacatgtgagcggcgactagcttgttgctgtcagaggaaagctggccctgtcttgttcca

SEQ ID NO: 23677 - DNA, 268 bp, Triticum aestivum
  Clone ID: PAT_TA_23677
gaattcactagtgattaacgtggtcgcggccgaggtgtgtaatttttattttgaaatacctggatgaatgtaaatgtagtttcaagttgaactgtcgtttgcttcagttcattatagttctgcaagtctgtaactgtcattacgactgcaggcaattctgaaatatagtagtggtactgctgtactgtactaatatgctactagttagcatccctccattaagtttcaaatcgacccctacaagatttcccttgggaaaaaaaaaaaa

SEQ ID NO: 23678 - DNA, 833 bp, Triticum aestivum
  Clone ID: PAT_TA_23678
gctcgcccagagactggatacagaacagaaggaaaaggaaataaagaacagagaagaagaaagaaagaaagaaagatcagcacctaccgagcaagcctccgttgggtctccgacttcacatgggctgcggaattgttcccacgagccccctccgggcctgaacagattcatattccaccgaagaaccgccccttgatttccccctccccctttttctgctcgcgaattacttgctagtactaccacgcaagaactgctcctctctgttttttccgtgtttcgggggttggaaattcctccggttctgaaaggaaggtccctgggggcattggggaggaggaggcatgccaaaggaggcgacatgggcccattcataagccacgagcatgcaactttggtggattgagatggagaacaaaggggtcattggcgaagtatcagaccaatgcattcccagtaagtgatcttgaggctggtccacaccgaggcagcctcctgatgccgccgacgctgagcctcctggagctggcccgccgaagccgccggccttgccgctgcaggagcgagaatggagcattttctgatcaaaacttctggaagatgggggatgccgacccaagtcgatctagttctggatcggcactatcatattcagagagttgtgccccatatggttctgctgatgctagtgaaatgactggttcagcgcaatcgcatgcttgggagtcattggtaccatcaaaaaagagaagctgtgtcactcggaccaagtcttcatccgtggatatgcttgtcaaagatcttcattgtataatgcacgaagagcagttatc

SEQ ID NO: 23679 - DNA, 644 bp, Triticum aestivum
  unsure (1)..(644): unsure at all n locations
  Clone ID: PAT_TA_23679
gaattcactaagtgattagcgtggtcgcggccgaggtagccgctccgctacgacctctggctcgtcagcgccgccttcttcctcttcaccggcttcgtggtctgggccatcgagcaccgcgccaacctcgagttccgcgggccggcctcctaccaggtcggcacgctcctctacttcggcttctccaccctcgtcttcgcccacagggagacgctcaagagcaacctctccaggttcgtggtgctcgtgtgggtcttcgtggtgctcatcctgcagtccaagctacacggcgaagcctcacgtccatgctcacggtgccgcaactggagcccggccgtggccgactaccggcgaagctgcaactggggcaacgggagatggtcggggtcaatgaacaactccttcgtgctcagggccatgatggcgtcgggtttcccgcaagggaaaggtcgtgcggtaccgaaccgcccacccaagaacactgccaactccccaatgccgcccctttgtgagagcctactaggatctctaagactacgcgacacttacatgacggacgtaaaagacggcggtcggtccgtccaagggtcncgtcntacgnctgtccagcatctaagtncaagcataatacatatanctagtgt

SEQ ID NO: 23680 - DNA, 792 bp, Triticum aestivum
  unsure (1)..(792): unsure at all n locations
  Clone ID: PAT_TA_23680
gagagaacaagaaaaaaaggagaggaaaaacccaagaaatccgccttgcccactccgatctctccaggcagcatatcccgccccgagaatttcccccggatttctttccggagctaccccgcccagattcgcgatctgagttcggaggatgcgcggcgatcccctcccccattcccgcgcgcccggatcacaccaaaggcgtggaggagactgactgactgagggctccggcacgccggcgaggtggttccaaccgatccgatctcgcgtccgcaggtttcctgtgatttggcaggggaatgcgcgtgtcgacatggtaagccgaggaggaggagccgtgcggtcgttgctggatcgcctgcgcccgccgccgagggggaggaggagccccgccatgccgccgccgcccgccgccgccgccaaaggcgcctgcttttgcagctttagccactcgggcgcgtacggcgaggggcggaggaagggcgtcctggatttgggggtcggccggaggttcgcgccgggcagcgcgctgagcctgaaggggtgcctgaactggcaagacggcggcaggttcaggagggcggatggtggcgatggcgatgcggtggagatcaaggcgcgggttcttgccccgcagcggcagttcgtccgtgacgcggaggttcagctgtcggaagaggtgggcatgaagactgtggatggaaatggcgctttccgggcggnggaagcgccttgatttccctgagcagcctgtgccgactaagatgngggtgctggtgatgtggatgaagt

SEQ ID NO: 23681 - DNA, 1375 bp, Triticum aestivum
  Clone ID: PAT_TA_23681
ggcgagcgaagcgtccagtgatctagacctgcagctgtccttttctccatctcgctcgatccgcgtgcctaaccgacgctgccacgatccccaagaatccgatatagggatcgacgcccatggccgcagtgaccaggaagaagaaggtcatcatcgacaccgacccagggatcgatgacgccatggccatcttcgtcgcgctgaggtcgccggagctggacgtgcttcgcctcccaggcagatcggcgatgtcggggcgcggcaagggcggcaaggggctggggaagggcggcgccaagcgccaccggaaggtgctccgcgacaacatccagggcatcaccaagccggcgatccggaggctggccaggaggggcggcgtgaagcgcatctcggggctcatctacgaggagacccgcggcgtgctcaagatcttcctcgagaacgtcatccgcgacgccgtcacctacactgagcacgctcgccgcaagaccgtcaccgccatggacgtcgtctacgcgctcaagcgccagggccgcaccctctacggcttcggcggctagattcgtgtcgtgtgtccgtgtgttctgtggaagacgggttttactactgctttggcgtgcgtcgttgtgttccgtcttgtgttcattaggctgtaattccttgttgcggtcaatgaaactagttctgttctgaatcgaaatcggaattaacattacgcaccaagtactcctttctgatgttgaccggaagaagcttgaacagtccgatagcaaatatgctcgctacttgagcaatatactgggttattattatgattatcacatggacgcctactccataacaggagtatatcttcatgatccgacaatcttcttgccgccgtagatccgtcgctgacgacttacacggacgcagtggtgagggttcagacggatggacccacaacgcgtcccaccgttttcgccaatacccagacaacgtatggggagatatcagcgtggtgtggcaagccgtccgtgaaggttcctgtcacggtcctcccccgcggtgcctcgctgcttaccatcctgtgccccctcgccggcaactccttcgtgtggtcagcgatgctgctgccgtgctgcatcctcacctgtgtcaatgttgcattatgtactgtctaccttcgggggctgagatgaaccatgggcctcttcttttgtagttcaacacttgaacatttacacttgtagcacaacacttgaatatttacacttgtagtccaacacttgagcattttacacttcaggcagaaagaccagattatagttcatttttcacttttcagttctcaatgcacatctgaataaattgtttggtgtataacttccaaaaa

SEQ ID NO: 23682 - DNA, 676 bp, Triticum aestivum
  Clone ID: PAT_TA_23682
gaattcactagtgattagcgtggtcgcggccgaggtttttttttttttttttttttttttgcaaaattgttcttcacttgtttacttgggtatatgtacatacatctatttacacattgcatcacatgaagattaccaaaaaggggtgcatatatatacatcaagaatacatcacttctcactagctaaaatatagccattgactggccaagacccgtgcaaaccatggcgatgccactctggttgctgcgtggcattaccacagagctaaggacggctctctccacctcctctgaaggctttcttttaagcaagcatatcacatacgccatcaccgccgcgttgcaaggtaccgtgatcctgtcttcactcgtgaaacccgaactcgtcctccgacatcctcaggagttccccgaacaccgttgtactgaggtacgccagcgggacctcgaaccgctctccaccgggggggtagacaacgcagtggcccttgtctgcgatggccgatgcgccccgcccgtcggcgccgtggatcgccgccatcgtcgctggcctccgcttcctgagggctgccgtctgctgccactcctgcccccgccccgccggcccccgaggtcttttccgcggcgattttttctgataagatgcccttttgcataaatgtgtgttggtactt

SEQ ID NO: 23683 - DNA, 739 bp, Triticum aestivum
  unsure (1)..(739): unsure at all n locations
  Clone ID: PAT_TA_23683
gccggccgggcctgcggactaacntacttggagcgaagtccagcacactcctatcccacatcccaagacaagaagcgcctggagcttgccatggcagccaatccagatcgggaggtgtgccaccgggcagggagaggagggaagatgctgctgccggtgatggccgtcttggcggcggtggtgctggcgtcgctgccgtcggcggcggtggcgaccaactacacggtgggcgacgagaaggggtggaaccccaaggtggactacacctcctgggtgaagaagcaccgccccttctacaagggcgactggctcctgttcgagtaccagaatgggcggtcggacgtggtgcaggtggacgaggtcggctacgacaactgcgacaaggagagcgccatcagcagccacagcaaggggaccagctacgcgttccagctcaaggaggccaaggactacttcttcatctgcagctacggctactgctactccggcatgaagctcgccgtcaccgccaagaagggccccgcctcttcctcccccgactccggctcgtcctcctcctcctcgccggccgccaagtcatcctccaaatccgccgcctcccctctcgccgcccgcaacgccgcccccctcgccgccgcccttcggccccgccccctccgacccactgatctctctcgctgatccgtttgccatcccttcccctttccctcatctgttttaatcttgtcttgggtctctc

SEQ ID NO: 23684 - DNA, 389 bp, Triticum aestivum
  Clone ID: PAT_TA_23684
tcgagcggccgcccgggcaggtctagtctcgagttttttttttcgggggttcgtctccagcggcccccccgggcaggtccaaaggccaatacatatacatgtatggtaaaatgcaagaaaccctttatacaatggggatattaagaaaatggactatacatatctgacaataaccacgtaattgcgaatgtaatactgctggttaagtaaacatgatgtcgatatttttttcattgaggaacgtgctgtcgatctttgtagcgaagagaaagatagatgcacatgttcctttggatgttctttcacttgggagaaaacctcggccgcgaccacgctaatcacgactcctggctacctcggccgcgaccacgctaatcactagtgaattc

SEQ ID NO: 23685 - DNA, 668 bp, Triticum aestivum
  unsure (1)..(668): unsure at all n locations
  Clone ID: PAT_TA_23685
gaattcactagtgattagcgtggtcgcggccgaggtctagaaccgagaataccgctgagaaggcacatatctcccaccccgcccatccgcagcaccagcttcagctggtggtggccacccagaaattccagtgcaacggctgcaagcagccgggcgcgggacaaagctatcggtgcgagccatgcgactacgacctccacacagtctgcgtgcctcccaaaacgcccctcaagcacccccggttcaatggctgcgaactccgcttgctcctcgagccacccggcccggggcgctggtgcgacgcctgcggcgatgttgtgctcggcttttgtgtacttcaaaccgcgaacgcgagatcgacctccaccccgccctgcgctttccacccacagctcgtcgagatagacggcaccctgttcgagctccacacggacaaagacgcggaccttgtttgccggcgatgcgaggtgaaaggcgcccgccgcaatcaattactggtcctatcgttccaagggaccgccgcgatgacgggaagcttgcgtactgcacttagggtgcatgataaacggngaaagttccgcaagcgaaggccaaccgcctacaacatgcatggcgctccctccggcgcctactggccttggtacaanagtanttgggagctcaacaaa

SEQ ID NO: 23686 - DNA, 530 bp, Triticum aestivum
  unsure (1)..(530): unsure at all n locations
  Clone ID: PAT_TA_23686
gaattcactaagtgattagcgtggtcgcggccgaggtctagtctcgagttttttttttttttttggaaaaagttgatgtatatataagcttctgaaccatcaggacacttgcacatgccaaaaattacagtggggtagacaccctttgggacagtaaactaaaactaaaaatctatatttttttccttttctttccttttgacagggaaatccaactaaatatctgctttcgaacataaactaaaactctgttttttttgcctttttccttccttttgacagcgaaatcaaactaaatatctgtttttttcttttcttttctttcttttgtactgaatgagtaggcgtagcaagcgagacctgcccggggcggccgctcgaaatcgaaattcccgcgggccgccaagggcgggcgggggagcagtgcgaacgtcgggcccaaattcgcccctaaaagggaggcctcgtcccctaagccctcctaaanccccaatgnttatggccccccctggnaaaaaaaaantatgcnt

SEQ ID NO: 23687 - DNA, 342 bp, Triticum aestivum
  Clone ID: PAT_TA_23687
gaattcactaagtgatttcgagcggccgcccgggcaggtcgacgaccgtggcgccgcgccggaggaggacatagacggcaagaactggcatttcttccccatggccacgggtgagcagcacgctaagatctaagcgttgctctgtctctgaatttcatccgctagactgaagaactaacaagcgagcctgacagactgacactgttgttcatcacccttgtttcagcaaaacagtctccccagtactgtacacaatttctttccgtgacaagaagctaactactgttggtgtaaaaaaaaaaaaaaaaactcgagactagacctcggccgcgaccacgctaa

SEQ ID NO: 23688 - DNA, 493 bp, Triticum aestivum
  Clone ID: PAT_TA_23688
ctcgtgccgaattcggcacgaggggtctttctcatcttttcatcttctcaatctacaaaatcacacacaagatcaaagtaaccttccaacttcaaaatggacactgtaaagcaagctgccaactacgtcactgagtctatccaaggtagtggcgctgaggcctctaaagaggcaaacaagagcgttgctaaggattcggaatcaaacttgtcctcccgagtcacagcagcaaaagatgccgttgttgacaagaaagatgaaatgtctcacaacaccaaagccaacgtcaacaaagaatcagctaaacactagagattgacagagcactatgtgagggggcatgaattagctaagatagactcaaggctgtggaggaatttgtttctggctccgatgcacgagaattagcacaagccttctcggcttttaaataacttactatttttcttctgaaaaaaaaaaaaaaaaaaaactcgagggggggcccggtacc

SEQ ID NO: 23689 - DNA, 587 bp, Triticum aestivum
  unsure (1)..(587): unsure at all n locations
  Clone ID: PAT_TA_23689
ccgaggtcaactacctacatcaggggtgtgagatgcagattctacactttgacatcaagccacacaacatccttcttgatagcaattttgtcccaaaagttgctgattttggtctcgccaaactttatccaagggacaagagttttgtgccatcgagagccctacggggaacttttgggtacatagctcctgagatgatgtctccggagctttggtgtcatatccgagcaagtctgacgtttacagctttgggcatgcttcctgctgggagatggctggaggaagaaaggaacgctgaccccgaacacaagcaaactccgagccaagcgttactacccatcatgggtgtttgacagactaactgcacaagaagtgtgttgagaacccctgttgacgacatgcatgagttggagagaaactatgcattgttggtttatggggcacccagatgaattcccatgacaggccgacaatgagggaggccatananatccggaagggggttcnaggctgcaaatcctccaagcatctcntgatgataacanatgcgttcggatctaccttgtatccggctacgaatccgagag

SEQ ID NO: 23690 - DNA, 588 bp, Triticum aestivum
  unsure (1)..(588): unsure at all n locations
  Clone ID: PAT_TA_23690
agggttntgagggccagnaagttgntaantgggtgatngccccaangtttgttanntggtttgntganggggaatgtttggtgactncnttgaaangctttttcttnaactgttggggttgaagatggtggcgaggattcccaagattnttaagccattgttgcatgatgacncntatggtaacttgattcaagtttgttaggcatacaaatagacggattctactctgggcccaagtggtatgattcacctgtaggtttagattccagtggcgatgcaggagtcgccagtgtttggcgtggtcgcggccgaggtttgtgattcacccctgattccaggaacgtcctggtaaattctgtatgctagaaatgtcataagcttgcaccaatttaatgtagtgtctgtaggtggagcttcaaagtaacctatcttccctgatatatacaggctgattaattcaaccttcttaacttgtctatagtgccgctgttgattactgtcttctttctagacagttgaacattggttctgttcttaaagtttttaatcatagtattttactatcttattattgttaaaaaaaaaaaa

SEQ ID NO: 23691 - DNA, 613 bp, Triticum aestivum
  unsure (1)..(613): unsure at all n locations
  Clone ID: PAT_TA_23691
tcgagcggccgcncgggcaggtgttggttcctccccctccatctctctctctctctctctctctctctgacaatcttcagttctgtcgcacgcatccaacacacaaaccttattggtccctctctctcgcgcgctcgcgcccgcgctctctctctctctctctctgacaatcttcagttctgtcgcacgcatccaacacacaaaccttgttggtccctctccctctccctccctctctctctctctctctctgacaatcttcacttctgtcgcacgcatccaacacacaaaccttgttggtccctctccctctccctccatctctctctctctctctgacaatcttcagttctgtcgcacgcatccaacacacaaaccttgttggtccctctctctctccctccatctctctccctctccctccgatcctctctcgctctctcgctatctccctcccccctcctcttgctcgctccctcccgctctatctctctcgttcctcccgctcccccgtccgtctccccctctcatctcgtcgctcccctcctcccctccaccctccgttccgcccctctcctctcctctctctcctcttcctatcctctctttcttg

SEQ ID NO: 23692 - DNA, 1702 bp, Triticum aestivum
  unsure (1)..(1702): unsure at all n locations
  Clone ID: PAT_TA_23692
agagnnnnnaacgcgtgggctcgctccctccctccctccgatcccctttatccggccctcgtccccccaccccatctctcgcctcggaagcttccacgagctctcggggggagagatcacagccccgtgcgaccgtctccagcatggctctgtggcggcgcagctcgtcctggctcacgtcctgctcgcgcgcgccggccggcatcggcggcgggaacgaggccaaggtctcgcccgaggtcgccccggaggacgccgccgcggagcacgagggccgccgcgcggaggccggggacgaggagaggtggtcccgcctgctgccggagctgctcacggacatcgtgcgccgcgtcgacgccggcgccgagcgctggcccccgcgccgcgacgtcgtcgcctgcgcctgtgtgtgccctcgctgccgcaacgcaaaccgcgtcgtcgtgcgcacccccctcgcggccggcgggcgcgctttcccctcctcgcccctgacgccggcgcctccgggggggccgtttcgctcctccccccggccgaccccagccacccccgccgcgtcgcggtcgcgcagccggtcacccgcccgtccggtaagggcgaggacctcccggctgctcgaagattcagacacggggcacacaccgaatatatcatctcttatgactctgatgatctatatccaggaagtaattcaggtgttggaaagctgagatcggacttcctggggacaaagttcgtcatgtacgacaatcagaaaccatacgacggcgccaagtccttgaagagccgatcaagtcgccgctttgcgagcaaacaaatcagcccacacgtttcaggcgataatcttgaagttggacaggtgtcatacaggttcaacttcctcaaatcaagagggccgagaagaatgcactgcagtatccagtgccccgtaggccagggcaccgcatccgatccatccaaggagaagccaccgagcacctccagctccttgtctctaaaaaacaaagcgcctcggtggcacgaccacctgcagtgctggtgcttgaattttcacggcagggtgaccgtcgcctccgtgaagaacttccagcttgtcgccccggccggcaccagcgacccatggggcgtcggggacgaggagacggtgatcctccagttcggtaagatcgaggacgacgccttcacgatggacttccggcatcccctgtcggcctaccaggcgttcgccatctgcctcaccagctttggcacgaagctggcctgtgaataagtgccatctctgttgatgttatcgtgtgaatcatgtggcggatggcatgaactcttggctctgttaatccgggagaaaggggcggcactgtgatactgtactcgcaatctctgctcttctctttctcgtctgatgatggatgtggatttgactctatggctgtggttgttgtttgtaaatggcactccatttctttcggtgatttacccatggagcatggtgtgtaccttgctccaatgccgttttacccttcacgtaggtagacatggtttggggctgctaatctgcattgataaattaacccttgtacatgtcgttatgactaccttcctccaatgccgttttaccggcaatgtatcccttttgtggtctacatgacattgtaatgttaagtagtaacatttgtatcgttgtctgataaaaaaaaaa

SEQ ID NO: 23693 - DNA, 1620 bp, Triticum aestivum
  unsure (1)..(1620): unsure at all n locations
  Clone ID: PAT_TA_23693
caaaggaagacccattacttcgatcgattatatattgaatcccttttctaagcaataccgctctgttattggtctgttatatactaaatactaaactaaatactaaacagatacagatcaaaggggtatcctctggcattagaaaatattcatcttgacaagaaattatctatatgttaagatatctctgataagggctatagctcagttcggtagagcaactcgtttacacgtccgccagtgcttttcaaaggagcttattatgcaatgaacataatcgatcttattgcaaaatcaatgtcttacttcatagattcgagagaataggagaacagtagcctgacaaacagtcggttcagtccgattcaggtgccaattcaggtgcctaatcaaatagaacccttatggatttgctagttgataaggtaaatatccagcccactaaatgctaggcgtaatgaggataagggcctccaaaaaacttcttttcgttctatgaactttaaggtgtatgaagtctcatagttaactcttgcagtggaacgatagagactccatttcacttaggttgatttaatttagaccggaggcagacctaagtcaaggtaatcctcctttgaaacactttggtattgctcctagatagatcataataaaaaaaatcaatcagagcacagggagccatctcattatctttccgtaaagaaaaagtatggtggactaactgatctttaaatcagtttatgaaagagcccaatgcaaaaaaatgcatgttgggtctttgaaacagttcaaatcatttcgataataatccgtttgatctgttttacaaaaaaaaaaaaaaactcgaaaccgtttctctcccctcggccgcgaccacgcttttagcatctctatcctatgttttctttagtttagtatagttttcattttctcattagtatttgtttatagactggataagcgcctgcgacataggataaagataaaggcattacaaaaggctcattcatcgaaaatcaaaatcatacagacaggaaaagaaaaacgaatttctatcaaatcaatagaagaaaggatcctttccctgatttgaatcccgtcctccttcaaataggatatctctagacttccctataataactgcaatgattttatccattttgcgaattcctactttgttttaagtatatttattactttgtttatagatacattatgtaaattgatcaactttaaatagaaaaaataaagtaaagagtaaataagaaaacagaatattctgtctcatagttctgaaatagagttctttatttttattttatagtattacttctcattaattctactgcatagattagtcctactatcttaattaggttctaatttagtagtattctcatttttatttaatagtctcttattattttattattaaatattaaataaaggatagagctattcttttttctagagattctagagaaagcgagacaaagtgaaacgagaaagttttctttatataagaattagatctacatacaccatatctaaatagagggaagcgaaagaccaaaaagggttggggtgcctggggatgcctcttgggagtgaatnntc

SEQ ID NO: 23694 - DNA, 760 bp, Triticum aestivum
  unsure (1)..(760): unsure at all n locations
  Clone ID: PAT_TA_23694
gcgtgaaacctaccacatggttctggtggttttcttgacactgacaccctttttggactagcctgggtgttgcccagaagtcctagaaggtacacagcagaaaattcagtaaaatatggtgctccaagggacaccgcgcgccctgagctcaggcagccattggcttttgaagtttggcaacatattagagaagaactcaaaccaacgaattcactagtgattagcgtggtcgcggccgaggtaaacatagcaaacatcattctatctgacacaaaagcagaatcagtaattgagcacatttttatagtcgggagtcatttggctggcggaaatggagatcgaggcaatgtgttcactgttccatcaaataagttttcagagttcaatttctttcttgaccctcaagctgccaaggcggttgtagaatccggtttagacatcactctcattcctttgagagctcaacgccaggtggattctttcaaagaagtcacaagatcgttgtgtactgctgagaagactcctgaatcattgtttgcataccaagttgttgctgtcaatgcagaaactgcaaaagaataaccaaagcatatcatcacatcgacaatgttcccttgggggagcttcctggggccgggtggtccttgggtcaacaatccgcaacctgaatcaactccgatnaaccaaaggggntaatcancggttannatttgggtcaatgttaagcaatccnatgggcaagaccaancccnccgcccgg

SEQ ID NO: 23695 - DNA, 256 bp, Triticum aestivum
  unsure (1)..(256): unsure at all n locations
  Clone ID: PAT_TA_23695
gaattcactaagtgattaggcgtgggtcgccggccgaggtctaaggttgcatgacttgtttggttgcgctgttggtagaattgaatctcgcagctggtattagctgattgtaattcaatttccgagtactggtatgtactactactgcctagtctcttacaaattaattgaagttctaagttctgttcaaaanaaaaaaaaaaaaaaaaaaaaaanctcgagactagttctcacctgcccgggcggccgctcgaaa

SEQ ID NO: 23696 - DNA, 700 bp, Triticum aestivum
  Clone ID: PAT_TA_23696
gaattcactagtgattagcgtggtcgcggccgaggtaagctagcaagctgaatagaacacaagcagacacgaaggcctccaggactgagcatggaggcgaaggcacaaagtggatttgtgcctccaatgcgagggtcttccgaccagtcgaatgatcgaccatatgctccgccggacgctagccaaaaggcgccgtcgcctagcagagctaaagcatcgtcgacaggaacaacccctgagcccagcaacggcaacaactcatcgagaacgccatacaaagcagagaaaacgacctcacaaaaaggcaggggcctctcgtggggggcgtgggtctgcgtgcggaagaagaatcatgtgaataaatatcagtttgtcctagttatctatcaagtacgatatttcgtggtccaagaaacctctatacctacatatgggtaatggattgtatagcttgtgaaagtggtcgtgtagacaagtagtatttcatttgttcatgcatgttcttcatttatatctataccttagttatgttggtgaatttgtacggtgggtcatatatatttatatataatgtaaaagaaaaaaactcggtttgctcgtcctcgcgcccgatctcgcgtttcctaactcccccggccgccttcgccgggcggggagcatgcaacgcccgggcccaaatccccctaaaagtgggtcctat

SEQ ID NO: 23697 - DNA, 408 bp, Triticum aestivum
  Clone ID: PAT_TA_23697
aattcgccggcggacgaccaccggcctcgaagacggcgcgtggcggcgagctcgtactggagcaggggagtgagagcaggggagtgagcgagcaatgagagagtgagcgagtgtgtgatctcgaccgaccgagcgggtatatttaccccacttccgaccgggccggtcggctaacggccgtgaactgccgcgccgtgagcgcgcgtggccacgttggctgacagatgggcccaggccgtcagaaaaacggttaaatcgctagtcaccacgggtttggatttttttgaaacagcggaccgcgcgtttggtagctttctgagaaaattaaaaaagtgatagttttttggaaccctaacctgtaaactagtagctttatgctatttactccaaataaccaataacaaaaag

SEQ ID NO: 23698 - DNA, 768 bp, Triticum aestivum
  Clone ID: PAT_TA_23698
atgcattctatctggtcaacatagaacaggaaattgcaactgcagggcaagcagtcgaccaggtaatcctgatgaagaatccggcacaagggctagcatatcaagaattgttatgctagcagaagcactctttgaggtcttggatgaaatccaccaacagtctgctgctttatcctcaaggacatcattaccttcaattggatccgttcctgctccaaaggagatcgtcgagagtcttcctgtcaaggtgtacagaaagccgttgaaacatcaaactgatgaggctgcacaatgctacatttgccttgtcgaatatgaagagggagactgtgttcgcatacttccatgcaatcatgagtttcatctaacatgtgtagataagtggctgaaagagattcacagggtttgtccactctgtcgtggtgatgtctgccgatctgattcgtcgagcatagggaaattcagctgattcttttatctcttaaggatccagcttcttgcgagaaaaaatggagcttcggacacggttcttcgatccagcggaacagagccggcagaatgttgcgggcgcgatttgatcttcactagcctggtctgaacaactcaggatgctcctgtatgttttagcaaatttgcgtggcggtcatcccattataagcgatgaacttccatgcgaatttgagattgttgtacggtggtgtgaagcctgttgatatattggttatatatggcttgcgttttcgtgatgtttggaaaaaaaaggggggg

SEQ ID NO: 23699 - DNA, 994 bp, Triticum aestivum
  unsure (1)..(994): unsure at all n locations
  Clone ID: PAT_TA_23699
tcgattttgnttccccatcgggcggatcggagttgtcgagcggcggaggaaaccctagcctacatcagagaagaagaccaggcggctaccgatggcggcgcttcgagtcgcggcgaggaggctcgtcggcggcggccagacgccggcggtggctgtggacaaggcgcagcgccggctcttcccgaggctctcccaggtcggccgggctaggtccaccacatcctccgctgctgctgccgcggacaccaatctggcggcgaccaagccggcaccgctgggctgtgaagatcgggagaaactcatgagagagatccataacatgagagaggagctgtatgagaaggtttcgtacgcggaaaggacctacagtatccctggcagggcaggcaaacatatcaatcggctgcatgacgatccgccgcatgagggagcctcacccctgcgggcggctcctggagccaggggcgagcgcaagagcgccttatgccggtgctaaaaaccactggttgcgtcctactttgcgtatgtgctccttcgcctggtatctgctcatggccatggccgctggtaagatcgttgaattggatccagatgaaaagcaatggatcccgaagaaaagaggggagcggcgcaagcgaaagtgaaacaaaatgattgagggccatgtttatgaacggcacaggtcccaataaatggttggtactgtgttcttacatggacgatcatcgatcgctttgtagggccgatctagctggttggtaccaagttgtctagatgttatgatatatctattttagtgtctcccgtttctatgtttgttgaagatattgaaataaggagttcacagctcctgctgatgttgctgcttaaaggctgacatgtaaaaaaagttaagctgtagtagaagcatcttctggggagcatgcngaaatgcagctcacacaacaaaaaaaaaanaaaaaaaaaaaaaaaaaaaaaaaaaactcgagactat

SEQ ID NO: 23700 - DNA, 281 bp, Triticum aestivum
  Clone ID: PAT_TA_23700
gaattcactaagtgattcgagcggccgcccgggcaggtcatgcatatgcatgccatggcggcctgccccgctgatgtaacattggccaagctgcatgcatgctatagtatttttacttgcaccgtgtaacgttactggtagtgattgggaggtggaagaaggtgacaaggttgttgcaagaaaggcaggctatatatttaagctaattaatttgaacttctcatgcaaaaaaaaaaaaaaaaaaaaaaaaaaaaaaaaaaaaaaaaaaaaaaaaaaaaaaa

SEQ ID NO: 23701 - DNA, 247 bp, Triticum aestivum
  unsure (1)..(247): unsure at all n locations
  Clone ID: PAT_TA_23701
gaattcactagtgattagcgtggtcgcggccgaggtgtaaatttcaaaaaaataaacttgtaccaaataacatgttctaactttttttctgaatcagatgtataatagacacatttcagtccgcatgtggtccatattggaatatcaagaaacatcttatatttgtgagaaaaaaaaaaaaaacaaaaaaacaaaaaaaaaaaagactaaaaaaccccgtgactactacctgcccgggacgttncca

SEQ ID NO: 23702 - DNA, 1762 bp, Triticum aestivum
  unsure (1)..(1762): unsure at all n locations
  Clone ID: PAT_TA_23702
ggcccccgggatatttttcgagcggccgcccgggcaggtcgcgaggattgcaaggcaggaggacgaagaggagctccgcctgcttgaggaagaagagaggcgtgagcaggagaggaagaggcggcgggtaggccgatagcagccggatcagttagctccagcatttgtcatttctggatgttgtttccgcaaaggcctcaacgccttcggctggaatgtgggtgctgtctgtgcagacaacagtgaacgagcctccgagctctgcccccagttaagcaccgtgcgtatttcacgccaaatcagaaaaaaaaacggcaggcgaaaagttcttgcagatttgaagtcgcttgtagaccgttgaagtcctcgtgggttgtacctcggccgcgaccacgctagtgttacctaatggtcgactacagccctcacaaagccaggggatgcaagttctcttgtatgggcggtacccgctcgtctcgttgttgggttgtactacctgacatctcatgatgtaactgattgttcaccggtcgccggtcatacacatgccacagcagtcggccacctctgttaaattaaagctggcatgtaggagccagaggccactgcagtcgtcgcagagccagaggccactgcagtcacagagccagaggcaactgcagtcctcgcatcgtgagaggcaactgcagtcgtcgcagagtcagagaccacaacagtcactacagagacagagaccacagcaatcttcacagttgcaatcctcacaaagccaaagacagctgccacaaagcaacaggccgcagcagatgttgcaacggcaaaggcctctttcctcgcaaggtcattatcctgagcaaagaagagtccaagcaaatgatcgagtaaaaccatccgaaaggcagccatctcgacaagtatctgccaatggacgtgatgatcgtgcaaagaaaaagcaattggggaaacgaaggtttgatgacgacattgaagatgaggatgatcccatggctatgatcaggagtatgttcaggtatgaccctagtaaatatgcaggcagagatgatgatgatagtgacatggaagcagattttgctactatagagatggaagagaaaagaagcgcgaggattgcaaggcaggaggacgaagaggagctccgcctgctcgaggaagaagagaggcgcgagcaggagaggaagaggcggcgggtaggccgatagcagccggatcagttagctccagcatttgtcatttctggatgttgtttccgcaaaggcctcaacgccttgggctggactctggtgctgtctgtgcagacaacagtgagcgagctgccgagctctgccccagtcaagcgccgtcagtatttcacgccaaatcaggaaaaaaaagcggcaggtgaaaagttcttgcagatgtgaagtggcttggtagaccgttgaagtccttgtgggttggtacttcttccccgaaagctggataggggtagttaagtcccngggcgtatccgagattagtgcaccaaaggtccaaggtgttcctttttttttggaaagtgggtacccgactccgtccacattggttgggtttgtactacctggttttccccnaaggatggtaactggattttttccccccccgttttagctgggtccaacaaaacatggcccattagataaagtngaacctcccgggtttaaattnatttttgggattgtnagggnggtggtttngaacctnagtnaaacnaaggcatttttcc

SEQ ID NO: 23703 - DNA, 460 bp, Triticum aestivum
  unsure (1)..(460): unsure at all n locations
  Clone ID: PAT_TA_23703
gtcgggcctcgtcgagccgcccccccggcccgtggaagacgcggcagcagcagccgcggccaaggcgaaggaggaagaagaggccaaggaggctgaagcaaagaaagacaaggagaaagaggaggcggggttgaagaaagccaatgaggaaaacaaagggaaggacaaagcaccggaggaagccaatggagacatcaaggaaggtgacaagtgaagtgacatcaagaaaggaagcaaaggaaaaaagaattagcttgttcactagtgcccccttctacaaaagataaatgcatctttgaaatgaaaacctctaaactgaaatattatgtgtagcatctctcatttgtaatatatatgtgcccccttacctatatactccctccttgtagatatttgttttatctctaatttgtagtacctcgcccgcgaccacgcctcacctcggccgcgacnacgctaa

SEQ ID NO: 23704 - DNA, 898 bp, Triticum aestivum
  unsure (1)..(898): unsure at all n locations
  Clone ID: PAT_TA_23704
tcgcccactttttccccgacctggggatnaggtgtccaccgncattatcggntccaagnggatctgnttgncngagagtttttncgatcgatgntttngaagganaaacccagataaagtgatgcttcagngtaccntgntaggttttgnagaagaattcgtgaagtggctnacggaacttttggaggcttgggttcgttccgcgagcccccctctttgacttctgttctgaacaactacactcgaagatctacttgctctgctctttgctcagctgcgggttttttgccatatcgaatttccctggtcgacggaagcttgcggtagagaaggtcagcaaggctgccgatgaactatctcgtaaagttgatgaagctattcagaaggatatatctcagagtggtagtaagctagtcccagttcgtagaccctgccagccaaaccgtaccaggaagcatgccagcgaaaaattgactggctgcagggtgttcagggtgagttgtccgccgttgagcgtaagctccaaactctgaaaatcgacatccatgatccgcgcggccccccgcgctacttgcctttgttgacgttttcttcattcgtttgcacgtccacaccgctcatcaaattttgtttggtcctgtgccgtgatgatgccggtgtagagcagttcctgtatgatgataggtatgtctgtaatatatatgtatgttgtacgttccaaccaaatgccatgaatcatgtctcgaggtagttgcccctagggccagcacagaaagctttgcaaactgtaagggacctacatcagtactccgactgtcctatatggtagtgttggaaatcatgtgtaaaaatggaaaaaaannaaaaaaanaaaaaaaaannaaaaaaaaaaaaaaaa

SEQ ID NO: 23705 - DNA, 535 bp, Triticum aestivum
  Clone ID: PAT_TA_23705
ccgttcctgccgtgctcgacaagatgatgaagtccgggcgcgacggcgccgaggccgcggtggccgtgctctgggcggtgtgccacaagtacaagggaccgcagggccgcggaggccgcagcggcgtccgagggcgggctgacgagggtgaagctaaagctgcggcttgcaagctcggcggaggcgaggcagatggcgctggagctgctcaagatttacaaggtgaacgccaagagctgcctcgccggatacgattccaagaccgcccacatcatgccgttctagccaagctaaacgaatggcttgcaagctcggaacaggggataattccttttttttttctttcatgtttattttgttttttattgtaagttttgatagagaaacagaagaattgattggtcgagagaagaggaaaaataatatgtacagtaaaaaaaaaaaaaaataaaaaattaaaatctatatataataattataatttaagaatatataaatattataaataaaatataaaaaaaataataactggggg

SEQ ID NO: 23706 - DNA, 487 bp, Triticum aestivum
  unsure (1)..(487): unsure at all n locations
  Clone ID: PAT_TA_23706
ggcgcctccacttctctgctccctcgtctcctcgcgcgcagggcccggcgaaagggaagcaagatgtacaccgccaggaagaagatccagaaggacaagggcgtctagccctccgagttcgaggacaccgttgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaaagcccttcaggaagatccatgtcaggctcgtcagggagctggagaagaagtttagcggcaaggatgttgtctttgttgcaacaagaagggattgttaggccacccaagaagggttctgttgttcaacgccctcgcaacaaggacctgacagctgttcatgatggtatcttgggangatgtcgtgtaccaanctgannattgtgggggaaagc

SEQ ID NO: 23707 - DNA, 416 bp, Triticum aestivum
  unsure (1)..(416): unsure at all n locations
  Clone ID: PAT_TA_23707
cgaagctgcgctacgctgacccagaggtcttcaggcagatcagaatgcttcccgaagaatacgtccagaggtacctggctgtgaggaacgcagcggttgtactacgataacaagatccccgccttaccgtgcctgttcttactagccaatgccctgctctttgatctgaataggcatcatccttttcctcctgatcgcgtcgctagctcactaggctactgaacccttgtgcaattgagagagatattttgcttctgtgtactgtcatccgacgtgccttttgtgccactctgccctgttgttattccaaaaaaaaaaaaaaatctcgagactaagttctctctctctctctctctctctctctctctctctctctctnacctcgggcgcggaccaacgcctatccgaattcccgg

SEQ ID NO: 23708 - DNA, 1085 bp, Triticum aestivum
  Clone ID: PAT_TA_23708
acgtgacgcgcatactctctctggtcctgctattatccacttccgccgccgccgccgccgcctgtcgtcggcgagattccgtggttgatgcggccgtgaacacccccgatggccgcgcagccgcccagctcctcgccgcaagatggttccggcggaggcggatcctcggaaaatctggtactccaagccccacaggcagtgcgggaggattacgtgcagaacgccgtcaatttcctcgcgcatccgaaggtgaagggttctccggtgtcctacaggtactctttcctggagaagaaagggctcaccaaggaggaaatcgacgaggccttccgccgggttcctgatccgccgacaagcagtacggatgctgcggctgttggttcgcaacaagcaagcaatccaaatcaatctgcgggggtgcagccttacgcatcagttcagacgccacaagcgccaaacgggctctgtcgccactgctcacagcggccgacaaacccaacgcaccagttagctcgtgacagcccctccctgtgcctgtggtttcccctggagctaccacggaggcgcccatgcccgtcaccgcggaccctattctcccttcaacggacattttccgcacaaaagagacggctcgcagcaagctcagcagatcctcctagcccgccagaatctaccatttattcagcagatgaacggcggatccatctgctgacacccctgacgagtcgcctactagcagcgctagccgtgggcaccatggccgggcgcggcccgaacggtgagaatggagaagggcctggagccgcctagattttgacgtagagcaactcattcgattttccgtgttgtgtgcggttcacatatctaattatctatgcactgttaattaggtattggaaactgcatatgatggttgtaattagcagcacgtgtataagaaaaaatggattagatacttgtgtgattcacttgacggcaccatgtatacggaatcacttatattttctacctgtatgtaagaaacattttctgccgcaggtcatattaaccagcagtttggatagctatgattagtgataaaaaaa

SEQ ID NO: 23709 - DNA, 685 bp, Triticum aestivum
  unsure (1)..(685): unsure at all n locations
  Clone ID: PAT_TA_23709
agaattgctggcttcaaaggaagaagataagaagatacttgtaaagttaacagaagcattggattctcaggcagaggtgttgaaatccttgagcgagaccttacatcatacaagggagaatcggttttcgcagtacaatatgttggaagagcatgctcaacctggaccatggaatgggccaactactaattcatggagaacttcccagcaaaccaatatgtacacaacgacgccaaatggtgattttgactcggggaggcaaccgttcatgccattacctgcagaacctacatcgggatcatttccaagatcttatgttgatcagcgggtgccgagggctgggtatgggttccagccgcagatgggctatgacagattgaacgctggcactcgggagggctactacggttctcctccgtactaccccgggggcagcaatgccgttgatgctccagcaccggcaccagctccggtagcagtaccagcaccagcaccagcaccgacaccagttgcacaggaaagcccgttccagcgccactgggttcccccacagccaccgggggtcgccatgccagaggccggccgccattccgcagccaagncccttccaagacaagaccacagcaaggggaactcanccgannttaaaaaccggnaanccgccattaatgncaanggnggttac

SEQ ID NO: 23710 - DNA, 846 bp, Triticum aestivum
  Clone ID: PAT_TA_23710
cccacgcgtccgcccaaaacctgtttcgcactggtctggaaatcgcaaacctgtctgtttatctgagctttgcagggagatgggtgggaggaatatcggagttgctgtggacttctcatcatgcagcaaagctgctcttcgatgggcgtcaaccaaccttgccaggagcggtgatcaactcgtgctgctccatgtcaacaattcctaccagaatgagcaaggagcgatgcacctctgggaagagagtggttcaccgctcatccctctggtagagttctcggacccccatgtcacaaagaagtacggcctgtcaccacacaaggagacatcggagcgcgtttcacaagtagcacatcatatcggagttgggcccgttgggaaagttgtgcaaggcggtccgaccaagaagctgtgagctgcatggtcatcggattcccctcagctgaccacgctcaagaagcatcgtgatggggaagcgtaaaagcacttacatggggaccgtgagcgcctacctggtgggctaagcggtctgcgcggtcacgattattaaggagaacatgtgcccccatcttgctacggaggatgatattactgtctgcgatctcgaaaaggaaaacaggaagataaatcgtcctgtaaggacgatatagtaacgtccatgcgatggaatgaaaccaatactaataatatgacaataaggcgtgcttggcgtgtgcactcatgcacatctgttttgtatcctagcataaagttaacagtaatgagccaacactgtgggattggactctgaaagaaaaagaaacagaaactgatagacctcgtgccgaattcggcacgagggggggg

SEQ ID NO: 23711 - DNA, 394 bp, Triticum aestivum
  unsure (1)..(394): unsure at all n locations
  Clone ID: PAT_TA_23711
ctnttaactgggtatngaattcactagtgattagcgtggtcgcggccgaggttttttttttcaatggaaattcacaatacacactttaaaattgattttgcaagtacgggcaaaaggtaattaagatatacacaacgccatatgccttttggtctaaactaacggtataccaagtgccaacaaactaccgtggtacaagcagagacgacacgaactcctgctcttggctgaactgacgtgagctgttctgaccaatcaacggagcaatgccaccacgcccattgtttcctgcagcttcagagtgaggctgtgcaacttcgccttgctccaccctcggtgcaacacgggcgccccgtcaggagctgcagcctcatctccaaaccgggggcccgcg

SEQ ID NO: 23712 - DNA, 542 bp, Triticum aestivum
  unsure (1)..(542): unsure at all n locations
  Clone ID: PAT_TA_23712
gaattcactagtgattagcgtggtcgcggccgaggtgtgaaatgcaggaggttaagagatggtgggtggatttgggattgtctcaagaaattccagctgcaagggaccaagttctgaaatggtacatgtggtccatgactatcctcgagggtttctccttctcaaggtatcgggttgaggccacaaaggttatctcaatggtctacattgtggatgacatctttgatcttgtcgccacacatgaggagctctctctctttaatgaggcaatcaaaatgtgggatcttgcagctgctgagtcactgccgaagttacatgatatcatgttacaaggctctttacaccatcacaaatgatatccgctgatatggtcataaaaagagcaatggactgaatcctatcaaatcatctcaagcaagcatgggcaacttttgttttgatgggttcatgatccaagggaaaatgggctatctactaatcaaggtcccacatccgggggacctacctaagaaaatggggtcatcacttcnaggngcaacact

SEQ ID NO: 23713 - DNA, 757 bp, Triticum aestivum
  Clone ID: PAT_TA_23713
ggttcgtcgtacacagacaaacacagccatggtggaggacttcacatgccctaccattccaccggtgccgtgcggggccaagaagctcccttcccctcacttcacttcgccgccgccatggttcgtcgtcccggccgacgcgggagcgcacgaccatcaccggcggtgcttctcggccgccgagcaagccgggaaccccaacaacgacgtctacccggggccgggggggcgctccgagaggttcgccgtcatggaagagcacaagatggacatgctgtgggaggacttcaacgaggagctggcccgggcgccgcagccgtgcccactgagcatggagtggtcgagcgaggcgtggcacgctggtgaaggcgacggaataccatcccagcatgtggatgtggtggtcgcctccggtaccgggagcagcgtggtccggcgaaggaggctgggcctgatgatgatgctcaagctgctcaagaagctcttcttggcacgcaagtccagcaccacctcaaggaagacgccaccaaactgacagcagtttggatgcgagaattacatagatgcgtgcataaatcaatcccaggtgtatatataatatcgcattgtcgatcgatagatacatctttctgaatcaatcttctagcttctcacttgcttcttttccctcgtttgcgcggtcttcagagctttgtgctgctcaattctggcatgggttctgtttgaaattatcatggtttggattcatagataaaaa

SEQ ID NO: 23714 - DNA, 554 bp, Triticum aestivum
  unsure (1)..(554): unsure at all n locations
  Clone ID: PAT_TA_23714
gaattcactaatgattaacgtggtcgcggncgaggtccgccgcaagccgtccgcctcgctcttctcccgagcctggtcctcatcctctcgcctctctccccccaaanaggcttagcaatctagcgttagcgcctccgtccatctcgtaagctgcttcgatggngatnaagaggaccaaggncgagaagaagatngcgtacgaccaaaaagctctgccaagctgctcgaggagtacaccaaggtggtcatcgccgtcgccgacaatgtcggntccaagcaagctccaaggagattcgcaagggtctcccgcgggggactccatccgtgctcatgggcaaagaacaccctcatccgccggctgcaatcaaaggtgcactccggggaaannaaccgggcaacaanggactttccttgagctcaancaaacctcctccgtcggtaacgtttgggcctcaattcttcaaccaaanggggtggacctcaaaggagggttcccgaaggggggccccaaattcaaagggttggggccccccctcgcctggggggggctaaat

SEQ ID NO: 23715 - DNA, 518 bp, Triticum aestivum
  unsure (1)..(518): unsure at all n locations
  Clone ID: PAT_TA_23715
gaattcactagtgattagcgtggtcgcggccgaggtgtgactggtgccatggaaagcctacttcccaagctgggtgagctgctcgttggggagtaccgcctacagaagggcgtgaagaaagatgtcgagtcccttgagagagagatgaagagcatgcacgctgctcttacaaaggtggccaaggtgccaagggaccagctcgaccagcaagtcaagatctgggcagatgaaatcagggagctgtcgtacgacgcagaggatgtcgttgacaagttcctggtgtctatcgagggatctaatcctacagtcaactcgagcaagctcaaagggctaatggagaagatcaccagcttgttcaccaaaggcaagactcgccatctgattgccaatgcaatcaaggacatcaaggaccgtgcccaagaggtggctgacctgcgtgacagatgcaaagtcgacgatgctgttgcantgcagctatcaataacaatacnattgattcctccctctntttgggtttt

SEQ ID NO: 23716 - DNA, 732 bp, Triticum aestivum
  Clone ID: PAT_TA_23716
ccacgcgtccgagcattgcgacatcagtgttgggaggatatcctcccgttccctgaagcatttgagcctcagaagctgccgctccaactcgaattgctgggtccatgtttctaccccgggcctcgtctccctggtgctggttagatttgggggcacaaccccttttcttgagaacatggcgctgctagagactgcgcgtcttgatcttagcgatgacttcgatgtctgtttcgattacgactccgatgagaattctgttcctttcaataaagatgacagtggcgattccgtgctcctgggtgctctctcaggtgccaaacatcttgagctggtatctgcatttcaaaatttcgttttcagaagagatttgagacagtgccctacattcagcaagttaaagactttattactcaatgaggactggtctgaggctcctgacttggatgcactagcttgcgttctgaaacactcaccagttctagagaagctcactcttcaactctttaccaacaagggaccaaaacaagaaatgaaaatgaaaggaagctacagttcagcggagagatcggctgcaatatcagagcaccttaaagtagttgaagtccagtgtaatgtggtcaatcagggagttttcaaagttttgaagttcctctgtgcatttaatatacgattcagttttgagtaggggtgagaagatgtggggtgtctgttgatctgccatccctttgctat

SEQ ID NO: 23717 - DNA, 833 bp, Triticum aestivum
  unsure (1)..(833): unsure at all n locations
  Clone ID: PAT_TA_23717
ggcttgatcccttactactccttcgatcagtttgtgcgcaaagctgagaaagttggggccagtagccgcgttaggagatgcatttcggaattgaaggaaagggttgccagagggggggatcctacactactgcatcaaccgctagtggaagaagtcataccagagggagaacctgatggaaccacacaagaagacccaatcctggggacagaacctccgtcgacggacaatcatgaggatgtggacccatttgcgatggaaagtgatgacgtggatcccatgcaagaggatttgctaaatgaaatatacgaaaagacagccgatgaacctgtactaagatctggcgatggaggcgctgaacaacccgtggctccaagagaggcagagaagcatcaagatggagaggatggtggcggaagcaagccaagcaaagttgagctgacggaggagcagaaggcgcgcatggaggctaacaggctcaaggcgctagagagagcggcagcagctcgggctcgcgcgtcccagtcgctgcctactactgaaactaccacctgaaagcgtgcagggttttgaatcactccgccttgcatgtttgggcgtgtaagcatagatggtgtgtttcatggagatggtgttcgttgaaattgaggtgtaaaatccaaagaacctttatgttctccagtctgaagctggtgatctgtttgcgagaagagttggtgatatgctgctttatttctgtgctggtggtggtagacaagctacagaatttaggtgttttctcccaatttgccatgtaggtatccccggtgcatactgttattgctnccctgatt

SEQ ID NO: 23718 - DNA, 501 bp, Triticum aestivum
  unsure (1)..(501): unsure at all n locations
  Clone ID: PAT_TA_23718
tcgcccacctccgggaccgggcgaacgtggagaagctacggctgctgaccaaggcggagaaggcgggcctgctgtccgcggcggagcgcgccgggctgtcgctgtcggcggtcgagcgcctcgggctgctgtccaaggcggaggagctcggggtgctgtcggccgccaccgaccctggcacccccggctcgctgcagggcctcgcgctcctgctgctggccgccggccccgccgtcgtcttcctcgtccccgagcagtacccctgggaggtggcgctccaggccgtcgccgccctcgtctgcgtcgccgggggctccgccgcgttcgccgcgtccagcttcgtgtccaggctccagggctcctccggctgatctcgacgaactctgcttgcttcagcatcgaccgagtgtcaattgccgcgtttgattctagcaccaatgatcttgcgtagagttaatctacttctgtaaagatgggctgatatttatacgatgcgccnna

SEQ ID NO: 23719 - DNA, 1318 bp, Triticum aestivum
  Clone ID: PAT_TA_23719
ggcggcgttcaacctgctgccgctggtgatgagtcgacttcgccatcatgctgctcttcgtggtctgctcgccgccgccccggcgcaggcgctgcgttgccgtcccgtgctactgacctggcctgacctcatggtggccgggtggtgggagcctcacatcggcggcgctacacgcaggccagtggctggtgctgtggtaggcgtctgtttggttggtgtctgaattttctgactgatgcgtcttcggcggcagaataaactcaatttgtgctgaatcgagacgctctgtacaactgaagagattctcttgtttgaagcctgtgttgttgatgataaccactctggccgtggaaaaacaaataattcgggacggtcctgaaccattacctagcagagcaggggatccatcgacgacgcgaggagagaggtggcaatggcgtcgcttctgtcgcccaacaccgtcgccgcgactacggcgcggacggccggctggaggggccgcctcactcctagtgtcaccgccatggcaaccaagggcccgaagcccagttccggcggcacgaaaagatcgtcgggcactaccaccgtgttcccggtagggaagcccgcgggcccgccgcggccggcgacgacgaaggggtcggcgcccgtgaagctgctgacgaacgtggagaagctgcggctgctgaccaaggcggagaaggcgggcctgctgtccgcggcggagcgcgccgggctgtcgctgtcggcggtcgagcggctcgggttgctgtccaaggcggaggagctcggggtgctgtcggccgccaccgaccccggcacccccggctcgctcgcagggcctcccgctcctggctgctgggccccgtcggggccctcggctgttttccgcggtcccccgaccagtgacccctggcttcgtgtcgcggctccgggctcctccggctgatcttgctgcggttcccgggggtcagcatcgcaccgagtgtcaattgctgcgtttgattctagcacggcttgatcttgcgtagagttaatctactgctgtaaagatgggctgatatttataagatgcgccattcggttgcaatactgcaggtttttgtattaataatgcgatttcgaacttgtgatggaagcacttcttttataagatgttccattcggttgcaatactgcaggtttttgtattaaaggggtattgtcgaacttctgatggaagcacttctgtacttagtttatctgtatctttaaaaggattcagaatcagaattgcttttaaaaaaagagttaattataacggtggtgtcagcccttt

SEQ ID NO: 23720 - DNA, 662 bp, Triticum aestivum
  unsure (1)..(662): unsure at all n locations
  Clone ID: PAT_TA_23720
cccacnctccggggagagaaacaatatactacaggacgcggggcccctcccccagcccagctgtcttacaccccacgcgtccgctctctgctctctttcctccgtcgccgtcgcggagagcgggggcggatcatggcggaacacggcgaggaggaggcggggacgctcgagttcacgcccacgtggatcgtcgcgctagtctgctccatcatcgtgctcatctccctcctcgccgagcgatgcctccactacctcggcaagacgttcaaacggaagaaccagaagccgctctacgaggccatcctcaaggtcaaagaagagctgatgcttctcgggttcatctcgctgctgctgacggtgtgccaggggaagatccagaacatctgcattcgtcctagctggacactccacatgctgccatgccaagggggggtacgaggtccgggccggtgaagcgtcaccgacaaaggagcatcttgttacagcccagatcatcggcagaatcgggaggcggctgctcagcgggggcgcggcggaagccgacgtctgccggtcgaagggaaaagctccgttgatgtcccttgaagctatacaccagttgcatattttcatatttgtgctggctattacacatgttggattcagtgttttgacgatgcttt

SEQ ID NO: 23721 - DNA, 525 bp, Triticum aestivum
  unsure (1)..(525): unsure at all n locations
  Clone ID: PAT_TA_23721
nttttattgctcccggcccnccattgcggcgggnggaattggtttngagcgcccccccccccgcgggttcgtccctcgtgttttttttttttttttttgttgctcatagtttacccatttcatagataggcttaccagttggtaattttactaagtactccgctttttactcatttataatggggtgtctaaaattacttaaatgttcatgaagcggaataatacagcgccacgattttttttcgcgggcaacgaccgtcaagtcgtgaacacaaccacgccatcaacaatttcactaaatagtcgagcacacctttgtcgatgcccgtctacagtctagaccgtatgcagaccgtatgtgagtctgcagaaccttctgcgtgcctgacggagagtatgaatgagaagttacggccangctccccctggcacctgttgcatgggccaatagctcngctcttaccagctggggttttgggtgtgaaaatacctcggccgcgaccacgctaatcacttagtgaattc

SEQ ID NO: 23722 - DNA, 383 bp, Triticum aestivum
  Clone ID: PAT_TA_23722
gaattcactagtgatttcgagcggccgcccgggcaggtctagtctcgagtttttttttttttttaggagctgttggtaatcaatgatatgctcttattgatgatgttattgttgttgtaaaatcaaagacgcattaccccaaatgccttcagaagatctgaagtaattcgagctgtaattgtgcgtatgggaaaaaaattgaaatgcgaaggcagtataacaatcatctatgatgaacaacatcatatttttctcttatgctgatcagaaaatctgcattatctgaattgtgtaagttgtcactaccatccttccacagttcatccgtcaagttgttgcatcctccacctcgggcgcgaacaacgccttaatccgaattcccg

SEQ ID NO: 23723 - DNA, 263 bp, Triticum aestivum
  unsure (1)..(263): unsure at all n locations
  Clone ID: PAT_TA_23723
gaattcactaantgattcnagcggccgcccgggcaggtagtaagcgtagaagttgcaagaatgtgcaatgtttacatgttggaatcaataatgcacttgtctaatttttgtaggtagtttagtgtgttcactgtcatgtttttattatgaaatgctacttctgtattgaccgttattcaattgaaaacatgactattttaactttggtaaaaaaaaaaaaaaaaaanaaacataaataaaaatccaaaaaaaaattaaacaaa

SEQ ID NO: 23724 - DNA, 2993 bp, Triticum aestivum
  unsure (1)..(2993): unsure at all n locations
  Clone ID: PAT_TA_23724
cacccctcgcattcgtcttccccacgcgcgcccagatccaagccctccgccatggctcccacggcgccttcgccggcgaagtccgcctccccgtcccaccttgacggcaagagcgaggtgtcggatctgaagcagcagctgcggcagttggcggggagccgtgcgccagacgctgatgatcagcgccgggatgtcttcaagcgggtgatctcttgcatgacctttctaccttgtgggttgcattcgttacacaagatgagccaaggcccagctcaaaatcaaggccgaggatgggactactgctgaggcattttctaccttgtttcaatcagtattgtcgcaatttgggcattcttgatcgtgagcattttccttctcggtgatgcacctgcctccagcttttctggctctgcacaatatctctgcaatccactacattaaactccaagcaaagccttccgttacatctttttatcagaagcttggagcaggtgaaatttgccgttggcctcccagtgtcatgcaagtaccatcagaccattaaattctgcagggaaaagacatgactcgtcgctgttttgcctgctgcgctttggggacttatgctcttagcaccttatgcccctgtagttttcaattgcttgcattcactgcttgagatatggaccctagaagctgccaattcatgaggcagcagggagggagattgagacactatatagcaagccagtggtgttttacttgctaaacaaaatcaaagaattcagcgagtgggcacagtgccatgttcttgagttggcgtcaaagttcataccatctgataataatgaaatatttgacataatgaacctgcttgaggatagacttcagcatgcaaatggagctgttgttttggcaacaatcaaagtgtttctccacttgacgatgtcaatgaccgatgttcaccagcaggtttatgaacgcataaaggcacctttgcttactctggtaggtgctgggagtccagaacaatcatattcagtgctatgtcatctgcatcttttggtgatgcgtgctcccatgttattttcttccgactacaaaagtttctactgccagtttagtgatccttcgtatgtgaagaagctgaaacttgagatgttgactgctatagcaaatgagagcaacacctatgaaattgtaaccgagctgtgtgaatacgctggaaatgttgatgtaccaattgcaagagagtctatcagagcagttggaaaaatagctctgcagcaatatgatgtgaatgctatcgttgacaggcttctacaatttcttgaaatggacaaggattatgtgactgctgagactcttgtcttggtgaaagatcttttgaggaaataccctcaatggagccatgactgtatagctgttgttggaaatattagtagccagaatattcaagagccaaaagggaaagcagctctcatatggatgttgggtgaatattctcaagatatgcatgatgctccatatgttcttgaaaatcttgttgataactgggacgaggagcagtctcccgaggttcgtttgcatcttctgactgcggtgatgaaatgtttctttaagagaccacccgagacacagaaggcattaggggctacattagctgctggtctagctgatacacaccaggatgttcatgaccgagcacttttctactacaggcttttacaatatgatccagctgtagctgaacgtgtagtaaaccctcccaagcaagctgtctctgtatttgcagacacacagagcagtgaaatcaaagatcggatatttgatgaatttaacagcctatcagttgtatatcagaagccctcttacatgtttaccgacaaggaacatcgtggaacattcgagtactcagaagatcttgcgaacttaactgttggggcagatgctccagaaaccgtcatttctgcccaaagataccaagaaagcgataatgatcttctgctaagtacttcagataaagaggacaacggtataagaagcagcaatggttcttacacctctacatacaatgctccttctgatttgctaagttcgcaaacaccagctgaaactgcactaataaatcctagtagttcgacatattcaacacaaacaaacttcagtctcgatgatcttcttggacttggtgttcctgatgccccagcacctccaccacctcctgcactggccctcaactcaaagcctgtgctagatcctgcgactttccagaagaaatggggccaactggcattatccttttctcaggaatgctctttaagtccacaaggagcagcttctttgatgaatccccaatcgctcattcgtcatatgcaaagcaactacattcaatgcattgcttcaggcggtcagcctccaaactacaagttctacttttatggtcagaaagctggggctgctgctttctaccttgtaagaatgcattgtgaacaccgcatcagcgaaggcccagctcaaaatcaaggccgaggatgggactactgctgaggcattttctaccttgtttcaatcagtattgtcccaatttggccattcttgatcgtgagcattttccgtcttgatgatgcacctgcctccagcttttctggctctgcacaatatctctgcaatccactactttaaactccaagcaaagccttccggtacatctttttatcagaagcttggagcaggtgaaatttgccgttcgcctcccagtgtcatgcaagtaccatcagaccattagattccgcagggaaaagacaccagagttttttttgggggggatttctttgggtgggtgaagtcactaagcactgtacaattactagacatttcattcagtcaccttgtgaaagcggctaatttgttcangggttatggtggtttagatggtgtgtaaccttgttactggaccggtacatgattccgtggatgtggtgagaatagatggatacctgtaatttgtttgc

SEQ ID NO: 23725 - DNA, 808 bp, Triticum aestivum
  Clone ID: PAT_TA_23725
gccccttactgccatcccaccaacgccgacgcgctccggtccctagctagctcgctcgctcgccggtggtccccgcaaatcgtttcttgtttctggctagagcacaaccttttggttcaggccagcctcccgcttcgcatccccttgcgtgaggccatggccgaggtccctggagctgccggcgccctcggctccccgcccagggaggtcgtggacgccccagagcgcgcggctgctcttccctccgcggccggcgagctcggctccgccgccgatgctgataaggaggttcctggaggttcggaggtcagcggcgccgttggcaccgacaaggcagccggtctgtgttccggcgccgagctcgaatcggcggagccgggtgtttcggatgcgagattagaagctccggcggcgcgaatccacggacagaagctgggttgcgggagtacgggttccgatggagctgccgcaatcagccatatcccctcaccggttgagccgtctccgtcagacgccagttcgaattcagacaccaacaccacccctggggccattagtggttcttcttcccctgcggaggggtccctatcccaagcagaagcagctgattctcgaggacgcgagccagaagcacacgaagagccaacgggcgcgcgtggggcgcctgatgctgcagctgcggtggcctctagcgagctcgcagtcgagtccagaggggatttcgacggtcaaaacggccttatccaaggggaattggagttgcgtgccggtggctttttgcgtggcgaaggggcagaggcggagcctg

SEQ ID NO: 23726 - DNA, 484 bp, Triticum aestivum
  unsure (1)..(484): unsure at all n locations
  Clone ID: PAT_TA_23726
gaattcactaagtgattagcgtggtcgcggccgaggttttttttttttgcagaaagatcaatatcatatatattcagtactataaccaaaacatagtagttttgttgccaactggagtcgatcatttaccgctggcagtactagccattgcgacaagtagaattgtggtgattacaatacaaaagtgggtaaaaatggaagcaatcttggcggcagaagcaacatgaacaggtgaaacatcaataagtagtgagaacactctttgtgttgttctgtgaaaggagcctccatgagagtccaaacccaatagccatggaggataataagtaagaagaatcccggtgaagcttgttcggtgaaagtgttgctgatggttccttaattgaaaccggccaagaatccgggtgaacatgacctttggcagttccagttgacgccggcttgggggtcctcaanaaccttggccgtccaccggggaaaaaag

SEQ ID NO: 23727 - DNA, 1236 bp, Triticum aestivum
  unsure (1)..(1236): unsure at all n locations
  Clone ID: PAT_TA_23727
actnacttttcgcagccgctatcaacatatgcatcaactgcgtcattaatgatgcctcctgctgggaggaatgatcagttgttgtcagctaggcatggtcttaaatctgggttggggaattcagatacacttgatagttggcaaccatggaaaggtgatagtagcatcaacaatcatctctggagggacgactccccttaccaacggacgacaagtggtcacgcgtatcaacaaacttggaaagatgatgcttatcagcagacacggggcactgagacagaaaacttcagcaggtttggaggattgcaaccacctagacaggctcctgtcagttttgtcatgcagcagccacaggcgcccgtggctgaagaatatcagcaccttgacatcatcaatgatttgctcgacgagggacagagcaatggcagcaaggcagagcctatgcgccatgattaccatgcttatggtctgccattttcgctgaggggcaacatagcagattcggaaatggcttctgttagcagtcccgggcggtttagcagaggcaacttggcagatttggatatggcctctctcagtagttccaggcggtttagcagaggaaacttggtagattctgagatgtcttctgtgggtagtcctgggcggtttagcagaggcagcctggcagatccggagatgctggcttctgtcagcagccccagtcggtttaattccaccgaccggtactacgacgatgggttctcgagggcctacgacatgagccctctccaaggccaggggacaagggagatacagttctcctcgctggatggatactccaccaatggtggtctgtctgacatgagcacatcaaagccttggctgtatggcgggcatagccccgtcaatccgtcgtcgatgaatctcggatcgttgagcacaaatgggttcccacagcaccaccaccagatgggggactacagcagcaacctggctagcggggtgaacggtgtgggctccgccgcagccgcgtatcggcgccaggccaacaacgggcgctggtgatgcgatgatataatgcctgtatacagtcagcgagtcttacagtggaagaaaataatgcttgttgtaacagatgcttgtcccgccatgggcatgtaatttgaaacctttagctttaaaaaaggggagaaaagaaaagggatacagtttacatttccgtaaaaaaaaaaaaaaaaaaaaaaaaaaaaaaaa

SEQ ID NO: 23728 - DNA, 258 bp, Triticum aestivum
  Clone ID: PAT_TA_23728
gaattcactaatgattccagcggccgcccgggcaggtcgggctcctaaacgggatgtgccttgcctgctccacatgccattcttcgtcctcgtttgtaaaactatatgataccccacagattgctgcaggaatttatagtattgcatatgaataagatttatagtgagaaatagtgatatgagaactttttataaaatttgcagttttaaataaaaaaaaaaaaaaaaaaaactcgacctcggccgcgaccacgctaa

SEQ ID NO: 23729 - DNA, 546 bp, Triticum aestivum
  unsure (1)..(546): unsure at all n locations
  Clone ID: PAT_TA_23729
ncccacnctccgcccacgcgtccggaaatttcttaaagccggtgacaaggttaagatagtggtgaacttgaaaggtcgggagaacttgtacaaaaaacaagcgattgaacttctcagaagattccaaactgatgttggtgagctagcgacagaaggaagtaagaattttgcggagaggaatatatatttgattcttgtacccaataaactagctatacagaaagaacaagatggggtgagcaaaaaggatgctgtggaaggagagacggaccaatcggacgatgaactggacggggacgagactgtgatcgaacaactggagggaagtagtttggatggggatgagcccgtgatagaactggaggaaagtaaggaacctgagacagaagtctcagcaaatgtttgatttagctgtaaaggccaagggcgccatctctgattgtagaaggtattttgtagttttaaacaatatattgtcttgcatcttgtctaatacaattacgtttagtaccatttggtacttttcttgattccctgatttgcact

SEQ ID NO: 23730 - DNA, 1549 bp, Triticum aestivum
  Clone ID: PAT_TA_23730
gcctctgcaagcaaaacccccgagcgagcccatcaggcccggtcaccacgccccagcaccgccaccggccaaggcccgcgggcacgccggcctcatggaagcgactgccgacgttatccaggccactcatgaggaatgcacaaagtatggaatggatggctaggtctccgcaacccttcgaggagaagcagctcttcaacggcagtgccgaagttcttgggtacctagcacatccagctgcacagcagtctgcgcattcagggtgtgtgcattggactgggagaaactctgactgaacggaggcagctatgttttgtgcggtcctttaaccgaggatgcattctgattccggtgctgcccgcggtcgcggcttctccaggagtccgcgctacgatcaagttcgtggcgaggcgggcagcccgagagaggtaacggagctgtacatgtattgtattggcaggccctgttttattaccgtaatgctaggagagaaacatatgccaaagggcgagcactgcgttgggcgctgttggggagcagcattgtgtactgtactgtacgcgttgatctagagcatagtttttgctgtacagctgccacggtttttctgctccggtctgctgttgacttctacggcacgcagacatggtaaggctgggaaaggagagcttaatttttggctgttttactccgtactggaaatgggccggtatgtgtgggtgatgccgatgtaaagggggcgattgcgtgaccatgtggagttgtattgggaggaaataatgaatcgattaggggatttgtgtcgggaagctagaaaaaaaaaaagaacaaggcgggcctcgcacgcacccccccggcgcacgagtgaatccccaatcagaggatgaattggatggggacgacactgtgatcgaacaactggagggaagtagtttggacggggatgagctcctgatgggacaactggagggaagtagttgggacggggctgagctcgcgatagaacaactggtggagagtaaggtacctgagacagaagtctcagcaaatgtttgatttagctgtaaagcccaagggtgccgtctctgattttagaaggtaccaatactgttcatgtaaatacaaggatggtgctattgtacttgtactcgccgtccttgcctggggagtcagacagaacaaaaccctgtgatatcaagaagctgggggctaccatgtgaacattttggtttcggggcctcgaatcatcatctcgcattgtaccaacggaatctactaaacggctcgggaccgtgcagtaagtgagtcagtaacagtcacagtcacggagactgttaggaaagttcacttgtattgcctggtccggcattgttgtcagcaaggttttgttttggcgctgtcgttgtaaatccttgtcggtgctgtggagaagatcagtagtcgtatcttgtttatcaaatggttgctttcggattttttcaacatttggctggaagtgcctaagaagagggagtgtctgctattcactgtgtgggcagtaatttctatc

SEQ ID NO: 23731 - DNA, 742 bp, Triticum aestivum
  Clone ID: PAT_TA_23731
gaattcactaagtgattagcgtggtcgcggccgaggtgtctcgaggtttttttttttttttttttttttttttaaaaagtgaggaggagctcacgtactagcacaagctttgctataaggttggatggattggaatgaaatggccttgttacaagtgaaggagccgggtccttttataggccgggatgtgcacaacacacgcacacacactaggaattacgtggctactaccatggccatgcaaagccatttcctagaatctactatgtaattgcttacacagctgtagtctacttcttagtcaacctcccatacaacgctaaggaaactactaggaaataacaggaaactacctatgtatgaagtgatggcggagatcgatgtgcttgctgcggtcatgaagcactgggttcttgaagagggaaatcgcccgacttgttgtcgacgaagatgagtgcaggggcggtgtccttgatttagcatcccgcccagaaggtgagccaaccagattccctgacatgccactgcagctgccgcgatgtactccgcctcgcacaaagaagcggcgacaaccttctgcctcactgattgccagctgatgggactgctcccaagaaaaaacagtatgccaaaggtgcttttccgggagtccaaatgagcattgtggtcggagtcgctgtagccgagtaagctctcgccatcgacctgcccgggcggccgctcgaaatcacttagtgaattc

SEQ ID NO: 23732 - DNA, 309 bp, Triticum aestivum
  Clone ID: PAT_TA_23732
tttgatgtggaatgctgcctaacatgtcatatcatatttcttttctttatagcatggacatttggacttctatatggttcgaaccaatagtctaattttaacatgataatttaaatactcaagcatatcaacaagcaaccatgtctttcaaaatatcaacgctaaaataagctatccctagcccatgatgcacaaccattgatccattcatgaaacacactcgcatattagctacacccaatgctcaagtacgatcatattgcctcctagttgatgccttttataagagaagatggagactcagaagat

SEQ ID NO: 23733 - DNA, 337 bp, Triticum aestivum
  Clone ID: PAT_TA_23733
tggatacctaggcacccagagacgaggaagggcatatacatgtttgatagtgttggtgagccaattggaaaggctgtcactataggccagttggacgatcagcttctagttcaagcacatcgatatgtcttgcgacactctgatgagcttgatgatctccgtaggtgtgcttcaatgttgtctcctatttcttttatttttcacaagttggaaaaatcatgatgttaattgtcttattattacagagaattaacatcatgatttttccaacttgtgaaaaaaaaaaaaaactcgagactaagttctcttccacctcggccgcgaccacgctaatcga

SEQ ID NO: 23734 - DNA, 1179 bp, Triticum aestivum
  Clone ID: PAT_TA_23734
ggcacctccgccttcggcaccgccgcctcctacgtcaagttcgtcgaggccggcggcgcccgcgtcatcccgctcatctacaacgagcccgacgaccgcctccccgacgagcgcctcctcgagaaactcagtttggtgaacggcgtgctgtttactggtggatcagtaaagaggggtccatattttgagacgattaaggtagtgtttcagtatgtcttggacaaaaatgatgcaggagttccatttccattgtttgcacaagtgtcttggactttgagcttgtaggcctgtttgtgtgcgaggacattcatcgcctcagatcaagcatcgactctccatttccccaattatcctccactccagggatcagtatttgaacgatttcctccggttgtcatattgcatcctgatctcatccatgaaactcagcaccagttgtcttgtcatgcaaaatcacaaatatggtatatctccgaacgagattgcgagagaatgatgccttatcaagtttcttcaagattctgaccacatcccctgatgaaaacggtgaggtttacatctcaaccgtcgaagcacagaaatacccgatcacttgcactcagtggcatcctgagaaagccattttcgagtggggtaaaccaatgatcccacacagcgaggacgcggtacaagtgactcaaaattttgccaactattttatcagccaagcccgcaagtctcccaacaggcctcctgctgacaaggtgctggacaacctgatctacaactacagccctacattttccgggaaaacctcgaaatccttcgagttggtgtacctcttctcctggaggctgggagccgacgcttgcagccgcggttcttctctcactgtgctgtacattacagtattgtgtaccatgtggtgtattattgtactgatgagaccttccggttcaatggtgtagatcatttgtaaccttgatgtgatgtttcggtttccggagtgaataagagcatcctcctccgaggtgttgttcatcttgtattatcacagtagtcagtaccttcgccattgactgatgctcagttcagtggtacagatcattggtaaacaatggttgtcagtctcagcgtgcaggagcagcgtcgctagttgtgacctttgccattttcggaataaaaataagagcatcctct

SEQ ID NO: 23735 - DNA, 754 bp, Triticum aestivum
  Clone ID: PAT_TA_23735
ccacgcgtccgcggacgcgtgggcggacgcgggggcggtcccgtcggggaaaccctaacccatctccgctctccccctcctctcccatccccgacctcgccgccgccaccgccgccccctcgcccgctccggcctccaccgcaccgccccgaaccgcgcgcggggatggagaaccccgacgggcaagcgggagccgacgcggggcttcccccgcccccaccgccgcccctggacgccgcgggggcgggcctgggcagcgacccggccgaggttctcccaccgccgcccccgcatctcccggggggcgccccgcacgaagtcgcggcgcagggggccgacggatccgcgtacccggccgagcacgcctcgctgaacgggacctccggcgacgcggcgggctaccaggccacggagaacggcgccgccgccgacgagatggccgagcccatggtgcccgagcagtcgtacgaggatgctgtggcttcagcagaagaggctaggttatgggatgttgtcaccgcggactgcctggactttgatgcttggaccgcgcttattgaggagacggagaggatcgctgagagcaacatattgaagatacgcaaagtgtatgatgccttccttgcggagttccctctgtgctttggctattggaagaaatatgcagatcatgaaggccgtctggatggtgtcaataaagtttttgaggtgtatgaacgggcagttctttgcagtacttattcagtggacatat

SEQ ID NO: 23736 - DNA, 454 bp, Triticum aestivum
  unsure (1)..(454): unsure at all n locations
  Clone ID: PAT_TA_23736
gggcgaattgggccccgacgtcgcatgcttcccgcccnccccttggcggcccgccgggaattcgattagcgtgttcgcgcccgaggttctcgctggccttgaaatgcttgccaggacgacaccgacgcgaggccttacatggccgaaatcgccagggaactcgatgccatccggagcgctttgcccgagggagaagagctcatgtctgtaacctccatggagatgagctcctcaggcacgctgacccaatccacgtcgaactccttgataacgaccaccggggagcatttcgatatatcccacgcctccagcagcggcgtcccttccagaatggcgatgaatcctcgctagcgtcgccgcgccgatgttcttcgcttttgtaaatgggtgtggacagtaggcgtgcaagtgatagctttgtagaattaacgctggtccggcctgcccgggcggg

SEQ ID NO: 23737 - DNA, 705 bp, Triticum aestivum
  Clone ID: PAT_TA_23737
gccccctccttccccgtcggctcccgccctgcgcgctctccctcagcccgatccccttcctcaccgccggccgatttcggtcgttgccactcctccccgccgatagcaccaacctccacgagctcccctcgctccaccttctcctgtacagcgaggaatcccctcctctccggcggatcctgtggctcgaggcgacggctggctaggcccgcgtgacggacccaggccgtgggtgtgctgcctctccgtgccggtccacctcggtccccggtgacactgcacttcccggcgggcgtctcctccacctgcaagtcagttcctcagagtgattgggccgcacaactccaacaccgtttgtaaggcctgcttgaaatgatgatgaaaaacaagcgcaggatgggagtccatgagaaacaacgtccttgcaagaaagtaattaggccaactttagatggtacctcctcagcgagatcggacagctcgagggaacccagtccaggcgcgttgagtcaactcagtgagcaagtagtttcaagattgtgtaggagtgttgtgtcgctcgcctcattccatggtgataccaagttaggggaatgcacaggcatatgcatcgaaacctcatgccctgatgctacaagtttcctgacatcgagacttttgattccacttacttggcctacaagggagatcactgaaaatttgacg

SEQ ID NO: 23738 - DNA, 257 bp, Triticum aestivum
  unsure (1)..(257): unsure at all n locations
  Clone ID: PAT_TA_23738
gaattcactaagtgattangcgtggtcgcggccgaggtagtgcttctggggcaatatcaggtaatctctgagcagaggaacaagactaaacatgtaagaagtctcaaatttggttctgctcttgttcacctctatcaatgtaggttcggtatttgttttgtgatgttgcattaaggtttgagaacgttcaaccttgttttttccttttttattaggtcaaangaacattcctacactataatttttataaccacagc

SEQ ID NO: 23739 - DNA, 1717 bp, Triticum aestivum
  Clone ID: PAT_TA_23739
cggacgcgtggggggcgcacaccgtccgcgatcctcaccagagcgccaaaaaggggcctgaaccccggctgttaggcactcgtggaggtgaaggggagaagaaagggcatcgcaaggtgaccctcccaaccgtctcgaactataccatccgtgacgccgaggacggcgacaatgccaagccgcaacgtagcagaccggaaacagaaaataagcttgaaatggtcgccggcaaaagcgatggatctcagcaacaagattgggataacgcggaatgggggagcaaaccactttgtgatttctcaaacttcagagctaatgtctgcgagatgcggggcaacatcaggattcacccgaatgcgagttcggtgatgtacatggaacctgccagctcaaagagaaatgagctatggaaacttaagccctaccctcgtaaaggtgatgagctctgcctcagcaaagttacagagctgacggtgaaatcaagcaaagtggcacctgagtgtaccaagtaccacaatgtgcccgtcgtggtctttgctctgactggatacaccggccaaatctgttccacgcacttacacccgacgccgcttgtccccctcttgacgacggcaagcgagttcaccccctcttcccagtgcctcatcactgcaatgccgtggttcagttacggatcacagatgtggttttttggtggccaaccaactaccccctgatcgatttcaacaaagacactgacgtgcagagagacttccacgccgatactggcctgcatgctgccatgcaggccattgttgacccccacgcggccccgcacttctccaccgtccccgccttcgcccctctcatccgcaccacggtggagttccccagggtcgcccgctcggcgctcggcgtgccccccgaggccgtgccggcgctccgcgagatccccaaggccaagccgagactgctcatcatctcaaggcagagaacaagaatgttcctcaacctcccggagatcatcgcaatggccgaagccaatgtgagctccgtcctcgcccaggtcgccaaggtgggctccgccctcgccctgttctccggcgtcctgggcgccgggctcgcgatctggggcgtccttccacccggccccacgctctgcctgttcctgccgcgcggcgccacagtgggcgtgtgcctgccctggggtggcatacaggggcgtctgccgggtcgacttcggcgaccccggcggagcacatgggcctgcggtacaaccagtacagcatcgccgtgcacgagagcagcctcaccgaccagtacccgctggaccatgagatcttcaagaacccgctggccttccacaaggggttcgagttcatcaaggagaccttcatggacaagcagaatgtcaggcttgactgcaaccggttcaagcctgtgctgctgcagacccttgatctgctaaaccaataagataagaactactgatccgccattggccattgtattagatggttctccatacacctttttttttctgtttcacccttcttctcttctcttttcttctctagtaaaaatttgttgatcgccttctagtacatgagcaaggaacagagttatctgtctagaattacatggatatgaagctgggatgtccatgatttgtcgtttatagcatatttattgtctggaaatagaagaaaaacaatacattttttctttggtaaaaaac

SEQ ID NO: 23740 - DNA, 716 bp, Triticum aestivum
  Clone ID: PAT_TA_23740
ccgcggtcgggagggcctgtttccctaggtccccaactccgacggtcgattacagtgccatgtaggtgttgttgctgcatacttgggtgggagattgaacatatgtgccaactttcttctgtcggcagagaccaaaatggctggagaaggagatgtgcctgacaatgaaacagagggttctgcaaatccgatctcacgacggaactcaaaaagggctgctaagcggcagccgcgtggcgatgataaggacggggatggagagggtgacgatggtggggaaagattcctcttagtaaaattgcagagaagaaaggtgcgcacggaggcagtatccaaaggggtagatgccacatcttctgcagcagccgctgaggggacataaattttgaaggagataatgcattactccacacacaggctgccaagtgtatggcatcacatacatgattgcagaaggactaattaaggttgagcccactacaatttctcagttgctcaacgttgccatcttcaagttttttagaattgtcccaagagtatgtaacgacttggcatcctcaggctttctgttttagttggctataatactctggatacctgatgcatttttttcacccctggatatgtttgtttgcagacatccatgtgaaagttggtttcaaacaatggttttcttgcacagggaactgaatttcttatgcttttacttgatcttc

SEQ ID NO: 23741 - DNA, 555 bp, Triticum aestivum
  unsure (1)..(555): unsure at all n locations
  Clone ID: PAT_TA_23741
gaattcactaagtgatttcgagcggcccccgggctgggcttgttcctttgaacgtggtgtaaatatatgtggcaattgccgttacattacatatatagtgcacaaacaagcttcttaagataaatacacaagcttaccgtggcttcagaaaataacaatactacaagcagcgaatttacaacgggaaacggagacagtgcatccaatctgagaaccagtggttccgcatccatccatcaccaagcatttagttttgttcaacccgattatcctgcgctcggcattcttcatcatgaagcacgaattcatccgtagttcacctgcccgtcgcaaccggtgtccggcctcccttgataatccggcccgacctcctcggtcggtcaaccttctcccccgaanantgattaatcaacggtcctcaagtcaaacaaggngangataaaaaccaatttcgattccttgtccaaggaacccncnaaaggcttcccttgggggtcttnnancggccggtcccccgtccttcaatcntcccgganaaanaangggccaaanann

SEQ ID NO: 23742 - DNA, 684 bp, Triticum aestivum
  Clone ID: PAT_TA_23742
cccacgcgtccgcccacgcgtccgcaagtcccaacgccacagctccgaaccaacacccccataaatccaaccaacacataaccactctctctctctcaaacgaagagaaggaagcagcaaggtacgcccatggcgccatcacctcggccgtacgcctctctgctgctgccatctctcgtcctgctcctcctcgtcgcctcctcccgcgcagcgagagtgggagcaaccgcaagaaaccaggcagcccaggacggccgcgcagaggaggacgccggcggcgaggcggcggcggcggcggaggatgaaggttgcggcggtggcgccgaagggggagatggaggcgatgatgagtgcttgatgaggaggacgctggtggcgcacaccgactacatctacacccagggaggaaaccacaactagctagcttagctggtagctgggactgaaatcatagcatcatatttgtatgatcaatatggagattttatcagcagttgggcacttttttttttttttgcgaatcgggtactcgattgtatataagctggtagagaaatcttgctgagttgtttgtgatccgctggtcaagccagtgcgttggctggcttgagtaagaacacaggaaagaatcttgtacgtcacccttgaacaataatgataatgctactgttgtgtatgggtgat

SEQ ID NO: 23743 - DNA, 1551 bp, Triticum aestivum
  unsure (1)..(1551): unsure at all n locations
  Clone ID: PAT_TA_23743
gggccgactcggccgacccgaccgaccctcgcgcccccccccttccccgcctcgccgtcgccatcgccgtcgccgagggaatagccagaccgaattatgagctcagagagcggtgcaagtaatggccatgcgaaagaagcagcattatatgagcagcagctgtccaagattggtgaagttagagctgctctaggacaactatctggaaaatctgcactatactgctcagatggttcaattgcgaggtacctgatagcaaggaactgggacgtgaggaaggctaccttgctgcgtacctgatccctggaatcgcggtcggggggtaggccgcctgagtgccgtcgggatccgtgatcgggcgatgccatgactggtaaaatgtaccgaagtgattatttcgaccggggggggccgtgtctggaaaaatttaccgaagtgattaagaataccaaaaagtccaaagggcagatcaggtatttggtatactgtatggagaatggaattctaaatcttccagctggacaggatcagatggtttggctaattgattttgctggcttcagcttgcctaatgtgtcacttctagtgacaaagttgacagcagatgtcttacaaggtcattatcctgaaagattgggtgtggcaattctttataatgctcccaagttttttgagtctttttggaagatggcaagtccccttcttgagccaaaaacgaaaaataaggtcaaatttgtatactcggatagacctgaaactgacaagataatggaagaccttttcaacatggatgagttagaatgcgcatttggcggtagaagcccggtcacttttaacataaatgattatgctgcaaggatgagagaagatgataaaaagatgccattattctggagccccgagaactcggctcttgctgcagagccatatcgcatgaagaaccacgggtctcaacaatgtgactcgggtttgaagactgaagagactgcatctgacatgattggggaaacagaagctgcatctgaaaagagtggagaaacagacactgcatcggagaaggaagataccgaggctgcatctgaggagagggaagagaccgagacttcatctgaggagaggggagagaccgcgactgcatcggggaaggggggagaaaccgcgactgtttctgtaaaggagggagtaactgagaccgggtctgaaaagaaagaagaaacagagaccgaatcaagcactgtaaaatcgacaagctcgcgaggggaaggtattgcatcagcaggcaaaagcggcagttcatctgatccgtgaagctatcagcacgagaagtacattccaatcttgatatgagctcccaccacagtgaattcccaccaacagatgaacattaaaagtgataacaacccttttaacacacaagngggggagtgttgcctgacttattttgtagtcgccccccttgtgaccttgttcgaagaaccttttggcaacaaatgaaccaatcaaacggtaacaatgataaaatatttgctaccctcaaaaaaaaaaaaaaaa

SEQ ID NO: 23744 - DNA, 660 bp, Triticum aestivum
  Clone ID: PAT_TA_23744
gagagggtgtgtgtgctggagcttgcttgataattcttcggctccaagggcagaccggctgatcggtagaggcaaagatttctctcggccagcactacaatcttcacactccaagctagagagctcgcgcgctaattaagcaagcagcatgtcgtacccctgccttcgccgcgccgccgtgccggtaaagcgggtctggctcggcctccgcgggcgcctcggcctccgtcgatccaccggtcttggcgagcttcgcagggaggtccgaacgtgcgagtacgacgatgtgcacgtcatgtgggagctgctcagcggcatggacggcagcgcgccgcggaagtacgtgcacgcagccgccaccgccgccatggttgacgccgccgcccggaagaagctgagggggaggaggcggacgaggagggccgatgccgaatccggcgcgtggagccccccccccccctcctgctcccccccccccgctcgcgcctgacggccgggtggcggaaggatgttgccgaggccgatgccgccgcgctcttcgctcttgaccgcgtgcagctatgatatgaagcagcaaacgtgtgcggagacggagggagaagtgatgacccagtgtcgattcgcgtctacgtagtacggagtatgtacgtattgcgagct

SEQ ID NO: 23745 - DNA, 589 bp, Triticum aestivum
  Clone ID: PAT_TA_23745
cggcacgagtttcaggtgacctttcatgtgatttctacttctaaaaattagaaagtaccttcagatcaaagcagtggatttgtagattttctgggtattggtgctactccatctccatttggcttacggtctttggtcactgattttgaggtacgacgttgttttacttttatgttaaatcccatttagcttggcacctccatttattggttcggaccgagcaaagatcccgtcgagcaatatcactgactggaagcataaattttcaaatcagtgatgagataaatcttgtgtaccggtgcttagcagctagcaaagtgcggctggtatttttggtctgtatgtaggtagcttcctgatgtgtgtggctgtgtattcattcacgacctaaacttatttctgttggcttcattttagtaaagatggggtggggaaaaaaactacaccctatatatgtaagttgactgaaaataataatatgtttcagtagctatatttctctgtttcctaacatggttgtaggctagatgttcgtgttggtttgtcttgctgtaaaacttgcccctattcatttgttacacattttgtg

SEQ ID NO: 23746 - DNA, 445 bp, Triticum aestivum
  unsure (1)..(445): unsure at all n locations
  Clone ID: PAT_TA_23746
gcgaagcnttgggtacctgcaacgtagggtgcatgattaggacggcgaagggttccnnccaggcgaaggcccgaccggacctgctggaacgctgctcgcccctggccggccgtcctccccccggggtttttggaagctcccccaagatcgtttggaaaattgccctacttatctcctcagtttcgacgggacagggtattacatcgatggctgaagcggtcgctgactatttcagcaagtaaacgagtgactgttgaaaataaactacttttcctattttccatagtactccgtcaattatgttgtcatcacccagcgtggagtgagtgttgagtctgtactctgtgtggctatgtacgcatattcgttacatgaataaaaaaaaaaaaaaaaactcgagactagttcacctcggccgcgaccacgctaatcgcgtagtcaattc

SEQ ID NO: 23747 - DNA, 494 bp, Triticum aestivum
  unsure (1)..(494): unsure at all n locations
  Clone ID: PAT_TA_23747
gaattcactagtgattagcgtggtcgcggccgaggtctctctctctctctctctctctctctctctctctctctctctctctctctctttttttgatcctctacaagtaaagtaacacaagaatacggggccctcctttagaggtagagtgacaagagatacacatgttacatttggaaaaaaaaatcgaaatcatgaaatgtagcacggcagatgcatggttgatcagacaactgaatgcattgtcccgatgcagaggtcggggctatatcttctttttttgaaaaaaaaagcatggttgacagcgcgcgttacacctgttcgtgtcctgtagggggcgtgtgcggtccatagccatgggcaggaggaggagatgcagggggaaactgctggttcggcgcgtgcgcaccgtaaccatgaggcgggaaggaggaggagggntactgctgggttctgcccgtgcaaccccgtagcctttgcacctgcccgggcgg

SEQ ID NO: 23748 - DNA, 490 bp, Triticum aestivum
  unsure (1)..(490): unsure at all n locations
  Clone ID: PAT_TA_23748
gaattcactagtgattagcgtggtcgcggccgaggtgttttgagctgactgaccctggaattgtaaagctctacaaatgaactctaaaaaggttggaacttggcatggtatcatcatttcacccacatagcatgtgcaaaaaagtagagagggttacggcaaaaactagatgcacctcgtgtacaaactggacaatctctttcaaaagtatcagtgtttcggacgaaaactcatctgttacaccggcacttcattttttaaacttattacaaccccaagacttattttgcattcagtantgcaccattcaaagccacgtcataaaactttcaaccatttccggacatcaanttgctatttttcatgcatttaaaagatttgttttgangccaaatgacccctgaaattggccagacaataaataataaaggaaaagaaataanaacaacttagaaataaataaatacagtctaactacaagcataaaaca

SEQ ID NO: 23749 - DNA, 587 bp, Triticum aestivum
  Clone ID: PAT_TA_23749
ctctgctattcgcctaccaccggcaggttcaatgatgtaaatctacctgatatattgttgatgggaattaagtctaacgtagagtgatctatctactactaggcagactctcatattttttattatcttaccgatcaacctcagatagtgccggcaattgtgcaaagtagtttgcacattagaggtttggtatgggattctgaagaaaacattagcccttatgatgccccaactttgtggctattgcagctattgtggcaaggcacacatcatcgtcgtttcatattgatatcctgatattttcttcagtttgctattggcaaaaattctatatccctggttgctctccacatatttctccgcagtgatagaatttgcaatctggtgtggccttgcgctcctactattctgctgaagaatgatcagcaaatgcagtggatttggagctgagctattactgaatattcacgtcatctgtattaatcagaggttactaagattagatgttgattgatctgttctctacccatgaggcagtggagaagaaagacaactctaggtatgtatccaccatgctctcatcttat

SEQ ID NO: 23750 - DNA, 682 bp, Triticum aestivum
  unsure (1)..(682): unsure at all n locations
  Clone ID: PAT_TA_23750
gaattcactagtgatttcgagcggccgcccgggcaggtattttttcgggcgggatccattttcaattggaattacattctatatacatcattttttatatatatactttcaaaagcacaataccatttatacataaatatggtttacaaatggcatgatctcatattcataaggttgtatccatcaatttggattttcaaatatttgaaaccactttatgttgaaatccaatgtatgcattcctcgctaactgtctccaattattgtgtgtttcatgcggggtttttttacttctcagacatgtataatggtgtttcacacacgcaacataatagtgtaatccccattttagacattaanttgcataataaaccatgccttgtggcttgttaatgaactgtggcccaccgggatcaccaatctttgttacacctcacgtgtcccgaaattcaaaatggaatatgcatgttttggatacaccaattggcattaatgatattaaccgatgtcgnggatccccagtttaaaatatttgatcccatttaacccnggtattcntcctaatataactacacccatgcttatatnggacatcccnccaaacctatagcgttaacnncncccgggtacncccaagcaactgtngncaanaaggtcttttactccgnaananacggaggga

SEQ ID NO: 23751 - DNA, 867 bp, Triticum aestivum
  Clone ID: PAT_TA_23751
gaattcactaagtgatttcgagcggccccccgggggagcggtgacgctgttgggcgaggcggctcctgacctcctgttagtccgacgtctcctcctagagtcatgccatccgggggacggcaagtcgccggctaggcgaggcggctgggggcgagtagagatcggaagcgcaacagaatagaggggaattggggcctaggccgacccaaaatccccagggtgggtcgcggacccacccgtgggcaccctgtagatacacacccgagcggcgtaagtgcatttttgaaactaaacttaggaacatttagctgaccaattaaacggctctgttttaataatatcatatccgtatttgaacaactaagcttgtttagcttgatgggtggagcagtgctattatgacacggagcacgtatgttgatcgtatagtgatcataaaagggggaaaccctaagcattttcttgaacaaaagagggtttcccctccgatttctattaaacaaaccaccacggaaccaacatgatcaattaaaccctaagcatgatcaattaaaccctattatgactgtgccaacctcggccgcgaccacgctaatcactagtgaattcctgtcttcccagttgagatcaaaaagttgaggagatatgaagtgccacctctcctgcggcgccatgtaggcatcgggggtgcgatggctgtcggtggcgctgaagcagatctgcgatgatagacgggtgcatcgggggataagtcctattgtggtgtaagaacctcggccgcgaccacgctaatcacttagtgaattcgacgggtgcatcgggggataagtcctattgtggtgtaagaacctcggccgcgaccacgct

SEQ ID NO: 23752 - DNA, 655 bp, Triticum aestivum
  unsure (1)..(655): unsure at all n locations
  Clone ID: PAT_TA_23752
gaattcactagtgattagcgtggtcgcggccgaggtgaaacaactacttagaaccaaatggcttcaatttgttgggctctactactctttcttgcaatgttttcggcactagccacctccgacacccatagcgacgataacctcactctccgatgccatccagaccaggctgcaagcctcctcctactaaagcgatccttctctttcttccgttaccccagtggccttgagtcatggcaggatgacaccgactgttgtctttgggaaggtgttggctgccgcaactcctcggggtatgtcaccgctctggagctaagtaatcgtggcttgtacagtcaaggccttgaccccgcaatcttcaacctcacctcgctccaactactcgaccttaagcatgaacaattttgggcagtgcaatctcccggcgaccggggtttgagaggctccccttgctcacacactcaactctccaattcgggcttcaaaggcaagatacctattggcatcggnaactgcaaccttactcntggatcttcngtctcaataaaaggctctgatgatcctaaggcaaggacagatctgggtanagtggtaggtgaggaccaattcaatcagtggaactanatcggaagcactnangangttgcacannaat

SEQ ID NO: 23753 - DNA, 426 bp, Triticum aestivum
  unsure (1)..(426): unsure at all n locations
  Clone ID: PAT_TA_23753
gtgtccattcgctttgctacgtagcagcagcagggtagctcctcagtccaatacgtcgtctcgagtgaagaagatcagcagctcgatggcgctctctcgtcgcagcgccgcatccgccctcctgcttctcgtgctcctcgtgcacgcagagatggggacgacgacgaccaagctggcggaggcgcgggactgcctgtcgcagagtcacaacttcaagggcgcctgcctcagcagcagcaactgcgccggcgtctgccacaccgagagcttccccggcggcgagtgccacacgcagcacttcgagcgcaagtgcttctgcaagagggtctgctagcccgcctgctcgccccggccgccctgccggccagcgccgagacgtccgatcatncgtgccgtgcctncacgttcgtnagtagtagtatttct

SEQ ID NO: 23754 - DNA, 450 bp, Triticum aestivum
  Clone ID: PAT_TA_23754
gaacagaacccactactatcttgctgttgagttcttatgatgacttgtcttgcgagagcagccaaaaatgcaatgccgaaacagaaaccggcaatggaatttagtccaatgtttttccgatctgcatgaaaagataaacaagagagtatttgttatgtaaagatggaacagcatacgacatgatcacatgactataacatggtaaagtattgggtactggcgaagagataatttaggtcttattatgctgtaaagaaaaagaaaaaggccatatagaatatctcaagctgcccaaaatgcataaaatgtcaaaagccatgtgactcctgggggtcaaagcttaaccagttcccctgaatccctgacgcattggggattgctcatgagcagtgaactaaatgtcacctacgcaaacctatcttctttacatctgccacattttgccggacg

SEQ ID NO: 23755 - DNA, 618 bp, Triticum aestivum
  Clone ID: PAT_TA_23755
gctaacaaagcttagtagctaggtacaatgctaatgacacttcctctttagtctttacaatgacctgatgccagaatcatccgttcctgggcatgcagcacggggtaattgtacaatagtcttcagtgaagcccatgaacttcagaccaaatatcatacatgccatgaatctaccctatctggatccaattagttggtgacaaaatggtacctggagtccacatagctctcgacgtcccagaggaaggatccgaaggtgacagcctctaagatgagccttctcaacccggagaagcttatcctgacatactcatccttggaagaatcgaccgttccttccggggtgatcacgatctccggcttcccgaatagcgcctccgtgtgcttctcgatgatgccaaacgccaccttcgaccggattgtcgcgtaagtttgtaacgtgtctgaatcaaacgacatgacgtacgatcgaagacgggaaggcttgacagactggccgagacctcctgcgctgaggtcgggggaagtccacgactccacctctggatgggaactgtaggtcttaatttgaggggctgtgagtcggtcgtcataacttgattgagcccgtcgacccgg

SEQ ID NO: 23756 - DNA, 542 bp, Triticum aestivum
  Clone ID: PAT_TA_23756
ggccacgctgcagcagcagcagcagcagagagctcggatttaacactcgggtgaagcaagagagcaagtgcagaagagagatggcatcccctcgtcgcatgggcatggccgccgtaccggccgtcctcctcatcctgctcctcctcgtcgccacagagatggggacgacgaagaccgcggaggcccggacgtgcgagtcgcagagccacaagttcaagggcccctgcttcagcgacagcaactgcgcaaccgtgtgccgcaccgagaactttccccgcggccagtgcaacacgcaccacgtcgagcgcaagtgctactgcgagcgggactgctgagctttcttctttgtgccttccgtgttgatctgcggatgaccagaaataaagttgcttcgtgtctgaggtgaagatcggtcctgggcctactgcagcgattcgtcgccgtgtttgcggcttcaattagtttgcgcggttaatgtatacgagtactactgtactagtaataacgataccactgaccactgatgtatgtggcttctctcc

SEQ ID NO: 23757 - DNA, 699 bp, Triticum aestivum
  Clone ID: PAT_TA_23757
cccacgcgtccgcattcgttttgctagctagacaacacacagttccacgtagcagcagtaggatagctcggtccagtacgtcgtctcgggtgagccagagcagaccgatggcgctctctcgtcgcagggccccttccgccctcctcctgctggtcctccttgtggccacagatacgtcgcgctgccgagctctactgcagggtttgttccctcgatgatgatgctctgctgaccgtggtttggttgatgtgcatgcagagatgggggcgacgacgaccaaggtggcgggggcgcgggactgcgtgtcgcagagccacaacttcaagggcgcctgcctcagcagcagcaactgcgccgccgtctgccgcaccgagaacttcccccggcgagtgccacacgccgcacttcgagcgcaagtgcttctgcgagaggctctgctagtccgcccgctcgccccgtcctgccgagacgtcccatgcatgctactgtaggtcatccgtgccgttagctcgttctgttccgttcgccagtgcgtccacgttcgaccctacttgttcgtgtgtcccgctaggtaaaactaataaagtggaaaatcaatcggggtctcgagtttagttggctgtacgtggtgttggttggcacctgatttgtgtgtggtgaactggtgatgtaataaatatggtcgttgtttcagcatgg

SEQ ID NO: 23758 - DNA, 753 bp, Triticum aestivum
  Clone ID: PAT_TA_23758
cccacgcgtccgcccacgcgtccgcccacgcgtccgcccacgcgtccgaaagtgtaaactacaatggcaagcgttgcaacatccttagctatggttttcattgtagttgttgccatgtcctatggcctccgcgccacccatgccgacatcaacttcattgctcacacatgcaagaagaccaataactttgcattgtgcatggccgtgctaagggccaacccaaagagtgcccaagcatccaccgagcatgacctcgccagcattgctctgcaaatcgccaccaacaccacccggaagaacgccgcggccatctgtgacctagattataaacaccagggcacacccgaggcaccagtgtggcatgtatgtgtcaaggcacatgtccttgctgcagccgacctcatcgccggcgccggccccagcttccacgttggggactacgctgatgtgttgaagattgtgtctgaggcaaagggcgcaggagatacatgcgagaacgcattcaaggcgatccacaaagcgtctcccgtggcggacatggaccgtcagacgacggagcattgcggcctcgccggcgacctcatccgcctgctcctcaccaaatgatctattatggatcatttctcggcttgtctgttcctctcagtaatagatatattttgcttgtcgagaaaaaaagagaataatgtaaagtgttcctacaatattttttctatagacatttaacattttctaatgcatgattaacatttt

SEQ ID NO: 23759 - DNA, 622 bp, Triticum aestivum
  Clone ID: PAT_TA_23759
agttctcactcaccgctgtccattcttctccattcgctttgctaacacagtccccagtagcagcagcagcaggacagctcagtctcgggtgaagctgagcagatcgatggcgctctctcgtcgcatggctgcgtccgccctcctgctgctggtcctcctcgtcgccacagagatgggggcgacgacggtcaagctggctgaggcgcgggactgcctgtcccagagccacaagttcaagggcgcctgcctcagcagcagcaactgcgccgccgtctgccgcgccgagaacttccccgacggggagtgccacacgcacaacttcgcccgcaagtgcttctgcaagagggcctgctagcccgcctgctcgatcgccccgaccgccctgccggccagcgccgccatgtccgatgctagctagctgttagatcgtccgtgccttttggtagatctgttcgtcagcccgttctcgttcgtcactagtagctgttcgtgtggctgtctcccgtaataaagtacgaaatcaaccggggtctcggtagtttggttcgctggtgatgttacagatatggtcattgtttgggcagccacgcccatgtgttattttataccccccccccccccc

SEQ ID NO: 23760 - DNA, 765 bp, Triticum aestivum
  Clone ID: PAT_TA_23760
gccaaaaacttttccctttcctgttagaaccaaaaggcccaacataacctttttgtcattcaaaagcatcccattgagctcattgattgcattctgtgctgattcgtcctgctcatactgaacaaacccataaccttggattctccagacatttctgtagcaactttgcatgaaagaatgtttccaaaggcagaaaatgtgtcatagagcgctttgttatctattgacttgtcaagattcttgataaatatatttgcagcaccacttttacgtgagctggggtcacggttagaatacattatccttataggcttcccattaacaggagtgaagttcagcatttccaatgcccttgcagcatcggcagggatgctgaagttgacgtacgcgtagcctagggacatcctggtgttgacgtcccggcacacgcgcacagacaccaccgagccgacctggctgaagacgtcaaagagctgcgcgtcctgcacactcacgtccagatcccccacgtacagggacgtcgccgggaaagccgcagccccagccgccggagacgcgccgccctccatcgcgccagccgctggagctgccgacgcctgaacctgcgccgccatcatcaaccgggtaggagagataatagataagcggatccggccgaaggataggttcctgatgatttttttcaagatttttgggggtaattttgcggatttttttgggttttctagggtttggtaggaaggggagggagagggtttcgctccc

SEQ ID NO: 23761 - DNA, 705 bp, Triticum aestivum
  Clone ID: PAT_TA_23761
gccggccgggtcgaggcttccgagttctgactcaccgctgtccattcttctccattcgctttgctaacacagtccccagtagcagcagcagcaggacagctcagtctcgggtgaagctgagcagatcgatggcgctctctcgtcgcatggctgcgtccgccctcctgctgctggtcctcctcgtcgccacagagatgggggcgacgacggtcaagctggctgaggcgcgggactgcctgtcccagagccacaagttcaagggcgcctgcctcagcagcagcaactgcgccgccgtctgccgcaccgagaacttccccgacggggagtgccacacgcacaacttcgcccgcaagtgcttctgcaagagggcctgctagcccgcctgctcgatcgccccggccgccctgccggccagcgccgccacgtccgatgctagctagctgttagatcgtccgtgccttttggtagatctgttcgtcagtccgttcccgttcgtcactagtagctgttcgtgtggctgtctcccgtaataaagtacgaaatcaaccggggtctcggtagtttggttcgcagcacgtcgtgtttgtcgctgctttgtgtggtaatgtaatatggtcgttgtttcagtatggacggacgtgtgcactgcatctaaatctgaggatggtttcatacttaaaaaaaaaaaaaaaaaaggccccctag

SEQ ID NO: 23762 - DNA, 871 bp, Triticum aestivum
  Clone ID: PAT_TA_23762
taggggccttttttttttttttttttcagctaggactccccaaattcaatatcgtgaggaggaacaacccaacaagagcaaatactaacaaagcttagtagctagataaaatgctaatgacacttcctctttacaatgacctgatgccagaatcatacattcctgggcatgcagcacggggtaattgtacaatagtcttcagtgaagccgatgaacttcagaccaaatatcatacatgccatgaatctaccctatcttgatccaattagttggtgacaaaatggtacctggagtccacatagctctcaacgtcccagaggaaggatccgaaagtgacagcctctaagatgagccttctcaacccggagaagcttatcctgacatactcatccttggaagaatcgactgttccttccggggtgatcacgatctccggcttcccgaatagcgcctccgtgtgcttctcgatgatgccaaacgccaccttcgaccgaattgtcgcgtaagtttgcaacgtgtctgaatcaaatgacatgacgtacgatcgaagacgggaaggcttgacagactggccgagacctcctgcgctgaggtctggggaagtccacgactccacctctggatgggaactgtaagtctgatccgagagccgtgagtcagtcgtcataacttgattgagcgcatcgtcttctgatccccaagggaggctcttcatcgacttctccagctgaaacctcttgtcaactctcttgaggaagtagccatacattactgatgcggcatagacctggccaactcggagcttacttatggccgcgacagtgccatcggcttgccgctgccccaatatgagattcaagtggttctcgat

SEQ ID NO: 23763 - DNA, 961 bp, Triticum aestivum
  Clone ID: PAT_TA_23763
cacgaatatatcaattttcaatctcaatatttaaacaaatataaagagtacaatatgttgaaatccacagttaaatctatttgagtaaaactagacaatttcaggtctgaagcaccaagcacatacagaaaccagaaacaagcagcattccaactaagaagcaacaaagccatcgctcagcgaaagagcagccagctgatcagctggaacattggtttgctgctgctgagcactgcggagaacctccatagcttcagcgaccttagacttcagagcatcaggtgactcgattagatgaaggacctcagtctggtccatctccagaagcataccagtaaccttggcagcctggtcatgctccagctgatcaacaagtgggtacaagctttcaccaagcatcagtcgttgctgctccggcggagagttagcaagtgcagatgctaatgctccactagaaacttgctgcggtgctccagtgtcaccaggagtcatccttcccatctcatacagcgatggcaccatagctccaacaccacggaatgcagcatcaggcatgccacggccagacggataacggtagccaccacggccgccccttggaaccatctgctgatgacccattggcattggctgctgcattccaccagcacctgcgcgccttccaaatgggcgttgtggttgctgaccttgctgcaccattggcatgacgaaatttggcattggagcaacaccaggtctcattccaggaatcatatgttgctggaaaccaaatccaggctgtgggttaacaaaagctggaggtggttggccatagaatagttgttggcccattccaggaacaccaggggggtacatgggcatgcgcggagcaactggcggtggcatcacaggacgcatttgcgaaaactgtgcctacagcctggctcttctttcttccttgcgttgcgcaagtgctcggacg

SEQ ID NO: 23764 - DNA, 721 bp, Triticum aestivum
  Clone ID: PAT_TA_23764
ggtccttctctccactccattcgctttgctactagctaacacagccacccgtacatagcactagcagcagcagcagggtagctcctcagtccagtacgtgagcaagatcagcagatcgatggcgctctctcgtcgcatgaccgcgtccgccctcctcctgctcttcctcctcgtcgccacggagatggggacgacgacgaccaaggtggcggaggcgcgggagtgcctgtcgcagagccacaagttcaagggcgcctgcctcagcagcagcaactgcgccgccgtctgccgcaccgagagcttccccgagggcgattgccacacgccgcacttcgcgcgcaagtgcttctgcaagaggccctgctaggccgcacgctggccccgccctgccggccagcgccgagacgtccgatgctacatcatccgtgccgttagctaataattagcttatatctgttctgttggtcggtgcgtccaggttcgtcagtcagtcgtactagttcttaactagatcatccgtgccgtaactagttctgttctgttcatcggtgcgtccctcttaatcagtagtacaactaataaagtagaaaaatcaatcggggtctctgtagtttacttcgctgtacgccgtgtttatgcctgatttgtgtgtggtgatgtaataaatatgttcgttgtttcagcatggatggacttgtgcaatgcatccccctttccccgc

SEQ ID NO: 23765 - DNA, 796 bp, Triticum aestivum
  Clone ID: PAT_TA_23765
gccggcccggtccgggcgcccgcgtcggcgctccagtcgctttgctactagctaacagcagcagcagcagcagggtagctcctcagtccagtacgtctcgggtgaacaagatcagcaggtcgatggcgctctctcgtcgcatgaccgcgtccgccctcctcctgctcttcctcctcgtcgccacagagatggggacgacgacggtcaaggtggcggaggcgcggaactgcctgtcgcagagccacaacttcaagggcgcgtgcctcagtagcagcaactgcgccgccgtctgccgcacggagaacttccccgacggcgagtgccacgcgccgcactacgagcgcaagtgcttctgcaagaggccctgctaggccgctcgctcgtcccgccctgctggccagcgccgagacacgtcccatgatagctagatcatccgtgccgttagctaatgagcttatatctgttctgttggtcggtgcgtccaggttcgtcagtcagtcgtactagttcttaactagatgatccgtgccgtaactagttctgttctgttcgtcggtgtgtccctcttatattagtactagaaccaataaagtagaaaatcaatcggggtctcggtagtttacttcgctgtacgtcatgtttgtgcctgatttgtgtgtggtgatgtaataaatatgttcgttgtttcagcatggatggacttgtgctgttgtgcaatgcatccccctttccccctgtctctgtgtaagtgtgtgatcgtgttcaaagagaaatgctagtattattgcttgtgact

SEQ ID NO: 23766 - DNA, 1074 bp, Triticum aestivum
  Clone ID: PAT_TA_23766
cctcaaatatatcatttttcaatctcaatatttaaacaaatataaagagtacaatgttgaaatccatagttaaatctatttgagtaaaactagacacttccaggtctgaagcaccaagcacatacagaaaccagaaacaagcagcattccaactaagaagcaacaaagccatcgctcagcgaaagagcagccagctgatcagctggaacattggtctgctgctgctgagcactgcggagaacctccatagcttcagcgaccttagacttcagagcatcaggtgactcaattagatgaagaacctcagtctggtccatctccagaagcataccggtaaccttggcagcctggtcatgctccagctgatcaacaagtggatacaagctttcaccaagcatcaatcgttgctgctccggcggagagttagcaagtgcagatgctaatgctccactagaaacttgctgcggtgctccagtgtcaccaggagtcatccttcccatctcatacagcgatggccccatagctccaacaccacggaatgcagcatcaggcatgccacggccagacgcataacggtaaccaccacggccacccctcggaaccatctgctgatgacccattggcattggctgttgcattccaccagcacctgcgcgccttccagatgggcgttgtggttgctgaccttgctgcaccattggcatgacgaaatttggcattggagcaacaccaggtctcattccaggaatcatatgttgctggaaaccaaatccaggctgtgggttaacaaaagctggaggtggttggccatagaatagctgttggcccattccaggaacaccaggggggtacatgggcatgcgcggagcaacgggcggtggcatcacaggacgcatttgtgaaaactgcacctgcagcctggctcttctttcttccttgcgttgcgcaagtgctacgtaaagaggcttaccgccaaccattttaccattcattgccacaagagctcgtgaagcatcttcggaagatttaaatgcaacaaaaccagatcctttgtttaccccatacaaatcccgc

SEQ ID NO: 23767 - DNA, 719 bp, Triticum aestivum
  Clone ID: PAT_TA_23767
ctacttcccggtgttcattctcctccactcgctttcctatctaacctaacacaggcccccgttgcagcagcagagcagatcgatccagtacgtctcgggtgaaccagctgagcagatcgatggcgcccactcgtcgcatggccgcatccgccctcctgctgctgctcctcctcgtcgccacagagatggggacgacgaggaccaagacggcggaggcgcgggactgcctgtcgcagagccacaagttcaagggcgcctgcctcagcagcagcaactgcgccggcgtctgccgcaccgagaacttccccgacggcgagtgccacacgcacaacttcgcccgcaagtgcttctgcaagagggcctgctagccggcctgctcgccccggccgccctgccggccagcgccgagacgtccgatctgttcgtcagtgctgtctgctagatctgttcttcagtgcgttcgcgttcgtcggcagtagctgttcgtgtgacgactgtgtcccgtaataaagtaggaaatcaaccgggctcttggtagtttggttcgccgtctgctagtaggtcgtgtttgttgctgctttgtgtggtgaacttgtgatgtagtaataaggtcgttgtttcagcaaaaacgtacgtgtgcactgcatccccctctgtctctgttggtgtgatcggtgtcaaaaacgctcttatgacttatattataagactgaggaggt

SEQ ID NO: 23768 - DNA, 1224 bp, Triticum aestivum
  Clone ID: PAT_TA_23768
ataacaaagtcagagagatgtctgacatgtttccattaacaacaaaaattacatcgatgccgctaggcgaacagcttattacatactgacgcaaatcagcgggcctccctaagccttcttgggggacttggcggccttcttgggcgacttgccctccttgggcaccttctccgccgtccgcttggggagcagcaccgggttgatcttgggcacgacgccgccgtgcgcgatggtgacgccggccagcagcttcccgagctcctcgtcgttcctgacggcgagcagcaggtgcctcgggatgatgcggctcttcttgttgtccttggcggcgttgccggcgagctccagcagctcggcggcgaggtactcgaggacggccgcgaggtagacgggggcgcccgtgccgacgcgctgcgcgtagcggcccttcttgaggtaccgcccgatgcggccaaccgggaactggagcccggccttgacggacctcgacaccgacttcttcctggggccgcctgccttgcgccctgcggctcccttcttggccttcgcgcctgctccggtggctgagacgtccatggctagccgctgatgctcgtcgaggcgcgtaagagaagatgtttggtgctgagagattgggatggcgagctctggactggtttcttgataaatatatttgcagcaccacttttacgtgagcttgggtcacggttagaatacattatccttataggcttcccattaacaggagtaaagttcagcatttccaatgcccttgcagcatcggcagggctgctgaagttgacgtacgcgtaacctagggacatcctggtgttgacgtcccggcacacgcgcacagacaccaccgagccgacctggctgaagacgtcaaagagctgcgcgtcctgcacactcacgtccagatcccccacgtacagggacgtcgccgggaaagccgcagcggttgcgggtgcggctgctgccgcagtcccagccacgggagacgcgccgccctccatcgcggcagccgctggcgctgccgacgcctgaacttgcgcctccatcatcaaccgggtaggagagataatagataagcggatccgaccgaaggataggttcctgatgatttttttcaagatttttgggggtaattttgcggatttttttgggttttctagggtttggtaggaatgggagggatagggtttcgctccccaactacggcgc

SEQ ID NO: 23769 - DNA, 1434 bp, Triticum aestivum
  Clone ID: PAT_TA_23769
agagcggtctctaggatctgctcccccctcctccctcgcgtcgccccgcaggggcgactcgggggcgatccagatcccgttcgtcgccaccccccttcctccgcttctccccttgccgccgccggaggcagccgtcggcaaccacgtgcgaacgccgatgagggtggcggcgaggtcttcggtcgcgtttcctccctgggaacggacctagggttccaggcggcggccttggtggcgtgggcggcgccgtcccgacggcgggcggcggacgccggagttggggccgcctcccctcggctgcgtgggcggcgaggcggcggtggactggggcgtcgtgcgttggggcccccgcgtccctcttcaccagatctgaagacggtgtcccgtcgcttgcagcagcctcctctatgttaggttcgacccgatctggttgttggctgcgtggatgtggagtggggtgctctggatcggagtaaccccttggcctccggcggcggcggcggccacctcgtcgtctccttcctgaaggcggcgttgaggttcacctccccctcctccccttccccggcacccgggtgaaagcccacaactttggtttgggcggcggcggcgccatggcagcgtcgttacctttttgaacgcgccgttttgggtctgtgggggggcgggcaggctgttgtgagcttcgggagctcccggtggcggcggcttctccttctggtggtgactcttcgccatggatgaccagttccctcctatggccatcgtgctctcccccatgtggttctgtctgcccggcggataaacgcccacggcctgggctagaggggatagtggtccctcttcggcgacatggacgcgacggtggctgagttggtggccttggcgagctctggttcctcctagtggctgtgttgctcaaatcagtgccgtgtcttcttgggacgcctatggtccttgccttgcatcaacaacatgcttcaattgtgggctgctgcttgtgttcgatgtgcttgctggagtggtcgcgccctttgccttcggtcggcctgacatctatggcgagcttgctctcggggagcagtttctccttgtcgacggcgcagcatcactcaagcctgtgcgtgaagagttggccctcgtctgttggtggtggctttcaatcttgttggcttcaggtgcagaacgatctcttccggtggcgcgattcccctcaagaacttagatcttcaagttgtagccttttcttttatcgttgcgcttgtgctttcctttagctccttgtatcggccgctgtagggttgcatccctgtcttattttctttccttgttgctgggtctgtttccgctgtaatcctggccggttgatagctttgttaattcaaagccgggctatgctcgagcccttctcgggctcggattgtgtctttccct

SEQ ID NO: 23770 - DNA, 1107 bp, Triticum aestivum
  Clone ID: PAT_TA_23770
gccggccgccggccggcttctcactggtgcccattctcctccattcgctttgctagctagctaacagagtcccccgtcgcagcagcaacatcaggatagctttgctagctagctcggtccagtacgtcgtctcgggtgagccagagcagatcgatggcgctctcgtcgcatggccgcgtccgccctcctcctgctgtccctcctcgtcgccacagagacggggacgacgacgaccaaggtggcggaggcgcgggactgcctgtcgcagagcttcaagttcaagggtgcgtgtctcagcagcagcaactgcgccgccgtctgccgcaccgagaagttccctgacggcgagtgccacaggcagcacttggagcgcaagtgcttctgcaagaggccctgctagttcgcccgcgcgccggccccgccctgccggccagcaccgagacgtcccatgctagctcgatcatccgtgccgttagcttatatttgttccgttcgccactgcgtccacgttcgtcgctacttgttcgtgtgtcccgctcggctcggtagaactaataaagtagagaaccaatcggggtctcgctagtttagttcgctgtgcgtcctgttcgttgtcacctgatttgtgcgtggcgatgtactccattcagtaataaatatggtcgttgtttcagcaaaaaaaaaaaaaaaaaacgcccccataggcagggatgctgaagttgacgtacgcgtagcctagggacatcctggtgttgacgtcccggcacacgcgcacagacaccaccgagccgacctggctgaagacgtcaaagagctgcgcgtcctgcacactcacgtccagatcccccacgtacagggacgtcgccgggaaagccgcagccccagccgccggagacgcgccgccctccatcgcgccagccgctggagctgccgacgcctgaacctgcgccgccatcatcaaccgggtaggagagataatagataagcggatccggccgaaggataggttcctgatgatttttttcaagatttttgggggtaattttgcggatttttttgggttttctagggtttggtaggaaggggagggagagggtttcgcggacg

SEQ ID NO: 23771 - DNA, 2355 bp, Triticum aestivum
  Clone ID: PAT_TA_23771
cgatgtgtgccgacgcgtgccagcacggtaccgctccaccctagccgctgcccgcccgcagaaaccaaccgcccactcgcaccaccaccaccaggaaaagctggcgcccgaccccagcagaacgacggcggccccggctcgcctcgcgtcactcgaccctgccaccacggcgacggcccgcgcccggaccgggcccgctggccccctccgccacgacgtacctgccgcggggcacacgggtgcaggcgcggcgcgtccagggccggctcaccaggacactccggctgcactccaccctggagcacggccgtggtccaagcagccacttccagctccgcagcaccccgcacctacagaatctcccagcaagcgggcttgcaaccacgaagcaaccaagccaccggccagcgcgagtccagccccttgagctagcctggccatcggtagctctgttcgtggggcgcttcggagaacttcgttgtgcttgcggcgatccttagtacttcaggagcattcggtggcgtcttcgtattagatgaagaaacatcagtcttggtcgtttctctagacgcattacctggtaacccttgccagcttgggtcatgctccaggtgatcatacggagtcgatacaagcttacacaaatgattcagttcgttgctgcttccgggcggaagagtttcacaagtgcagaatgttactggttccgactataaacttcgctgcggcttccgccagtggcactagcagtcgtccttcccctctcatacagctactgctcccatagctcggccaccacggaaggcagcttcagacgtgccacggccggacgtccaagggtaaccacgacatggcgcacgttgcacaccgacccagcaggaccggcgtcgcagtgggaggtccaggacaaccgcaccgtccccccttacggccagtgctgccacatacagggccgtctcctctaaaggcgcagcatggtctggcactggcactaccccagcacccgtcactggatacgctgctccctgcattccgaaagccgctcgcgcgtccgacgacgcaacatgcgcttcgtccatctaacatgtagtagagatattacttatgggggtacagtggaacgataggatacggaggaccatttccaaagtctttgcgggaagctttgcgcatcgttttgtggttttggtcctgtttcttgtcaatttcaggtgcagggccaccccttcctacggcacgattccccccaacaacttagttctccatgcattgcccttttcttttgtcaatccgcttggggcgatctaattgcaccataactcggccgctggtgggccgcattcgagtctcgcttaaccttgcatgaagttagagtgccaaattcggcgaaaacttttgttgatttctcatcgtcatcaacacataccatccaagtttttcaaatacaagttagtgccttggttcctgtcagctgtctctttattgcttttctcaaaattttccttcaattgcatctccctttcagacttcttttgggctctaccaacatacaattccttatcatcaaatttcttgccattcaaatcctcaacagcacatgcagcatcatccggattttcaaagttcacgaatccaaagcatctggatttaccatcatcgcctcgcactacaataacactagttataggtccaaaattaccaaacaattctctcagattatcttcagtggtagattctgatagattctttacatagacattattgaacttgggactgccaaaaacattttccctttcctgtttacgaacaaaaggcccaacataaacctttttgtcattcaaaagcatcccattgagttcattgatagcattctgtgctgattcgtcctgctcatactgaacaaaaccataacccttggattctccagacatttctgtagcaactttgcatgaaagaatgtttccaaaggcagaaaatgtgtcatagagcgctttgttatctattgacttgtcaagattcttgataaatatatttgcagcaccacttttacgtgagcttgggtcacggttagaatacattatccttataggcttcccattaacaggagtgaagttcagcatttccaatgcccttgcagcatcggcagggctgctgaagttgacgtacgcgtagcctagggacatcctggtgttgacgtcccggcacacgcgcacagacaccaccgagccgacctggctgaagacgtcaaagagctgcgcgtcctgcacactcacgtccagatcccccacgtacagggacgtcgccgggaaagccgcagcagttgctggtgcggctgctgccgcagccccaaccgcc

SEQ ID NO: 23772 - DNA, 1765 bp, Triticum aestivum
  unsure (1)..(1765): unsure at all n locations
  Clone ID: PAT_TA_23772
cacgagcattaatctaaccggatcacaaatcaaaccaacccacacctctctctgcctgcccatttcctcctctctccctcttcctcccctcgccgtgggctccacccgtcagcctaccgcgtgggggagtcggcacggggcgcgtcgccgccggcgccgccgcccgctcccccgcggggtcccctcccccgcccgccgccggggcctcctccgtcagcggcggcgggcccgccccctgccgccgctgccgccgccccgcccccccccgcggccgcgcctgctgcggggcgccgcccccgcccgcctcgcgcgggcgggggcgggcgtcgaggcgcggcgcccccccgccgccgcgctcggggtccaccgcgcccgcctgcgcaaggccgccgccaacgcacaaaccgaaaaggtccacgaggacttggatcgagcgtcatgcctcataagtgatggtgacattgcgacgattctccctaacaaggcgcatggcacttttttgaagctgttattgggaccagtgaatctccgcgcaaggaaggaggtacagctcaaggtgaaggaggaatacaatagctacagggataggactgccatagtgtttcttggttttccgatgattctgttgtttcttcggtcatggctatggaatggatgctttccagcattgccagttcagctatatcaggcctggctgttactcctctatacaactttagctttgcgagagaacatattgcgagttaatggaagtgatatccgtccttggtgggtatgccatcactattgtgccatgctgatggctctggtgagcctcacatgggggattaagggacaacctgattgtgcccgcaaacagagaggtgtcgagttatttctgtgctgggctgtgatgcaaggttttgccatgatgttgcagaacagatatcaacgtcaaagactatatactcgaattgctttggggaaggctaaaaggatggacgtcgtgtggggcgagactgctggtgttgaaggccaactattgctgctgtgtcccatcctttttctcttgcaggtctttgagggttatgttggatttttacttcttcggacagctcataaagggatcattcctgagtggcaggttgtggtgtgtgggatcctgcttattgcaatggcaattggcaactttgcaaacacagtggacacattgatggttaagtccagattcaaagcaaagatgaagaagtccaagagcaaacgagatcttgctgcatgcacgtcaccgactcgctcatcgctgacaaattcggcagctggagcttgaaatggagacgttctcatcatatgaacattgcccatattcaatcaggggctgtcaaaattgtaaagtattagtttttttggccaccagctccttgtgctgacagtctctgtcaaagctcatacccatgtaatcatcaaacgactcggttgctgatggtgtcaggttgagggtaactaagaataaactgttcatgtttgtttatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaataaaaaaaaaaaaaaaaaatnaaaaagggggggccctttaaaagaaccaaattttagtaccggggcctggcaaagtaattttttttttttggggccccaaaaattaaatccgggggccggtgtttaaaaacggggggcggggaa

SEQ ID NO: 23773 - DNA, 614 bp, Triticum aestivum
  unsure (1)..(614): unsure at all n locations
  Clone ID: PAT_TA_23773
gaattcactaagtgattcgagcggccgcccgggcaggttttttttttttttttttttttttttttaaaggtaagggggcacatattacaaatgagagatgcaacacacaatatctcagttgagagtttatattttctgtgaacaaacactgcattttctttttgtacaagcgggcactagtgaacaagctcattcttttttccttggctttctttcttgatttcacttcactttgtcaccttccttgatgtctccattggcttcctctgctgctttgtccttccctttgttttccttcttgggtttcttcacctccgcctcctctttctccttggctttctttgcttcagcctccttgggctcttcttcctccttcgccttgggctgctgctgctgccgcatcttccttgggcctgcttgaagtgccttgacgaaggcccgacaaacacaaatcaaggtccctctttttcttcttcgacattggcatcaaggtccctgcaacgtcggcggggtgacatgtccggtctcctccaacagctgcgaattccccaaacaactcaagcctaacggcagcccagtacccctgcgcccgacctgagcnccccccaancgga

SEQ ID NO: 23774 - DNA, 1352 bp, Triticum aestivum
  Clone ID: PAT_TA_23774
caaactggtacctccagccgaggatctcctccaacggtggccagggtgtgattagtgtcacgtcgctcaagctatcagtgctcacaaatacggttacactgaggaggctgatcaggaagggggtgccaccagcgctgaggccgaaggtttggctgtcggtgtcgggtgcagccaagaaacgatcgacagtgcctgagacatactatgacgagctgatcagggccacggaggggaaaactacgccggccactcgccaaattgaccatgatctccctcgcaccttcccttgccatccctggttgaacagtgaggaaggccaggcatctcttcgacgtgtacttgttgggtactcattccgtgattcagaagttggatattgccagggtttgaattatgtagccgctctgttgttgctcgttatgaagacagaggaagatgcattttggatgctggccgtactcttggaaaatgttcttgtcagtgattgttatactgatactctttctggatgccatgttgagcagagagtattcaaagatcttctagctaaaaaatgccccaggattgctgctcatcttgaagcaatgggctttgatgtttcacttgttgccacagaatggttcttatgtctcttctccaaaacattgccttcggagacaaccattcgggtgtgggatgttctattcaatgaaggagcaaaggtcttgttccatgtcgctctagcaattttcaagatgagagaagacgatcttctacgcatccaacatattggtgatgtaattgatgttctgcagacaactgcccatcacctatacgagccagatgaactgctcacgtttgctttcgataagattggctccatgacaacgaacacgatcacgaaagaaaggaaacggcacgagacggtggtcatggcggagctcgaccaaagaaccagacggctggggtcgctcaagatggatgcatgatgcgcagaaaaaacatgttgagaggcttagctgaagccctgtgtgttttgaaggaaaggcgagacgacactgtgagtttgcactcagttcctggtcagactggattctgcgacgagtaaaaaacccactcgtggtccactgaaaacaggaatgtattatgggaagttgccaaaactgcaaatgtgggtttgtttttgggaccttcatatttgtgtgtttctgtgctcgtgcacgatgccgtgggagcaggttctgccgctggttgaaacctgcacgaatccgatgcttgtcggcggcgctcatggcattttgcttgatttgtattccgggtttgttgtgtgtgaaatggagctaaagaaatttcttctgtttttactagtaaaa

SEQ ID NO: 23775 - DNA, 467 bp, Triticum aestivum
  Clone ID: PAT_TA_23775
acctcaaatttctatgcttgtaccaccatcacggttgggaagacagcatttgtttgacgttgctctggcagctaggtagctacgctactagctagtctgaaaaatctgatccatccagaagatggggctgctgtccaacaccccggtgcaccacgccgtgccggacgagtacgtcctgccgccggagaagcgccccgaacccgacgagctcgtcgatcccacggtcaccctgcctgtcatcgacctcgccgccggccgccgtcgccacctcgtcgtcaatgagatcatcaaggccagcaaagagttcggcttcttccaggttgtgaaccatggcgtgggcgacgaggtggtcggggcgtttcggtccgcggcggcggagttcttcgccatgccggcggaggagaaagctccctactactccgacgacctcaccaaaccgttccgcgtcgacaccagcaccacctacg

SEQ ID NO: 23776 - DNA, 514 bp, Triticum aestivum
  Clone ID: PAT_TA_23776
cccacgcgtccggggattgatccttcttgattctaaaaaagcgacaactccctcgcgtcgtctctccgaggcgacccgggggccccaaatccctccaccgccggccggcaatctgcttctcccctgccgccgctgccgccggcccttgccgcggtggcggcgggccccgttcctcgaaggggagggggacctccggccgatgcgtggggcgcggcggcggatcttgggccccggggcggcggcctcggtcttggcgacgacggctgctgcggctgcttgggcggcgcggtggttgggcctggggcggtgctgctgcggccatgctgggtgctcgcggtggaggaagctcggtcctcctgctgcacgacgttcttcggcgcgacgactccggcgacttcgcggccttgcgtcgccgaggtccttctccagctggcctaggcgggtgggcagccccctggtctgcctgtgcgagctcgtacccgtggcccgcttgtcgatggtgttgccggctcgt

SEQ ID NO: 23777 - DNA, 1007 bp, Triticum aestivum
  Clone ID: PAT_TA_23777
ccgtccgctcgcccgccgcccccgcccgccgcgcgcgtccggccgtccgtcgctgcccgccccccccttggcgccggcgccgcgccggccgcccctgcgcgcgggcgcccgccccggccaccgcggggtcggcaagacgtcgctgatgaaccagtatgtgaacaagaagttcagccagcagtacaaggcgaccatcggcgccgacttcctcaccaaggaggtcctcatcgaggacaggctcgtcaccttgcagatttgggatacggcagggcaggagaggttccagagcctcggcgtggccttctacaggggagccgactgctgcgtgctagtctacgacgtcaatgccaaaagaaccttcaacacgctcggcacctggcacgacgagttcatcaaccaggccggcccatcagaccccaagcaattccccttcattttggtcgggaacaaggtcgatctggacgctggaagcagacgagtggttcctgagaagaaagcaaaagactggtgcgtctccaagggcgacattccgtacttcgaaacctcggccaaggacgactacaatgtcgacaccgctttcctgtgcatcgccaagctcgccttggagcatgagcacgatcaagacatctacttcaattcagttgcagaacaaggccctaaaaccgaagaacagacaaccggatgcccgtgctaggctaccatcttggctttcccgtccaaggtaacgctacaattttgcccactgtccagccccatatacattcccgaagataataggtcgacccgcccatagtgcgccaagctgcaacagctgcaagctgtgctccctttgctgcgctatatactgtaaacagttccaaccaaggaattattgtcgacctaattcttggtcggttgtaacatgttgcacttcaactgcttggtctgattgtaaacagagcatactcactctagttgactggatataaataagctgcaatcccgttctcagtggtaaaaaaaaaaaa

SEQ ID NO: 23778 - DNA, 477 bp, Triticum aestivum
  unsure (1)..(477): unsure at all n locations
  Clone ID: PAT_TA_23778
agcgtggtcgcggccgaggtctctctctctctctctctctctctctctctctctcgcaaatggcaagccatatatattcgtagagaatgtcgtgtcaaaagacacaaaatctccatatagctcataattcatcttacacaaggagtctgtccagaacaggctccgcactacattcttctctgtctcttccacatggtggaatcccggcctccgcctctgcatatcaagcaaacagtttcatggtgtcctcgatatcaagtgtcgtgctctccaagccctgtcccgggcatgcaacgttgcttatgtcaattgtgtcgaacataatttctccgcctcggtttccccatgggaagtaaaaatctggaataaccttccttgggtccaatcccaccttctgcaaacacttggtataaagaaatttccccggatggngccatcttcctaanggcactccagggaaactttaannatccaatn

SEQ ID NO: 23779 - DNA, 464 bp, Triticum aestivum
  unsure (1)..(464): unsure at all n locations
  Clone ID: PAT_TA_23779
taccatagggaacatattcattctaaatatctatgaaaaagatatgtttctttctcttgtttgagagagcttttgtgttgaaaatattcttactattattgtattatccgtggtcgcggccgacgtgttgagaagaggttgttaataagagattgcccagggaaataggtaaaagaaatttccatccaagatttaataactgatccattctcatcctcggtaaagtccatcttattgtgatagaaatgaagagaaataaataagctttagttaatgtaataaatatacccattgtcatttccaaaattccaactgctttattcatttggaaaaaatcaaaaaaggatatatagggaatagataaattccacccgcccaagtagagaactgttacaaataaagaagaaactaataaatttaggtaagaaaaaananaaaaaaaaaaaaaaaaaaaaaaaaaaaaa

SEQ ID NO: 23780 - DNA, 1276 bp, Triticum aestivum
  Clone ID: PAT_TA_23780
atcggctgccgcgttgttctcccgcgccgccgccgtgccccgggcttcaatccgctgccgcgttgtagttgcgcgtcgccgccgcacccccacacgccacccggccggactttccgccggcctgccctccccccccgcccctccaggcctcgtgcaggcccctcctcgtgctctgccctccctcgtgccgaccgtccatccgccccggcggttattcgtgtagcgccggccttccggggccgcgccgcgtcactagggcatctccataggtcaacaggagagacttggagctgcttcagcatcctcaggagagtcatcaaacaacgatatggattcaagtgccactcactgctgaaggctattgcttttactgacaaaaaagatggacactgactctggcaggatattattaagaatgtcaaaggaaaaaaaatcgtgccttcaaagaagtccctagacatgcaaataaaaaagcagtcctttagagaatggtaatagtaataaagggaatgcaaagattcagcgaggcaaaaagtcgagatcatctatacgacaagctgttctggcacaaaggaggtcaaatcttgatgcaaatcagttccaaatcacaaagcaggctgcaaacaaggctgctactatgcctgtgcgcggtagggctgacagatggaacaaaccaagtggcccgtctacctcagcacagaggaggcccgtaagcgaggctcctcagaacagcaagggtaaggagatgcagaatgagcctccaaggacaatggatgcgctctttgcacagatgaagcagcaacggatgagggtcatgccaccgcagcaaccaaaagctcctaccaatggccatcagtttaaccagcagcggcgtggtcagcagcagcggcgaggcagagggggatatggtgtccgcagcggtggtggtaaccgttgagcatggcacccatatagaacattatcactggtgttcctcggaagggagaagcctcacccctggaattctacctggccatgtgttgcctctcgtatttgtattctctgcgagctgtgaacagaatcttaactgaagtttacaggcagttttctagtcgcttgtttcaagtttcaatttccgatgtgtaatggtcgatggaatgtacgggaattgtttgctagtcctttggttcctaccgcattattacaaaaggggaattggtatattattactggctgttttggttggtaactatcgtagtcttagcagattgagagtaaaacggcaaaggtgaactgt

SEQ ID NO: 23781 - DNA, 414 bp, Triticum aestivum
  unsure (1)..(414): unsure at all n locations
  Clone ID: PAT_TA_23781
tcgagcggccgcccgggcaggtaccacagacagatcttggttgtttccaaataaaactttttctgtaaagaaattatttgaagagtgagagttctcttgatgaaaattttttgatcactcccctgaagtcaaataaaagccttttgaaaaatccaaataaaaacttgggtgtcacacataactaattaacacaagaaggaaaaagaaaaggaacaacataataagaaaccggaagacgaaaaggaaaaagaaaagggaagaaagaaaagggaanaagggaaagggaacaangaaaaggnaagaanggaaagggaaaaagaaaaagggaaaaagctccgggactaattncctngctccaggngcgaacanccggaaatcnaatntcccgccggccccnaanggaggggccgggaa

SEQ ID NO: 23782 - DNA, 1019 bp, Triticum aestivum
  Clone ID: PAT_TA_23782
cccacgcgtccgctctattctcccatcccaccgctcaccatggccgctatcgacgaggcctctggccgccgggcggccagctgcttcttcgaggtcggccagcgcgagatcggctcatccagctcccgccgaatcagcggctccgagggcctaattttgcggatgaaccaatatggaaagttgcgaggtcatagtggctgtgttaatactataagcttcaatcctgctggtgacctccttgtgtctggttcagacgacacagacatcatactatgggactggcttgctaaaactgaaaaactaacttacccttctggacatcaacaaaatgtctttcatgctcgtgtgatgccatttacagatgacagcaccattgtgaccgttggtgctgatggccaggttagggtgggacaactgaagcagggtggtggattcacaaccaaacaaattggggaacatcatgatcgtgcgcataagatggctctcgaaccaggaagtcctcacatactttacagctgtggagaggatggcttggtacaacactttgacctgcgcagtgattcaccaacaaagcttctcacctgctattcattctcaaatagaaggcgccgtgtaagactgaataccattgctattgacccacagaaccctaattatttttcgatcggtggctccgatgagtatgtacggctgtatgattttaggaaaattaacttggactcttcaagcaatatgaacctaccaggttgatacccttctgccctgagcaccttcttatgggcgggaaggtccacatcactggtattgcatactcttattcaagcgagttacttgtctcatacaatgacgagcttatctacctgttcgaaaactatatgggtcttggtccgaatcctgaatcaacacagccagagcatttggacaagctcgagcagctacaatcatactctggtcacagaaatttcagaactgttaaaggagtcagtttctttggacccaataatgaatatgttttgagt

SEQ ID NO: 23783 - DNA, 638 bp, Triticum aestivum
  unsure (1)..(638): unsure at all n locations
  Clone ID: PAT_TA_23783
agacatagcagaagcggcggcccgccccgggctcctgctccccccatcgcaccctcgctcctccctcagccgccccgccgcctcagccgcccagctgtagcacgtcacattagtcaagcacgtgatggctgctgcgcatgtatgcttctccttatcctccttcgcgccgttgctccattccacgctgccggtggccagaaatggtggccggagtggccgaaaccgtggcttatttcgcccttccccggtgatatatcccgggcgggagccggtgtcccatgagctgtccgacgattttgacttccaagaaaagcctatcgaatgttcaaagcgttgcttcatcaacatccgaagagcagcaaagggatgttgagcactgggttgatcacctcaaagcgcctctgcattgaccactatttccacgatgaaatcgataacataatgggccccggcgggtggccttccctcgtgagggtctacttgacgcaaaccttccctaagggtgatnaaagaactggtatccttttcgganacaagttctcnggagtcanaacataatgggatnaaacttaggatacaaagactnaaggtnctactttaagaattnaactcacaggagaantccctcaggaaggatn

SEQ ID NO: 23784 - DNA, 417 bp, Triticum aestivum
  Clone ID: PAT_TA_23784
ctaccatcctgataaggaggcgcgcatgaaagcagtgattgaattttatgttaatggaaagcagaatgcacttgatcatttccctgatggatcagaatgataaaaccaaagcttattaggagcagccaatgacccttcttgttctcttgttgttatccattgttcttgaaactctggatggaagcccgtatcagtaactactgtaaacaatacatgatcattttggaacattgtgcttgagatgtcagactttcagtgagcatctaaccctgatagttctgtacttggtaacttgaatgtcgatcttgatactaccttctgtactttgttgggcttgaacgattttatgtcttgcaccacgggaatgattttatgtctggttattattaaaaaaaaaaaaaaaaaaaaaaaaaaaaa

SEQ ID NO: 23785 - DNA, 1245 bp, Triticum aestivum
  Clone ID: PAT_TA_23785
ccgtgccttgctgttttttttttttgcaagagaagagagaaagcttattaactggccaccatgcatgatgaacggccatgcatgtatatttgcctggctagtcgcatgcacttgcatctgaagatcgatctctataagtttggttttgtgagtagtttcgacggattacacggtgtggcgggtaattgacaagagcaagtaattgaagaagaggacgagggtgaagaaaaatggcgtgctgactgactgctgattgagaaggaggagactctgcctggcctggcctggactggacagacctgggtttcgagctatgtacactacacactgacaccgtaccaccatcggttgcatatgatcgatcgatcgcgtcgtcttctccacggattcgattgatcggcagcagtagtgctctgtgttacgaacactgatcttgttgcatggccgatcacgtcggcgattccttgtatggtgcttgagtgcttgaccgaccactactcgctcggggactcgaactcccaccattgggagctgctgcaggtctgctccgccgcggacgacggccagctcgagtggaacgggaacgacgacggcgactgctgctggtactcggccggccccgacgccgtgaagccgccgtcgtgcgcggttggcagctgcagcgagggccggaggaagaggcccgcgtcgtcgtcgtcctcgccgaagagcgagagcttgccgctgccgccgcagccctcggacgccgagtatagcttgctggccccgccagcgtccacgaactatgctcatgccggccacggccaagcgcacgtgtccctggcggcagcgccggcattatctccgcacttggccccgcccggctcccgcagcatctccgccagcttctccagctggttgaggagcgcttgcttgtccttcttgagctggtcgtagctggagaggagcgcgtcgtagtcgtcgcggagcgcggcgtactggcgctcgagctgcttggacttccagcgcgcgcgcttgttctggaaccagatggcgacctggcgcggctgcaggccgagctcccgggccagctgcagcttctgccggggctccagcttggtctgcgtggcgaacatggactcgagcgacttgatctgctcctcgctgaagcgcttcttgttcttgtccagcgcgccgccttttcccttccctgtggcgcccgcgccgcccacctccatcatccactccgggccgtcgtcgtcgccc

SEQ ID NO: 23786 - DNA, 1858 bp, Triticum aestivum
  Clone ID: PAT_TA_23786
gctcggtcagtgagtagatccgcccgcccgccgtgcagttggaaaggaaaggaaaggaaaggaaaggaaaggaaaggtcattgacctcgccacatcagtcgcctccggcacggaagcatgggagctaccgcgcgtctagcaaactaatatccatgctccagtgtgcgattgcaaccaggggctcatcctgcagcagatctcactccctatcagaagccgaagtagccgagaacacaagatctgccgacatctacctgcgtattcggaaggaggcaaaggcccgccagtacggcaaaaagctgttgcttctcggggctgcggaatcaggcaggacctccatctgcagcagacttcacccccttaatctgaccgaatccgccgacgcaatactcacgggatatacgccgaccagcattgccaaggggtccaagtccatgaagccggacaataagctatggccactatgttctgatggatcaagagagtttacccaactggaaacgaagacgccaaaatttcgaacatcccccgataaggcggagcttaaaggcaatataccagaaatcgatggcaggttggattagacaatcaatataaagtatgaggtacagaatgtgcgaaaattatgggaaaatccagccattaaggaaacttactcgtgtggaagtgtgctgcaagtacatgaccgtgcacactacttcatggagaatctggaccgattagctgaaccagattatataccaacaaaggaggatgtgctccatgccagagtacggacaaatggggttgtggaaattcaatttagcccccttggagagagcaaaagaggcggagaggtatacaggttgtacgatgtaggaggtcaaaggaatgagaggaggaagtggattcatctttttgaaggcgtcgatgccgtcatcttttgcgctgccattagcgagtatgatcagctgttgtttgaggacgggacacagaacagaatgatggagacaaaggaactgttcgactgggtactaaagcaaagatgttttgagaaaacatcgttcatgctgttcctcaacaaattcgacatatttgagaggaaaatacaaaaggttcctttgaccgtgtgcgagtggtttaaagattatgagccgatcgcgcctggcaaagtacaggatgtggaacatgcctatgagtttgtgaagaagaaatttgaggaggtctacttccagagcagcaagccggaccgtgtggaccgggtgttcaagatctacgggtgttcaagatctacagaacgacggcgctggaccagaaacttgtaaagaagacgttcaagctgatcgacgagagtatgagacgctccagggagggaacggggacgtgatgaagactaggttgttgtgactgagccacaggagggggaaaacggcaattaggatgacacattaagtttacggtgtcgcaactctgtgttgtaattcattctttagtgtagaagaggaagaagactgatttgatccctttgtgcttgctttcacaaacaaagtccaggaaacaaatctgatgaatacagtacagtattatgcaaagtttggatctgtcattttgctttctacatggccgtaaaatatttgcagattttgttggatcatcactttgttgcctcatggctattttggggaccaggctgaggtcgtatgttatggtatttctggcccatttatggccctgtgacaatttttacgacatttcaaatatataatttgaacacctagggcgtacaaaaaaaaaaaaaaaaaaaaaaaaaattggatcatcacactcattgttccttcatggttattttggggcccataattaggtagtatgtcccggt

SEQ ID NO: 23787 - DNA, 599 bp, Triticum aestivum
  unsure (1)..(599): unsure at all n locations
  Clone ID: PAT_TA_23787
gcagaaactcccactgcaactcccaaactttggtccgccatgtcctcttgcgtctcctcctcccatcaccactgcgcccgccgcctccccgccccaacgccccgggcgcacctcgccgcagctgagttgtgcgcgtcccctcaccgcagacgcgtcggttccctgagggcagtgagagccgagccgccctcgagcgtggcgccggcggggggcaggaaggctgcggcggtgcaggcggagatggtagaggcggcggccatgtggtgcgccatgcacggactcgtcgtcggcgaccgcggcgacctgagatctggaacagtcccaggtgttggtttggttcatgctccattttcgctacttccaacacgttttccagcatctttttggaagcaagcatgtgaactggctcctattttcaatgagcttgtggatcgtgtgagcttggatgggaagttcttgcaaggttctttgtctanaacaaagcaggttgacgatttcactgctaggttgttagaaattcatgcaaagatgatggcagtaaacaagaaggaggatatccgcttaaggttgcatcgatctgactacatgcttgattctga

SEQ ID NO: 23788 - DNA, 589 bp, Triticum aestivum
  unsure (1)..(589): unsure at all n locations
  Clone ID: PAT_TA_23788
ccatggcggaattcactatgtgattagcgtggtcgcggccgaggtaggttttattagcggagaagaagcagtaaattggggcttatcgggaccgatgttacgagcttctggaatacaatgggatcttcgtaaagtagatccttatgagtcttacaaccaatttgattggaaagtccaatggcaaaaagaaggggattcgttagctcgctatttagtacgagttggtgaaatgagggaatccatcaaaataattcaacaagctgtagaaaaaattcctggaggaccttatgagaatttagaagtccgacgctttaagaaagaaaagaattctgaatggaatgattttgagtataaatttcttggtaaaaaaccttcgcccaattttgaattgtcaagacaagagctttatgtaagagtagaagccccaaaaggggaattagggatttatccaagtaggagatgatagcctttcccctgggagaatggaaaatccgtccaccgggttaataaatttgcaaatctcctcagctagttaaaaaatgaaantggctgatatcatgacnactgccgggcggccgctcgaatcgan

SEQ ID NO: 23789 - DNA, 814 bp, Triticum aestivum
  unsure (1)..(814): unsure at all n locations
  Clone ID: PAT_TA_23789
ctcgcacgaattcctttccccgtcttggtgggcgaagagcaaggtgagcagcaagaacagcaccggcgtcggggccgcttcctgttccggctggcgctgctcatggcgaatctcagagcgaagacggaggcggcgttggactctggaacgatctcatcggcaacgggttcagaggcgtgcgagccgccgtttgttttgggcgagggcggtgacgctttgcccgattcggccgtagtctcgccggattcggccgtcgaagctccctcgccggacattcgtcggttggatcgaggggtgggcttgctgatgtccagtcctccggggcttcctgcaagagcttcagtgctggtggcggagatgtggcgtccgcaaaccccgggtgcgggactcctgccgtcttctcgcgcacatccgccgagtccagccgccgcagtggctcttcgggttcctgcacgacattcagttctgggggcgtggtcgtgccgtcggcgcgagactgcgacgatacgccggccgtcgtctcgagctcggtcgtgcagtccttagcccaaaacgggccgggttcggggaacaccaccatccgcgttggctggaagcgcagctagctactgattttctgccgtttacgccaattgtgcattttcctgttctcagtcgtgcgagcaagtgcgggatgtttcattagcctggtggtttcgggttgggccctggataagactggaggaaacaacagaaatctgaatcaacccttcccaacaaaaaaaaaaaaaaaaaaaaaaaaaaaaaaaaaaaaaaaaannaaanaaaaaaaaaa

SEQ ID NO: 23790 - DNA, 628 bp, Triticum aestivum
  Clone ID: PAT_TA_23790
cggcccccgcctccccctcgccttcgcgcccgctccggcggcaaggggaggcagcgcccagatccgcagccgcaccggcgggccgccgtccctcgagatcgtccatggaggtccgacccggctgcagccatggactgagacgcccgaatccctagctacccgtggaggtccgacgcctcaacctccaaggaaaggacgcgcgccggctgcaggccatctccggcgacctccgaccatggttgctcggatctggaccagctgctgctcctactgcttcaggtggacgaggacgagccctccctcatggctgctgcggctgcctactccctcctcctaccccctggcctggtgtgggtgttggggaaaataatccacgctgtaatacgaccggatgcattacgccgcacacgcatcactgatccctgaaagtactgaaccctgttgctaacgtgactcggtgccagcaggctcccatccacttccttaccctcaacgacgcactacataatttgctccctgctgatacctaggtgctcgcgcatcacctttgccaaggacactaaacaagaacgctgggtctagcattcatgctggctatcacacgccattccctgtccctgatccggtt

SEQ ID NO: 23791 - DNA, 557 bp, Triticum aestivum
  Clone ID: PAT_TA_23791
ccgcccgggcaggtagactagttctatgatgttctctcgagacctgtgctatcgcttttgcaattctttttcatcgataaatccttgtggataactacttacacttgtcgttcatatcttcatccccagtttcccttgatattacttgataccctgaaaaattcttcgatagtctgagaatcctttgtgcctaccgccttgtgtttctttaccacctgaatacccctacggataatttctcgtacttatcgagtatccgctcatccccaattgatcaatatatttcacagaagtcttcgaattgccattcgatcttccgaagatcctcaacaacctattgcttttgaaattcttgcttacaagcattacgattaatcccataaggtcccggtaatccttgttggctcattgtcattatcattttgagtccttgattcatcctccggctcagacacatttgaacatgagctggatatcacaacaaatgcatcggttgtccctaaaacaccaactcggcgcacacgctaatcgaatccgcggcgcatgggggcgggaga

SEQ ID NO: 23792 - DNA, 1235 bp, Triticum aestivum
  Clone ID: PAT_TA_23792
cccccgccgcccgccccgtcgcatattccaagtcgcgtgagcaaggcatatgcgtcggtcgctcaccttctcatggaccagctgaagagccgcggatcattttgacaacgatgtacgactgcctggagttccccacttgctcacttcttcagtgattttagggatgattgatggttgccctggatcgtttgttttgttgacggtttagatggtagacagctagactctgttgctgaaaaatgcggagctaccaaaaccttctcccagatgttcccagagtgaccttcgctgaagatcgaagccaaggattcctgcgtccctcagatgtgcagcacagagctttgagcttatccatggctgttctctgttgtgtgtagcacgtcaggagtgtgcacatgtgctgtagaatctatgcttttggtatcattggcgcttcgcggtgcgacagcaaggcgagggggtccgtgtacgaccccgttctcgggatctgctgccatttctgcaggcagaagaaactctgcggcgaggagggctgcaagcgctgtggggaaggagactttgagcagcaatgcatagggaagacggagtgctcctcttgccattcctcctatgggatcctctgccgtgcttgccttaaagttaggtacggtgaagagatggaagaggtcaggaagaacaagaagtggatgtgccctcactgtgttgaggagaagggtaccaagaaattctggatatgcaacagctccatctgcttgaagaagaggaagatagcaccaaccgggatcgccatattccaagcgcgtgagcaaggatatgcgtcggtcgcacaccttctcatggaccagctgaagagccgcggatcattctgacaacgacgtacgcctgcctggagttccccgcttgctcacttcttcagtgattttagggatgattgatggttgctctggatcttttgtttcgttgacggtttagatggtagacagcttagagtctgttgctgaagaatgtggagctaccaaaaccttctcccagatgttcccagagtgaccttcgctgaagatcgaagcaaggattctgcgtctctcacatgtagcggatggatgagctttgagcttatccttgtatgttctctgttgtttgtaaaacgtcagttgtgtgcacttgtgctgtagaatctatgcttttggaatcattggtgcttcttcagtcaagaaaataaaagtgaatgtcgtcgt

SEQ ID NO: 23793 - DNA, 841 bp, Triticum aestivum
  Clone ID: PAT_TA_23793
cccgcctcacctcacctcatcattccccacctcccccccatctcgccctctcgccagcaaaaaccccggtggcgccaccatcgcggcggagacggccgtggcttcggcctcgggatcggggatctggtcgcggcggcgggatgagatcacgttcgatcgcctccagaagttctggaatgacttgccaccgcaagcacggcgggagcttctaaaattggataagcaaaccctcattgaacaagctcgcaagaatttctactgttcaaggtgcaatgggttgcttctggaaaatttcaagtcactgcagcaagaagtttcagatattgattgtctgagctcaagtggtgaatcaaagattaggcagcaaaatggatctcaggatccatctgttcacccttggggaggtcttgcaacaacaaaggatggcatccttacgcttattgactgctttatgaaagctaactcgctacgggtgctccagaatgtatttgacaatgcacgactaagagaaagggaacgagaaatgctttatcctgatgcatgtggtgggggtggcagaggatggattagccaagggatggctagctatagcagggggtatggaacaagagaaacatgtgctctgcatactgcccacctttcatgcaatacactggtgaatttctggtcagcattatgcgacgaaactagatcttctcttctgcggatgaaggaggatgatttcattgaaagactaatgtttaggtttgatagcaagagattttgccgagattgccgaaggaatgttatccgtgaattcaaggagctgaaggaactgaaacgcattcgaagggaacctccc

SEQ ID NO: 23794 - DNA, 493 bp, Triticum aestivum
  unsure (1)..(493): unsure at all n locations
  Clone ID: PAT_TA_23794
gaattcactagtgatttcgagcggccgcccgggcaggttagtctcgagttttttttttttttttctgggctggacgacatccttgtgggctgtctatgctttttttttttttttttttggctgggtgtgagttgatttgctgggcctcgtagtacttgttgtttgatgctggctaggtgcctaggccagtctctctctctctccttggctcgcagtctcatgcagtttttttttctagtttctcaaaaataaagtatatttgtttttctttataaatcaacggtgtgttgtttttctatgggaaacaccggtgttgttgttttttttttgagagaacactggtgtttggttgtgactgtgtggagagtagctagagcgcacctgtgagtgaatataatttcataaaaacgaaacacacaaataggccaaaaatagaaattaaaatgttccataaaaagggaaaaaatggctaggctgagcctgacgcnaaana

SEQ ID NO: 23795 - DNA, 1166 bp, Triticum aestivum
  Clone ID: PAT_TA_23795
gcccggtgtcccggagagacctaggggctggctgaccgtcgtgggccgacaacccacaccccagcaggatgccgcgattgcgactctcccggtcaggcaccaccagcggctgcccccgccggtgacgccgcctatcccccacccgcttatccagctcagccccaagcgcgctggcaaaacgaaagggcaggaggaggctggcggctcacggcagcccgagcttccgtctgcagcatcctccatcttatccgcaatgctgggatatcgacactgaggggtctgcttgctgcggatgatgccattgtccccgtgtcttcgccgttggcgtctccgttgggggctgcggaagagaccgacaagaagggagtggtagcgaagcgaaagaaagtccaagccatcaagaaggacatcaaggagagacccaagaaggtaaatcaggtagccaagctggttcgaggaatgcgcgtggaagatgcccttttacagttgcaagtgacggttaaaagggctgcgaaaacattgtaccaggtgatccattctgctcgtgcgaacgcagctcacaaccatggactggatgcagataaacttattgtggaagaggcttttgtggggaaaggactttatctcaagagattgtcttaccacgccaaagggaggtgcggtgtcagggagagacctaggtgcaggctgacggtggtggtcagagaagccacagccgaggaggaagccaagattgcgaaactcagggtcatgaactacaagaagctcacccggaaggagaagcagctcatgccgcaccggcttatcgaggtcagcccgaaatgggctcgcaaaaggaaagaggaggaggaggaggctggtgcttcagcgtagtacaagtttccgtttgcagcagggtctgtctttcttggcgggcctggagccagagattagtagctgcatctgcagtcgtctggtctatctgttgagatttactgaagaacagccgtggcgaggcgctcccgtggaagaattcgtgatctcgtttgcctgaccagcctctgtactgtttgtgtcatccatacgaaatctttcaagacatttgctctagttagcaaagaataagttgacctctgatttgttgttccgcatgtctctttttatacatgccatcggtctgttttttg

SEQ ID NO: 23796 - DNA, 619 bp, Triticum aestivum
  unsure (1)..(619): unsure at all n locations
  Clone ID: PAT_TA_23796
gaattcactantgattagcgtggccgcggccgaggtcttgagtgcctttatgtttatcggctaactagtacgggcccagttgtgtagccacatcattccattctgtgtgcgtgtgctcaggtatagcctgccctgcttgctttataataggttgtttgtactacagctactgccattctcaatgttgagcccttgtacgacacattcatatgctgttatggtttccctttaatttttatgcttgaacgtgccccttttttcttgtaaagctcctgattctctgtagttgacatccattcactcacatgttaaagttgtcaacttttgcgtgtttgcagacagatagatgagtacacacacctcattgcgagcataaaagcacagatcaagatggtgtgtgaaggtatccgtgaactcctgcagttagcagcggagtgagcattagggtcccaatgccaagaatgtatgccaagaacgcagctctcccaaatcccaatgtttttgttttagggtcccaaatcccaatgttgatcaggaggcattgtgtaagtataggtgaaagaagtggcaaaagagaatactttgcttgatctagcatcctgcccgggcggccgctcga

SEQ ID NO: 23797 - DNA, 596 bp, Triticum aestivum
  unsure (1)..(596): unsure at all n locations
  Clone ID: PAT_TA_23797
gaattcactaagtgattagcgtggtcgcggccgaggttcgagttttttttttttttttttttttttttttttttttttttttttttttttttttttttttttttttttttaaaaccatcttaacatcttcccgaaataaatatgcatctttccatgtgttcggttcggcggttgtggcatgacaggcatcagtcacaattacatatggttacttggcacaagctaataaataaaaaaactgtccaaattttgtcttgtgatcgaaaccaaatttttatgcaaacagcggcccgacgacggggcatcacagctagcaaaaggaacaagggccctaacgttagctgcttctcaaaaagtttcatagctgagaacccttcctgatctgcaaaaaaaaacctcggaccacgggcgtacttaaatttctaagatctgaacaactcctcgtcctcaacccaagccctcgccaacccccgaggctatgctcacccagaacccacacatgcaatatttaaactgttcnccatgtcctgtggattgggcttctctcaccgcccccgggtccccctggaaggatccatgncgggtnacctttggtt

SEQ ID NO: 23798 - DNA, 440 bp, Triticum aestivum
  Clone ID: PAT_TA_23798
gttatttaaggtttaaaaaacaactgaatttcactcaaaagctgtaacattatcgagacaacacaagcaccaccgacgtctaatcctggcatacaaccaatcccatagtagctttgcagtcagcactgttacaatgcaagttaaatgacaaaaggtctctgcttaagagaacgcgcaatgtttcaagccaatctcatatggatcgacagagctttcacgggcgctgtcacccggtcctcaagatgatgtgcaccccgctctcagtatcaaccacgtcgctcatgtcccccaccttcagagcaatcaccgccttctcgaaaggcttctgcatcttgcccttctcgaatggaccgaggtcgccgccgcgcttggcggagttgcagtcggagttgatgcgggcggcggcgtcgaactggagctccccggcggcgaactggtcg

SEQ ID NO: 23799 - DNA, 916 bp, Triticum aestivum
  unsure (1)..(916): unsure at all n locations
  Clone ID: PAT_TA_23799
tcgagcggccgcccgggcaggtgcggtgcgggtggtggcgatcgggaagaccaagccggtgtcgctgctgcggcagctctacgacgccggccaccgctgcttcggcgagaactacgtccaggagttcgtcaccaaggcgccgcagcttccggaagacatccggtggcatttcgtcgggcacttgcagagcaacaaggtgaaatcgctactagctgctgttccaaatcttgacatggttgagggtgtaggtaatgaaaagattgctaatcatctggatcgtgctgttgttagcttggggagggagcctttgaaagttatggtgcaagtaaacaccagtggagaagaatcaaaatctggtatcgatccttctaaatgtgtggagcttgctaagcatgtgaaactagcttgccccaaacttaatactgtcaggactcatgacaatagggatgaaagattactcctcaacaccggaaaattttaaggcattggcaaattgtaagcttgaagtttgcaaggcccttgggataccgacagaacggtttgaactctccatgggaatgtccggtgactttgagcaagcgatagagctgggcagcacaaatgtgagggttgggtcaacaatattcggaccaagagagtatccaaaccaaaagcagaattgaagaactctgtttcatgtgttcctcaatacaattcttatgtacattgtatgtatgatggcatgtaaatggacatgtaaataactgatgtttataagtgtatagttacacgaaggacacatatttggggtataccctgctggtattgcattattaagaggcattttcttaaaaaaaaacctcggccgcgaccacgctaataattagtgaattctcctgaaagaatattgcanccatttccttccaaaaaaaaaaaa

SEQ ID NO: 23800 - DNA, 621 bp, Triticum aestivum
  unsure (1)..(621): unsure at all n locations
  Clone ID: PAT_TA_23800
agagagtccacttatccgcgcgtccacctctccttctcctctctcccccctccatggccatggcttcctctcttcttcttcaccggagacacatgctgcctgcagcttccctgagctgagctgagattcctcctctggttcctccctgcagctttccctgacccgagcttgctgctacctggactggacgcaggcaggcagggggcgtagaagccatggctatgggggcagtgctctcctccagcagagcagccttcctcgcctctccgctctcctcctcctcctcctcttcaccaggaaagcagcagcagcagcagcatgacaccatgatgatcaagtactcctctacgtcgtcaccacacaccaggtggccggtgtgctcccagctggttgccgggcacacaaacggccggcatgtcgccaggagcactggaaagtcaacaccacaccaattctctgcccaaattcagcagcctcagctcaactctactcccatgaggctctgcnnnactgcaggcctggtgannnnnannctcctgtccnnnnnnnngtgctnnntatnnnnnnacccggtcaccnnnggatgnnnnnaacccaagnnccnnnnnnnnnnnnnnnnnn

SEQ ID NO: 23801 - DNA, 492 bp, Triticum aestivum
  unsure (1)..(492): unsure at all n locations
  Clone ID: PAT_TA_23801
agcgtggtcgcggccgaggtaaacagattcagcctccatcgttacagagcattcaaatttaccgctacatcgttgcatgcgaattattcctcgtgaccaaaacagtggagcattttttatagcagtccttcagaaactctctccgctgaatgagagtctggtggtagaagtgatgaaaggtgagcgcagtacctcgaaagacaaggctttgaaatgttcgaatggtcagggatcagatacggtgccggctgaagaaatttcagttcagcagccaggggttgatgacacccatgttcttgttgagcaacaaaacagagacatggatactgaaatttcaaaagataaaagttctgaggaagctaaggtggttgctggtgaggcgcaaaatgatcaagcgacaaaggagagataaaagaaagaccaagaaccaaaggcaaatggagaaggggtgatcctgtgatanttttcaaaagacgaagcgaacaatcaana

SEQ ID NO: 23802 - DNA, 515 bp, Triticum aestivum
  unsure (1)..(515): unsure at all n locations
  Clone ID: PAT_TA_23802
cccgcccncccattgcggccgggggaaattgattttccccgcccgcccgggcagttttttttttttcgaacataggcacaacattattttgtagtaatttgaaactacgatgttgaagcatatgaatcaaatgaattaccaatggactactcaatgactattgttgccaaagctacaatggaaaccgtatagttgtctatcaacagacagttggctgtttggaagattctccagaaaacaccaaactctacctcccagtatcccaccagccttaccatgtacgctctacatcacctcgctagcagagacgctaggacacctgcaaagtatactactgcgatggctgctaggatcgtgacgaacttgaggaaagagttgagcaaaaacgctgtaagaatgtcgtcgaggtcgccgaaatccgggatgtgctgccccaatcccgcgtaagcgtcgagcagcgcatctggatcgacctcggccgcgaccacgctaatcactagtgaattcggcggcan

SEQ ID NO: 23803 - DNA, 1452 bp, Triticum aestivum
  Clone ID: PAT_TA_23803
ctctagccgccgccgaaggcgtgagcaggatgacgccgagcgtcgacgccggaaagccgcctgaaagatcatatgtgagagccatcttttgcgatctgcaggcttgcatctctgagcccgctagaatttttcattactggacgcggaatattgttggaggacttcttaattgggttaattgggtaccagcaagggaaagtgcaagaggaactggagaagtaggagaaacaatcaaggtaatggaaacaagaacggcagaaaaagaatctccttatgactacaaccagaaacagtctgatgtgtaccatggcatcggcgatggcaacgctggcagcagcgtagatggtgatgatgataagaaggggtgccatgacattcgtgatagtggctttgactatgggccccaagacatggctgatgggtactacagcggcagcgatgatggcatcgataggagttgccacaaccgatcatagaatttcttataatggagacagtaaaaacatacaagtaccaccattctcaataccgtgccgggtcgagctgttcactgtgcgtccccgcttcagcttcacggggacatttgttgtcactgatggtttttctgcctactactggtcctcacaaaaaaaaaaattacagatttatcacattgttgattcacagcataatttggtgctccactcagaaggcggtgcccttacggacaccttctggattaaaatcaaaatcctagaggacaacagcggcgctgatcatgattctggatatttctcattcacagtggacccatatgtttgcaacaatgtcataacccacaccatctcaactaaacagcgccgcaaaatagatttgactttcatggcgttgcacacagctatacaggccaatgtgtacgtcaactttgatttcgtatgtcgtaatgccactaagcctggcaccatctactatgtctatggtgaaatcaccgcacaccaccaactctacgatggtgagagtgtcatgctcttttctcgtggggaagaaaacaaagcagtggttactgatggtggtgaactaccactctcacggaattgtgcagctgttccaatatacttggagcctctcttgatactcaaactgaacctgcatgttccaattaaatgtgatcatgatgatgaggatcataccattgcctttcgagattatattatttttttaccgtgacgagtatgaaaagataatctgcagtgctgacagtgcagaatgccaacatggtaaagttaaagtgcggatttcataccagtagttgcagtgcccagatggatgcaatgtgtactgaagttctatcttatagttatttatgtatggaatgtgtcatctggtatgacacacaccaatgaatattaatgtacgcttccttgtaagacgtgcagttataatttgatctagattactgaatttgtagaaaaa

SEQ ID NO: 23804 - DNA, 758 bp, Triticum aestivum
  Clone ID: PAT_TA_23804
cccacgcgtccgcccacgcgtccgctcagacaagctgtgtgcccagccggtcaccatggccacggagggagccaagcacacgcacatcaggttcaggctccaggtcgacatgcagtgccggtgcatgggctgcatcgacaagatcgacaaggccatggccgccatccgaaccttcacaggggttgaaacgtcggtgggagacgtcgggactggggtcgtggccgtggcggggaaggtggacccagcggagctctgccagtggctcaagaggaagacaaggaaggacgtcaagattgtccgccctcgtcgaccatctgacaatcgtaataagcagaaaagaagcagggacacaccgccttcagctccaccgttaccgcaacacttgtccagggctctaccgacgtcaagagttcactctgaccacaaggatctgcatatgattgagaagaagatcagggacctcgacaaggccagggatacgttgaagatgaggaacctgaagaatgagctgactgctgccaggtgtaagctcaaacagtcaagagaagtgatcagcaatggcaagaaggctctcctagatggtgctctgatccagctccacgcgtacaagaaactagaatcacttagtcggctcactatatgagtgagctgaccacgcttttcgccattattatactctatagcatgagaatggtccgccggtgtaaaacttgttgctgcctagtctgcaaaataaaactttcttgaggtttttatgc

SEQ ID NO: 23805 - DNA, 1698 bp, Triticum aestivum
  Clone ID: PAT_TA_23805
ggtccgctcctcgtcgccggcccttcgcctctcctgccgccgccgcctccttcctagccccctccaaacccccagctcagctaagccatcggatctccccctccatgcccagagccaagtagatagaccccccaccggcgcacgaaccttgaggcaggcagcgcggccggccggccacctgatggcgtccgtggcggagctcaaggagaagcacgcggcggcgacggcctcggtcaactccctgcgagagcggctccgccagcgccggcagacgctcctcgacaccgacgtggagaagtactccaaggcgcaggggcggacggcggtgagcttcaaccccacggatctggtctgctgccgcacgctgcagggccacagcggaaaggtatattctctggattggacccctgagaagaactggatagttagtgcctcacaagatggaagactaattgtatggaatgctttaacgagtcagaaaacacatgccataaagctacactgtccatgggtgatggaatgtgcttttgcacccaatggtcaatccgttgcttgtggcggtcttgatagtgcatgctctatattcaaccttagctcacaagcagacagagatgggaacatgccagtttcaagagtacttactggacacaaaggctatgcttcatcctgtcagtatgtcccagaccaggaaactcgcttgattacaggctcaggtgaccaaacgtgtgtcctgtgggatgttactactggccagaggatatcaatctttggtagtgaatttccatcagggcatacagctgatgtgttaagtctgtccatcaactcgttaaacgcgaatatgtttatctcgggttcatgtgatacaactgtaaggctatgggatctcaggattacaagtcgggcagttcggacatatcatggacatgagggcgacattaacagtgtcaagtttttccctgatggtcagaggttcggtactggttcagatgatggtacatgcagattatttgacatgagaacaggccatcaacttcaagtgtacaatcgggagcctgatagaaatgataatgagctccctattgttacatctgtcgctttttccatatcaggaaggcttctttttgctggatactctaatggtgactgttatgtgtgggacacgcttcttgccgagatggtgcttaatttgggaactctccaaaactctcacgaaggccgtataagctgccttgggctgtcatccgatgggagtgcattgtgtacaggaagctgggacaaaaatttgaagatctgggctttcagtggacaccgcaagatagtctgaagccccagcgcgtgttctccccgtgctgtacgttcctcgtcgcgagttgggggggtggttggccaactcgaaaggttcctgaagatgaagccgtccgttttgtagcatggaatccatgaatctcctgttgtttccaatggaaatcgcagtttgccgagacagagtgtgctgtgcgatgttgttgcgcctggtcaagtcagcgtactgttgtttatagagttgccagaaagcaagcagcgcacatgtgatattttctgccttgttgtgtacaactatatatttttactgtaaaaaatgaaccgaattgttagaaccaagaacaattgtcctttctggataaatgaaatgcgactcaaaaaaaaaaaaaaaaaaaa

SEQ ID NO: 23806 - DNA, 1046 bp, Triticum aestivum
  unsure (1)..(1046): unsure at all n locations
  Clone ID: PAT_TA_23806
gcgaaacccaaaccccagactctgcgccagagagaagccagtagcctcctccgccgccacccatgtcaggaggagggatcgcgcggggccgcctcgcggaggagcgctccgaaacccaaaccccagactcagcgacagagagcagccagcagcctcctccgccgccgcccatgtcaggaggagggatcgcgcggggccgcctcgcggaggagcgcaaggcctggcgcaagaaccacccccatggattcgtcgcgaagccggagacggtggccgacgggtcggtgaatctcatgatctggaactgcaccatccccggaaagcaggggactgattgggaaagtggatactacccacttactctccatttcagtgaggactaccctagcaaacctcccaagtgcaagttcccgcagggttttttccacccaaatgtctatccttcagggacggtctgcctctcgattcttaatgaggatagtggttggagacctgccatcactgttaagcagattctagttggaatacaggatttgcttgatcaacctaatccagctgatcctgcccagactgatggttatcacctctttatccaggatccagcagagtacaagagacgcattcggctgcaggccaagcagtaccctgctctggtttgaggatccatgtagcagtctaaaatcataaattaccgcacctgaaaatatgaagtttgactaaatataaccgaaagcggggtattgtggagagctttccattgtgaccgtggacatttgtgacgtgtggtctggtgttgaccaaacaaaaatcaggtccttctgcttgaatgatggatgtgtggatacttttgaacttgaaacctcgactgtgtcttcgcgaatttttttgtgtgattgtttcggtgatctcttcaaaaataatttgatgtgaacacttccttttaaaggaagatgtaaaagaaggggtaaggcaacccagttgaaccctaaatacagtaggactttaaaaaggggacgcatncttcaacaaagttttattgttctgtaagc

SEQ ID NO: 23807 - DNA, 444 bp, Triticum aestivum
  Clone ID: PAT_TA_23807
cccacgcgtccgggaggagatggaggcgtaggccggccggcactccggcagacaccgtcaccgtcatcgcccagagcacggtgatgcatgaactcacccaccgattaatatttgcccgattaatcaccgaccgatacatacatgcatggtaataattggtttgtcctcatgcatggatggatggacgtggctacttatttaccataattattaatccttgcctgcgtatggctggctggattatttattttctaccgtaatcgtgccgtgtttgttttagcaatcgtctgacagctgctatatgcctccgggtttaacatagaggagggggatgatatgtgtcgtgttgtggtgtggtgagatcgagtcgagtcgagttgcctgcctgctagctgttgttgtaataagtgtttttgacactctatatgactcaagtgatccatc

SEQ ID NO: 23808 - DNA, 1685 bp, Triticum aestivum
  Clone ID: PAT_TA_23808
gccggcgcgaggcgctcactctcacagccccccagctagctagtgccctctgcatctcctgcgcggagcaacttagatcagcacagagcgagggtcgattcgcagctgatcggcagatcatgggcgtggagggctgccgcaacaaggaggtggtggggggagacggccctggatgaggaagctcgccggcctcgccgcggccaccggcgagctgccctcggtccgtcgctcgccggcggtgaacgcgctccccacccgaggtcgtgccgcctcgcagccagcgccaagcaccggggacgtcgaggccctgggccccgaggcataggagccccgcgcccgcctcatccccctctgcgccgacgccaacgggccaccttgggggtgcgccctcctgaccgcgatcgacggcccacggacaccccttctccgatccactctcacccctcttccccctgaacttcaacaacgtacatcaatgctccacgccaagctggcagcacgggcctcctcgcccgccagcctcctgcggcccggccccgggcctgcctcgcagtcctcgggtgctggccggctgccggctcagggtccctcgcgacgcccagtgcgccacctccgccacgcctacctcgagatctactaggtgtgtgcgcaacgccaccggcgccaaggcacgcatgaccgccacgacgccgacgccggcgcgcgcatggcgttccgcacggcggacgtggccgacgtgacgaccgagctggcgggctacgacgtggtgttcctggcggcgctggtgggcatggcggccgaggagaaggcgcgcctggtggagcacctcgggaggcacatggcccccggcgcggcgctcgtggtgcggagcgcgcacggccgcgcgcgggttcctgtacccggttggtggagccccgagggagatccgggcgagggcgggttgcgaggtgctgcaccgtagcaccacccgggaggacgagggtgatcaagctccctccgccgcgcgcgtgccggtcggacaacggcggcatgccggcccagtgcgcggtggcgggggagcagaccgtgcctcggctgcgcctgcgagcttggggacgagggcgcaccagaagatgaaggagatggccatggaggagatggaggcgtaggcatcggcatcgccagcagacatcggcatcgcccagagcacggtgatgaattcaccgaccgattaatatttgcccgattaatccgcgaccgatacatacatgcatggtaataattcgcttgtcctcatgcatggatggatgtggctacctatttaccaccataattattaatccttgcctgcgtatggctggctggattatttattttctaccgtaattgtgccgtgtttgttttagcaatcgtctgacagctgctgcatgcctccgggtttaacatagaggaggaggatgatatgtgtcgtgttgtgttgtggtgagatcgagtcgagtcgagttgcctgcctgctgttgtaataagtgattttgacactctatatgactgaagtgatcatcaccaatgcaagaagtgcaacacctatgctttcttaattgattcccttggctcgaagtgtaacaccgtacctaactacctatgcttgcttaattgattcccttgtttcaacgccttgtcttaactcgagactagttctctctctc

SEQ ID NO: 23809 - DNA, 553 bp, Triticum aestivum
  unsure (1)..(553): unsure at all n locations
  Clone ID: PAT_TA_23809
gaattcactaagtgattagcgtggtcgcggcccgaggtcaattatcatgggggatatgaactttagaaccatccccaatccgccaaatcacaccctccctgagaagatctcggccatgtagcacactcctgtaggtgtaagacgcatttgatgggaaggtggccgacatgattgtctcttctttaaaatagcgtgctttaagaaccctagcacaaagagaggctgggtacttgcagaattctccaggcttgctttgctaacaaagcttgattgaacgcctcggggatcgcgggaacccaagaccaccaaacactcttttgctgcaacacaanttttttgccaaagaagaacccagtgcanctttccctttcacccttcgccgctcccccccccaacttcgaggtgtccgaggtcaggtgccggcccggggtctcccggggccgttttcctctctggggcctggtaagcaacgcctgaggcccaaagtgaagctcaaaccccccaagcccccttgggcaaccaaaaaacccncctanccgcntttggngnangc

SEQ ID NO: 23810 - DNA, 258 bp, Triticum aestivum
  Clone ID: PAT_TA_23810
gaattcactagtgattagcgtggtcgcggccgaggtctcgagttttttttcttaggtgctcattttgtctgggccttcagtttaatgtttttattcagcggccgtggttattggcaagaactcattgaatctatcgtttgggctcataacaaattaaaagttgctcctgctactcagcctagagccttgagcattatacaaggacgcgctgtaggagtaacccattaccttctgggtggaattgccacctgcccggcc

SEQ ID NO: 23811 - DNA, 1558 bp, Triticum aestivum
  Clone ID: PAT_TA_23811
aacgcggcctagggcaaccccttggggaagcccagcacgtgcccgccccacggcaacctgctccggcggggcccctaagcggagcacccccaagttcaggccttatgcaaagcctgctgcggcaggcgcgagaacccggtgccccgcgaggttgtcattttcttattcacttgcgacgacaaccccattcaagtataccaccgtgatgaaatatcccacctgaaacttcataaccgaggacggaataggtaggatattctcaaatgtgaaccccaagagaatgaataacaagacgatgatacaaaagatggcgtattacaaaactaaatcgaacaaggtcaacggtgagagtcatgcccaggcgaacgctcacaatggacctaagtagttgtgcggtgacgccaatgtataggagctgcaaccacaggtaccagttgcctcggtagtatgctgacaaccgtgtcaacaaccttttcaaaacggggagacaacgagccccacgttgccccttttagccttgaacgcaatgacattctccaaaattacccaacccccgtctgcacgaacgtctgagcatttagttgttattccttaggtgagtggggctattccccttggtgcacctgatcatagcacgtttggtcccactatggaactagcagttactacgtatgcaaggcaagttaaaattaattctctctggacatggatttgtttattagcatagttatttaaggaaaatcctaggaattgcacatagacatggctattttactaaaccatacctattgatgagataattgatgaggatctgacagtaattagtggaacaaaaaaatttatgtttgcaagcgttgattccggttgcaatggttgcatcttcactctaatgcacaaaagagatggagaccctggtccagttgagattgtacaaaacatgatgtcttcggctgcttcaactcgtaaacatatgtccaggtttattctgagggtgttgcctgctgaggtggtatgttatgcttcagaagaggaaataacaagagccattgctccacttgttgaaaagtacttccccaaagaatctccttcgggacataagtttgctgtgttatacgaagcaaggtcaaacacaggaatcgatagaatgaaaattataaatgcagttgcaaaatctatacctcaacctcacaaagttgacctcagcaaccccgacaagactattattgtccagattgccaagactatatgcatgattggagtggtggagagatacaaagagctttcgaagttcaacctaaggcagctgacctcaccaccggagaagtagtttctgcgtgagaaattcttcctcctggttgagttttaatcatatgcggtaactagctactgtgaaagtcattgccaaatgattcagatgtattatgtcgttaaaaagcatggtcattgacgtgtggatgcatcctgaattgcttgcttaatgccgtatggtgcaattttggaacctgttggaatttctactacaagcatcgttgggataaaaggttaattagattcatgc

SEQ ID NO: 23812 - DNA, 500 bp, Triticum aestivum
  unsure (1)..(500): unsure at all n locations
  Clone ID: PAT_TA_23812
gaattcactantgattagcgtggtcccggccgaggtggggagctgccattactattgccctgcagcagctaaaatacgtgttgggcatcgcaaattttacaaggaaaaccgacatagtttctgttatggaatctgtctggagatcagttcatcatgggtggaactggcagacaattgtgattggtgtatctttcctgggtttccttctgtttgcgaagtatatcggaaagaagaataggaagcttttctgggtgccaagctattgctcctataatatcagtgattctagcaacattttttgtatacattactccgtgccgacaaagcaaggtgttcaaatagtaaagcacattgaacaggggaatcaacccatcatcagtacacaagatttatttcaccggtccatttgtccgcaaaaagggttcaagatccgtgttgttttgccgcaataatttgggttgacaagaagctgtaactatttgggaaggcgattgcngcta

SEQ ID NO: 23813 - DNA, 1127 bp, Triticum aestivum
  Clone ID: PAT_TA_23813
agaatctaaagctttttttagaatcattaaaatgagattatttagtgacatgtccatgatttatacatgtaccattgcccgtgacaacgcacgggcattttactagttacaagttgtattctaacacagcgaaagaaaagggccatgcccgagacggaggttacgcacgcacagaggcgagggctattccaaaaactcaatggccctggatcgcagcggacttccacgccaccggccaggccgccgtccctgcaacactcttgacagaaaagaaatccaaagaagagcgacatcaactcaggaatcttcaattccatcttccagacatcccgttctatcctcccatggagccattagcctgggatcttcctagacgacgtcggctcttcgccagaccacaacagccgacggcgcttggtttaggcttgcgacggcgctgccacacatcgagtcgcatcgcgacaatggcatcagcttcctctggccttggccccgcgctggaccgggacaacggaaccaccgttttcgcagccgctccacgacgcggtcgctgcccgcgcggaggcacccgaggtcgtggctcctagaccgtcctccgcggtgaagccccctggcgcacgatgcggccactgcatctaactcggagcgacttcctccatggcctcgcctgccgagggaattgtcccggcttccggccggcgacacctggagcgtgcgcgctgcggtggctcgtccctccggagtcgatgacttgctccatgcgcgtcagcaaagcaaggcaaggcgaggcgacagtctcgcggctccttggggcgcgcacgcagtggcgtccttcggcctcgccgcccgcaaggatggcccacaaccgtgacgcggtatggaagaccgaggcgacgacgcggcccttggctcacatccgcgcaggcggcgcccgaggcaacggccctcggctgcccccccggccccggagcggtggcgccctccgcgcggctccccacagcagagatgacggcgcgccgggtttttcccgctcctcgccgacgagacggcgcgccgggtttttcccgctcctcgccgacgagacggtcgccggcagcgcgggtcgggggagcggtcggacgcgtggg

SEQ ID NO: 23814 - DNA, 497 bp, Triticum aestivum
  unsure (1)..(497): unsure at all n locations
  Clone ID: PAT_TA_23814
gaattcactaagtgattagcgtggtcgcggccgaggtcacggattgactctttgggttcaccgtcacaatacgcttctttcagtgaatttacgcttttagttttttccgttagttttgatcgacaatccgtccaattgctgcaaggcggtacaaaaagctttgtccatccaagtccacgtccacattctctaattgggcctacacgcatgtttcggcttgcattcacgcttttgtatctgtatttgtaccttacctgattttcacacatgtactcggagtaatcccacctcgattaattacatgaaagtctaccagttcatatacctaggaaaatttcatatcaacaacgggcctcttgaatcaacaaacacaagaatgagaacgaagggaaattgtacaacaaaacaagtagtctgggcgtgaaactgttcaatcccggcgctcgccgggggtgaggaaacgggggcacagcgcgcacaccccgcccggcnnaang

SEQ ID NO: 23815 - DNA, 570 bp, Triticum aestivum
  Clone ID: PAT_TA_23815
agcaaacacatcaagcactagataaattaccacaatattgtatatgtagttatgtacagatctggcaagaggatacaaaacccatccttattggcaccacaagcacatgatgggctccagggggcaacactgctagcagatactagtatgcagtacacaaaccacacagggagtgttgggggatcatgcccaaatgtcaagtctgaccaccaatatacaatcatatatcattggttcatgatacgagatacaacgccacggcttctaagccgcaaccgcctctcgcggtttgctgctgccttctggtggtgccaagctgtcgtagtactcgacgaggaccttccagccacccgggcacataaaaccatctggtgggctctcacggttcttggcaaggctacgcatctttgtgccagagatgaacaggaagtcctctttcctcgatgggtcgaagaaattcatcttgttatgctttgtgtcgtatgcagccaccttgaaaggaaggatattgagcctctcaagcccaggagccatgctcaggacgcttgggccgtgatcagcatcataaag

SEQ ID NO: 23816 - DNA, 1740 bp, Triticum aestivum
  Clone ID: PAT_TA_23816
agcaagcacatcaagcactagataaattaccaccacactattatatgtcgttatgtacaaatccgaagagaatacaaaacccatccttattggcaccacaagcacatgatgggctccagggggcaacactgctagcagatatactagtaagcagtacaaaccacacggggagtgctggggatcatgcccaaatgtcaagtcttaccaccaatacacaatcatatatcatcggtttgatgatacgtgatacaacgacattacttatccgaagcgtctttcagcttctacgctgcaactgcctctcgcggtttgctgctgccttctggcggtgccaagctgtcgtcgtactcgacgaggaccttccagccaccagggcacataaaaccatctggtgggctctcacggttcttggcaaggctacgcatctttgtgccagagatgaacaggaagtcttctttcctcgatggatcaaagaaattcatcttgttatgctttgtgtcgtacgcagcaaccttgaaaggaaggatattgagcctctcaagcccaggagccatactcagtacttttttcccgtgatcagcatcataaaggtccctcttttcggtcgggtggcccataccagcaggatcccttccgacaatatagaagtttgcaccagcattaatacgagccttggcatgccactggacctcagttggcccagcatagtgcattggagaggggaagattgcaaccacagttgattctgggtttaggacaccttcctcaagaaccttctcatgctgcttcattctcacactaagaggcacatcatctgcttttgtgaatcctcccagtggatggagaagaagaacagggtttttgtagcccatctcaagaaggcgcctccgtgtatcagtcatgagcaacgcatgcccattgtgcacagggttacgcagttgaaaagcaaataccgcatctgcattgcgcctggcaaattcttcacgcagctgtgctggagacaaacgatactgatccagaccatcattatacttgattggttctataacctccaggtctccaccaatcaaccaatcaccagcatttgtaatcgcctcctctacgtacggcagtccacgtgcagttgttccccaagtccgtgcaattctttcttccttgttatgcttgtagatctcaatatcgctgagcacggcgacggggcggtcgtgggcgtcgacgagcgcgacggtggtggcgccgtcggcctggatggcgcggcgctgggcgtcgtcgagggcgaggacgatgggcacggacatgttgacgaggctgccatcggcgccgcggacggcgttgaaatgaagtgcttggaggaactcggtctcgcgcatgaagccgcgcagcgggctggcccagccctcgctgagcacgtgcagccactcggtgtccacgcggcccaggcgcaggcggtgcggcagcgccgccgcctcccggcgcagcgccgcccgccggccgccctcctcgggcgccaccagctccaccagcctgcccccgtccggctcgatcaggccgccggcccggcaccgcaccccgcgcgccgccgccgctgccgcccctcaccgcgacccccacccgcgccggctgtccctgaccatggcccctgctcggccgcgccagctgcgggaatctcactgcgaaggcggcctgcgtcgccatggctgctgcttcttgccgacgacgggacggtcggcggagcatggg

SEQ ID NO: 23817 - DNA, 700 bp, Triticum aestivum
  Clone ID: PAT_TA_23817
actccaattgtagctgctcgccgaattatttatttatcattagtacaattctctaggtcttattgatcataagaaattattacatggacacaaaggaaattatgatattgacccaaccaaatacgaagaccatgacttaacgataaagagaacctagcgagattgtgagcttctacccacgatgccttaatcccacccgagcacaactgcagagttaacccaacatcataaacattattacacatctgcaagcctcaaagttccatgggaacattgtacggtgttgctactaggtgaagctggttctttcttctcagtgttgtgccgacgatcatgtccatgtcaagttcatccggacgcattccgcccggtaggctccaatcgaagaagtacagaagccgagccaggatgagctccaacgtggccaacccaaaggtattgccagagcacattctttgcccgctcccgccgggcaagtactcaaactgtgtgccgttataatccacgataatgtcttcgaacctctccggcttgaactcgtctgcgtcatgccaatactcggggttcctcgctatcgcccatgcattgaccatgaccctggagccctctgtgatctcaaacccactaacatcgcaagtcttgctgcagacacgggggagcaagagcggtgcggccgggtacctcggccgcgaccacgcta

SEQ ID NO: 23818 - DNA, 1368 bp, Triticum aestivum
  Clone ID: PAT_TA_23818
tgttttcttttctggcaaatgttgctaccggaaccaagtatttgcttttaggcagcatttgtgttttgtttcctcgccgcaactcctttaacgtaagaacacgccaagatgcctaccaatctatgtgcaccccctccacagccgatcaacaacatggagttaaatggattcgacatgtccaaactttcctacccattccaaattcaggaccatcggtagtcgcatccgcggcacgcgcagcttggccaccacatcgacggccaacagcaccaaccagccttcgccgccgcgccagtttccgccgccgatgcctccgaatcctccaacgcggccggaagactgcgcgggccggcgacgccatcggtggtggcgaacctgacgggcttcttgttcatgcttgtgctgcaccccgcgcagtcatccctcacgcacaaactccggctggagtttcctgtcgacatccctgggacggccggcagcctcgcgacggatgagaggcggtggaacaccccagcggagtcgtagtagaggtcgccaacaaggtaaagcgggccgtccccgccggagttttccagctggatgctgaacagctggtcgttcgaggtggcgctccattgggcggggcacgtggattgcgtgcggaacatcgatgaagggagcctcttcgggtcgtacccagcgggctgcccctgcgccatcatcgtctggactgccggcggcagcgttgccggcatgaactcgtcgggagaggaagaatagtcgtggtccgccgccgcctcgacgtggtgcaagctctcgtaggaggatgtggaggacaaggatgagtgccggtcaaggtcgagtgcgggaatgctctcgcacgacgagctgctggatagaggtggggacgacgacgaagcggacgacgaccgcagcgattcggccggcgtccagaaggagtcggagtgggaaagcttgtggtcgtgagtggtctcgacgctgccgccgctgcaggagtatgagggctgcctcctcggtgccggtgccggtgcgcgcgcagaaccgttgtcctcgtccatgaccgccatggctgcgttacgcgaggtcgtgatcgtgactcgtgatgattaatcggttcgtcgagtccgttctggatcaacgatggagaaggcggcgtcacgacgccgcagatctgctgtgaagagctaaatgggcacatatgggattggtcggaactcggcggcgagaggccggcaaggaaaatccaagaaatggagctccgacaagagacaacaatagccggcctcgcttttatatgcttgggagttgggatcgatgaacggggaagaggacagaccgtttattgccagggaaatttcctcgtgccga

SEQ ID NO: 23819 - DNA, 549 bp, Triticum aestivum
  unsure (1)..(549): unsure at all n locations
  Clone ID: PAT_TA_23819
caaagctatgcatccaaacgcggtgggggaagctcccccaanatgggccgancctgcaaggcggggccggcgagattcccctaatggattaacgtgggccgcggccgaggtcaggtattgtcgacccaaatgtgttgcttgttatatgcttcaggactttgtacgaccaagacggtataagacaacaagtcacttttgttttctcgttactcctgggaaaaaaatccgcaactattgtttattgagaaccaactaacattttttggatagacataaaaaggtttgtgaaataaaaagtttgaatttggaaagttcatgaacgaaaaactaatcatcaatttaaaaaaatgacatttctgccgatttgaaagaaagattgcgcattcaaaaaccaaggtgaatttcaaaaaatgttcacaaatgatgaaaatgttttctgatctaaaaaagctcacacgtttgaaaaaggttaccaatttgatttcttttgggaaatttgcacgtttgaaaaactatcacggggggtgaaaactccccccccccaaggaa

SEQ ID NO: 23820 - DNA, 2061 bp, Triticum aestivum
  Clone ID: PAT_TA_23820
tatcagagtgccgtagtctattccgtgccaaccctacaaatgagcaagaagcatcactagaaacaactattacacagctcaccaccaaatgtacagccgtacggatacatctctctcccccttctaaggtgtgcttctagtgcacttgcgcggtcctaaatgccggtgacggcggcgccatcgctccaagagagcgccgcggcgagggttggcccctcattggcgactttgggacggtattggaggtcctccggatgtcaacctgcggcgacattaaattgcttttagagtcttggagctgctccagctcttctaagacctctgagatctgcggccgcatcttggcgtcgttgcagatgcattgcaaggcgaggttcgcgacggcatgtgcgcctttcttaggatactggcctcccagcttcgtgtccatgacacggtacagcctgcgcttgtcacgcaggtgcggtttggcccagtccactaggttctgctctatgcctggctttgacttgtccagggctcgtctcccggtcagcaactcaagcaacaccaccccgaagctgtagacgtctgccttagcagagaggcgacctgttgcgatatactctggagctgcatatccatgggtgcccatcacttgtgtggaaacatgagttttatccccagttggaccagctttcgctaatccaaaatctgaaagcttggcgttgaattccgagtcaagaagaatgtttgatgccttgaaatcacgatatataacttggttttcagcatgatgtaaaaatgacaaacccttagcagccccgatagcaaccttaagccttattccccatgacaaaggatcagcacctcttctgaacagatgattctccaaacttcccttgggcatgaactcatacaccagaagtctgttatcaccatctgagcaataaccaatgagcttaacaagattggcatggtgaagttggccaaggtagttaacctccgtcagccattccttgtgcccttggaaaccttctggtttaagcttcttgacagcaacaaccataccgcttcccggtttcgaaggagcaagagtgtgttcatcaatccaacctttgaaaacatgcccaaaccctccttccccaagaagactgtccgggcggaagttcttggtcgcatttttaagatcattgaacaagaaagccttcaagttcgacgatgacaagatttcgccttctgtccgaggcggctcgctgcgatctcttatagatggcagagtaaacgttgaacgagttgagttggtcttgctcgcagaagtagcagatgacatgcttgttttgctggtcactttcgatggataggcggcactagtgttcatgctgtgatccacccgggccgtggacttcatgcagttccccatctcttcctctacttcccagctgacaggaagaatgagcttcctttcctgaagatccacaggcgaactctgctcctctttcctccgccccgggtaagtcagcaaagctagagagagatggcgggcaacgcgagggatcaggaggagcagccgctgaggataactgagctgagcagccaaccctagagtcccagccggtttctggcgaggcttttgggtccagctgatctccgccgccacttgaagggggggatgagactggagaaaaatccgctgaggccgttggccggcagccgcaacgccaggagagaaacaagcgagaagcttcaaaaagtcaatcaaatcccctcctcctcctccgggctgaccgaatgggggggagtcagtcgggtcaactggaggcgaggccggccagccaagccgccacgccgcctccaagaaccgcacgggggcagggcaggggagggaggcggacgcggccgcgcgggaggaagatgctctctcgctcgagctggggctgcggcggagtgggaggaggagctgctgaggaggcgcagcggaggtagcagcaggtcgctgccggcagccaccgaccggctgggctcaggtgggaacggacctccggccgagtgcggcgggtggtgggatccctcgtgccgaat

SEQ ID NO: 23821 - DNA, 682 bp, Triticum aestivum
  unsure (1)..(682): unsure at all n locations
  Clone ID: PAT_TA_23821
ttccatccaagcctagctagctagacatggagatggacccaccacccaaaatgcttgaatcccttagtgattagcgtggtcgcggccgaggtgccacctccatcgcacttgcatcggatgcagcagtgctcgaaggacaagcaagagcactcttcatctggaaagacagcctcgactaccaaagccagcaagccctgcactcctggggaaacacgtcgacaccttgcaactggcgcggcatcaattgctatatcggtgtgcagcaacaccaacattggccggcgatcagcggcatctctctacggggtatgcggctgagcggagctctggagtccctcaacttctcaagccttgaggaccttgggacgcctcgacctctcaaacaacctcctcactgggaagcattcctcctagtatcgaggtccttggcgagctccaatgctctccttctgcaaggccaaccagataagagggtcaatcccactaggtctaggaaatctcacaaaatgcattccttatgctcacgaaaagaatctccgtgaatacaagccagcaggaacatgatacctgtacccaatgtaacatcattggtggcaatcctgtaatagcaataaccttatgattaattgcaatatactttggaaatcaacacaagngttgcganccaanttcctnaaaaatt

SEQ ID NO: 23822 - DNA, 1306 bp, Triticum aestivum
  Clone ID: PAT_TA_23822
aatcagcaaactaaaccacacagaaaattatttattatcttcttatcaagaaatacaactttttttgagttacaatagtatacaaccatttatgtgtttacagaaaattctgagcagacctccctagatacaaacatatcaaaagtcaacactattcagaagcaattaagtattcgtgtgtacaattggctatagccaggacaaaacctcgcgtttgaacaaatctatgttgcccgattcatgcctcttctgattggcgcatgagttcaagtaagctagaagctttcctttttgcgcggtctgtgccggtttctgacagctccttgagtgcatcttcccctccagctgcctttgcagccatggtttgttcagcatcagcagaacagagagaccaaagaatggctgccgcattctccctgttgcgaggagagccagttttgatcacctcgactagtggaggcattggctctgattgtgtaattacagacttgccttcttgattaccggcaagaatcgacaaaagagtgagcgcctcgtcaatcattcccccagtgggatccaccaagaagttcatcagatgggtgatgattccagctttcaccgcccggaccttattgccctgatatatgcacaggttgaaaattgccgttgccgcatctttcttgcctcttgggctcccgtcgcacagaagattgatgagcggaggtatcgcaccagcagctccaatagttactttgttttcatccacaactgacaggctaaacagcgtggctgctgcgttctctctggcttccatactcccagttttcagcacttccactatcttagggatggcattggagtccacgatgcttgccttgttgttctcatggatggagaggttaaggagtgccgtgacggcgtgttcctgcgtccttggatcggaagaggagagcagattgaccagcaatgggatggcccctgcttcagcgatgcatatccggttgttgacatttctcttggcaagcaaccggatctcccccgcagctgcccgttgctcgtcctggttcccgccccgcagcctattcatcagcgagaccagaccagcattgtcatagtcggaacttttcaccgctttcttgtcatgggagttggccttgttcttgggaagctcaatgccattggcttcgcaccactgcgctatcaggcttttgaggacaaagtttggtgtgagggaagtatgcgttagggccagctgcatcttggggcaggtcttgtgcccagaatcaagccacttctggatgcaggaccgctcgtacgtctgacc

SEQ ID NO: 23823 - DNA, 1175 bp, Triticum aestivum
  Clone ID: PAT_TA_23823
gcttggattggtaaccgtcgcgacagattcaattgtccagcagacgatctatgtaccccttttttcagatccataagtcgtaaacccaaccgaagtcctcgaaggcagtcgtacatcgttaagatgtggctacatttagtcgaagagaccgccgaagccctcatcatcctcctcctcctcagactcgtccttcttggcctcctcagcagcgggagcatcaccgccggaagcggcagcagcgggagcagcagaggcgtaagcatcggggttggcgatgcggtccttgagctgctcaatctcgggccagctgacctcggtgacaacggcaacagcaagaaccttcttgtagctgttgacgagggagtggaggacggaaggcagggtagggaagttcagagccagagagatggtggcaatggtggcaatggcctgagacagagtcttgaggagctgctcctcaccgacgtcgaggacgctgggagggaaggtctggccctggtcgtagacctgagagatacccataccgtaggtgaagggagagatgttgagcatgttgaggagggtggcctcggagggaccgaccttggagccggcctcaacgagcttgagatcagtggtgatttcaatggtaccacgggcaatcttggtggggacaccgagagcctggaagaaagaggtctttccgggctccattccggtgtttccagcaggaacccagacgtcggcaggggcgagagcaccggcacgagcgggagcagcgaccttgttggcgaggataacatcgcgaacctccttgaggtcctcgttggtgaaaacgaaaccgacgttacccttgacgtggggaaggagacgctcgtactcgggggagtcagcgacgaaggtcttcaaggctcggcgaaccatggtgttcttgcccatgaggacaacacccttgtttcggagagcatgtcggatctcgtgcatctgctgagagctgacattgtcgatctcgacgatgaagatggaggtgtacttctcgagcaagcccttgagcttgtcgaagtaaagcgacttgttagacttggcccccatatcttcttattggactgaaggcaggttgtttaaggccaaggggtatcgttatggaatttggggttgatgaagatgttgatgcccgccgccgccggcgccgcaca

SEQ ID NO: 23824 - DNA, 561 bp, Triticum aestivum
  unsure (1)..(561): unsure at all n locations
  Clone ID: PAT_TA_23824
gaattcactaagtgattagcgtggtcgcggccgaggttatcatgatataaggaaataaaataataacattattattgcctctagggcatatttccttcaaaaacatggtgctactttgatgcacaagtgtggtaaaggatactagtaatgccctttctctctatgtttttttctttttctttttttttctctcattgtccggagtctcatccctacttgtgggggaatcatagtctccatcatcctttccttagggcactactctaaaaataaataatgatcatcatcatacttctatttaattataactcaaaagaaataaaaattataactcgatacctatgacaaaatatgactatgtaaatgcctccagccatgtaccaaggatgtgcaatgatctaacgtaacactatgtcaagctatatgatcatggcaaagcaatatgacaatgaatgctcaagtcatcaaacgggaaaccgggggaagttgcatgggaaatatatccccgggatgggcaagggaaaggcataaataaagtaagtangggggtgntttnaggaa

SEQ ID NO: 23825 - DNA, 1055 bp, Triticum aestivum
  Clone ID: PAT_TA_23825
ccagaatcgcctgatgtgaattcatgtttcagccaatttacaaataatagtttacggagtacaccctatcattctgttttcttctttattcaagcaccaaaagcagctaaccacaatccttgcaacaaaaaacccagctaaacacaaacgcgcacagcaattttaaaaaaacggaggcatccgtttgaaagggagaaacagagacaccacgctaagcaatgccgccgttgacccgaatgacctggccgttcacccactcggccgcgtccgtgcagaggaacccgaccgccggcgcgatgtcgcccacctccccaagccgccccatcgggtgcccggccctgaacctctccaccgcctcctggctcttcccgtcgaagaagagctccgtcgccacgggccccggcgccacgcagttcaccgtcacccgcgccgacccgagctccttcgcggccacccgcaccatcgcttccacggccgccttggacgccgcgtacgccgcgtagccagggagcagcgtcgccgccagcgtcgaggacacggccacgatccggcccccgccgccgcgccgcagccggtttgccgcctcgcggaggcacagaaacgcgccccgggtgttcaccgcgaacacgttgtcgaagtccgccgtggaggtgttggcgagcgacgggtaggtcccgatgcccaggcccgcgcaggccaccaggatgtgcgccgcgccgccgaaggcggactccgccgcgtcaaagagggaccggacgcccgcctcgtcggaaacgtcggctttgaccgccacggcgcgcgggagctcagcggccagcgcgtccgcctgctgagagctggaggcgtacccgaggaccaggctggccccgagggacgacaggtgggtcgcgatgccgcggccgatgccgcgcgacgcgccggtgacgatggccacgcggccggccagtggcagcgtcgctgccggcgccgctggggatgtgatcgccgaggtggccatgagcttgtttgcgagattgcgagtgtgcgacgggctttgcgactgactttgcgagatt

SEQ ID NO: 23826 - DNA, 220 bp, Triticum aestivum
  Clone ID: PAT_TA_23826
ggagcattagattttagccagcaataccatggacattcaacaggcagcaagcagtacacctgcctggccccctatctgtatatatcactatttctgcctgctgcctctctcttctcacaggcaatgcatatacggtactaaatttttctatgtgtggtggagagatgtgcatgtgcatgatgagaaaactatctcaccaaccactagatgaatgcacact

SEQ ID NO: 23827 - DNA, 1695 bp, Triticum aestivum
  Clone ID: PAT_TA_23827
gccacacagtcgcgcgggccctttatttttagcttggtatgcaataaattttgattgttgattataccctgtcaccgaaatgtaacacagttgcgccagcactgtatgcacagatgtctctctctattcatttatctctctcttttctcatctttcctatctcataaatgtccgccactgtcttttacagtttactgtgaaaagaaaagggaaaaagggaatcgtttcttgtgttggtgtcaggctgcttggtgtgtggccgtcgtcttgtttctaccgagcaggagattgtgtaatgtcacccagcatgttgagtgcagggcaagggtttgtcgatcaggtatcatgtggccagctccaatattccatgtagaatttcatggttcttgtacgacttgaggaaaggcctgggggccggtttgctttaccttccccccccttgcagtagagcggctttctgggcgaccctgtgaaattcttcagcccttcccacttgagcttctggacccagtccagtgttcccttggttgagcagatgagatcgagctgtccgctgtagatggtcacctccacgccaagtttcaggagttcgtcaacctcgttgattcttggcttcatgaagtcgcctgccagggcttcgaacacgtcgcctgactgctctccccaggagaagttgttggggatgatgcccagcttggccttgacctcggcgttcatgaggccgtccaggccgccttcccgcgtcgccttggagctcaggtacctcgtgtagcccaccttcctcacagccgcccccgcagtcgccagcaccgcagcgtcctccgacgactcgtccttgaggatgttgtagaagttcacggagttgctctgctcgaggacggccgactcgaggtcctcccacgacttctccgccgccgcgtactgcttcgccttgagctgcgcgttgatcttattcgccaggctgtcgcattgctgcagccccttctcgtcgatacgggacacttggtacagcaacgggccccatgacaacacggagtcctctggtgaaatccagctatccccgagggccacacctccaagcttggccttgaggtgtccatgtcggatggccttgagcgcggtgagcgcggtggtgacggcgaacttgccgccgtacgactcggccacgatgtagagcgggctcccctgcagccgcttgttgtgccggtagagcttgatgagtagcgccgtcaggtcgcgcgccgcctggccgtccgtgcgcgccatcaggctcttgttgccaccctccacgaagctgaaccccgtgcccacggggttgtcgacgaagaggaggtcggccttgttgagccaggtggtggcgcggggcttgaggtccgtgtccagcggcccgatctccatgaagttgccgtaacccacccccgacgcgcccgggccgccctgaagccacagcacggtcggccatggcgccgtgccgttgtcgacgcggtgggggctacggtacagccaccagaacatgtgcgccttgggtcggacttgcatgtatccccactcctccgacccatcggcggtgccggcggcggcggcgcgggagggcaggacgaggagaagagcgacgcaggacagcaggagcgacctcgccggcgccattgtggagctgtgacaaggactcatcgtggacgaccgcgtgccgaattc

SEQ ID NO: 23828 - DNA, 613 bp, Triticum aestivum
  Clone ID: PAT_TA_23828
cggacgcgtggggattctatccatccatgcatatctggcacgcgaggtttttgtgtggcatctttctgtacataaatcaggtacagctttcagagtagttaatgagtaatgccgtttctaagaaggtaagaggttttcctgtaacagagcaccgactctgacgctactactttccgtcagaagttgggtccgtgtagaagtcggcaggaaaggtggatgagaagtttgcttgagagaagttaatgagtaatgccatttctaagaagagcaccagctgtgacgctactgctcaccgtcagaagatgggtcgatgcagaagttggaaaggtggatgagaggctttaattactttgcaactctgcctcatgagctccatcagcccaacaagtcggttcctgcctttcatcgctcgctttagcagcgaccctgcttgatggccagacctcatgcggcagcagggcagggcagcacgggttctcggtagattgtgatcgagggcctagcacgaagattcccagtcgccggtggttgtaaagggcaaaacccctggagcagattttgtcaatggacaagtggagactgctatgctagttcatgggaaaatacagaatga

SEQ ID NO: 23829 - DNA, 1583 bp, Triticum aestivum
  unsure (1)..(1583): unsure at all n locations
  Clone ID: PAT_TA_23829
gtattcaatatcaagctacaggctctgggtcanaatgccaatcacaaaataccgaacgccgagctggacaagcaaaatccgatcgtcccaagcatacactataccaatttcaggctctattcccagtcctcatcgctatctgaatcatcgtcactgtcttcctcgtcgctactctcttccttcttcttggagtcctttgagtccttgggactgttgggagtctgggttgtctttccagaggcagcgccgacgacgtcatagctagcttcgctatcggcctgtgacttctcgtcgttggatttacgaggctcggctggcttcagcagtgtctttgcggcaggctgggtagtgttggaggaagcagtggcaggggtggcggcggcggcaggagtggccttggtttcggtcttggtttcagtcttgagttcagtcttggactcagtcttgggctcaactttggtcttggtcgcgggggtgctggtgtcagcagagtcgtcggagtcatcatcagaatcgtcgtcactccaggcaacatcatcctcggcagaggcagccttgaggagatctcgtcgtctagcttcggctgtctcaataccgtgacgaaggaaatagtagcgcttccagaagtcaacgtagggaacctggtcaggaaccagcttctccatggtagcccgcaagtctggaaatttctgtagatcattattgatatccggggtcttcttatcagcgtcaaactcctttgaccaagcagcataatcagcactgttagggtccttcgtgaagctctcagtcgaggtgtgaataacgtgtagttgagcattgaatcttgaagtatggatcacgcgcttgccctgcgcgtctttgctttcaaaaagaacagtaccactttgatcagactcttggggtggtgcaatgctgacggcatcacggaggaagtttcgcacattaccaccaaacttaataagagcttcatcagcagcttcctcggctcgctgaagatccttcaacctcttggcagcttcggctcgaagacgggcaagggtattctcggattgttttgcttcttccgagccatcctgagaagcccttggggtggtttggtctttctctccgtcctttgagctctcacctgccgtagcagtgttgagtgaaaggttccgtgtgtggctcagaatagttgaccgcagactggtgagtccttttgacgcatcttcgccaacctctgccaactcctttgatgcttgtgtatataccgattcaccctgcttggccacagtgccaaagaaaccaccaatcttggcaccccacggactgtttgagaatgccttataggcgtcctggaggtcctcattcagagttgactggggttgggtagtctttggctcttccgtcttcttagcgtagccatcttctgcaatatgatcgtaagccagatccatggcgtcgagctaggtatcgttctaagttgatgtatttcaaactatggttcaggatctcggttttcaaagcgaattgatcgttcaattcgttgaaggtcacttcattcgatatctcctgtcgttgctgttcccggaccggccggc

SEQ ID NO: 23830 - DNA, 818 bp, Triticum aestivum
  Clone ID: PAT_TA_23830
taggggccttttttttttttttttttcaaggacatagcttgtttaagccatttgacatttatcataactcaaatatgtatcgtaaggatgtatgtacaatgaacactgagaatacactttctttttaattcaaccaacaccttagtcaaggcgaggtaggtctcccttctcctgagcctcttcaacaagcttgttgtagacctcaaccttctcctcgtactctttaacaaggtcctcatctctcttgccaggtgtagcatcgtctccgccaaaggctctgacagcagcgtagtagacatcggcaagacctctgcagacaccagaaacactcgaagattgacattggaagtacaaatcggtcttgaagttgctgtcgatacgggccttgccgctcactgtgaagcggttctgggcgcggtagttgtggtagccaaagtcgtgacggttgcaagcggggacgaaagggaagccgaatgggttgtcgggggacgaagtgcaaccatcagaggtccagtcgacagtgggaggatcgcgggcgttgcgacgagcagtgaattgtgggagtgtaacgctgaagaggagctggtctgtcactgtgttcacgctctggcgctttgagatggatgcatcttcgcctgttggtagagcgaggactactggaaggacggagagaactgtagcgatgaacttcatcttgatatgatagagatagttgatgaagaagggaggattcaagattgtacaccgttgtcaagatgttgagcaggaggctttaacttggacagctagggaaagtgcttgttcccggcccggccggc

SEQ ID NO: 23831 - DNA, 268 bp, Triticum aestivum
  unsure (1)..(268): unsure at all n locations
  Clone ID: PAT_TA_23831
gaattcactagtgattagcgtggtcgcggccgaggtaaaacacttgtttatcaggaatggggaacagagcaaaaatgtctccctgttacctttactaaaccaccctctgggtagcgaaataacaccagggtcaagtttgtactttttcatctgttaaggtggtgtttttaggctaaaaaaaaaaaaaaaaaaaaaaaaaaaaaaaaaaaaaaaaaaaaaaaaaaaaaaaaaaccacgaaaaacctgcccggggggccncncaaatcaa

SEQ ID NO: 23832 - DNA, 624 bp, Triticum aestivum
  unsure (1)..(624): unsure at all n locations
  Clone ID: PAT_TA_23832
gaattcactantgattaacgtggtcgcgcccgaggtttccacttccaccatctcactgtccttaaagccttaactgccttgtttctgtttgcagttcttgttccaaatcatgttcaagggcgacatcatcggcatgactgtccttctttctcctgtggcccttttaggaacgtaccatctccatttcgtcaggcgggtgatccaccctggggtggttttcaagtcttacgagctagtttgcagtgataccagggctacaattcgcatcaacaatgcaacatatcatgtgtcccgcatcaactatactgtttcttacttctgggttgttgatgctgtcttggatttacccaaccggtgccctcttcctcagtggaatcggcctttttatgaacacaaatatgggccatattactacccccctaaaagctgaaattacggccccttgcacacaagtgtcgctagcctttgttagaatgttctcaaggaagtaagggacaatggnatgtcatgcccgcacttgcatgagcaccaaccattcgttgtctatgngtaactggcatatactctggngctgntgggancctcnanccttnttttggatatntggcaaangactnctttggg

SEQ ID NO: 23833 - DNA, 509 bp, Triticum aestivum
  unsure (1)..(509): unsure at all n locations
  Clone ID: PAT_TA_23833
gaattcactaagtgattagcgtggtcgcggccgagggtttttttttttttttttttttttttttttttttttttttttttttttttttggctttgagttcactgtaataactcgacccaaaacaggccgggctcaattgaatgacactgctttccgctgttatttaaaacaacaatgaagaattggctatgaacaaattccatttcgtggccggcaaaaaattacaatcctccattccctctctctctctccctctccccacctaggggcaccaagctgccatacatacggtcacccccaactatcgagtgacaggagtccgtccgtccatccaggtgaacctccgtcacacaagcatccatccgcccaaggtaaccgggtttcgcgaacccgcctccgcgaagctcgatttcttctcctttttccgtctcaccgtccggcttcttcgacgggggagcccccccgggtggggcctccggcngattttccgcgaggggttcgaccggngg

SEQ ID NO: 23834 - DNA, 779 bp, Triticum aestivum
  unsure (1)..(779): unsure at all n locations
  Clone ID: PAT_TA_23834
gagttcataacctaataaatgaaactttgcatgacaccacatacaatatattacgtagtatttcccactatagatgtacgagtcgtaatataatctagagtctttacgagtgcaagttaatccattgtggctagtctatggaaacaagggagacccgttccagatccacgacttcagtttgccgccaggccagtggagaacgtggccatggaggcaagaggcgccgggaacaaccgatcaagcgcggcggcgccgccaaggacgccagatccggtgcgcacgccgttgtatgcggcccatatcccgcagcccaaccaccgtcgcccgcctccacagcaagttgtcgtggccaagcgcactactccgcaactccgccgctccagggccgccggcctgtttccttgcgagctccgaccacgccgtccccgcatctgccgccgcaccgcacgtgggcgccaaccacgccgtccccgcatctgtccccgcatccagcgcgtctcctgctcagcgcacggtcttaggtggcggctggtggctgccgaaagagtttttgcctcccgtgtcgtcttgaggagcgacccggagcaacccaaagcgtctttttgcgttttcctgtttctgggaggtgttgatacttgatagtgagcttgctaaccttgtcaatgtcaacgtcgaaaatgatctcctcgatggccttctggtcgcctcttggggatagcgctttcttgagctcttncatctcgatgaaccgctcatgttcttgttcgaagtaattgaac

SEQ ID NO: 23835 - DNA, 1293 bp, Triticum aestivum
  Clone ID: PAT_TA_23835
agttctgttagttgattctgtctatttcatatacatggtttgagtactcagctcgctttcactttttgtgccatgggcgcaacgggtcatctagtaataaaacagatgacatggtctcgtggaggcaagtacaatacaagtatttctgatagttgtttgacacccgcatttgagataattagggttaatgacctccatgatcgctttgcatcaaaaaatgcggtgacctctacatgatcaaggaaaagagatacacttattacacacacactttctctccatctctctctccgtgtgtgtgtgtgagtgagtgagtgtatgtgtgtctgtgtgtgcgtgttacaaatgagcatgcaagtggagtcacacttttctcagctaatgtcctattgttctttcccagcaccacctagcaggctgctgggatcaagctttagagacacgtccttgaacatcttgcggctgagggtattgaaaattgctcttgagtactgtcgtgatgcattcctccagtccactccagctttcatcattaactcaaactcctcatagcttatcttgccatccttgtcaatgtcaacgtcgaagatgatgtcctcgatggccttctggtcgcctcttggggatagcgcttccttgagctcttccatctcgatgaacccgctcatgttcttgtcgaagtagttgaacaccttggggaggtgttcctcgctgcggattttcttcaggtgaatggagaccgtgacaaactccttgcagtccaaggtgccatttccatctaagtctgcagcttccatgagcatatccacatctgtatcatggacattgttccctatcatttgtagacctttcctgagctcctcaattgtcaggtgcccatccttgttagtgtccagcatgtggaacagttccgtgattgcctccagctcttcagcaggcaagtattccgccaccacaagcaaggccttcttcttgaacttgttcatgacagtgaattgctttagccttgaccttactgcttcaccaagaggaatgtttggagcagcggtggaattctgtatccatggatgctctaaaacttgttgagccgtcaatctggcataagggttgttttcaagcatcctgctaacaagctccttggcgttgtctgacaccttcggccaaggctcgcgctcgaagtcgacgcgtgatcggatgatggcctgcgcaatcccttcgtccgttttggcccagaatggagggacaccacatagcaagatatacaatatgacgcctgcactccagatgtcgatt

SEQ ID NO: 23836 - DNA, 573 bp, Triticum aestivum
  Clone ID: PAT_TA_23836
cagataatcaatgtgcttaagatcattcatatcggcatcgccgtggacgtcaaaacaacataggcatcgtacacagtccagtgatccttcctacttcccagccctattgataaaaccctgattttaccgtccataggtgccaacagcccatctcaaatgtgaataagcaatatgtaacgccacgaaacgcctatagtccaccctatgtatataccagtctcctcaggtatcgtgcatcttgctagcatagattctgcgccaagagcttaacggagagctgtggaaagctaagataaaccaacgcgaacccagaataagagaatagaggaagggcaatcaagagctcttagtcttcttgcgacccgacttcttgggctcttcctggggctcgacgacggcggccttggtggagcgccttcgcttcttgtcggggctggcaggggctggcttctcctcagcagcggcagcaggggtagccaccttgcgcttgcgaccaccagcgggcttcttaggagtcttagcgggggtctctgactcttcggggctctcagcagcaagagcagcggcaacagc

SEQ ID NO: 23837 - DNA, 1735 bp, Triticum aestivum
  Clone ID: PAT_TA_23837
cgcggggtgggacgccgggcgccctgccgggcgagggccccccttttgtcttctggtggtcccgcacgcactttatttcagagctttattgcccttgcgcagggagatttttttttccaactatcgagcccaaaatagtattttgtttcatcgaaatacattaataattccgggaatgacctcccttaattaaccggctggagaaataataactgtccagacaggcatgttaacaaggtagcctgcttaacaacaacacaaatagttcatgtgcacatatgcaaacagacgtgctttagttcgatcggctatatacgtgcaacatatcatgtccattagtatggcctatttcatcgcgagctcatgggtagatctcaatcactgaaaagggacccaacaccggcatgatcttgtaatcgtcgctgaatccagcatcggaaaagatcctcttccactcgctctcgtcccgttccaccccgttggtgcacatcgcgaacatgtcctgcaaggcttccatctcgccgatcttcttttccgccgagcagagaccctcttaccatgtctatgattatcaaccttccctccggcgcccctagcggggatggcttccttgcagcgctcatgtatctcgacccagtcggcgcgcccccagtcatgctactccttggcgagcaccacagcatccgccggcggaatggactcaaacctgtcacctgcgacgaaactcaggttgccgccgccggcggcggcggccgggccgacggcctggcaacgttgaagtatcttgacgcagtcgtcgtggccccagtcacgcagaacattcttgagcaggacagcatccgccggtggaatggattcgaacatgtcacctgcgacgaaactcaggttgtcgtcgccggcggcggcggcctggccgacggactgaggaaggtccagtacggtgcacttgatgcgcgggaacgccttggcgaccacccgcgtgccggcgccgttgccggcgccgacgtcgacgatggagctcaccccgcggaagatgcggcccttgtcaacaataatgacttccaggaagagctcgctgtcggcggtcatggcgtctctgaggacgccgccgaacccggcgtccttgcccgccatctcctgccgggagcagccgtgcgcctgctcgaagagggacgcagcgccggccggcgccggctcgctcctgagccaggcgggcaggtcgaagaaggaggagacgatgagagggttcacgaagaagggcgccacgggggacaggttgcgccagccgacgaggaagcggcccgtcgtggtcagcccgtactgcactggcggccgtgtcgtcggcaggaccgtcgtcgtccccggcgccggcggcggtggtggtggtgaagatgcccgaggcgctgagcagggccatcatgcgccggaggtcggcgaccttggccgggtgcaccttggcgtcggccgcgatgtcggccagggtggcggtgccgccgcgcttatggatggccgccgggatgccgaggtccacggcgcacttgagcgaagtggccttgacgtagccgagcacgtggttctggagctcggcgagggactccagcagctcctgcgggctcacctccattaagagcttgagcgtcatggtgcctagctggctgcacagctgagtgcactgcagatgaaatgcaagctagctttggatgtatgtgtgcgtgtgtaatcctgtactccccct

SEQ ID NO: 23838 - DNA, 569 bp, Triticum aestivum
  Clone ID: PAT_TA_23838
ttttttttttttttttttttagcaacaacttcgcgttttttttttttttaactggcaaaacgaatttaatcgaatggaacgaataaatcaaacggttacaacacgtattttatgtatgtatcgtggtgttgcagtagaatattctcctctgttctccggccgacaactactggccgttggcaacggcacccgccggaactgatcgggtgggtgaccaatcagtcgagccgcatcatgtcccggtggaaggcgtcgacgccgtcggcggcgacgcactgggtgatgaggcgcgcgccgggcttgtgcgcggaggggcagaccaggatgcacgtcgcgatgtagtccaggttggtgaggggcaccacgtgcacgggggcgccccacccatagtccacctccgcgaacccgagccgcgaccagtccgacaccagcagcgtccggtagtccgacgtgatgcggtacgggtcgccgccgtcgcccacctcgccgcggctccaccgcgcgaactcggacgggagccgcttcttgccctcgcggatcagccggaccacctcgttcagcggcgcctc

SEQ ID NO: 23839 - DNA, 887 bp, Triticum aestivum
  unsure (1)..(887): unsure at all n locations
  Clone ID: PAT_TA_23839
gtttttttttntatattttttttcctgagaacatattattatatagtatgacatcatacaggcaataaaattattattttcagaatctgtagcaaactaacagatttttattccactcatctcggaacttgtaccatagatttttctagttgatattctggatattcactatcaaagaaaggacaacttgatcaatacatatctcataggagaatttcatcactttcttggagcacaaaagtgagtctacatgcagcactaactcttcatcgccgcttataactgttctgcctgtgtgggaatattaggagaaggaggagacataggtgcaggcgtcacgattgttgttgaaggtccctttagagtctttggtcccttatcatcaacgacctcctcagcagctctttccttagccttttgggctctctgaactacttcctcctggaattcctggacctgcttctgctgctccgcctgccactgcccgacgacgctgaatacctcgcccaccaccgactcggccctctccgtcagcgcctccgccaaggccttcccgaggaagaaggcgtcaaggacggccttgctctcgtcatcacctgctttgggctcgggacggccgccgccgccgctgctcctggccgcaaacctgcgaaggcttttggcgggggaggaggggaaggcgctgcgggccgggagagagacgcggcagaaggtgggaggagccgccgccgccgccggcgcaggtagtacgggcgccatgtctgcccgcgctgtcgtggagctgcggggtcttccagcggcggttgggattgggaatcgctcggattagaacccccggccaccggcggacgcgcagccacggattgggggcaatccggacgcgtggg

SEQ ID NO: 23840 - DNA, 1868 bp, Triticum aestivum
  unsure (1)..(1868): unsure at all n locations
  Clone ID: PAT_TA_23840
agcgcaactcttcttctctgcccccgcccctcccctccgtcgcccatggaggctgcagaaatcggcggcctctcctgttcgccctcgccgcgccgcctnattctccgccgtctccaccgcgccgtcgacttcagccacccgctcgccgtggtcgtccaggagaccatctcgtggttcatcggcatcttcgatggctcctcctcctcctcgtcggcggcggggggcgtgtcctggcggaggtgtacgagctgtgggtgcgggtgcgggccgggtgatcgcgcggctgcaggtggccgtctggcgtgcatggtcatgtcggtgatgctggtggtggaggccctgtacaactgcgtggtcagcctcggcgtcaaaggccgtcgctggcgccccgagtggcggttcaagtgggagcccctcgccggcgacgacgaggagaaggggggcgccactaccccatggtcctcgtgcagatacccatgtacaatgagctggaggtgtacaagctgtcgataggcgcggcaggtgagctccagtggccaaaggacaggataatcgtccaagtgctggacgactccaccgatccgtttatcaagaacttggtggagcttgaatgtgaaagctgggcggtcaagggtctgaacatcaagtatgccacgagaagcagccggaaggggtttaaagcaggagccctgaagaaaggaatggaatgtgactatgccaagcagtgcgaatatgttgccatatttgatgctgatttccagcctgaaccagacttccttctcagaacagtgccgttcttcgtgcacaatccagaagttgctcttgttcaagctcggtggtcgttcgtgaatgacaccgcgagcctgttgacaagggtacaaaagatgttctttgattaccatttcaaagttgagcaagaagcaggatcagcaaccttttccttcttcagcttcaatggaaccgctggagtgtggcgtacagcagccatcaaagaggcaggaggttggaaggaccgcactacagttgaagacatggacttggcagtccgagcaaccctaaagggttggaaatttgtatatgtcggggatatcagagttaagagtgaattgccatctacttacaaggcctagggtcgacagcaattccggtggtcctgtggtggtgcacatttattccgaaaagtagcaaaagatattttgactgcgaaggatgtatctctcatcaagaagttccatatgctctatagcttcttcttggttcggagagttgtggcccctactgtcgcgtgtattctctacaatatcatacttccaatctcagttatgatcccagaactattcctaccagtctggggcatcgcatatattcccacagtacttttagtggtcacagccattagacatccaaaaaatttacacattctgccattttggattttgttcgagagtgtgatgacaatgcatcgcatgagagctgccctctctggtctattcgaattatcagagtttaacgagtgggtcgtgacaaagaaaacagggaacaattttgaagatagcgaagttcccttgttacagaaaccaaggaaaagattaagagacagggttaattttcgcgagattgtattttcggcgtttcttttcttctgtgcatggtacaaccttgtattccctggcaagattagctactattttaatctctatctccaaggactagcatttgtatgtctagggctaaacttcactggcacttgcagttgctgtcaatgacaacaactaaactgtaccaagtgctgttatacagtttgtttatgggtgtaagagtttcaaacatttcaaaaaaaaaaaaaaaaaaagtcgacgcggccgcga

SEQ ID NO: 23841 - DNA, 775 bp, Triticum aestivum
  Clone ID: PAT_TA_23841
gtacaaaagtaacctcatacattgatgtacacaattaaactcatacattagcaacatggtatttcaggggggacacattttcgccggttacaaacaatattgctgcatggcctgcaagaagaacaaaaacagggagcaatgtgctagaacatcacgatgtttttacatacacaactttactcttctagttcgcgatggttggcctggtcctcatgtgctctctttcctactcgatgcctctagctcctttttctcttcatcatcgctgctgctgaccgcggtgggggttgtgggtggaggctggtcgccgccttcctcaggttctttcttcagttctgtttcgaattccttggctgcctgctggaagctcttgacggtcttgccgacgctgcggccgatctcggggagctgcttcggcccgaacagcagcgcggcgacgccggcgatgacgaccatctccggcacgccgagcccgaacaggcacttgcacccgagcgcgccgccccccgcccccgtccgcctgggccgcgcggccaccgccacggaagccgccgccacggcgagcccgctgcccgcggcgaaggaggacgccctcgaggagagcccggctgcggcgaggcgcgctcggtacgccgtgctcctcgccggcggtggcgctcgggaggaggagtaggtcgcgactggagcaatcaccatggctgccgctcgctcgccggagtgataggaaatgggaggagtcgcggagatttttccggtcgccgggcgcgtccgtcga

SEQ ID NO: 23842 - DNA, 531 bp, Triticum aestivum
  unsure (1)..(531): unsure at all n locations
  Clone ID: PAT_TA_23842
gaattcactaagtgatttcgagcggccgcccgggcaggtgtaactccggtgtctaagtaggatacatcatgtgtgggtacaagcctctgattgggcgcattttacactgctgatggaaactttgctcagcggtgttgcacgcctggtgaatgtagcagtatattatcccctggtagacaattcttctgccaacattgcatatgtttgattacttggtctgcagttcctctgctctaatttggataccatgtcacggcatatatctgaatgaccgtttcttatcaggccatcaataattactttccacacaatttcatcaaggattgtcgtcttcccatnctacagttcccaaaaanntttcttcaagccaatatgagcttgntccttcaactaantaaagccccgcaaaagcaaggntgcttgataaggccatcaagtttgtgggtacaaaaccaacaaccaatncatggggggtggcgccgcccgcccatccggaatactgtcttgatttgcataaacacataacaagng

SEQ ID NO: 23843 - DNA, 1029 bp, Triticum aestivum
  Clone ID: PAT_TA_23843
tataataatgattaaaagcgccctgcagtgcaaaagccaacaaacagcccgacacgtccgaaacaagcagcgcagagactatggctggcatgggcgagcgcctcgtgatcggcaccctgctggccgccgccttcctggcggcaccggcggcgggcaccacgctgaccctgcacaacctgtgcccgtaccccgtgtggccgctggtgaccccgaacaggggcttcccctccatttgcggcaacgacatccgcctcgagggcaacggccacgggctcgtctccttccccttcccgccgaccttctggtccgggaagctggtggcgcgcaccggctgcgcgcccccgccgcggtgcgagacggggagcgagcggcccgcgggcgtggtgcagctgaccgtgcactcggccgagggcgcgccgcggcaggacctggcggtgtacagcgtgagcctggtggacgggttcaacgtgccggtggcggtgagcccgcaggccatcagcggcgacgggccgtgcccggccctggggtgcacggcggacctgaacgccgggtgcccgccggcgcagcgcgtggtgggcgcgggcggctgcgtggtcgcgtgcaatgggccacccgggtacttcaagcagcggtgcccgctgacgcggacgacgccggtcgacagggagcccgtggagcagcactgctacgcgcccggcgagctcaaggtcgtcttctgccagcccgcaatggtcgacgccgacgccgccgcacagccggatattgtcgtcgccgagaactaggtggcgggccattagcgcgtgctgttgatgatacacgtataaggtgtagtagtgaaaataagaacggcacgtacaatgtgtgccgcccggccgtgactctgtgtcacgtaacagtcacgtaaagacacataatgtgaagattatcgctcccgaatatattatgtgaatcttaacgggatcgtcaacaatccgttcccgtacatccgttcttatgcatacattttgtggacaaaaaaaaaaaaaaaaa

SEQ ID NO: 23844 - DNA, 438 bp, Triticum aestivum
  Clone ID: PAT_TA_23844
gaattcactagtgattagcgtggtcgcggccgaggttctctctctctctctctctctctctctctctctctctctctctctctctctctctctctctctttttttttttttttatcagccagcgagcttctaatccaaagcatgtacgcacatcatgctggccaagccacatgcatacatcaatacacattaaactggcatgcatgcatcaacatgccaacataacacacgcacgtacaatgccagacaacacacacgcatcacgccggcaaaccgcataacgagttgaagccttcgatctccgagatgccgtagatgttcgggccactgccatgctcgaggttgaactcggccagcgtgacgagcagctggccgaagtgcacgctacacatggtgccgcccaagtcgccgggccccgcgggccggattcggcacgag

SEQ ID NO: 23845 - DNA, 659 bp, Triticum aestivum
  Clone ID: PAT_TA_23845
ctccaaaaccctagccatgcagaagcagacgggcaagtccggtggaggcggcggttccgccgcggccaagcgcggtccaaaaccctagagcagcagaagcagacgggcaagtccggtggaggcggcggctgccgtcggcgacccggcggcgccggccgccctcgtcgggccttccctccatgtcctcacggctctctccgatcagaacaataaaagaattgtccttgcattgcaaagtgggttgaagagtgagatattatgggcattgaacgccctcacagtactctcttttaaggagaaggatgacctccgacgggatacaacacctcttgctaaagttcctgggctattggatgccctccttcaagttattgatgactggcgagatattgcaatgcctagggaccatacaaaaccaccaagagtaagaactttgggtgtcaatacaacaatctcaggatttggtcttgaaaacgttgggaaagtatactcggacagcaccactcctccaaatgatcaatcaaagatagagagctccactatcacaaagaagagatctgcaggatttttgtttgatgaagatggtctttttaatattgatgatgaagggcggacagagaggcaacagtgtgctgttgcggcctccaatataatccgca

SEQ ID NO: 23846 - DNA, 484 bp, Triticum aestivum
  unsure (1)..(484): unsure at all n locations
  Clone ID: PAT_TA_23846
gaattcactagtgattagcgtggtcgcggccgaggtcacaactattctcatctcgagctcaaatgaccctgcatgaacagtaaaatcataaaaaattaattaaaaaactgaattttttgtgcgaaacattgacaaaatttctgagtgctcgcaaatttttatattacatctgtggaagtggtgaaaaaaaatcgattctccaaaaaatgccattttcaaaagcattttcatgtgctgattttgtttttttctgtgacttccacgaatgttatttctacgtgaaaatttggaggctcttaaaacctttgttaaagtttatcacaaaaaaattaaaaaatttgattattttttcattttcctttcgaatttactggttcaccccgatctcaattgagctcggggagcaaaatgacacttttgttgtttggaccaattacttgtccgtttggttaatcctaacancagatttccctaccattttccc

SEQ ID NO: 23847 - DNA, 677 bp, Triticum aestivum
  Clone ID: PAT_TA_23847
gacccagcgtccgtgcttgtcggcatcattgtgctctgcggaatccagcccgtgctatcaggtgttgctgttggctgtgggtggcaagcattggtggcatacatcaacattggatgctattacttcatcggcgtaccccttggcgcgctcctgggcttcaagtttgactatggaatcaagggattgtggggaggcatgattggaggcacgctcatccaaaccattatactattgtggatcacattccgaactgactggaataaggaggtcgaggaggcgaggagaagactggacaagtgggacgacgcaaagcagccacttctcgctaacgtgcagcgatgatgcccggagaagattaacgtgtatgctgctgcaagttcggcagattgatccactcaccaacttatgttcggcattatctcagttttttttttaggaaatggcattatctcagtttttttaggaaatgttgagcatcgtccttctcatctcccgctgctagctgcaatttttgttcaatcaagtttacaatgagatggttctccttgaggattcacgttctattctgaactctcctcgcctaaaatagtctctcgggggcttggactggccttgaagaacggaatggagtaaaccaggggccttgtttgtaataaagagcaaagtaatccggtggt

SEQ ID NO: 23848 - DNA, 695 bp, Triticum aestivum
  Clone ID: PAT_TA_23848
gtctgccgcgttctctgcatgggtggtcaccgccatgtccgcgctcatagcagtcctagccggcgttctggtcttcctgctcaggcacaagctcagctacatcttcaccggcggcgaggccgtctcgcgtgccgtcgcccgatctctgtcctttgcttgtcggcaccatttgtgctctgcggaatccagcccgtgctatcaggtgttgctgttggctgtgggtggcaagcattggtggcatacatcaacattggatgctattacttcatcggcgtaccccttggcgcgctcctgggcttcaagtttgactatggaatcaaggggttgtggggaggcatgattggaggcacgctcatccaaaccattatcctattgtggatcacattccgaactgactgggataaggaggtcgaggaggcgaggagaagactggacaagtgggacgacgcaaagcagccgcttctcgctaacgtgcagcgatgatgcccggagaagattaacgtgtatgctgctgcaagttcggcagattgatccactcaccaacttatgttcggcattatctcagttttttttggaggtgttggccttcgtccttgtcgtctcccgctgctagctgcattttttgttcaatcaagtttacaatgagatggtgctcctcaggattcacatgctattctaactctccccacctaaaa

SEQ ID NO: 23849 - DNA, 528 bp, Triticum aestivum
  Clone ID: PAT_TA_23849
gccggctttcacgggaacgacgttccgctactccaggatcaagaggatggtgaagattcatgctccttaaaagcagacaggaagaaggttctggctcatcaagggagctgcttgcagaagcgaggttgtggtgttcttggatgcgatggtgccgtggaggatggaggcgcggctggcggcgacggtgcgggcggccctcctcggctggctcttcttctgcctcaccgtcgccagcgacgtcgcacgccaactcaggagcagcgatctctccgtctaaggccgaccgcgttcggcatggccgacggcgaagaaccgactctgcgtctacagattgatttacaggagggtaaccagatgcgattttccaaagtagtgctcgtctttagaagacggctgtccttaagagttaagactcattgagcagatgctccctgtaaattttcaactaaagcgtgttgttcctttgctcattttggggggtcagcatggttacttccaaaagaaaaaaaaaaaaaaaaaaggccccta

SEQ ID NO: 23850 - DNA, 557 bp, Triticum aestivum
  Clone ID: PAT_TA_23850
gccggccggtccgggaacccaattcctttagcttccactttcgcctttcgacccgtatgacgttctgctactccaagaggatggtgaagaactgaagattcatgccccttaagagcagacaggaagaaggttctgcctcaccaagaagcgaggttgtggtgttgctggatgcaatggtgccgtggagaatggaggcgcggctggcggccacggtgcgggcggcgctcctcggctggctcttcttctgcctcaccgtcgccaacgacgtcgcacgccaactcagaagcagtgatctctccgtctaaggccagccgcgttcgacatcgccggtggcaaagaacagcgtctacgaagtgccactccatctggtgcacgggaggaagatttatttacagcagggtaaccaaatgggattttgcagtgtgttcaacccgcggttaggccccgtttgatagcaaagtattttctaaatattttggaaatactacagtttttgagattatcatagttttatttacaacaaaaaaaaaaaaaaaaaaggcacctaaaaaaaaaaa

SEQ ID NO: 23851 - DNA, 1899 bp, Triticum aestivum
  Clone ID: PAT_TA_23851
cccacgcgtccgcatttccgacgtgccggatttcccagctctgaggagaacgctcctgcgcttggcgccgagagtcgcaaacctccctgaagatgtgaagaaacaacttgaagacccggatagcaggtataattttggctggagccatgggaaagagaaacttgaatctgggaaactagacacattcaaaggctcctattatgccaacccaattttggcgccggcacctcagcccgccggtgccggcaccggggccttgcaccacgccttccccccccctgcccgccgccgccgcccagtcctccgcccatgcgcccaaacgctctccaccccccgccaggaggtccaggcgcggggcgagcgccggggccgccagagcgggggctggctaggccccgacgcgcgcagcgtcgtcgccgcgccagccactcgcgcatcacccgcccggagccgagaccgaggccaagaccgcgccttgccccgtcgccgcgtccgctgccgcgccgccgccatgccgccgtcagtccgcacggtctccatccccttcgccgacctcaaggagcggggcagggacctgagcggcaagatcgaggaggggctcggccccgccgggctcggcatcatgtccctactgctgatgatgtccttgtaagtaggtatccatcgtactgccgaccaaatatctggccagctgatcatctgcctgagcttgaaatagcatttaaagctcttggaaagctaatgttggaagttggcttgatgttggctcgtcattgtgatctctatgtaatgcagcacggagtgggaccatatgatggtgaaagtcttgagcagacaatttcccgttcaaggtgtcacaaggggcgtctcctgtattatttccccagacaattcagcacacaaaaagaagatggtgattctgtttcatcgtggtgtggatggcatactgaccatgggtctttaacaggtcttacatgtggcctgtttatgaaaaattcagtggaggtcccctgtcctgatagtgcagctgggctgtacatccggactcgtgatgcccgagttgttaaggttacatttggggaggatgaagtagcttacaccattggggaaactactgaaatactatcaagaggtcgtctatgtgcaactccacactgtgtgcaggcacccagcagtgtgaatgcttcaaatgttgagcgctctacttttgcaatgttcatgcaaccagattggaatgggacgcttaactttccaaggtgaaattccataccaccaagaagttgattccaccaaacggagcgcttacgtttggagtgtactcagtagagactggtgaacaagtattaccaggggaagacgtgattctcctgaattgtcacgatgaggcgcggagaaaaggcccctagtgaagatacaatgctaccaggaaactaaaatctttagctagtcgtgcctgcaaatacacttccaagttcctaggaagcatatacaaaatataggtgtagattacatcatttccgtaccatgcgcggttgtaaaaaagatgcaaaaaggtgacctgttcaaaactgtataaaataagatgaaattcgtgtacggtacttcggtatttcgtcctagcgggcgcccgggtgcctctcctctctctctcctggggtttcctcaaggggcctctcgctcgaccgagttctgtgccgttcttcgccctcggcgccccccatttcccacggttgtaacctctcgggcgggcgctgctactttcaggcacccagcggtgtgaatgcttcaaatgttgagcgctctacttttgcaatgttcatgcaaccagattggtacgtgcaaactttctactcaaaattgtgaggacagtgtagttttgcttccatttgatcgactatg

SEQ ID NO: 23852 - DNA, 482 bp, Triticum aestivum
  unsure (1)..(482): unsure at all n locations
  Clone ID: PAT_TA_23852
gaattcactagtgattagcgtggtcgcggccgaggttgcacatgctatgtggatgaaatgatgataccatgtcaacttccaaccttttcagagttcatttgaaatgcttttcaatttcagggtcttatagctcaaaataatcagtaaatacatggaaaataaccttctcaactttttagcacatgctatgtgggtgaaagggttgaaaattgatgatataagtagaaaccaaataaaataaaataaactctaataaaatatataagtagaaacacaataaacttttataaataagtagaaagagttatcaaagtattttcagtgaaaagcattaaaagcaaaaagaatattcataaaataagtccaaacaagcaaaaatgaaaataaaataaataagtntaaacaaaataaaacttttaataaataaagtnggaaaaaaataaaatttaatagaataaataagtngaaacaaaataaaatnn

SEQ ID NO: 23853 - DNA, 1578 bp, Triticum aestivum
  unsure (1)..(1578): unsure at all n locations
  Clone ID: PAT_TA_23853
gcgcagagcctccaaaagaatgtttgcaactcatatattacaaacaattacaatgccctcccaccaaacttgctacctatttccaggataaaagctccctacagattcaacacaactagtcatctcaatctccagtcgaaaattttgtcaagaccaggccacccttctgcgcattcggaacatcgccagcagccccaaccgtggagctacgcgtctggacagagagcgacaggggaacttggtcatgccctaacataatttacacctaacaaacccaacattaattacattagcctagccgatgctggcgaaggcccttgccaaaatggggctgcatcaatctaacatagagaccgttcaggtccatcagagagtcatgtgtgccctgctcaactatcctaccaccatttaggacaacaatgttatccacatgcttcatcatcgctgccctgtgcgctatcaggaccgttgtcttgttccccatgaccaatgtgtcaagagcttcctgtaccactctacttgattcagactcgatcgcagagctggcctcgtccaacaacaatatcggcgcattcttcaaaaccactctagcaatggcaatacgttgcttctgcccaggtgtcagatcaacccctcgcattcccacatgagtgtcatagccatgtggcaagctactaatgaaatgatgagcatttgctatccttgcagcttccttcatctcagcctccgttgcgttgtgccttgcatagataatgttctcccttattgttgtcgagaaaatgacgggttcttgttgaattaggcccatgtggcttcgtaaccatctcaggttgaacgatttcagatctcggccatccagcagaacttgaccagacattgggtcataaaatctctcaattaacgaaatgatagtgctcttcccggatcctgaaacacctaccactgcaactgtttgcccaccgctcaccttaagattgaaattgctcagcacaaagatttctggacgaactggataggagaaatcaacattcttgaattcaatgctcccatagacattgggtggtttcaggccagtgttgtcatcaggatcaatctttggctctcggtcaataatttcaaacactgaagtgagagacttccgccgcttaagtatgtatggggcaagtccaaagggctccaccaatgcaaatgatgcaaacgagaatagaatgtactgttttagccccgtggctattgtcaggcgctgcttgtccactgaggtggcaatgtaccacagaaggagggcgttgcaggcaaaaagaagaaactgcgagaaaccaaaaccgaagcctatagccaacccatgcacaagactttgcttcagtatcttaccaaggtgtaatttgtagagttccattatcttgtctccagcacaaaaaagcaacaacggtgtaaatgttgcgggactgcatcttcaagtactaatgaagnctttctatgcatcctcctggattccttttgagaagcaagcaagncataatttctgtgcaatggcaagngataancaagaacaggtaaagttgcaagtgcaacaaagcg

SEQ ID NO: 23854 - DNA, 518 bp, Triticum aestivum
  unsure (1)..(518): unsure at all n locations
  Clone ID: PAT_TA_23854
tcgagcggccgcccgggcaggtgtcaaatccctcgtgtgcgtccgaaagctgtgccgaacccgacccgagcagttgtgaccgatgggtccggatcatccccaaacatccctaaaatatcttcactttctcattagccttccctagcatatttattctcaaccgcccgattatgatcggagggaccaggtaacccttacccaaaacccacttgatatatatataggtccaaccctaggatgtaggcagcttgtcccatcaatcccactccgccgccaccatcttcctcgggatccatcctgaagccaaccacctctccacctgctccatccaatccatcgatccctgcctccctttgattccccaccaacaagagcccgcacccatgattcaaaatcctcccccgaccatctccctcaatctttgcggtgccccgcaccaccttcaaaacccccgccgcctgttcccctaccctcggccattgtgaccccggccgagcttgtcnaaacctgnttggggg

SEQ ID NO: 23855 - DNA, 549 bp, Triticum aestivum
  unsure (1)..(549): unsure at all n locations
  Clone ID: PAT_TA_23855
gaattcactaagtgattagcgtggtcgcggccgaggtctctctctctctctctctctctctctctctctctctctctctctctctatcctgtcaatactaataatgcttcctttttgcaaaacaaataaaaacaagaagtatgggttgtcatacatattcaatcataagcaaccttttatgctttatacttgttgcacatatgtgcaccttaatataaaactaaaacatatgtgtgtgagattttgaacagggtgtgaacaaagatgggcaaaaaattgctgtgaaggtgcttcgcgatttagaaaatgctgatgagatatttgagaaagaatatcacaacctacaaagtctgcaacaacaaaaatattgtgcggttggttgggctattgcaattaaactcgactaagtaaaagtgttgtacaatggaaaaatggttcctgcttattcaattcaacaagggcactttgccttggggttatggtggctgggggggaanccttgnaaaatggtanttccgggttgtntccaanggggacaatgaatgggcc

SEQ ID NO: 23856 - DNA, 1193 bp, Triticum aestivum
  Clone ID: PAT_TA_23856
gttctagatcgcgagcggcccccttttttttttttttttcatgaaattctggaaaattctcactttatatatgatatacatacaagatacaatcaacaaaagcatttgttttccaattcagagatagtatatcttgtctaatttctaccatctcattttattctcaagtggctagattcacatataaattccgcctgtgattttgatcatcagagcttagagaaaacaggcttccgcttctccatgaaagctttgatggcctccatcaggtcattagatctcagcattccagaattccaagtcgctacatgctccagaccctgctctactgtgatatctctgcttctcagtagaactgccttcgttcccatcactgcgtttgccgacttctctgatatttctttggcgatcttcgcaacaccggcatccagctcctgcttggaatcgaacaccctgctgacgagccccatctccttggcctccgcggcggtgatcctgcggccggtgagcgcgaggtccgccgcgttcccgtagccgacgatccgcggcaggcgctgcagcgcgccgaggtcggcgacgatggccatgtccacctccttgagcacgaaggtggcgtccctggagcagtagcgtatgtcgcaggcggccaccagttcgacgccgccgccgacgcaggcgccgtgcacggccgcgatgacgggcttccggcacagctcgacggcggtgagcgcggcctgcatgcccaggatcgcgcggcggagctcctccgccatggccgcggggtcggcgccgcgggcggggggcgcggtgagcgggttcccgggcccgccgagctcgatgcccgcgcagaagtgggggcccgcggcggacagcacgacggcgcgcgcggcggggatgcggtcgagcagcgccatggcgcgcgggatctccgcgaaggagtccgggctgagcgcgttgagctgcgccgggcggctgaggcgcacctcgtacaccgcagccgccgggtccggccgcgtcacggccagggccttgaagccccgccgcagctccgcctccgcgtccgacgagcccgcgccggccatctgatgccgtgtggggattaaactctagccgcctgtgctgctctgttgactgcggctgctgctgcctcgtgcgaacttatccaaagcttctataagagcatctccaatatg

SEQ ID NO: 23857 - DNA, 2145 bp, Triticum aestivum
  Clone ID: PAT_TA_23857
tatttacttgggttgaaacttttttatttttttaattgtcattatttcagggctcatttattcattcaagattcatcacaaatctgctgcagcacagcataaagtttaggaggcaacttattctttacaagttgatccaaatctgctgcacaacagcagcaagttcagacacaaccagacataacgctagaccacagcacggtagcaacaaagaacagaccagacgaggacacgctgacaatcccatcgaaggacacagaaagacaactgacttgtgagcccagagacataagcagctccatggccaggcacttactggccaccacggaggcggagcaccaagtgaagggtggactccttctggatgttgtagtccgccagagtgcggccatcctcgagctgcttaccagcaaagatcagacgctgctggtccggtgggatgccctccttgtcctggatcttcgccttcacattgtcgatggtgtccgatgactcgacctcaagcgtgatggtcttgccggtgagggtcttcacgaagatctgcataccacccctgaggcgaagcaccaggtggagggtggactccttctggatgttgtagtcagcaagggtgcggccatcctcaagctgcttgccggcaaagatgaggcgctgctggtccggggggatgccctccttgtcctggatcttcgccttcacgttgtcgatggtgatccgacggactcgacctaccagcgtgatggtcttgccgggtgagggtcttgacgaagatctgcatcccaccacgcaggccggagcaccaggtggcagggtggacttccttctggatgttggtagtcagcgagggtgctggccgtcctcaagctgcttgccggcaaagatgaagcgcttgctggtccggggggatgcccttccttgtcctggatcttcgccttcacgttgtcgatggtgtccgaaaactcaaccttaagcgtgatggtcttgccggtgaaggtcttgacaaaaatttgcttccccccacgatctcagccgtcattttgtggaggattatgtcaacttctagaagttgagaggctaaaggaagttcaaatgagagtgggacaaagataagtccattttcactaggataaatgggaaatgctcctctcttggcaaattttttttttttttttcagggctcacttattcattcatttcacagttcatccaaatctgctgcggtcagaaagttcacggacacaaccaaacataagtacataacactagaccacagcacggtagcaacaaagcacaagaccagacgaggacacactgacaatccgatcggaggacacagaaaggcaaccgacttgtgagcccacagacataagcagctccatggccaggcacttactggccaccacggagacggagcaccaggtggagggtggactccttctggatgttgtagtcagcgagggtgcggccgtcctcgagctgcttaccagcaaagatgaggcgctgctggtccggtgggatgccctccttgtcctggatcttcgccttcacattgtcaatggtgtcagatgactcgacctcgagcgtgatggtcttgccggtgagggtcttaacgaagatctgcataccacccctgagacggagcaccaggtggagggtggactccttctggatgttgtagtcagcgagggtgcggccgtcctcaagctgcttgccggcaaagatgaggcgctgctggtccggggggatgccctccttgtcctggatcttcgccttcacgttgtcaatggtgtcggatgactcaacctccaaggtgatggtcttgccggtgagggtcttgacgaagatctgcataccacccctgaggcggagcaccaggtggagggtggactccttctggatgttgtagtcagcaagggtgcgaccgtcctcaagctgcttgccggcgaaaatgaagcgctgctggtccggggggatgccctccttgtcctggatcttcgccttgacattggcaattgtgtcaaaggactcgacttaagggtgatgggcttgccggggaaggtctttacaaaaatttgcatccgacacccaggccgcgcaccggcaggcaggtggacaaagacaacagagaaaaaaaaaagaacaaaa

SEQ ID NO: 23858 - DNA, 446 bp, Triticum aestivum
  unsure (1)..(446): unsure at all n locations
  Clone ID: PAT_TA_23858
ccgcccgggcaggttcgagtttttttttttttttttttttttgaatacaataaatcacatatatttctcatattattaatccaaatatgcatatttcattcaagcatatctcattgaaaatatattgctactcatttcgtagtaatgcgcagggtatcatctaatatgctttatcacaacgaccagacaacgctagcagcattaggacatccaaggctttagaaaaattcataaagaaacaattagattagggttcaggggagatggttgccaagaattctttaaggcagtggttataggacacaaggcctctctagctggtgctaagatgccctgccttgcttatgcttcgcaagcatcgccttctcccccaggcttctcttttagcatccttggcattccccctgggnaaagaangtcggcatcctcggcccaanaacatantg

SEQ ID NO: 23859 - DNA, 2426 bp, Triticum aestivum
  unsure (1)..(2426): unsure at all n locations
  Clone ID: PAT_TA_23859
gggagattcctcctcgcctccgcccgcgcgtccgagtgaacgctgttctgactgctgtggttcaggggatgaaccagacagagctaagctctgaagtccgtcttgcagcagttaaagctctgtataatgctcttgactttgctgagagcaactttgcaaatgagatggagaggacctttataatgaaggtaatatgtgatactgctgtatctaaggaagtggagatcagacaggcagcctttgaatgccttgtggcaattgcatccacatattatgtgcacttagatccttatatgcaaaccatattcaacctgacagctaatgctgtcaaaggagatgaggaaccagttgcactgcaggctgttgagttctggagtactatttgtgaggaagagattgaactccaagaggaatatgagggatctgatgatgctaactcaactgtaaattatcgcttcattgagaaggccctcccttcacttgttccaatgctgctagaaactctgttgaagcaagaggaagatcaagagcaagatgataatgcttggaacatttccatgagtggcggaacatgccttggactcattgctagaactgttggtgatgcaattgtccctcttgtgatgccatttgtggaagctaacatcacaaagccagactggcgttgtcgcgaggcagccacttttgcatttggttctatccttgatggcccatcccttgagaaacttgctcccctggtacaggccggacttgatttcttgctcaatacaatgaatgatccaaacagccaggtaaaagacaccactgcatggactcttggacgggtatttgagcttttgcattctccatgcagtactaatccaatcatatcaaatgcaaaccttcctcgtatcatggctgtcttgctagagagtagcaaagatgttccaaatgtggctgagaaagtctgtggagccatatattttcttgcccaaggttatgaagatgcagagccggcctcatctttgctcacaccttatcttcctaatgttattgctgcactccttactgctgcggatcgtggtgatatgacccatgtgaggcttcgtgcatctgcttatgaagcgctgaatgagattgtaagagtcagtaacatacctgaaacttcaagcattataggccagttattgcaggagatcatgagaagattgaacctgacatttgccggccaaatattttcatcaggcgacaaggagaagcaaagcgatctgcaggctttgctgtgtggtgtactgcaggtcattatccagaaactgagcagctcagatgcaaagtccataattgcacagactgctgatcagctgatgcttctgtttctccgcgtctttgcctgccacagtgctactgtacatgaagaagcaatgcttgccattggtgctcttgcttatgccacaggtccagattttgtgaaatacatgcctgagtttttcaagtaccttgaggcaggcttgcagaattatgaagaataccaagtatgctccatctctgtaggggtggtgggtgatatttgccgtgccttggaagataaaattttgcccttctgtgatgggatcatgactgtgcttctcaaggatctctcaaactcacagctcaacaggtctgtcaagcctccgattttctcatgctttggagacattgctcttgccatcggtgagaattttgagaaatacctgccgtatgctatgccaatgcttcaaggggcggctgagcttcttgttgttttggatcaaaatgatgaggatatggttgattatggtaaccagctcagacggggaatatttgaggcgtactctggcatactacagggcataaagggtgcaaaagctcagctgatgataccttatgcaggccatctattgcagttcactgaagctgtctacaaagatcggagcagggatgagagcgtgacaaaggctgcagttgctgtcctgggggatcttgcggacacacttgggccaatctcgaaggatctgttcaagagccacctcttccatgttgagttcttgagggagtgcctcgatctggatgatgaagtcagggagacggcgtcatggacccaggggatgataaaccaagcgatagtttcctagacgagaaattatcttgcgtcgtctgttatggtggatgtttggttttgttgctgcgccataccccgtttggctcagatgaacagaagggtaccaaagtatagcgtcagtcagtcgtaggaacattgtcgtagatgtcttctgtggtggtttattattttcagtctgtcaagtcgttatgcgtcacattcgacggcagtggggtttatggtcattggacgtcttgaacagctaaacttattattgtattctactcgtccgtgttgcctacttgcatccatgctatgttgcgnctggggt

SEQ ID NO: 23860 - DNA, 704 bp, Triticum aestivum
  Clone ID: PAT_TA_23860
ttttttttttttttttttttttaattagcactgaagccaatcaacagaatttgcagtaagcattatgatagtgacagcaggtccgttgcctcgagcctccaaatcacagtgcacatagataatggtttcacagttctacagcagggccctttgcacattccagcgccaccccccccctgagttcttgccaactacaaattcttcagtttactcccttgttctccagcagaagtcagctgagcctaggctttggtgagatgccaagatctttttgcataagccacagtgaacacatcagtcaaccctgagttctccaggctcagtattcttttgatctttctgtaatcgagaggcaggcaaaatagatttgagctgggtgctctccatgtttgacaagagttgtgtgacagtcttaatttgagatgcgctttgcaaactactatccataaaagcatccaaggaagaaattacattaggtagttgttgtagcacttgctctgtgttctttgtaagagatgctttcgccaagagattcttagggagtttagccaagtggacctgggcaggggaggactgctccatgagctggagaaggttggaggtggactgcaccgcctgccctatctgctccgccaccgtcgccttcgctcctccgccgccgcccgccgccgcagccatctcctggtcgtcgtcgtcgccgccgc

SEQ ID NO: 23861 - DNA, 483 bp, Triticum aestivum
  unsure (1)..(483): unsure at all n locations
  Clone ID: PAT_TA_23861
gaattcactagtgatttcgagcggccgcccgggcaggttcgagttttttttttttttttttttgcgaggaggaccgagtgcaggagaggagcaggcggagtcggccaccgtgaggaggtgcttgtgacacggcagcggagctggcgcaggggtttggccccgtgcgggagaggagcagcagcaggggtcgatgaggatggtgcaccttctacttattgtgaaattttccataaaagataattctactacaagaaagtatatgttaagtgtgttgttggtaagctctaggtactccaaattcaacaaccaacctattctcatgaaatttgcctggaaagttggttctggcccaaagtccaattttatacagttttgtcaganttgccaaggcctattttgggaatggggaccaagtttaagtgaacttatttctaaaaaacaagggagtcccaagnttgacnaaaaacctnantcccaaacgan

SEQ ID NO: 23862 - DNA, 332 bp, Triticum aestivum
  unsure (1)..(332): unsure at all n locations
  Clone ID: PAT_TA_23862
agcggccgcccggcccgggggcggtcatggcggaggatcaggtggtgccggctatccttgagacggctatggtggaagaggtcacaatgaatgagcagatatgtatatttattttactaaacatctgtgttgatatgtgatgtgcttgaataaaagatttgtccttatgctcgcatataggtgtaatgttgagaaatcgagcaagcaagccaggcttgccttgtctcctatgtatgaaagagaatataacttttgaattgataaaaattggcttcctaaaaaaaaaaaaaaaacnnaaaaaaanaaaaccacctcggccgcgacnacgctaa

SEQ ID NO: 23863 - DNA, 1307 bp, Triticum aestivum
  unsure (1)..(1307): unsure at all n locations
  Clone ID: PAT_TA_23863
gaccgaggaagcaaatgcgcaagcattgctcaattaatttattgaactgggtgccaagtgcaagccagcaataaaatcagcatgctacaaaattttgttcatcttaacaactacagaaaaggatctatgaatctgaaatcaagaaggtacatggtcggttttatctctcgtttcacatcacttgagaaatcaagaaacaaatctatcgctaattaacagaacttccagtgttcaaattcaaggaagtatggcatgcctgtaatattattgtttcttgctgatgttgggcttcaccgagcaggagttttcgccaactgagtagggaggctctaaccagtagagaacatgatcctctccatggcgtactcgcaggttaggaggtccaaatttgactgaatttacaaagctgataagcaacagctgctatttctgaatctgttgcctggagaccaagcacatggcatgggaagcgcctattgcaactgagatgacacgaggagggcttggatcctcatcaccgtcagcaagaaaattaactttaacaggtaatggttgcacttctggaagatcgggaacgcctagctggcagtctcttgcatttccccacatgtacaggtcacctttctctgatatagcagcagaagttgatcccccacaggctatgtagacaattcgctcctcagacagagctttaatggcaagtggaattctatgattttgaatggttggatgccctagttggccatgtccgccatgtccccatgagagaacttcaccttcatcagtcaaggctaaagaatggtatccaccacatgctacttggattacatggacatttttcaggctagggacaatttgtggcctccagtcactggaattgcttcctctgccaagttcgaagtttgagtttgctccccaactccatagctgcccatccgaggtcagcgcaagtgtgaagaagccaccacaagcaaccgcagcaactggtacaggcagcgcgctcaccttggaaggaacactgagagagccggcttcacctggaccacccccactcccaagccctaaccttccatcgccttcatcacgaccccaagtgtatagttcacctgattctgtgatcgccgcggtatgcgctccactcgtggcaatgtgtgcaatcttcccttcccaagggccgttcactttcctcggcaacagctctctatggtaaacgtagtgccccagagctccaaatccaccataaccccaggtgaagacgtcgccgggggcggtgagggcggcgcctcgtgccgaattncctgcagncc

SEQ ID NO: 23864 - DNA, 587 bp, Triticum aestivum
  unsure (1)..(587): unsure at all n locations
  Clone ID: PAT_TA_23864
gagcggtaaacactactatagtttaaccatcgcaaaaaagaaaaaagtttaaccatcgcaagtcataagtgacatgtgctaagtagactatcactagctataactgatagacgatagatagtacataaacttgagttcacaacacctcgttgctaacgacaagggttaaactagacgaccaagacgagagaaatgactcttctcatctcaacttggctcctctacggctgtatctcgcccatgactcggccacgacctccggcaccaccttcctctcggccaaagaggacatcaccttcgccctcgtcaccttcttcaccaggagccgccacgtcttgtccgccttccccgtctacgccttggccttgaaatggctgcagagcggcacgcggcaggcccggtccggccggtcgcagacggaggcgtggagccggaagagctgcagcatgcgcttgcaccgcgcgcacccaccgggcgccatctttttcgggcacgtcgcgaagtgccgcatcagcacctgcaggccccggcacgtgcaccctgccctcgcgcacggggcgtncgcgtccgcgcagccggccttggcg

SEQ ID NO: 23865 - DNA, 570 bp, Triticum aestivum
  unsure (1)..(570): unsure at all n locations
  Clone ID: PAT_TA_23865
cgattcccctagggtttaccgtggtcgcggccgaggtatagtattaggaatgttcatcgtcaatgagtccatcagggtgggcgccgaaacaggtgagcgcctacgaagctggatcctgaaatgcatcaaggaaaatagttcaataggaagcaactgtaactgggagcacctgaaagtcaacactaggactaaacattttgtgcttatagcagttatgatgattttgctttcttttgtgtgggttctgagtatcgtgttggccataataaaggtgcgcaatcttgatgatgggcgctgtactatggttggggtgctcggttgcgcctccaggcgtttgggttacgctggtacttggcaaggctcaatggccagggaatcggcaaacagagatccctcatatggctgcccattgggacacttgtagccaatgttcttgctgcgggtatcatggggcctcgccccaatttgggggacaacntngtnagcccaaatngttccttgctggccgggggtaatcaaaggggaatcnacctgggctngtgnaccccccaanagcgggttgaaataaca

SEQ ID NO: 23866 - DNA, 948 bp, Triticum aestivum
  Clone ID: PAT_TA_23866
ccgcaaccgggccgcagccgcagcagtgggtcacgccggagccgaggccgcgggcgcagctgccgcacgtggcggactcgccgcctgtgcccgcgcgggccgcgccatcgacggtgccggcgccgggcccgaccaggtccgtcgaacgggaccgccggcccgtgcccgacatcatgtacaggaaacgccgcacggggaggcgcggggcacggcgctgttcgcgcggctcgtggccgcggcgctctgcctggcggcgctcgcggtgctcgccgccgacacccgcaagggctgggccctcgactcctacagcaactacacccagttacggtactcggaggctgtcaacgtgatcggattcgtgtactcggtgttccagttctttgcactagcgctgcacttgacgaggaagagacatttgattccccggcccaagggcgattatttcgacttcgccatggatcaggtcctcgcatacctcttgatatcatcatcgtcatcagcaaccgcgcgagtaagcgattggatcgacaactgggggagcgatacttttccgaatatggcgaacagctccatcatcatatctttcctggcattcgtggtttttgccatcaactccctcatctccgcatacaatctgttccgccgagatctttagctgcatctaacaattattaacagtgacatgttgtcgatttttcatttctggacgaagattccagtgcagactatgttgtgttgtaaatgtgtatgatcgaatgactgcaagtgttgagttctaaacttccagtaatgatatccatgcgtccatagctgctgctgcatgtttatgtaatcagcaaatttctgaaaattacaatattgtagcacctggatttcttcaagatatgttgttttggacataggaaaaaagacccgtagtactccctcctatcaaaaaaaaaaaaaaaa

SEQ ID NO: 23867 - DNA, 1040 bp, Triticum aestivum
  Clone ID: PAT_TA_23867
cgggaagccggggcgacccagcggccgggggcaagctcaatctcttcagcatctcaccacacaacaaataaaccacaatcggaaacgcaaccacatttcgtactggactcgatatgggcaagttcgtcttcttcgcggtgttcctggcggctctggtgtccgtctccgccgcccaaggcgtgctcgagcagagcctcacggacgcgcagtgccggggcgaggtccgggagaagccgctcctcgcgtgccggcagatcctcgagcagcagctgaccggtcgcgccggcgagggcgccgtcggcgtcccgttgtttcaggcgcagtggggcgccagggagcggtgctgccggcagctcgagagcgtcagccgcgagtgccgctgcgccgccctccgcggcatggtgcgggactacgagcagtccatgccgccgctgggagaagggcgccacggctcgtcgggggagcgtcaacaagagcagggatgttccggcgagtccacgggagccggagcagcggcaggaggtacaaggggggcagtatggcagtgagacaggaggaagccagcagcagcagcagggaggaggctaccacggggtgaccgtcgggcgtggtggccagcggcaaggacaggtgctctgtcacaagaggccgcagcggcagcagggagaagggttctccggcgagggggcgcagcagaagccgcaggccggtcgcgtgaggttgacgaaggtgcggctgccgaccgcgtgccggatcgagccccaggagtgtagcgtcttctccgccgaccagtactactactaggctagctgattggtcgatgcaatgtgtgagctctgataataagtgtgacctgtaatcacaatcctccatgcggaaatgacagtgataatgaaaaggcaatgaataatgaaatgagtttattcggcagatccttgagcagtcgcggtgccaagccatccacaatgttgttcatgctattattctgcatcaacagcaacaacaacaacaacaacaacaacaaaaacaaccattggggc

SEQ ID NO: 23868 - DNA, 961 bp, Triticum aestivum
  Clone ID: PAT_TA_23868
cctcatcccatctcaatctttcaatctcaatctctcaagcatctcaccacacaacaaacaacacacaataagtaaaccacacccagaattggaaccagtattgattattggtagttttttgtgctgctccgtgttcctcgcggggctggtggcggtccccgaggcccactccgtccgcgactagaggctcagggacgcccaggcgagggccgagggccggggctacgcccgtgctcgcgtgcccgcggatcgccgagcagcagccgagccgcagcggccgcgtggggccggccggcggtcctgtggcttcatgccgagtcgggggacgaggggccgctggtagctggcaggtcgcgagcgcgagggcgccagcgccgcggtgccgccggccgggggcgtgatgcgggagtacgacacaccgccatgccgccgcgaaggggcgcggggggccgacggcggcgcgctcgggcaggagcggaggatgttccggggaggccgaggcggcgcaggcccagagcggcggcaggaggtacatagggggtcagtatgagggggagacaagaggagggcagcaggagggagcaggctaccacggggggacgggcgggcgtggtggccagcgacagggacagggtctctgtcagcagcagcggcagcggcagcaagggagaaggctgctccggcgagggggcgcagcagaagcccggggccgggcgggtgaagaatgacgaaggcgggcctgccggccggatgcaggatcgggcgcgcaggggtttagtgtccgaaccgcagtactgtactacttggttagccgattggtggttgtactgtgtgagcttagatgataagtgtaacctgtaacctcaatcctcaattgggaaatgtaattaaaaatcaaaaagcaatgaataaagtgatggtgttaaggccatgaataatgaaatgagtttattcggcagaa

SEQ ID NO: 23869 - DNA, 694 bp, Triticum aestivum
  Clone ID: PAT_TA_23869
gaattcactagtgatttcgagcggccgcccgggcaggtttttttttttcagtcaatcacaacacgtaaatgcatctcacagatataggaaaacaaatacagaaataaaggggtctagcaaaagctgtcctccaaaaccttagcctactccctccatcctttcccctcctgcttggtcgtgtcatatctagcaatcatctgctcagcctcattgacccctacccggtcgcctaacccccagttctggaggactcgtcgcaaatccaatgcatcgatgtacccatcattgttctcatcgaaaacccaagaatgccattttcacttcctggaagcttggctcgtcgtcgtcgaaaagcgtagaactatactcgcagctcttctcttgatcaaaatcgagtcccatctttctcatgggctacctcggcatctgactgcgtcgcattcatctcatcatattcactcttatttggtgccttcgatgtcttcttctcggcgaggaccggcgtcgaggttgtcgtggagacagtacaattgcaggattggcaacaagaagtgggaaggagactttgaagctttgagatgcaccaggtgaggatgaaaaggatgagaataccaactggctcttggaaaagtggtgcatgatggcatcctgctgtggctggggacttctccattgtctgagctatgagcctgag

SEQ ID NO: 23870 - DNA, 1715 bp, Triticum aestivum
  Clone ID: PAT_TA_23870
cccacgcttccgccctcagtggcctgcctaccctttggtccactctgcctcttcctctggctgggggtcccgcagggcctctgttgtctgggatcaagaggctggtcggtacgtgtcagtgcccatgcaaacaacaagaacaggacccggtgttgagctgcctgcaagaaacccaagtttcttggcggattcaattggtgaagttctcttggccttcaccacaagggtgcttggtgtacacctccaagaatatttattgatcaggatgaagtgattccacattacgtccctgggacggttccttcaaccgttgatcctgatgctgctggatacgctgaaagagcaaacaaagccaagaagccagtcaagattagtgcccggagccttgcaaagctggacagaaacgaggtgatgaaagctgcggcaaaagctcgggcatcatcctctgttctccgaccaatagatgcccgtcatggccatgaagctgatattagctccagtggcaatgccagcgtctgcagttgcatgagtgttgactacagtgctacgccagaatcaaggagtgagatgaggctgtgatgtacacagaactcataacaacagagtcatgcaagccaggatgactatgagactggcacacagactgcaagcagtttaagcagcccggtccacatccacaagcttgcccctcatgctcaatttcgtgcagcacctcatccagctccacctcctgaaaggcctgcgctagggattacaaggccacctgttcctgccacacatataagtaacaacccaatgttccagtcagccacatcatatgtcagggagaaccgaagagcctctgttgtctgggatcaagaggctggtcggtacgtgtcagtgcccatgcaaacaacaagaacaggacccggtgttgagctgcctgcaagaaacccaagtttcttggcgaatccaagtggtgaaccaggcaaccatgggagaaatcttgcacctgccaacacaacttcatcagcgattcctccggggcagccgtccgagaggttgacgtacacaggccaatcaatattctttggcgggccaatcctgagcaccactggcgtaaatgcagaaaggaatgaggcgggcacaagagtgcgtcctgagacaagcagagatcccaactcccaccagcgtgacatccgtggtgagaaggctcggacaggctccttcccattgtttgagcctaggaatttctagaagaacctgctttgttggcaagtgaccttgaccggctgttttactcttctctactatgtcgtctgctcaagtgccaccgccatgacagtgggggtgatgttgatgcactgcaccccgtgcagagtcagggaactgctgaaatagttgacccggggcttcaacgatacatagataatgatgctttttagagctttattatagtgagtgaggatggcgctaactttgtttgatgttttacaaactgactgatagtcgcagttttattttgcgtgcattaggagttgagatgtttgatgcgcttggcatgtagtagcagagctgattaaactttgcccttgatgtgtagaaccttttgatttgccgctgactttgttccattacggacttcggagcgttcattccaagtctctgttctgttactgctgtaatagtagcccacctgtgaaggcattgtttccaaaaaaaaaaaaaaacccaat

SEQ ID NO: 23871 - DNA, 663 bp, Triticum aestivum
  unsure (1)..(663): unsure at all n locations
  Clone ID: PAT_TA_23871
cgggtcgaccggaggagctcgatagcccatttggcaatccagcccgtggcatcgccgttgtttattatgtcattgagtggtacttccgaggccaccgtaattgaacactcttgaaagtagtgtcgtaatttccgggatgccataaataccgcgtatgttatcttttgataatgtgggtaccgtgatttgcatggagtgaggacagtggatacataatatactggcttttgaagtgggaatttatgtccgtccgtctctcgttcgacgacgagcaccgcgctcacaacttggtgagttgccgctatatataacaacattggttcgccaacatttggcgcgaccaagatggggttggtggccaagatggttttattgctccaactctgccgtggtgtgtcngccacccgaagtgttccggtgcaccgaagaagcgataaaggggangcttttcccctaacngggagataaagcggttaaggcgccacgcatgcattacttttggttgcccaagcattgggatagacacncacannacaagtttaccggattgctcatccccacggagacataaccaaganttcaacgggacccaaagctttccgatgactaagnanagtcggatacaanagccagcgcatagnncacngcggttancaacacact

SEQ ID NO: 23872 - DNA, 261 bp, Triticum aestivum
  unsure (1)..(261): unsure at all n locations
  Clone ID: PAT_TA_23872
gaattcactagtgattagcgtggtcgcggccgaggtctgaatcagttctgacctccaagtgtggtgggttgaccactgccaattaggccagctgaaggtcaaatcgtgtgatgttcaggggtgattcggaagcgagtggcagagctgcagctccggcgaatgaagaagtgcccatcttgcccgtgtccctgctgacaaacaggagaagggtctcccaacaatggagaggaggganaaagaggaggtggggtgttaccctgt

SEQ ID NO: 23873 - DNA, 486 bp, Triticum aestivum
  unsure (1)..(486): unsure at all n locations
  Clone ID: PAT_TA_23873
cctcacttttgggggaaattggcccnggacgtnggcattgctcccgccccccnnttggcggccgcnggggtctctagtgaggcgcgtgggcgcccccgaggcctttgtaccntgatttctccctaaaattgattgccatccaaaccaatcccccccgtggccctctttcaagttgcttcggcgattcggtgtagcttgaagcctgaagcccaaagcttctcacgagtccgagtttggccgttgggtcaacatggagtgacatacttaatttgctcatggtagtgtcaggatctcgttaggagtagagtagtggaccattgcgttgggtaattttggtcttggacttggttgcaagcagctcagtggctgttgtccagcagggcagaacaatgcaatgacaaacgttccctgtctaaaaaaaaaaaaaaaaactcgaagactagctctcacctgcccggggcgggncgctaatcgaattcccncggc

SEQ ID NO: 23874 - DNA, 590 bp, Triticum aestivum
  Clone ID: PAT_TA_23874
gggcggcgggttggtggtgatggctcggctcgatccggcgccccggagcgtgccgtgggtcaggaactcgtgggccagattcccggctagcagcttgctgttgccggcccgagccggcttggacagttcggctttagctgccaggctctggggctagggctggggctggggccggggccggggccggggcggggcccagatgtgcagctcccgctccttgcgcttgcccagtgcgatacgcgccgcttcccagcttctcgctcagcgacatatcaacggctgggacctcgccacgtcagcagcgccagccaagaggagccgtcgatggggaggaaagcggtttctgatgggatatgtatgtatgtggaggatgcaaaaaaagaaagaaataaaaacaattattgggagggaaaaaaatcttcaggaggttgatggccgtggggcccaccgggggcaggacggtaacttcacagcgcaagggccgaacgagaggaggggaggaaacaacgggacgagacgagagaaagatcggaggagagacggggagagcactggaggagggggaggaggcgagagaaaattcttctggc

SEQ ID NO: 23875 - DNA, 575 bp, Triticum aestivum
  unsure (1)..(575): unsure at all n locations
  Clone ID: PAT_TA_23875
cggcgatgcatactttcctttcagatttacagaaatggagtgaaagctcagcacacgcacatgacagtaaaaaagatagcacgctcattttagtgttgtgctagctagctgcacgctcattttcaactactagtagtttgatttctagtagcatacgtatgcaaacccccggatgagtcggcaaagctatgccgacggcccccgttagccccgtcggcgtaggcctcacgccgtcaaacggccgtcgccgcccgggtagccgggcccacaggtatgccgacggccagcaccaccgccgccgcctggagtgcggcgcagcacacgattccgatgtccagggcgctcgcctccgcgtccctctgcggaaagaacatggacagcgcggaggtgaagagcgcccaaacgccgtaaaagatgaacaagacgaagggggtgaggagagcccaaacgcttacaaatccgacagcggccggaagagcggccaccgtcgcgctcacaggaaccacaccaggcatctccacgtccatggagccaaccttcttctgtgcggagtccatggatccaagctagtnctg

SEQ ID NO: 23876 - DNA, 385 bp, Triticum aestivum
  Clone ID: PAT_TA_23876
ttttttttttttttcttctgaagacacaagctttattctgaaatttcaaaatgtgcaggaaatttctaaatctctactgtcagtctatcattcaatcacagtgaagaacccccagacctcacagtaaattccaccaagcaaagtttatctgcgttgcctttccgtctagccaagcgcctgttgatccatcttccacgttgattgagccgaccccttcatcatcatcgcgaacatatctaactgctcgccgtcaactgcatctctgactgcagcggcaaacgaggtgtaccccattgtcagctgcgtagagcaatcgaatcatggctgggcactcgcaccggcaggacctgctgttttctgatatttggcttcccagagcatatcc

SEQ ID NO: 23877 - DNA, 845 bp, Triticum aestivum
  Clone ID: PAT_TA_23877
tcaagttatcatagaggacaatcccatacgaacaaaaaatggttctgattacataatattaattacttattctaacacaaaagcaaaatgcaaaatgacccgcataagaggggcaagggatgtctggatatagttcccgagattaacatgcacaagtgagatctttgagaaaataaatggcttccacaagcttaaaatatgcataaaaatacaaaagcaatcagaagtggcctctcaaatatatggtcaataaagggcattcaagtatccatgatcttgggacaaagcaaacccagtctgttgctgaatccatgaatagctggcaaatcactgaataataaaggagtcaacacaaactacctaagccagggcagaccaaaaggcatgacatagtcagaaggataagaattctcatatgaggaagtatcagtcccccttgagcagaataccgagtgataacaaatgtatcatatgaacagagtgaaactgtatgtaatggaaacttttaaactaaaagcctatggggcaagaatttcttctcccacaacacaaattttttcttcgttgcgttatcacccttgaatcttctgctgcaatacgcttctcttgaaccacacaggaaaattacagaaaacatcagtatgtaccttatcattcttgtctatttcctacaaatcctttttatcagttgttcactatgagaaacaatctcagggaaaaggtagattgatgaccaaagaaatgaaattacagaccagtatgcagtatgattgaattattagagaatctgactgctatagaaaatgcatttagtgaaacttgattattatccttcttaaaccaaa

SEQ ID NO: 23878 - DNA, 933 bp, Triticum aestivum
  unsure (1)..(933): unsure at all n locations
  Clone ID: PAT_TA_23878
gtaggcaaggtaacatgtcagtatgtattcccgtatcccagtccacaaatctgagtcgacagttttacattttactctcttgattgattcaactatgtacaggccctcccagatcacacacactacatcccctaaagactaaattacttgcaaccatttcgagaaaacaatgcttgcgagttgcaaccctagccttcttctacctaaaaactggcttctgcccggttgctgacaactgcacgtctccattcaggacggaaaccacaaacctttcagcttcttccattgacacctcacccttatacacagggaacctcccccgtcgaggcttgtacgcgagcaggagcttatcggacgacttgtatccggacttgtcgaacgaggacaggaacgcagattgtttgttgccgtccaacaaggcgtaggtgattgcgtttccagagctgtagctctgccccctgatcagagtcttctgagatatctcagacaggatgctctccagcttttccttggctttgttggacttgaaaacaccaatgatgcatactggagccttctctccacaggtttcctcgaaattggaggcgctgaggagagggattttgttttccttcggttcacttgccttggcatgtttcttagcttgttccgatgctagcttcttgttcttcttctcaaaactttctagcagggtcttcaattctttgatgccagatcggagatctttcactgaaataccatccttcagaagttgcacctcaccgcccacgcgtccgccagtaagcgccggaacattcttcacgccaaagcgttttagcagtggaagagaaacatcctgaacctctgcatcatagaatatcaagcgactgtggaacatcccactgactgctcgccacattgctggtgtgtccttctttgttgacagcaaaanac

SEQ ID NO: 23879 - DNA, 967 bp, Triticum aestivum
  Clone ID: PAT_TA_23879
agcagcacaatcatcagagtttagcactcgaatagtatttcatgtctcaaaattaaagataggagggggcataacagcctcgaattgcaaatgatacagagcattcaagcatgaacatgcatttgaaggaaaagacaaatagttatcgcgcgatggtaattggagattcttgcatgatcctctttcctcttgctgagaagacagagtagcagcctctacttgggggggctgcccgccgccgggggtgctgcaggaggaggcgtcgtgcccttggccttgtccagacgaagattggcgcgtacttccttggcagcttcgtgcacgacgaagtcgtgcacgtagcccccaatcagagtggcgcccgcaaaagtgaaggcgacggcggatccaaacatcgtgtaaattgtagtaacaagtttctctttggatcgcacttggttcatggcggcttccagcttaacgctcgttatttccgccatcagcttctcatccacctcggcgagggtgttgtagcagccccgcaccctccccacctcggtgaatacatccgtccgcaggtccgccaccgcagcgcatccgcatccaccgctcccgttgcctgagccggtgaccgcgccgccgccgccgttggccggagccccacctccgctcgctccacccccgccgttcgccgcccctcgtccattcgctggcccgccgccgttcgtcttcgtcggaaccccgctggtgtttgcggcggtcccgccggtcgtcgcaccgcggccggtggctgcagcctcgccgacggtggttgggtcggtcgagaaccttcgcgcgccgcgcccgcgctccccgagcaagctgcggcggatggcgccggagaggaggtgggagcgtgcgcggaggaggacggccatctcgttctcgtctcgtcgctgaaagagaagggaggagggtggcggcgcggagccggaaattccggaccggt

SEQ ID NO: 23880 - DNA, 553 bp, Triticum aestivum
  Clone ID: PAT_TA_23880
ttttttttttttgcaaaaatttgctacaatggccggagtttcttcattgcaggaacttgacacgaactgtgacgcagattacaaagctgtacagtgctacgtccatgctaacaggcttatttatcttcaactgacgattagattacaccatccggtagtgtcaagaaatggagtgcctgcgatccttgggcggcttcgtgcggaccttgccgccggccagagggtcgcgcacgaacgggttgagccgcccgagcttcttcatgaacccgccgcctcctcctccgccgctgccgccctgcttcttcggcagtggcggcttccccgacgacgggaagctccgggtgccccccgccgcgagcgtcggcgccggggccggcgccgccaccgacgggtccctcaggcgcatcttcatctgcatcagctccatcctcagctcgtcgttctcccgctgcagccgcgacacctcgctggacggcgcgctccggtcccgcccgttgaagcctcgcgccgaattcggcacgagcgccggggactcccccccggcgtacgactg

SEQ ID NO: 23881 - DNA, 883 bp, Triticum aestivum
  unsure (1)..(883): unsure at all n locations
  Clone ID: PAT_TA_23881
nnnnnnnnnnnnnnnnnnnnnnnnnnnnnnnnnnnnnnnnnnnnnnnnnnnnnnnnnnnnnnnnnnnngcagcgacacaaaaaaattactcgaatcgaggccaactcgaaagtgcaagctcacacagtgcggcacgacaggccaccaactcccccaccccacccatggatctacagtcccgaagcacaggcacaagcgagctgaatctcgagccccaaccaacccgagaaaggaaaccgcgggagcacagagcgcccggacatccgcctcggtctccggcccgcgatccccaattcggaggccggtcaatggcgttcatcggttcatgggcgccggcaattcgccatggcagcgagaagaggctacgatacagacatacagggcgcgtgctggatgggatggatctggtgggagttggtgggaagaggagaggagaggggagggggaggggctcacgatgagggaggcgacggaggcgatggcgagcgcgaggtagcggccgaggtaggcgtcggagaggaaggcgccgacgatgggcgccaggctggtggtgccgttgaggccgttgaggagcgtcgccgcgtccacgctccgcatgtggaacacctgcgtcaggtacaccagcaggttcgccgacgtgcccagcgtccccagcttctcgaacgtctcgttccctatgatgaagggcatggccttccagccgtggtacttgacggcgggccgcggcgggtgcgggctgtcgtcgtcgccgctgctgccgccgccgccgtccatgcccttgccggagtccatgctcttgagcttctgcccggcctcctcgtcctcccgcccgccgccgcgcattctcgctcgctccggcggccgctgcgctctcgctctcggc

SEQ ID NO: 23882 - DNA, 606 bp, Triticum aestivum
  Clone ID: PAT_TA_23882
cgccgggcaatttacctttctgtctttgaaagaagattggaaaggaggaacagggtactgaacttttatatatctgcataatctacatccgaagttaagcagtacacaaattactaaatggaggaacatggcaattttaagcttactacatgcagaattatgtcgctgcagctcttttagtactcatgtgtagattttcctacagcaatattacttgcattcagtttcgtgccgtcatggaaattcatatgtgcgttctgcagcatgttcagaataatactttgcaagggacagcagcccgatgtcgagcagtagcagcaacatgttctgcagcttcgatgaccctgatgaatctgctatagtgctcaactcctgctaggagggcatggaggagtttccccttgaactccacgacctgattctcaggttcgtaattttatcctattttttggctgttgcttgctcctttgttttctttgtagatgttctgattatttgggtgttgtaacgcttgtgcttggtagatactgttctactgacgctcacttcacctgaacggctggaccagatgatagtagatatacccagtgtagtatattgttataa

SEQ ID NO: 23883 - DNA, 736 bp, Triticum aestivum
  Clone ID: PAT_TA_23883
ccaggacttcctatttctcatccggtgatggatggcagacaatgggtggtagggaaattaaaaacattctccttcttgtttggtggcaaccctggggctggcggaggaaatccgtttggctttgatcttggtgatgttttctccaacatgtttgctggtggatcaatgggtggtagccagcatggtggatttgctggttctggtagacccagcgcgagaacttccagtcagcataaaaaccctgtcactattcaggaggttacgatgcaaacattcaacaaagaaatagctgaccaaggaataacttggcttctgctattctatacacaacaagcaaaaggtcaatttgtgcttgaaagtgttctggaggatgtggctcgttcattggatggtgcagtgagggctggcaaggtaaattgtgatattgaaaaggccctttgcaagaaaaacggggtttcagtaggtaaatcggctcgtctcttcatttattcgtacagcactgcagagaaagggtctttgcatgagtactctggagatagtgatgctaagagcctgaagacattctgtcaagaacacctgccgagactctccagacgggttgacattaaccaattcaatttcccttccaatgccttcccaaaccttcctgaagtgcttttgctgtcaacaaagaaggacacaccaacgatggggcgagcaggcaggggggatgttccacaggcggttgacattctat

SEQ ID NO: 23884 - DNA, 442 bp, Triticum aestivum
  Clone ID: PAT_TA_23884
ctcgcgggtcgacctggcattacatcgactggataatgtggtcggagagttccgacctatgatatttgcggaagtacctaatgttactagttttagaggggtggtagtatatgttcatggattttaccctcatgcggggggaacagttgtccgacctgggagatttcctggccacattaatggtgtttaccaactgggtgattttacataccttgacggagacttcacatctgagtctggaacgtctggtggaccagttaccatgggagatagagttattggagtaaatgtgcaaagtgtgggaggatcgagatgcgcggtttcccctctgacactatacatgacatttatgaattggtgtggttttaatggcggagaccatacaattgctgcgatgatacaacgccttgctgcctaatcagttttgcaatgtcaagcatca

SEQ ID NO: 23885 - DNA, 1415 bp, Triticum aestivum
  Clone ID: PAT_TA_23885
ctactgctcttttgctagtttattataaacataatctacaatgcacatgttacgctacgacaagtaccatagttctatatcatcccaaacaaaaccgtcaacacaataactaataaaagctaaagttcagacaaactagcaagcatttacagaacatgggttcgaccattacagggttctctagtatgctagtaattgctaaaatcacaacttgcaaaagcaacgatgtcgaggatagttatgctgggctaaatccttaaggacactttccaatcatcaatatgggtgatatcgtcctggggcaaaacttcccctattcatcatatcaggtgtgccgccaggtgcataaacacctagtgcaggatcatatgccccagcatacatggcgccatcaaagctagaactaccagggccaccaaagctctcatcaccaccccgcctgtagccacgcaagttccctccagcatagggtccatcaaagcctcctccatatggcccaaaacggctaggataaccaaaggaagaagacatgccttcatagcctcctaatcctggatagtaatgactgtatcgctcatggtagtgacgtaccccgccgtgaccaccaacaaaacctccatggttcctataaggaccaaatccaccactgttgtagctgctataagcatcagccagtccaccacggtcatccccagaaggatggtccctagaatccctaccatatgctgatctagaatcactaccagttgatgttggcagatttgaggatttctttggttctgctttcttgatctccaccttcgaaccagcaagatcaatcatattcccatttgctaacaaatcatctacaacctcctcagattcaaaaacaacaaatccaaagcctcgggagcgtcttgtttgatgatcacgcataatctggtgctcaaccacagctccatatttttcaaagaaatccttgaaatcatcttctgtcagtattgggggaaggccaccaacaaatatctttttagttctgaaatccttagggttggactgcatataatcttttggaatggttctctttatctcaacttgctttccattgatgacatgggtgtcctccatcactttatcaacaatagcagggtcagaatatgtaataaagccaaaaccccttggctgagatgtctgcttatttttcattatcaccgaatcaacaatctccccatagttgccaaaatgcttctgaaatgtggctagtgtggtgtcgcgcgggagccctccgacgaagatcttcccggggcttccgctgccgccaacatcgccgccgccatagcccttgggtctcgcctccgacttccccatggcagcgctggcgagaaagggtgaaggtccgtcctgggggttcggatcgcgcgtccgctcggtcgatt

SEQ ID NO: 23886 - DNA, 425 bp, Triticum aestivum
  Clone ID: PAT_TA_23886
ggcaggatgaaaaaatgttcatttctacaaatactgccttagaatcatgaatgtatattactctattcccccctattataaggaaaacaccatcagattccaaagaaataatcgaaggcatggctactccatgctgaaatttctcgctgattcctactgcacttgattgcccttccaaattaacaagcttagtatccaaatccccattacattcaacacaaattccggaaccagagccagccaaatccgcggaaaccggatcaacaaaagatccagaagatcgcctcgatcctcccccgaaaggattagagaggatcaccttccaaattaccaaacaactccgacgctcttctcctcgaaatcttcaggcagtttcttcgatccgccgcccccgtagaatccgccgcgatcttgctcgaatctcc

SEQ ID NO: 23887 - DNA, 787 bp, Triticum aestivum
  Clone ID: PAT_TA_23887
gaaagacaatgcagcttggctaggctcacaagcatgctgaaatatttgcaccaactgtagcttaatttggcagttcataaataataacaaaggctccctaggattcaggacacacaccaccgagaacaatagcatcaccaagcgtgcacaaagttcaaaccagagtgcatacagtctgcatatatattgcagaaatttatttttcatttgatgtgctgattaatcttaccaatttgccagcctccatggacacacatagtttgtgtagttcactgctcctttggctcctttgtgactagaagttcctctgcttctttcaataaggaggcgagagtcctgtaaggcttcagtgtgccacgattggcactgtataaaatcataaagctctcgagagaagacatggtcttgcaagcatcagccaaagattgtagaaagatcaccaagaagtgttctttgaggtagctgtcactgtgcttcactttcatcattgatatgaccatgttgctggcattcttcatcatgctcaggcaactagccgtgggttgactctttctccgcaccaactcattgagcttattggcaaagctggttggagaatctccaggagaaattttatcaaccagttgagccaaattatgatcttgggtgatgaatttgtcaaatattgcagcagcgagagatagtaaagccatgtgcaatttcatgtcatcattttgctgacaagttgaagtgttgttgctacggccatcatcttgtgaaacaagaacttgggcttctatgtcagcgg

SEQ ID NO: 23888 - DNA, 1804 bp, Triticum aestivum
  Clone ID: PAT_TA_23888
ggggtcaacagaaccatattatttcgcaataaaacaacagaaccatattcgaacaaaaaagaaaacagaaccggcaccggcaccgcctaaggtaggtatgcttttttttttgttccgttcagcctcagcgctttcgaagagtggcaatagtcaacgaacataggctaaaccgtatgtagctcgaactttcaggtagctgtagagagcaaaaaaaattttttccgggaaatgactgaaagatggcaccgtattttcttcagatctcaagtagatgaatccctctgaggtatgtcaagagattaagtactatatatggtgttttctcttgtcgaggcagcagcaccaaacacacaccgtcaagaatctcttctaaatgtttccgtttgatgtgtatgaccagtactcgttcaccagctcgcggaagagagatccttcagtttccatgagctgccgctcgaccgtgctccagccaatcttcagtaactgtatggcaagttcttgattattacaatgaagaccaaagctctaatctgccccatggtatgtctcaaaaatggttaacttgttacgtgggtgtaccgaagtacagcatgcaagctttaatggttgggatttgcttttttctgaaaacaaggaaccacccctaatcacccatgttgaagaacaaacctttacgtttgagcagaggaattggtcatccctccgctgctgcctttccctattgtttcactacacctcgagggtttgtcatactcggctactttcccatcgctcattgcaagtaccatgtcgcagtccataactgttggtatgcggtgggcgaccgtaataacggtgcaatgtttgaattctgtccggatcgttttctgaaggacagcatctgttgcattgtctatagaggctgtggcttcatcaagaaccaagatacggcaccttttcaaaagtgtgcgtcccaaacaaaagagctgcctttgtcccatgctccagttcgacccgtcttccgcaacaagtgaatccaatccctgttccttctcctggacagcttcaagaagttgacatttgtcaagaacctcccatatttgttgatctgagaattgcccaagaggatctagattgtatcttactgtaccttgaaaaagtgttggatcttgtggaatgatacccaaacgcgaacgcaggtcatgcaagcctattgtactgatgtccacagagtctataattattttcccatcggcgggttcaacaagacgaaacaatgcaccaattaatgttgtcttgccacttcccgttcgaccaactataccaatcttatttccagcttcaaacctgcaagtgattccatgtagtacaaggggagcatctttcctatacctgatcttcaaatctctaagctccacattaccatcttgaggccagtctggtgatggtcgattttctccaataatctctgctgcttcacttggtatgtccatgtactggttcactctttccacagagatgatttgacttgctagctggcactggttttggatagagaaaacaaaggacatattcagggataggccgtaagataatgccattcccacaaagccagggctaaaagttccttgaggaagaagagccatgacaagggcagaaaaagaaagcactgcagcactcatgatctccaaacgttgaatcagccattcagtcgctgcaaaattatagaaatatggaccagcattcttgtcaacaagttccaaatttttctcaaagaaacgatcttcttcctggaaggcccttattgttatagcccctgccctcg

SEQ ID NO: 23889 - DNA, 625 bp, Triticum aestivum
  Clone ID: PAT_TA_23889
aacatacaatgccatgatttattatacataattgttggcaagtacatgtcaagcgaaacaatttttcaacagaaatgacttcttttgagtggtgcatgtcaaaacaatgatattttattttcttgatcctccaaatttgggcgaagagaacgtaacaagagaagtgaagcaatgccaccacctagtacctggcagtaatacatgaagtctagcagccaatacaagtaccatgcgacaatcaaaaatgctgaagaatggagaaagttgagctggatcaggaggtgaaacacgggtggcctgcacgcggctctttgagtgaccggcgtcggagcaagaagttggactgatgatcgggagggaaggctgggctggctgctggagtaagccaacaaacatgtactgctgctcgcgacgaactcgacctccctaatgccatggggttggactgaacacatctcgactgtgctacggagatctaccctactaatcaacatatgcaagtctgtacatacaaaattggttgaatatgatgaacataacaaaatggatgctatttttcatatttgaatttctactaattagacttgcgaaggggaagtagatgaactgaaaagcaggaactatt

SEQ ID NO: 23890 - DNA, 1023 bp, Triticum aestivum
  Clone ID: PAT_TA_23890
agttttttttttttttgttacttttttattgcaactcagtttagtgacattaaaaagggctcatacttcatacaagtggggaacactgttattacaaatttgaatactagaaaacgataccaatcaataaggagatttgtagcttatccataattgatggaatcaatgataaatacagtctttaacaattaaaataggctttagttctagcacacgacttgtcacgcaccacagttcagcaaagcacctacttcttctcaagatgattggttccacccaccgtagttttcctcgggttgatcctcatcacgaggcctcctccggagtgaacgtcagaccgattttgatttctccacggtactcttcgtctttgacaacattgtaaacagttggtgggatgcttcctttcaagtgtacactccatccaatgggatcgtttgcttcaccaacgctgtcgtccgttccgtgccaccatcaactgtcgaggaagcttgatgacagagctccggttgcattcttcagagaagggtgaacacaaaggtttcgattcccattcaaggatcacttcccctttttcctggaggcgacggtgctcctttctgcctccatcgcggatgtgcattttagaaccgcgtacgggtccatgttgcagaggttagtcggtgttctcgagtcccttgggcctccgacgagcagcacctccagcgtcccctgcgccatcttctctccgggcctgatctgactgatctcgccttcctctcccgctcgctcgatcaggaattatatgctgatgggtaggcagcacgactgaaggtcgagactgattgctgtagatccgatcccgagccccggggttccgctgtatgtataggactcaggagttgaaaactggaacgctcggccgcgtcttcctcgcacctcccccacgtcgtcgtcacatggacgcggtggtggtagggcgcgacgagccccggggttccgctgtatgtataggactaggagttgaaaaatggaaagctcggc

SEQ ID NO: 23891 - DNA, 1107 bp, Triticum aestivum
  Clone ID: PAT_TA_23891
agttgcacacttgagcacaaactttattttttcgagagtacaccactggcatacaagtatcagcagttcagcgcaatcttggaacttgggagagttcgtgctatatgaatgttctgaataaagttcttcttccttcctacactgttacactacatatgttctgctcttggcacatcaggatggatgcggtggtggaggttcacttacaaatggggcatgaccgactcctcgtgctcgggccggtggaggttgtggaggatgtagagggaggccgaggagaggaagatgcagaccgagtagctgagcaggtccagccccgtggtgatcttcaccattttgctccgctcgaacatcttcaccagcaggatcatcacgatgacgtgccccaccttcgtcttgagctcgtccagcgacgtgatcttcatccacttcggcctctccttcagagcgaacatcccaaacagcgacgatccctgcagagcccggtcggattcggagggcagatcgttggacgcgttgctgatgaacagcccgtagagacccatcccgaagatgagcatcacagtgccagcaagatacacatcaatggcctccacgaccttgaggaccatctgccctgtatggacacctttggcgcagctcgtccagtagacgcagtacgcctctttgatgtacacgcagccattgaggaagcagaggagggagcccgccagcgacccggcgacggcgaggagagccaggaaccggaagtcgaagatgatcctctcgacggtggtctcgatggtcgtggacctggcggtgccggaaacagcggcgccgttggtcccgccgtagtcgcgcgccttgtgtccctccgagccacgcagcaccgagtccaccgcggcggtcgtgccgtcgccgccggacggcgaggccgcggcggccgaggcgacgatggcacggaaccgggacggccggtaaccaatccggctcgtcgtctccgctggccggaacgccgggccggcggcgttgacgggggcgaggcagccgcgcagcagcaggagcgccatgacccacgccgcgggtaggcccgttgctcgccgggcaatgcggagcgaggcgagcggc

SEQ ID NO: 23892 - DNA, 1232 bp, Triticum aestivum
  unsure (1)..(1232): unsure at all n locations
  Clone ID: PAT_TA_23892
ttttttttttttgncntgcaatgcngngaaaccttctcaaactgaccgtgctgtgcgaatgcaatatgggtctgcaaactttcaaattgatggacgtgtgcacatacaacatggaagaacaagagaattcagtgatgaccttgcaatagcagctagtattctgatcaacgtttgtgaataagtaacaatatctctcgaggtctattcggtatatgagtagccgctgatccagcagcacacttcgagtgcaagcaaacatcaacgcttcaagagagcttcttttcttcataaggggaccatgcatctagactacaagttcctcatacgaaagctcatcactacttgatcatgtagaattctagcatctcttgttccacagggtgagtctctcccactataatgagacagtgaaggggtggtccaaaatcaacatctagtagtttcttcatggggccagccacaatcttctgatcatcgcttccaaggcgagctacacccatacatagcgaatctggaccatatgcagatcccccatgcagttcctccacctccaaaagctgacttattgcagtgttcacggtcatgaatcttgctggttcgtacactttctttcctctgcataaggactcaagtgttggctccttaacacggatgtctagtaggcaaagagtatgcaagccaagtcgacgactgttctgaattttctcatagaaactatccggtctccatgtctctgtgaagaaaggtatagagatggtctctccatagcggtaaagttgcaacccacaaacgccaatagcattcatgacagatgcattgtggataaccttaacctctacccccatgttcttggcacgaacaaccaaatcagtgtgtgtggtcgccccaaacgggtcgccgacgacgaggaaggcgacgtcggcttccgcggcctcgctcagcatctggtccgcgcgctcctctaccatctcgcggtcggcgaccgtgatctccttgtcgtacatcttctcgaggttagcgagcgaggctgggtcgaggccgagagagaggagggaggtgtaggcctccatgtagaccttggcgcagcggcggacggcgtcgagcccccgcaccgtgatgtcgcgctcatcgccgaggcctaggccgactatgtagagcatcgccgcggtcgttcgctttctccgtgctctgtcgtctcccgtggagggagggagggtcccgacccggccggc

SEQ ID NO: 23893 - DNA, 983 bp, Triticum aestivum
  unsure (1)..(983): unsure at all n locations
  Clone ID: PAT_TA_23893
cggcgccgccctgctggtcacggagttcgacgggtgaagctggttcatcaatctcagcgcctccgactacccgctcatgccccaagatgacctccttcatatcttctcatatcttccaagagatctgaactttatcgaccacacaagcaatattggttggaaggagcatcaaagggctagaccaatcatcgtggatccagcattgcagatctcaaacaaaactgaggttctgacaacaaaggagaaaagaagcatgccttcagctttcaaaatatttgtaggttcgtcgtgggtaatattgagccgatcattcctggagttctgcatattgggatgggacaaccttcctcgcacgctgctcatgtacttcaccaatttcctgtcgtcctcggagggatacttccacacggtgatctgcaactcaaagtactaccagaacaccaccatcaacaatgatctccgtttcatggcgtgggacaacccccctcggacgcaccctctcaacctgacagccgaggtacttcgacgcaatggcgaacagcgggctgccatttgcgcactctttcacgcgtgacgatccggtcctggatatgattgacactgagctgttgaggcgagcgcccgaccgcttcacaccaggtggatggtgcctgggtagcccggtgggcggcaaagccccctgcgcctcggtcggcagggccctggcgctcaggcccgggaacggttcgcggggtgctactgtggtccttgtcgaagcctttcgtgcctgaccccgtcaggcccactcacggtatataacgctcctgtcacatttagccagttttttttagtattttggtagcgtgcgctgtgcgcggggcaaaagtgttcctgagggcggtttgttctcattgctgtggcggtaggcacagttacacggcgtgcttctgtatacttgcaactggaagctcgaagagtgactgncntcatacatgtacngcccg

SEQ ID NO: 23894 - DNA, 594 bp, Triticum aestivum
  Clone ID: PAT_TA_23894
ttttttttttgaggtgttatcttaggtgtctctagggccatttcctctctatgttgatgcatacattttcttccacgttatccaacgatctttgaattaatactatacaaaatggtgataaaactatacatgcagtttttacgttaagtaagtgctaattcccaacatatctccgagtttcaaattttgtacttatagttgcatgatgaaatgtatccatccgattgtggatcacgaattgtcgaccattttttaggtactcatatccagtgctcatatcggttgttcaccatttatttgacctgtggcttgtccacgctcctcaaagagtcctggctccgccaccaaggaggccttcaggcggggtagttcaccttggactcgtagcacttcccagcattccacccggcggggacgacattgttggcgacgagcaccttgccggaactcgaggtgagccggaaggagaatggggcttccagaggcttcccggtcttggagtccatgcaccacagggcgccccacgactgccgcctcgtgccgaactcctcgtagccttttttgccgccggcctccatgacttccacggagttg

SEQ ID NO: 23895 - DNA, 917 bp, Triticum aestivum
  Clone ID: PAT_TA_23895
gaaaatgctacacgttgcttatgtcgattgaggggtcaagcgtcacctgatttggtttcggagcaggtcaatttgattctggaagaactctcatacgttggtgaagagaaaaaagcaggcttcagtgagatctttcaaggaaagtgtctcaaagcaatgataattggatgtggtttggtgttctttcagcaggtcactggtcaaccaagtgtgctatattatgctgcgacaatttttcagagtgctggattctctggagcatctgatgccactcgtgtatcaattcttcttggcgtgctgaagctgattatgactggagttgccgttcttgtggttgacaaacttggtagaagaccattactaattggtggtgttagtggaattgctgtctccctattcttattgtcttcatactataccttgtttacgggtgctccttatggggctgtaatagcacttctactgtatgttggctgctaccagttatcatttggtccgattggctggcttatgatttcggaggttttcccgctgaagctgcgtggccgtggattgagtgttgctgttcttgtgaactttgcctccaacgcgcttgtcacttttgctttctccccactagaggacttgattggcaccggggttctctttgcttcgttcggggtgattgcggtggcgtctctcgcattcatattctgcattgtgcccgaaacaaaagggctcaccctggaagaaatcgaagccaaactgtagatccaactatctgtagtctcatcttagttagcatcttctttactgctcttattactcagctattttgtaagcgtagtattacattgagaaactacttatttttctctgaataagatatatatctaaaaaaaaaaaaaaaaaaaggcccctaagtccctagtgaattc

SEQ ID NO: 23896 - DNA, 477 bp, Triticum aestivum
  unsure (1)..(477): unsure at all n locations
  Clone ID: PAT_TA_23896
aggcgtggtcgcggccgaggtctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcaagtggcaaggaggatgcagccaacaacttcgcccgtggtcattacaccattggcaanggagattgttgatctgtgccttgaccgtaatcaggaagcctttcanacaactgcactggtccccaagggattcccttggtattcaacccctgtttggagggtgggaactggcctctgggccttggctccncttccccctggaggcgcctcctcctgtttgacctatgggaaaagaagtccaaagctt

SEQ ID NO: 23897 - DNA, 1002 bp, Triticum aestivum
  Clone ID: PAT_TA_23897
cagagcgacgactttgaaaacatatgcacatgatctaactgggtcaaagggattcgcacatgatttacaccctgagctgcacgcacgcggggctgattgattgctcccgtgcagacgcaccgtcctccgatagacaaaatctgagccacaacaggaggcccgcgttggcgcgttgggtctaactccaacgcacatcatcctgctcctcgccgtcgtctggatcttcctctccctccgccgaatcaaatgtgtcctgccgtgaaatctggcatcgcttgtcccttgcaacagccacagctgacctagtcttagcaccgacaggaacagcacgtgccgagggcacgctgcgcatgttttgctccaaggacagaaacttcttctcccaagtttcattcagtccttgtagagcttggttaatcatcagctgcacctgctcctgtgtgaatcttggctcttgtccctgtctgctcaagaaatctggggaggattttgacgatgaatcagtctgggccttcttgctggcaacaggagtaccttggtacctctcacgcttcgagctccccaactgctcttgcacaggatgggggccaagcagaggatctctggcctcctcagcatcccaggatgtggtatccttagggtgctcatgcattgctatgatttgtgagcctgcagcagcagaggggtggcctcctgcattccgattctttctcttttggtaagaaaccttcataaattcgtcttgggcccaatggtcacacaacatttcccaccatgctggttgcatccaatcagggacaaacggtttccaattcagtggatcatcatggtcgatcgacacaacggacccatctccctgtcgttcctctgaatcttctctatcgtctcccttttctaattctccattggccctaccaaccaccgaagatcctttgaacttctttgctgccaactcctctctaaccctttgcgaaaaactcagctgttgcctcattagaaagg

SEQ ID NO: 23898 - DNA, 1126 bp, Triticum aestivum
  Clone ID: PAT_TA_23898
cggacgcgtgggcgcacaaggtgattgttggacgtgagcgagcttcaggagcacttcctacagttttactgatctggacacaccaccttctcaggtctaaaattttgagttttcaggtctaaaatgtaactgatgtaaagatttgtccatcccttgacagaatccgactttttttccagctggtgcactgagggaggcgtttgatgtagcaatttatgttcgtccagcagaggatgctcttcagtggaaaattctgaaaccttattcagctttgatgtatagctggcacagtttgttaataatctctatgaacatttgtacaaatggtgacaaaaaagttcttttataaccatggaatcatgacatggaatgtattattaatgtgtataccttcaatgtggattatcgaagactactttcgtttcatattcatgcaaaaaacttctccgggaatgttgaaatttttgcttgtactgtcttttcctggagtcattgaaatatccccttgcacagaaatttgttttctactgaatttttttgaagagactctggtactaacatttaactattttgtaggaatgaagagctcaagggagcaaaaggaacaaggagaaaggagcgctcaagagaagtgaactcaaagtccaagatgcaatcttcacatagctcacaaatattaaccagtaaacactacttgattcgtgatggcattggaccagacacacaacatccagttctataataagtatattcgtgattgcattggaccagacacacggagatgctcgcttgtcgtcgaggagtgtagcttgtaatcgaagttggcgctacaaaacttgttctcaaaaccgacaaccaacttatggcgcaggttattaactcagatgttatcgaccgatccaggtttggtcctcttgtctaggagataaagaagatgatgtgaggcatcgacgagttctgagtggcttgggccaggagaatagcaaacaaagctgctcagatcttagctagggagggttgccttttaatgcaaaacttggtttagtgtttctacagattgtattcaagatgttgtaccggcccaggatgcccgctcctaaataataacaaggcatcaatttccttt

SEQ ID NO: 23899 - DNA, 634 bp, Triticum aestivum
  Clone ID: PAT_TA_23899
tcagctagtgcaacgccctcctctcctgctcatcgatagagtccagcttagctatggcgacaacgccacccaaccaccggccgccgcttctgccgttatcctcctccctgctgctgctcctcctcctcctggtccatcctttcctctccgccgggacgccgtccatcaccaccaaagccgtgccgcggctgccgggtttcgccggacccctgcccttctccctcgaaacagggtacgtggcgctggacgacggcgtccgcctcttctactacttcatccagtcggagcgcgacccggcggaggaccccgtcctgctctggctcaccggcgggcccggctgctccgccctctccggcctcgtctacgagatcggccctttctacttcgacttccatggctacacgggaggcctgcccactctgctctacaagccagcgtcttggaccaaggttagcaatgtcatctttgtggacgctccggcagggacaggcttctcatatgcgaccggagacaagagaaccatacccagtgacacaattgctattcaacagctgcacgtcttcctcgaaacgtggtttgatgagcacccacagttcttgtcgaatccgctctacatttcgggtgattcatacag

SEQ ID NO: 23900 - DNA, 326 bp, Triticum aestivum
  Clone ID: PAT_TA_23900
gatcaactcaaaagtaaattcagaaaacatttaggccatctcttctttttcatcagaagtgggcacatctcaaacatttgggtctccaactccagtccatgacttgtatttttccagcttcgtctcttcaacggcgaccctggcccttccccgcgacggcagccgagagccccatctcctcgaacagcttgtttagttcgttgatcgtctccgggttcaggaggttcctcgcccgcgcggcggccaggcgccggcgcagggaggcgacctcctcggggtggacgacgttatggtccacgaggacatcgccagcgaaggtgtcgtcc

SEQ ID NO: 23901 - DNA, 981 bp, Triticum aestivum
  Clone ID: PAT_TA_23901
cccccgcgccggaccagtcccccgtcatcgtcgaccccggccacgacgctcacatacctcccggaagcgcttttagacccacttgtgaaggagctgacacagcggatcaagctcccgcctgcccagccgccacggccgcgccggcctcggcgcttcgacctgagcggggtgccggatgggcagcttgcggccatcatccctgaggtgacgctcgggctgggcggcggcgccgcggtcacgctgaaggcggagaacacgttcgtggaggtgcaggaggggaccctgtgcttggcggtggcggcgaagtcggagcagcttccggcgtcgatcattgggaacatcgcccagcagaacatgcacgttgggtacgacctcgacaagggcaccgtgaccttcgctccagcagactgcgcgagttcctaccccgcaccctcaccctccggctctctgtagtagaccccttatgaaagcggaaaattatgggtaccgctctgtgccggcagatcccggacccttaatcgagtgttcaagattggtgccccgtatgctgggtgcggggggggctggttgcggcccatgatccctgaggtgacgctggggctgggcggcggcgctgccggtcacgcatgaaggcggagaacacgttcttggaggtgcaggaggggactttatgcttggcggtgtctgatcagttttctcctgtgtccatcatcggaaacatcgcgcagcagaacatgcacgttgggtacgatctcgacaagggcaccgtgaccttcgctccagcagactgcgcgcgttcctaccccgccccctcatcctccggctctgtgtagcttatgaaagcggaaatttgaggttccgctgggtgccggcagaccccagatccttaatcgagtactaagatttgtgggcagaataatggataactcgtgaacttgtaaccccaatgaaatacactgcaatatattcttcacgtggtac

SEQ ID NO: 23902 - DNA, 1007 bp, Triticum aestivum
  unsure (1)..(1007): unsure at all n locations
  Clone ID: PAT_TA_23902
cggacgcgtgggcggacgcgtggngaaagaaaactgtgatctcatcattgtggacacaagtggaaggcacaaacaagaagcagcactctttgaagaaatgcggcaagtttcggaagcaacaaaaccagacctggtgatttttgtgatggacagtagtattggtcaggctgcatttgatcaagcacaggcatttaaacaaagtgtttctgttggtgctgtgattattacaaaaatggatggtcacgcaaaaggcggtggtgcccttagcgcggtcgcagcaacaaaaagtcctgttatattcattggaactggcgagcacattgacgagtttgaagtttttgatgtgaagccatttgttagtcgcctgttaggaatgggagattgggcaggctttatggacaagattcatgaagtcgtacctacggatcaacaacctgagcttctgcagaaactgtctgaaggaagctttactctcaggcttatgtatgagcagttccagaacattctgaaaatgggtcctattggacaggtcttctctatgttgccagggtttagcgctgaactaatgccaaaaggacatgagaaggaaagccaggctaagattaagcgctacatgacaatgatggattccatgactgatgcagagcttgacagcacaaatcctaagttgatgactgaacacggtnattcggttgcacggggggtctgggcggctgtcaaggattcatggacatgctggaagagtacaagcgactgctaaaaccggggcaagatgaagggtccaagtccaaaagaaagggacatnatgcactaccccacatgaatgttcagcagatgacaaggcctcctcgcaananctaaacanattggtggatgggngctnatcccgataaaaatggtcaaggatacganttgaggatggtggtactgtttgnggtctccgnagcaattaacntaagcggggccgnacacancatccgaaataccggcanttgttggtantaccc

SEQ ID NO: 23903 - DNA, 1024 bp, Triticum aestivum
  unsure (1)..(1024): unsure at all n locations
  Clone ID: PAT_TA_23903
gcagcagtagcacagtgtggtccggtgctctgcttcactccactccactgcatttccctccactcaaagcttgaagacgtacggccgccatgcatgccaagccatcttctggcgcttgatctgtggtgactcaagcttgagcaagggatcatcttcttggtcaacccgtcatcctcctggtcaaactagctccgtgcaaaattaagcaggctgttgagatggatcggaaagaagctgacctccgctgtatggaagtatggtatatcaactgctatgccctgttcatggggtacctgctgatggccgttagggggctgggcttcctcgtgattacctggtccaccgtcgttctcctaggcggtttcgtctccgatctggagaagaaggacttttggtctctcacaatcattaccctcgtcctaacacctcgggtctctactgatgtcggtctgaaggggaagttgaaatatattgagtattcgatcattggtgtctcacacgctatatatgccacgctgaaccctaatggaactaatgacacctgggcacgccaactgctagcagctgttgtatggttgtgtcacctgctggtgggccctatagtagtgtgccctctagcggctctctatatgtgtgggccgctgttcagtgccgggatttcggcgtggcgcctgatagaacatgattacgtcgccaccaagaatgaagaagctgcacacctgcagccggccctgattgttttgtattctctggctatgttgcagggtctgctcttctgttacaggttttattcgagttttgcgcggaaggacttagtcaatgatgtggcgcgagcgtacaagatgaaccacatcgaagaggatgtgaaggaatacctgcgcgagaccgtgatcgggtgtgagaaggacccagcattcttcaaggagacaaacttggcgacatatgctatgggaatgatcaagtcccaaaaatcagaaaacttcctttccggngcagggattctggacgcactcttggagcaccc

SEQ ID NO: 23904 - DNA, 729 bp, Triticum aestivum
  Clone ID: PAT_TA_23904
cccacgtttccggcccatataaaaaggatgggggttcttgcattgggatgagcacaaccaaaccaataaaacaaaagcatataacagtctccgatcgagagggatccagagggcagcaacagcgagcatggagagtggtggtggcaagaggagggcagcggatgtggtggccattgccattacaatgctgctgcttctgcagctgatggcagctccgcggacggccatggccgcccgcaccctgcacgtggaggacatgaatacctcccctgtcctgcgcttaaacaccatcgcgagcgaatttgccaagccattgcgagccccattctgtaaggatacctgtatttttacttcttgcagtgaatccttctgccgctgcaggtggcccgactgcgtgaagagggatgacttgctagacgactcctcgtgatggcagcttctttctttgcgcttgaagttgtcgatcgatgctgttgatttctgtctatcatctgctcgtagctgttgtgtgtttccagccaggagtgttatgtatgtgtaattcgtgtcgggaggaaccgaatggtggtgttcaacttaatatttattgtaataataaataaacagggaagacgttggatgtgtaccttgcctgctacttatctggtacacctaaaaagtacctatggttgcctaaaggactaaaaacaaaaaaaaaacggacgcgcccctcccaaaaagaacccaaac

SEQ ID NO: 23905 - DNA, 617 bp, Triticum aestivum
  unsure (1)..(617): unsure at all n locations
  Clone ID: PAT_TA_23905
cttggtctcgacatgtggtcgtgtttggttcttggcctagagtaattgtgttcatgcttacggaccaaacatggacaaggcataaaaccatccgcccgcttgtttgcctcaagccgcaagcagaaaagtttgcacgccattaatgaactcgggagagcatcggtcatcgtgcatccattgtcggctcatcttcattacacaacactgcgtagaccaaattaatacatcttcagacatatcgttcaaacataaagttcatacataaagttcatacaagacttaaatgcaacaaacaaataactctctagctaaagcatttaaatgcaacaacaaatgcgatcaaagatcgcaactaaggtaacaattgatccaactgcgtaatgtccccaacctcctcgcccccgaccgcgctcccanctgatcttgggtcatcgncaaatcggaanatgaacncaattcanntcncccccaattctttaaatttcnccaaataccgttcccttaacnaattaacccncnaaataggncgttgaattcggtnaaactccagaaaatacatgcacttatgganattgctaaacaatnacagnnttaaggattcaacnatataaggnagg

SEQ ID NO: 23906 - DNA, 1190 bp, Triticum aestivum
  Clone ID: PAT_TA_23906
cgtccgcccacgcgtccgcaacttgcagctgccccccaaagaagtgtttccaaggcacttgtgactgtttaatagggattgagttatgctattcgggatgcaactgcagtgctgactgccagaacggcttatctcttggaacaatcaacccggctgctgcccaaggtaccaccccaacgcttgcctctggctcttctgctgcccaagatactgctcaaacgcaaccgcttgccccgagctcttctactgcccaaggtatcgctcaaccacatccacttgccccgagctcttctactgcggccgtgccaaagccagaggcagttggtgggcgggtgaagtgcaactgcagctttaccaaatgcctaaactgccaatgcacatgtttcagggagggtttgagttgcatgatgggacgttgcaagtgctatgactgcgagaacaacccaaattggctggccgacgaggattatgtggagtgcgcgtgcaaaaccaaaaattgcaaaaccagagtctgcggttgcaacaagaaactgaaagggtgtaacccaaattgcacgtgcatagggtgtcggcaccagctcgcgggggcagcggcgccgtcgtcccgtccggcacccggccgtaccgcgggcgccggcggcgcccgtcgctcggggcccagcatgctgctaggcaccgggcgttctcaccagcctccagacataccagagcatgatgcaagtcaccttacctaccttcctcccgccagtcgcctcccgtcgcctgttctccctctctcaagcacagccaggttcctgtagattccttgtaatggttggttactcgaagcaagcacggcgaaaactccatgatctgcgatgtcgttagcctcagaacgtggtgttgatcagacggatagatacttgagaacatacatatacatactcatgtaggaatatcagtcggcgtctatacataccgcgtgcctggaaagggttggttcagctacttcttatgcatacaatacatagttcctgcaaatgatttctctcttatatactttaggaatattttgatgagtgtttgaaacccaatgtagtatggatctgatgtgcataaacaaagatgcctggtggcgttatgatctgcattgcgttacataatctgatgatatgctctcactcatgtttgcatcatcatattcttaattc

SEQ ID NO: 23907 - DNA, 525 bp, Triticum aestivum
  Clone ID: PAT_TA_23907
cgcggctcccggcgaccgcctacctcgcgctgtccaaggcgttcgccaaggccatgtcggcgagcgggtacaagacggcgccggcgtactcgatcctggacacctgctacgacttcacggggctgagcgatgtgtcgctgccgacggtgtcgctggtgttccagggcggcacgtgcctcgacgtggacgtgtccgggatcgtgtacgccatcagccaggcgcaggtgtgcctggcgttcgcgtccaacggcgacgacgagagcgtcgccatcatcgggaacacgcagcagaagacctacggcgtgctctacgaccttggcaagaagaccgtcggcttcgcccccggatcctgctgatgacaggctcctgatgattatgaataagtaagctgcgtccaccaaatggttagtagctatacataaatagttacattatatacagatatgtgagaaatgcgtatacaccaactgtaagtgatggaatttggtacgcttcgatacaagtgaaaaacagagaagtggtcac

SEQ ID NO: 23908 - DNA, 1344 bp, Triticum aestivum
  unsure (1)..(1344): unsure at all n locations
  Clone ID: PAT_TA_23908
gcaaactcccggggcccgctgcccctgtcctgcccgggacatacgccaagccccgggccgctcgccgtcccccgccgcccccgcgctcccggcgacgccaggccgcgcgctgagcacgggcaactacgtggtgaccgtcgggctcggcacgccggcgtccaagtacgcggtggcgttcctcaccggcggcgacacgacgtgggtgcactgccgcccccgcccggtcaagtgctacaagctggcggcgccgctcttcgacccggccaagtcgtccacctgcgccaatgtgtcctgctccgaccccgcctgcgacgacctcgacagcaacgcctgcaccggcgcccacggcctctacgccgtccagtccgccgacggctccgaacaccgttggcttcttcgcccagggacaccctccccatcgcccacgacgccatcaaggggtgccgggtcgggtgcgggggtagacgaacagcgggcggtgcgggaagacggcggggctgacggggtctcggaccgcggggaagacgtcgctcacggtgcaggcctacgacaagtacggcggcgcgttcgcctactgcctcccggcgtcgtcgtcggggacagggtacctggacttcggcccggggtcggcgggcaacaacgcgaggctgacgccgatgctggccgacaaggggccgacgttctactacgtgggccatgaccggcatccgcgtgggcgggcagcaggtgcccatcgcggagtcggtgttctccacggccgggacgctggtgggactcccgcaccgtgatcacgcggctcccggcgaccgcgtacaccgcgctgtccaaggcgttcgccacgggcatgtcggcgagcgggtacaagacggcgccggcgtactcgatcctggacacctgctacgacttcacggggctgagcgacgtgtcgctgccgacggtgtcgctggtgttccagggcggcgcgtgcctggacgtggacgtgtccgggatcgtgtacgccatcagccaggcgcaggtgtgcctggcgttcgcgtccaacggcgacgacgagagccggccgcccgggcaggtcacgcagcagaagacctacggcgtgctctacgacctcggcaggaagaccgtcggcttcgcccccggatcctgctgattgacaggctcgtggccattattcaataactaagctgtgtccaccaaatggtcagtggctatacataactagttacatatatgtgagaaatgcgtgtacactatacaccaactgtaagcgatggaattggtacctcggccgcgaccacgctaaacagagaagtggtgacaagcatataaaaaaaaanaaaaaaaaaa

SEQ ID NO: 23909 - DNA, 1185 bp, Triticum aestivum
  unsure (1)..(1185): unsure at all n locations
  Clone ID: PAT_TA_23909
gcacgaggatcaccatctctgtggcatctgtgtctatttcccttagatggttctcctgtgtgatggttaaaaaatataaggtttgctgtgtgatattgctttcttcagtgtagtggtatagcatactgtgagcaatcaggaacaaaaacaggaggtttaattttcacaaatcggtactgcatatttttcagaagtacgtccaccttctgcacaatgcccttgcatttgttttcttatcaaataagtttctttctgtagaatttgttcagttcttgtctcactcacacctcaaaatgcaagtttgggagggcggtgctggtataactgatatccctttgatcttcgttaacttttgcaggatatgcattgtgattgaacatgagaaatcatttacctccctgtacttcannngtgtgttctgctctaaaatgacaagcacccaacgaagtgagagcgcaaaccacatgttgaagagttatatgccacctgctagcccgatgcacatttttgtgaggcagtatatgaggctccagtttgaccatgggaaggaggaaagttacgaaaggactatttgtcagaaaaactgatggaggtgtcgtgaggagagcaaatctggcaaatggcaatagagcagcatgcaagcaaagtgtacacttgtgctatgttttggagccccgtcgaaaggtttggaggcccaggaaggtagtgttggggcgtccgtcggcgtgaatgcgcttcaatgactagcaccaccggagtagcagagaggtgtagggaggccgtcgaacagccgggagaaagcaccacacgagggtctgagcaagcataccaggttttgcagcatctgcccccgtgaaggccacaagccgacgacatgccctgatcgtggagaagcacctaaacagccccgcaaacccggaaagtgcaagaactgttgaatggaaaggcgctgcaggaacacgtgcacacgcctactgggtggtgcacatatgtagtctagaagatttaaaatttcgtgtgtaatgtgtgattcaaggattttctggtgtgtgttgtgagccatgctccacgattgttcctccagtgcttaatcttagtgctgttgtattccatagtgttgtatggtaagtccgtaactcaacagaacttcccaattatgatagaaaaaatgttgggcgtgatttt

SEQ ID NO: 23910 - DNA, 1340 bp, Triticum aestivum
  Clone ID: PAT_TA_23910
ggccgctcccatccccttggccccacctcccggccccggagccttccgccgagccccccgcccgtccgccattcctcggtcgctcccatccccttggccccacctcccggccccggagccttccaccgagcccaccgccccgcccgagctccccgagccggcgcgcccgggaggagtctcgccgcccactcgtctccctcgcccgacgtcgtggtcacgcgcgagcaaggcaagaacgccaagctcgtcgccgctctggagaagcataatgtgcactctctggagcttcctcttattcagcacgtcgaagggcctgatgcagacaggctttcagctgtcttgcgggatgaaaagtttgactgggttactgtaacatctcctgaggcagctgcagtgttccttgagggatggaaggctgctggaagtcctaaggtgcgaatagcagttgttggagcaggtactgcaagaacttttgatgaagtattgcaatccaatgatggaccccttgaggttgcattttctccttccaaagctttgggcaaagttttggcctcagagcttccaaggactagtgagactgcttctaaagtgttatatcttgcatctgcaacctctggccatgaaattcacaatgggctgaaagcttgctcttttaaggtgacattgctgaacacctattcaaccgtacctgtacatgcttgggtaaaactcatgttaaacggggccgataactggccacatgctcgggtcgcctgtccaggcgcaatccgggcgtggctaaacctgcatgtcacgggtcgacaagtggagcaactcggtcgcctgcataggcgaggcgacggcgtcagcggccaagaaactcggcctggcgagcgtatactatcctgcaacccctggactcgaagggtgggtcgaaagcatcctggaagcgctcagagcccacaagcaaccgtccaagtgaggcgtcggcagctctcttgagttttctttctcggtttctgtcgtaaccttctttgttgctcactaggccccaaagtttcggagaggagcagggttgattgaccggccgctgtagcctctactgtagttggtgcatttttcaaggaacatgtgttttgttttgtttcctgctaatcacacacacgctacgcgtgcttttgcaccgtgcgtgaagggagccggggcatcatcggcatgtaaatctggtgaggcgtgcggtacgggcacggcatatgcacaagtgttccctgattcactgcaacttctcttcttcattcttttttaagagaaacttttccttttggctaagacggcaaaaaaaaaaaaaaaaaaggccccta

SEQ ID NO: 23911 - DNA, 805 bp, Triticum aestivum
  unsure (1)..(805): unsure at all n locations
  Clone ID: PAT_TA_23911
ttgctttccccattcactgctcactctgctcgccactcccctcctctgctcactctctctggaggagagagctgagcaatggcggcgtccaaggcgctgatgctggcggtgggcgtggtggtggtggcggggtgcgcggtggggctgtcgggcgcgacggaccacatcgtgggggccaaccgcgggtggaaccccaacatcaactactccagctggtccgccaaccagaccttctacgccggcgacctcatctcgttccggtaccagaaggggacgcacaacgtgttcaaggtgaacgagacggggtacgacaactgcaccatggacggggtcaccggcaactggacctccggcaaggacttcatcccgctcccgcgccccggccgctacttcttcatctgcggcaacggcttctgccagtccggcatgaaggtcgccatcaccgtcggcatcttcgatctcggcccagagatctaccccccgcccgcccccggcgccgacaacccatccacctccgcctctttcaccgcaggggcgtggccggcagcggcagcggtggtcaccgcgctgggagctgccgccatccttgtcctttagttccaaggagtatcatctgcagcgattgaccgagacatggtctctaatctagtctaattggggggcatttagctagctagctttcctgatgtaatgtaaccgcacccgcatttcgagtatcagtagaatgtactcatgaatcaccacgctagttgcaattcaccaagatagacccaaatcgcnggaaaaaaaagaagcnctgcaattt

SEQ ID NO: 23912 - DNA, 608 bp, Triticum aestivum
  Clone ID: PAT_TA_23912
catcaaccgaggaacctgatgttccaacgctgattgttcacgagagggtgaccattcgcctggaatcagaaagctatgttacactgcagtggtcctctgattccataagcgacatggtgtccgattctgtggtggccacgatcttgaacataggccgtgaaggcccaaaggctgttccgatcgaagcagcagcaaagacagaagaagaaacggagaaggtggtgcagaaggtagtatatgctctcatggtgtcgctcttcggtgatgttaaattcgcagaggaagggaagcttgttatatccgtggatggagacgtcgcgcatttggacgggaggagtggtgatgtcgagtgtgaaaatgctgcactgaaagaaagggtcagcactgcattccgccggatacagggcgcggtgagaccaatcccactttcggcatcctgacgaaaagccataaataagattcttgtatgctttaacttgttcaatgtttcctaggtaaacaaagtaggaagttcaaacttggctgacatgaaaaaaagagtgtaatactgcctgtgaaacatgagttgtaacattatattaatataaaaagtggttcagtcgtatgtt

SEQ ID NO: 23913 - DNA, 686 bp, Triticum aestivum
  Clone ID: PAT_TA_23913
ccccgcgtccgcccacgcgtccgcccacgcgtccgcgaggtgaggtccgccgctcagcgccgtagctggcggccagacgggagctgttgtggccagcgccgcccgcctttggcctgctgcgccgcgtggggtagtggccttcactgaaggcaagatggggtccgtgcaagctagctccgctcgcttcagccgcgctgcgccgcacggggctgtatccttggccggtgggaagacgggggccgtcgcggctagcaccgcccgcgtccggcgcgtccaaggctgtggccggcccgctccctcgtagaagatggaaccacagcgcgtgcacccagtcggcgggtgtggccatggccaatgccgagatgccgcgggaggtcgttgggtcgcacttgaagaagcgtgagctctatgcatctcaacaggcaaaggtgattctagttggttgcttctatccaacgttttggctaccgaatcccatgaaaataccgagggtgggcgagaaacgcggataccataaaattctgagcaaaagccgctcgaatttttcaaacgtaatttgaattcaatttttttgagctaggaatatataagtattgagctcaagtggttcacaaacaaggtgttcgcgcagtggcatgttctcgtcgtccgtcctcaacgtatgaaaggttgtggatttgattctc

SEQ ID NO: 23914 - DNA, 885 bp, Triticum aestivum
  unsure (1)..(885): unsure at all n locations
  Clone ID: PAT_TA_23914
cggcacgagggacctccccgccccacccgacgggctcgacctcaacgccgtcgttgcgccgccggtgagccaagttgccccagccccagatcgcccttcccatgtcagtgtacaagaattccgagctcgtgtccgtaccttggagagtgctttttctgatgcggattggtttttaagggatattcaaggtgaaatacagcagatgagggaggaggggcatgagaaagacaggcaaatccgatctctcgttgaagatgcaatgaagaaacgtcggtcaagccacattagaatcaagcaattcgaccatgataaagagctgatgcgtcgattctttcagggatgcaaagaaaaacttaagaagtcttctgatgcatttcgggagtataagaggatgtgtgaaggaagtggcgtgtcatcttcgggtgttatggctgatgagcaaaatcgtattcttatgatggagaagcaatcatgcgtagataacattacttggtttcggaaatatatgctatcgaggtttggagaatgtgctgatgagattgcaatactggcaacaaggactgcatacctcaacaatgaacttcaaaggctgaatgattatatacaaattccagatctcaacaatgggggtcctcaactgtgaattctacattggagactacaagggtgatgcaggtggccattgaagcttttgccatgaaggatgggaactgaagatgaggaggattgcatatattttggtgttgctgacataaccaagatgccgcaacatggtgccttaagtattattagttctgtagcctgtacccgcataccgtgctatgtaaagcctattatcaaagactcaaaatgtagcctcaccctgttcccttgtccnccagtaat

SEQ ID NO: 23915 - DNA, 1609 bp, Triticum aestivum
  unsure (1)..(1609): unsure at all n locations
  Clone ID: PAT_TA_23915
ttcccccgctctccctcgtactcccgcaaccccaccctctctcccaccccccgcgtgccagcgcaccgccaccggccgagagagacggccagacccagagagagagagagcgaacgcgggtttgcctcccatggagaagggggacgggcccgccctccagcctctgctgtgcctcgcctggctcgccgccacgctccccatcctcgccgccgcgctccccatccccgcggccgccggcggccgcctcctccacagcctcctcgccgccttctcctcccgcggcaagaccgtcaggccgtcctcctcctcctcctcctcctcctccaaggcgaagttcacagttccacagaagtacttcttgcatttctatgtggtgggagtggcggtgacaacaagcttgctgcttgcaatatgcttctatgcatatatgaaaatgacaccgctgttgccagagccatcgagttactccacaatcgctagccatcttattgggtcaaattcgttctcttttgggagtgtcctgtcgcgcaccatggaacacaagtatcgtgtctggcggactgtctttgtacttctattgatggaaattcaggtgctgagacgcctgtatgagactgaaaatgtgtttcactacagcccatcagctcggatgcacattgtaggatatctgacgggtctattctattacacggctgcaccattatctctcgctagctcttgtcttcctgaagcaatagattttatccgaggtcaaatagttgagttcatagtaaagggtcgtgcaagaatgccagacctagtcattgattcaccctctctcctaaagcctcttttaaagttggggtggtgccagtggataggtgctattgtattcatttggggatccctccatcagatccgttgtcatgcaattcttggatcgttgcgcgaaaataaagattctgatgaatatgttattccttgcggtgactggtttagtcgtgtgtcttgccctcattaccttgctgaactagttatatatttgggcatgttgatagctagtggtggttcagacatttcagtgtggttcctgttcatttttgtgataacaaacttgtcatttgcagcagtacaaactcataggtggtacctccaaaagtttgaagactacccccgctctcgctatgctatcattccatttgtattgtagcatctacaagcattccttctgtgcagtaaaaatctgtgtgttctggctagaatgcacaagcccggcatgtaaaagatattcatgtaaatgtgacagcatgtaagttaaaatgttgtgttgtgtgacttgaaatacttacaagggttctatttccagttgtaaattacgatacatactaaggtagttgggtcctgggtatgcagtaacctttatggacatatttaaggattagtagaaaataaagtcctcacagaaccggaagcatgccaaatttgacaactangctgatataagttccggactccaagaatccgacttacatggngtataacttataagtcatcttaatcatgttctgctgattaacaaaaaaaaaggggggcccgtaccaattcgcctanatgatccgatancccgcta

SEQ ID NO: 23916 - DNA, 715 bp, Triticum aestivum
  Clone ID: PAT_TA_23916
gaggaattcggcacgaggccgcctccgtcttcctccccctgcaacctcaccaccaagcgctgtccctcctcatcttctccgtcaatccacgtcacccacgcgtccgcccacgcgtccgctatacagcgcgtccactaccggcttggcgcgcgtttgccctaccccaagttctctcctcctaccacgcatggccgtgctccaccccaccagccgcccgtgctctgccgatgatgaactccagtcctggagtgcgcggcctcggtggctggctacagccacttaccggcacccggctgccaaaggtggggcggagctttggtgtgtgcgtttactgctgcggctggggcggcggtggcctggtcgtcggcgcataggggcctggggtggagtccccatgccgtggtggtggagcccgtgcccgtgagtggctggtgactatggggggctgtggtgctggtttgcagtggcggctcggttgctcgccagatctagcggctggccagcacatgcaggagctggctgggcctgtggcggaggcggcctggtggtgctgctcgtctgccgatggcccaagaattctgtggccgctcgggtgaaggcccccagttttctcttctcgttagctcttctatgtaccatcgccatatcttcagactccccttcttccctcatctctcttctctttcccgtgcttcttttctctaagagctctctg

SEQ ID NO: 23917 - DNA, 688 bp, Triticum aestivum
  unsure (1)..(688): unsure at all n locations
  Clone ID: PAT_TA_23917
gggaagcgcgccatcttcaaggaggccgagggcgggagccccgtgagcgtggtggactacgcgcagccgagcatcgtggccggggagctcggcaaggtgctggacgggcgcgcgccggagccctcgccgcacgaggccgaggccgtcgagctggtggcgtacacggccgtgcactgcgtgcggctcgagggcaaggaccggccggcgatggccgacatcgtggccaacctggagacggcgttcgcccacggcgagggcagcgcgggcggcagccgcggcgccggcggcaccaccacgggcggcggcttcggcaacagctcgtccagcgccagcctctccatgacgtccatggagctgtccggaaggctcgcggagtagccacattcgttccaggagtttcaaattgtgattagcccgggaaggaaggaggcgaggtccttggatcgtgatccgtttgttagttcattgatttttgatttgaggctagattttggaaccggagaggcctctctgtgtgcgtgtgatctgtgatgtgattatctcactcgtctcacgcattttgttcttggtggatgtacatgatcgtattgaactgatctcttctgtctcaacgtaacaatgnatcgtaattgaanccntgattcttcttnctgtcctcacaccnnnnnnnnnnnnnnnnnnnnnnnnn

SEQ ID NO: 23918 - DNA, 745 bp, Triticum aestivum
  Clone ID: PAT_TA_23918
agttaccccgcttcgtgtgggacgatttctccgcggattccgatgggctgctgttggtaacccccatctctttgctgggcctggtattgttgatggcttggagattatgggttttccaaaagggagtgggctgcttccgctttctaaaaggttacagtccggcagccttgctcatggagatgacactgcagcagctgtaaagattgccgagcaacattctgattttgtgcttggtttgatatcagtaaatcccgcatcttggtctgtggcaccatcaagcccagcgttcatccatgccacccctggagtgcagatggtttctggaggagatgctcttgggcaacagtacaccactccttattctgtgataaacgacagaggcagcgatataatcattgtggggcgcgggatcatcaaggcgagcgaccccgagcagacggccagggagtaccgcgtccaagggtggcaggcgtacctgtccagcttgtgaggaaagctgctgctcagacgcctctctcggtgtaaaacccaaatgaaatgcgctggtgttcgtgccatcgaccgaccgatcaatgtaataagagcgcctcctgtcggcgccgagtgatttccccccttgtgcctggtgtcggcggcacgcgtcgtcttgggggaaataacttcgaaatcgcggtaatagaaaccagaacgttcccatggacaaaacctgcttgcttgcttgctccttgttgctaaaaaaaaaaaa

SEQ ID NO: 23919 - DNA, 257 bp, Triticum aestivum
  Clone ID: PAT_TA_23919
aagtaggccgcgtgttacccttgaatacttcctctgttctagtagaatatatatggtgagtatggatagtttctaacgaaaagctcctttgacgcacggcgtccacgtccgctggtatgcatgtctagactatctaactgcatatgaataaccaaatcgcatttatgtagccatgtataggggatttggctctcagatacattaggtagtactatttcacatgggacaattttgtttttgttactctagattttacc

SEQ ID NO: 23920 - DNA, 529 bp, Triticum aestivum
  Clone ID: PAT_TA_23920
gtgcggcgctcgaggcggccggtcgggagtgtcgggtcacgatattgtgtggaagcacttggcttgcctatcaagtcacagtggcaaccatggtacctgaacaaacaggttgctggaagatttgtggagtaccatggtatgaccatggtgacaataagaggggctggccacttggtacccctcaacaagcccacagaagggatagcgctgatcgacacattccttcttggtaaacagcttcctacacagcgatgatggttaaatttgggatcaggtgaaatctacctatgacccaaaatgagttcaaggagagtttatgtaggaagcataacataatgcataatttcttcaaacatggtaatgttctgaattttggggctgatcctttccgtggatgaatctgtcttaaaaaaatgttgatgtcccatttagaggtgcttggtaaatttttcattgatcagctggacatgtattgatcaaattgagctagcgttcaagaaatgacaggtggcacatgctaatctttttt

SEQ ID NO: 23921 - DNA, 929 bp, Triticum aestivum
  Clone ID: PAT_TA_23921
aaggtcaatgtccacccaaatctcataatctgaaatgcataggacaaaacaaaaactcttctttttcctgtgggagcttatttattcatttccaccgtaccggctcccccacaagctcaaacaaggtcaatgaatgcgaccaccctaccacggctcgaaagcctcaatacaacacatacatgtctattctcttatttgtcacttatacaatacgcatcactagcaatcttctgcactgccacatcatcagttgatcgctcaaggactctcaccggaaagccatctatcgatcatagccaggcactcccttggcatgtactccggggctgtgtggccagcaccctttacagttgcgtatgtcagattgttggagtaagttcttgtgtaccccacaatttggtcgtccagatgccatggtcgccaacggtgtgtgatgggcaggttaagtcgtctgatccatgcttgggtgtcgacataagatattttactgtcatgatctccactgtatatcatagcccggtatcctttagtaatcaaggctaaatgatcatcaaccgtgctgttgatttcatatgtgtaaggtagattgaaatcacatcgtagccatgatggaacggtttccttgtgaatacccaaactctcccttacagcttcgtcatttgtccataactccgacaggaagtatgtggcattcctgcacacagacgaaactgcggactcggttagccttctccttccatgatcctgcaacgccggctgcttgtgaagggtgaggcttggatattctggacaaattttccccaagatgtgtacatcgtttaagccactcatgcactctttgatgtcttggagggatttggcacaatgggagttcgatggccatcgatattctcctccacaacctcctcgtgcagcctcgtagatttcat

SEQ ID NO: 23922 - DNA, 759 bp, Triticum aestivum
  Clone ID: PAT_TA_23922
tagcgtggtcgcggccgaggtgtttgtgtcaatgcaatttgcatctgtcagcggattatggcgatcaggcttggttattggcctacaggaaccaggtgctataatgcaccaatgctgctttctgatgatgacggcaatgccaaacgcaccatcacctgaggatgaagagaagaagaagaatcgggattgtcaattgtgtatttgcaattgtacaaatccgaggtctatgcgattggcggggatggaaccatgagaggagcagtggcgatattcgaagagtttaaacggcatggttggaggatatccattacatggatcccaaaaactgtggacatcggcatgatagacaggtcgtttgtgtttcaaactgcagtggagattactcagcatgcaatcaatgcggaacatgtggaggctgtgagcgctgtgaatggcattggtcttgtcaaacttacgggaaggagcacaggacacattactcttcatgccaccctgagcagccgagatgttgactgctgtgaatcttgagattgatttccacgttgaagggaagggaagcctgtttgagttcctgtatgaaaggataaagaagaaggggcatgttgtggtcgttgttgctgaaggcgctggtcaggagttaataccccagactgatgactcaacagagttaacttaatctgaacctcctctgtttctgctatatatctctatttttctgaacttaacaaccgaacagtattatatattagatcagcacac

SEQ ID NO: 23923 - DNA, 931 bp, Triticum aestivum
  Clone ID: PAT_TA_23923
gatgatgtcctattgttctgtatgtattggatggaggatgtgtcgtcgaacgacctcttcccttgttgcaatttcccacgtccatggacattgtcataatggtcaccttacggcagtgtattatttttggatctcgtattcctcaaggcgctccatccgctgattcgatgtcggccaacctgagaaataataggagcaataatccagcagaagaatttggtgaagaagaacaaggtgatatttctctcgtgtgaacacaatcattgttttcttgatgttatcacccatgtgttaatgttgtagaagatttatcatttgacttcttcttttaagcttcttcttttaagttcaatttgtgtttagttaatgaccacagattgtgatgttcatatatggggatttttttgggtcaattttgttgcttcaatatgtaggtgctactgtccatgtgtggtatataataggtcagactgctttgctagcttaattttttaactcgatattttcatttaggggtgtcctcttcagctgcatcttttgtgcagctccaaaattctatgtttcaaaacacttatttccatattctgtttattatttttaattcatgaaaactcttttcggtgtgcttgatcactccacttccatgtttatccttgcagaaaagaatgcctttatcctgataggcatggaaacaccgcttcgcattgagtgcatcatcgctaatcagctactatctatgagagcaatggatatagaagaaatatgtaaacagttgtccctggaagaaatatgcaacaacttattcagtagagagcaagggacatataagaaatctccaggcagcttcgcttagatgcatcatcttctgctaggacctaggagtcagcttgaagaacgaccttctcaggagactgcaactgacatgttggat

SEQ ID NO: 23924 - DNA, 474 bp, Triticum aestivum
  Clone ID: PAT_TA_23924
aggttcctcaaggcgctccattctctgattcgatgtctgacgatctgagaaataagaggaggaataatccagcagaagaatttggtgaagaagaacaagaaaagaatacctttatcctgataggcatggaaacaccggttcgcattgagtgcatcatcgctaatcagctactattagagagcaagggacatataagaaatctccaggtagcttcacttagatgcatcatcttctgctaggagtcagcttgaagaacggccttctcaggttaattcttgggagactgcaactgacatgctggatggggaataaccaaatttgtggacaaagacacagttcatcgcaaggggtggtgtttaggatatgtacacaaaagaggaaactttttttgtacagaaccaaattatacgatgtatttgaccactatttctaagaaatgttcatcatgtattaagtaaaaaaaaaaaaaaaaaa

SEQ ID NO: 23925 - DNA, 554 bp, Triticum aestivum
  Clone ID: PAT_TA_23925
atatatcaattgtttcccgtggtatttgccatatttttgtttcatacatctccaattcgtcactttttagttcccaagatgctgctgaaatgcagattgtatgtgcatccttggtagagtaatgcatacatggagtgtgttcattttttagaaactgaagattaatacaaagttatatggttttattttttgggtcaaaagtttgatttatgcagtacaccaattaattctcgatacatttcgcgtattcagctttttgattaactatacaaagtgctcatcttgcttcggattcaagtgatcagatcttgatgagaagcatggctgaatgtacctccaaccactagatttctgtgccaaaagtttgattgatgtaattctcaatgcatctaaggtattcaacacctccccataactgcatatactttacgatgctaattttgagttaacaattgcttaatatttcaccatgcagatatatgacatgaacatttttctaatatacataaaaagattgtgcatgtgctatttgtagttttttgtacctggtctaa

SEQ ID NO: 23926 - DNA, 758 bp, Triticum aestivum
  Clone ID: PAT_TA_23926
tgtaggtttgctatcaactctcaaaaaaggaaaaacaactttactctgttttttggataaccttcctgtagagtacctcgacagagacaaatatgcgatcacggatatattcgattgattttcacgcaaaacttggaggatatttttgcaggttcattgcttgttttattgttttcttactttctgttcttcaagacaatatcttcctagcagtgatctataaattttaatccatctttttgttccttttgattatcatggcgtactcatcctgtctaatccaagcaagggccttcatgtttgcagatagtttgatgctctcatggttaatctttttcttggaactattggcatgtagaggaggctgcgttttatttgctggtgcgttaggcacataagaaactggctttgcctttttcacaaaccaagctagggctagcttctgatgtatatggtcccggctccatttttattgtcaaaaaaattaagtacaatgctaaatgtgttggttcacatgccaattgttcatggtcttcaggccttgatcttactatcctatctgaatattccttttatgggaatcacaggtttatgtgattggcggggatggaacaatgagaggagcagtggtgatattcgaagagtttaaacggtgtcgtttgaggatatccattacagggatcccaaaaaacttggacaatgacatcgaaatcatagacaaggcgtttgggtttcagactgcagtggagagtgctcag

SEQ ID NO: 23927 - DNA, 711 bp, Triticum aestivum
  unsure (1)..(711): unsure at all n locations
  Clone ID: PAT_TA_23927
aagaccacgttcctcagggatcccagaatctattagacaatatggtagtccaatgcttttttgaagtatatattggcactatgctgaaaaaggacatggcaggaagtgaagacagccagtcatcgcgccatattcccgtgagctccattcatattactatatgcttaaaacgtcgtgctctccttctctacatcatgtggtttgctatcaaactctcaaaaaggaaaaacaatgttactctgttttttggagaaccttcctgtagagtaccttgacagagacatatgcgatcgaggatatattcgatggattttcacgcaaaacttggaggatattttttgcagatagtttggtgttctcatggttattttgtagtgattttccttccgttcattacttggtaaccatctaccgcagctcagctattgtccagttgctgtccttatggtcaagatccatgaataggagcaaggcatcacaccagctctgagaagaaaaggatatgaagacaaagatagaccagtgttctgctccgaagcaaaaacattttgcatgtaataatgaactataatttaccacaatctctctaaaataggcctacctattaccagtccgttgcttgcttttgtattaggaagtatgacccagtcatatatatttacattcacgttgtttagttatggtttgtagaanaaattaccttttaatcga

SEQ ID NO: 23928 - DNA, 416 bp, Triticum aestivum
  Clone ID: PAT_TA_23928
atgcaagaaacataacaccagcgaattatcaatcaacttctcaagggtgcaaaagcagtcacacactcgcatacgaagggactaaacatatacattgtcccaagcaaaatagcatgaactttaggtctctaaattatgcaggcgccgttgtagcaggccacaggcgacagatactagggtaaaaaaagggtaggggggagtgactgaagtgcttaatcgaacagactgaaacccatgtcttcatcaaattcttccttctcttcaaccttctcctccttctttgactcagcagcaggtgctgcgccaccaccagatgcagcagctggagctcccacagcaatggcacccccacctgaaggcacaggggaaaacttctcccttccagatgcaatcacttctgggatggccttgccttt

SEQ ID NO: 23929 - DNA, 982 bp, Triticum aestivum
  unsure (1)..(982): unsure at all n locations
  Clone ID: PAT_TA_23929
tctctcctcgcgccatcgtcctcctcatccatctcccgattcagccaagacaacagggatcaagactgtattatgttgaaaaaaggaaagagactactcttttgttacttacattacagatatatgttataacattacctttatgctctctttggatttcattttgtgcctaccaacaagtaagtcactaatatcaatgcctaagaattattttgtttgccattctaatcatgactgcagagagcaatggatatagaagaaatatgtaaacaattgtcccttagaagaatatgcaacaacttattcagaagagagcaagggatatataagaaatctccaggcaacttcgcttagatgcatcatcttctagtaggagtcagcttgaagaatgaccttcccaggttaattcttgagtcagtgttttggcttttctccattggttcgtaaaatgttgttcctatgttgcgggagactgcaactgacatgttggatgcgagactgcaactgacatactggatggggaataaccaactttttggccaaagagctacaaccaaggacaaagagttcatcgcaagggggtggtgtttaggatatatacacaaaagtggaaacttttttttgtacagaaccaaattatatgatgtaattgaccactatttctaagaaatgttcatcatgtattaagtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagtgggcgtgcctctataaaaaaatccaaggtccctaaattcaacaacgcggacgacttgagatattctttagggtaaccaaaaataaattgccttgcaccaaaattaaacatcttgcagcttgggaaaaaccttggcagtcccaaacttattgaccttgcaaacaattccccttcttcaatttggattaatacccaaaat

SEQ ID NO: 23930 - DNA, 1034 bp, Triticum aestivum
  unsure (1)..(1034): unsure at all n locations
  Clone ID: PAT_TA_23930
cggacgaggtccacagccgccactccctccctcctcctccctcgtctgccgccgccactccctccctgctcgtcgcccctgtctccgccctaggagcttcgccgcctcccgcgcgctcgtcctctcatctcccatggaggggaggggtggggatgtaggggaaggaggaagccggcgaggaaggcaagcaacagcggggaaggagctgggtgagcgatcctagcgggtaggaaggggcagggtgatgcctcgcgcacatgccggcggccggcaggtcgaattgtcgcgccaccgcgtcgtcgcctcctctgcgccatgaggcgccacctctgcctccaccctccaccgggcaaggagctcgagatgaacaggcggtgggaaggtgagaggaagcaggagctatctctccttcaatggctgccttgtgcatctggagtataaggaggacaacacgtgcctgttggaggcgactcgagcaacgcaggccagcggcgaactagatctgacatagaagaccacgttcgtcagattagaaagtgatcttcttccaatggctttaaatggatgtgcactcttgtctccgtcgttatacctattttggaaatcccatgggcagatgctgtgcttttgtcggacattcgtgcattgtgttagagagtcgccaggattgaagaaagccaccgaatgatcattatatttctcctctggctctgatcttctatttgacacataattgtgttttcagttgctgtttagtatggattgcctccaatggtttgccattagggcaaccaacaacaatacaggcgggtttcaagggccttggtccttgtggtggcatgtgctagccctcggtcatgcagtcgttgcgaattggtttggggcatgcgtgccttgggcatttcccaggaaggggcnctgaactgtgggggcctgggccatggcatttgccgttggtgggctgcaaanggttcaacctgaacgccagcgaagggggaccgacttgcgctgtggaaggggtcgacttgggaacg

SEQ ID NO: 23931 - DNA, 684 bp, Triticum aestivum
  Clone ID: PAT_TA_23931
aaaatggaatacttggaggtgtactgcaggaaggtggacgatgccaatcagaccagggtcaagcagcagcagtctgtggccactaaagaagctgaggttgatatgttagtggctactctaggggagcacaagttgtatctcaagagatccaggcagcatctagattgctgttatcatcctccatcaacaaaaccatggggtattttcggctctcttctatgtctctgttccaatgataaactgtcgtttgattctttttgtgtgtggcatgtctgcttattttggcccctgttaattgatgctaactatgctggccatttgtgcgtgcctaggtccttgtgggagctgcatacaaaccttgtggatgtatttggttggtagctgcagcagcctaccaatcggataagagaagccaaggggccatcggcgatggtgtagcttcagcatcctgtcaatcgaaggagaggccaaggagtcatcggcaagaagcaaccttatcctggaccttgaagtggagtaatggttaacaatgttttatggatcatatgttttcttttgttcacacttgagagctacaagcattaagatgttatgataaattatgtaccaaagtttgctttgtccgtggtcatatctatatgtgttaatttattttcctatagtcgtatcgatattattatccct

SEQ ID NO: 23932 - DNA, 470 bp, Triticum aestivum
  Clone ID: PAT_TA_23932
tggactggaaaaatatcttgcgagcccacctcccgcgtctccatcgacctagccgcctccatgctcatgcatcctcccgcgtcaatggcgcccaaacctcctcatcttggatcccgtgggaccgaggtgcgggcatggaggcgagcatccctggcggccacggcgacctacaggcaaagggtggcggtgggggcggcgctcgattagatctgcgggagagagagagagaggatgagagggagagataaggaagaagatgagggagagagagagagagagagagagagagagagagagtgagagaggaaaggggagaggaagggcttctacgtcaccgctctctggatgcacgccatccacccgcacacgctcgccaccaacctcgccgacttcgccaggttcggcttcctcaaggacctccccgagatcctctatcgtttcctccgtgacccccgcgatgagcgcaagga

SEQ ID NO: 23933 - DNA, 892 bp, Triticum aestivum
  Clone ID: PAT_TA_23933
ggcaacatctgcagtacaccaattaattctcgatacatttccgcgtattcagctttttcattaactataccaaagtgctcatcttgcttcagattcaagtgatcagatcttgatgagaagcatggccgaatgcacctcccaaccacttagattttctgtgccaaaagttcgattgatgtaattttcgatgcatctaaggtttatgtgattggcggggatggaacaatgagaggagcagtggcgatattccaagagtttaaacggtgtggtttgaggatatccattacatggatcccaaaaaacttggacaacaacatcgacattatagacaaggcgtttgggtttcaaactgcagtggagagtgctcggtaggcaatcgatgcgacacatgtgaggttgtgaatattgtggatggcattggtcttgtcaaacttatgggaaggagcacgggccacattactcttcatgccaccctgagcagcctgagatgttgactgtttcaatcctgagatcgatttccatgttgaagggagggggcatgctattgttgttgttgctcaaggcgctggtcaggagttgattccccggattgatgaccagaagcgagagcaggatgagtatggcaacatgttgttcctttagcgttggccttcttctataaagtttacatacaattcacctgcatggttaaaaaagctactatactaatgtaaatgttctgtttctttgaagattactcatttctcttactgttgttgtatcgaaacaattgtgttttggctgcttgcgctcattttataggagattgagatgtgggacaagctactaccaaatgtttggttcccatcaaaccgtttatttgccagtaaaataaagggttcccctttaaaaa

SEQ ID NO: 23934 - DNA, 796 bp, Triticum aestivum
  Clone ID: PAT_TA_23934
cgcgagcccacctcccgcgtagccgcctccatgctcgtgcatcctcccgcgtcaatggcgcccaaacctcctcatctcggatcccgtgggaccgaggtgcgagcatggaggcgagcatccctggtggccgccgcgacctacaggcaaagggtgacggcggcggcggcgctcgattagatctgcgggagagggggaggggatgagagggagagataaggaagaagatgagagggagagagagagagagagaggaaaggggataggaaggtcttctacgtcaccgctctctggatgcacgccatccacccgcgcacgctcgccaccaacctcgccggcttcgccaggttcggctgcctcaaggacctccccgagatcctctatcgtttcctccatgacccccgcgatgagcgcaaggaccaggacgacgtcgccgcggcggccccgggggcaagagcggcaagcggcgctgcgtcgacggccttgccgccgccgcggctgaggccaccaaggcccggcgcgagaaggaggcggagcacgcgcaggccatgctcgcgctctacgactctgacaaggccttccgcaacctctacgacggcgtcgccgacctcttcgtctggctgctcaagtcggacctggagcacctgcgcacgggcgacacggccaagatcgtgttcgccgccaagtgcgctcgtcgtatccatgggtctccattgctccatgggtgccgctggctgagtttgattcaccttattgtcgcctgcctcgagccgtgattccttctaaataacactagtgc

SEQ ID NO: 23935 - DNA, 619 bp, Triticum aestivum
  Clone ID: PAT_TA_23935
tagcgtggtcgcggccgaggtacaagaggcgtcctggctgtgcttctttcttctggcccatggacattgtcataatggtcaccttatcgcagtgtattatttttggatctcatattcctcaaggcgcgccatcctctgattcgatgtcggccgatctgagaaataagaggaggaataatccagcagaagaatttggtgaagaagaacaagaaaagaatacctttatcctgataggcatggaaacaccggttcgcattgagtgcatcatcgctaatcagctactattagagagcaagggacatataagaaatctccaggcagcttcacttagatgcatcatcttctgctaggagtcagcttgaagaacgaccttctcaagttaattyttgggagactgcaactgacatgctggatggggaataaccaaatttgtggacaaagacaaagagttcatcgcaaggggtggtgtttaggatatatacacaaaagaggaaactttttttgtacagaaccaaattatatgatgtaattgaccactatttctaagaaatgttcatcatgtattaagtacattttattgtgtcacttttttttgaagtgtagctttattcatcaaaca

SEQ ID NO: 23936 - DNA, 1017 bp, Triticum aestivum
  Clone ID: PAT_TA_23936
atctggaggtgcctgttgcaggcggctcgagcgatgcaagccggcggcgaactagatcatgccatgttttagcgctcatggagttcctctgtcatacgttgagtctggtgatccttacaaaacatatatggaaggctatggatcttatcatggatgagctcgaaaatataggaatttcaaatccatgtatacatcacactcatacccgaaactgaacagggacaagcacatgcaattatatgctgtggtagatttcaaaagagacccatggctcagagtagttttgcgcaaatgaaggataccagactgacccatagagcatgagaccctctttgtcaggggccaccttacttgtatggcctcgggctgaggggacccttctaataagttgttgcagatcctatgcgcctgcctccttcctccagctgcgtgaaggctaacgtgaggagctgacgagctaaagaaggagctggagcaggactgtaggagggagttacactaggggccggagcaggacaaccattgtttcagatccacttgactcatcccaactggttgcaatgtccatggacattgtcataatggtcaccttatcgcagtgtattatttttggatctcatattcctcaaggcgctccattctctgattcgatgtctggcgatctgagaaataagaggaggaataatccagcagaagaatttggtgaagaagaacaagaaaagaatacctttatcctgataggcatggaaacaccggttcgcattgagtgcatcatcgctaatcaactactatgtatggtcagcggacatgcatgcttattcccgtaacatatcattactctatctccttagcctttctaacttttaagatttgatcaattctttagaagttcgtacagatctagaagtatttggttttgttggtcaaatccattacctgtatgtccttatttattttattgttcgaacaagatatcagatcacctacattcattattcttgattacagtctcatact

SEQ ID NO: 23937 - DNA, 818 bp, Triticum aestivum
  Clone ID: PAT_TA_23937
aggaagtgtgcttcacacttctctttctgcaatatgtttcagagtatatgatttaattttcctacttttccagttaaaatactgtgtacttcattcttagctttgctttaggaaaaataggtatgcaggttatcgaaagctccatttttcaccattatatagattatatagctttgtggtcgaaggtaggttgtcacatatgggatgttgcttgtgaaagttatatacagccatgagtccctgacaaaataatcgtagctcatattattaggatcagggaacctcgacaatttttctgaaacatgtcgcagctcatgttcctactttcccagctacagtatgtacttcattcttacctttgcttttggaagttacattgctttcttttccctcataaacttgctaacgatattggcgaagtaatccccacttcagatttcccattgaatgaataactaatttagtttgttcaaaaattgtaggtcaagagccatgaataggagcaaggcatcacactccagctctgagaagaaaaggatatgaagacaaagatatcagtgttctgctccgaaacaaaaacattttgcgtgtaataatgacctgtaatttaccacaatctctaaaacaggcctacctacttgcttttgtattaggaagtatgactcagtcatatatatttacattcacgttgtttagttatggtttgtatgcatgaaaataccttttcataaacgagcttgaaaattcttatgtgcagtgaaattgtatcttagcactttgtaaagaacgaatgaaacacatttcgaataactctttag

SEQ ID NO: 23938 - DNA, 1239 bp, Triticum aestivum
  Clone ID: PAT_TA_23938
gctctccctcatcctctcctcacctgcagccgccggccttgtctctccactcgcctcctcctctcctctaccacgtcgtcgttgatccaccgccgaccttctcctctgcttacctcctcctgtcctcttccatgttgccgtcgatccagatcggacgtatcgtcgtgggggagcagcgccggcagggtcatcgcggtgcaggtgtggggtaggatgcaacgacaaggggaaggaggaggccggtgaggaagtcaagcaacaagcgggtgggggtaaggggcagggtgaggcctcgcgcacctgccggcggccggcgggtcgacttgtcgcgccaccgcgtcgtcgtctcctctgcatcatgaggtgccacctctgcctccaccccccgccgggcaaggagctcgaggtgaacaggcggtgtgggaaggcgagaggaagcaggagctcatgtctcctccaatggatgtctcgtgcatctggagtacaaggagaacaacacgtgcctgttggaggtggctcgagcgatgcaggccagcggcgaacttgatctgacatagaagaccacgttcctcagggatcccagaatctattagacaatatggtagtccaatgcttttttgaagtatatattggcactatgctgaaaaaggacatggcaggaagtgaagacagccagtcatcgcgccatattcccgtttgctatcaaactctcaaaaaggaaaaacaatgttactctgttttttggagaaccttcctgtagagtaccttgacagagacatatgcgatcgaggatatattcgatggattttcacgcaaaactgggaggatattttttgcagatagtttggtgttctcatggttattttgtagtgattttccttccgttcattacttggtaaccatctaccgcagctcagctattgtccagttgctgtccttatggtcaagatccatgaataggagcaaggcatcacaccagctctgagaagaaaaggatatgaagacaaagatagaccagtgttctgctccgaagcaaaaacattttgcgtgtaataatgaactgtaatttaccacaatctctctaaaataggcctacctattaccagtccgttgcttgcttttgtattaggatacattcatgttgtttagttatggtttgtatgaatgaaattacctttttaatcgagcttcaaaattcttatgtgcagtgaaattgtatctaaaaaaaaaaaaaaaaaa

SEQ ID NO: 23939 - DNA, 1522 bp, Triticum aestivum
  Clone ID: PAT_TA_23939
gaggctttgtaataaaaatttggcagtcaacttgaaacgggtcatttatctagctacagcaaccttccttgcttttgcaaataatactgtatggttgacactatagtctatacctgccaaatatttacacgttagtatagccagaaagttagatgatcgttccatgttggttaggcgtgataaatcaaatttctagagtagcagatgattcgtgtcaggtttcttttagagattgaaatatgtcttgactctgaaattagtagtacagtgtccagttctccataggtgaaagcatactatgcaaaactggacggccttctaaagctctaaaactactatttgttgtgtaatctgtatccctttttcatactttgtatatgctttctacttactaggaaaaaaatgcgtgagaacgatggcctagaggatgtgaattgcactcaaatatatgcaggtttcttgccaaactaactgccactattgtatttcaggtgcttcttctgtaacttagtgtattttgctggctcgtctcatttcctggcgaactttttagtatgtacagtcgaatcgttggaagttgttttctactatctatagaggttttatccaaactattagctgcctgacttgcttttttgaaatataccaacctgatagaccaagtggacccacacatttccatgggattttagaaaaatatatgtgaatttgcatacattttctaaatttctatcttttcttatccatgcttccccatagatatatagcaggctcaacaaaaatgaatgtccgattgtgtccaaatttcaaggaagtgtgcttcacgcttctctttctacaatatgtttcagagtatatgatttaattttcctactttcccagttacaatactgtgtacttcattcttagctttgctttggggaaaaataggtatgcaagttatcgaaagctccatttttctccattatatagatcatatagctttgtgatcgaaggtaggttgtcacatatgggatgttgcttgtgaaagttatatacagccatgagtccctggcaaaataatcgcagctcatgttactaggatcagggaacctcgaccatttttctgaaacatgtcgcagctcatgttcctactttcccagctacactactatgtacttcattcttaccttcgcttttggaagttacattgctttcttttccctcataaacttgctaacgatattggcgaagtaatcccgacttcagatttcccattgaataaataactaatttagtttgttcaaaaattgtaggtcaagatccatgaataggagcaaggcatcacaccagctctgagaagaaaaggatatgaagaaaaagatagaacagtgttctgcttcgaagcaaaaacattttgcgtgtaataatgaactgtaatttaccacaatctctctaaaacaggcttacctattaccagtccgttgcttgcttttgtattaggatacattcacgttgtttagttatggtttgtatgaatgaa

SEQ ID NO: 23940 - DNA, 1655 bp, Triticum aestivum
  unsure (1)..(1655): unsure at all n locations
  Clone ID: PAT_TA_23940
accggtccggaatttccgggtcgacccacgcgtccgcgcagttccactttcccaccgccctgaccgacagcagcgagtgcagatggatcccaccgtccccaactccggcgaccacgccgcctccacccctaccaacaccaccgtgaccctcccgccgctcaccctccgcgacgcgccgcggctccccgccttgccctccggcgccaccacgatccccaatccgatctccagccacccctacttccacccgccccccaccttctacatctccccgggcgacgtctccctccgccacgccttcttcgacctctcctccgggagcccgaacccgctggtcgcataccgccgcgcgggcccgcgcgagagcctcgccgtcgacccggcccgcgcccgcgccgccctcgtcacctgcggggggctctgcccgggcctcaacaccgtgctgagggagctcgtcgtggggctccacgagctctacggcgtcctcgacgtcttcggcgtcgccgcgggctaccgcgggttctacggcgctgacgacgaccacgtgcggctggacccggcctccgtggacgactggcacaagaagggcggcaccgcgctcaagacgacacgtggtggctttgatcttaacaagatcgtcgatggcatcgtcgcccgcgggtatacgcaggtgtatgcgattggcggggatggaaccatgagaggagcagtggcgatattcgaagagtttaaacggcgcggtttgaggatctccattacagggattcccaagaccgtggacaacgacatcggcatcatagacaggtcatttgggtttcaaactgcatgggagattgctcagcaagcgatncaacgcggcacatgtggaagctgtgagcgctgtgaatggcatcggtcttgtcaaactcatgggcaggagtacgggtcacattgctcttcatgccaccctgagcagccgagatgttgactgctgtttgattcctgagattgatttccacgttgaagggaagggaggcctgtttgagttcctgtatgaaaggataaagaagaagggacatgctgtcgtcgtcgttgctgaaggcgctggtcaggaggtgattccccggactgatgaccagaagcgcgagcaggatgagtctggcaacatgctgttccttgatgttggcccctggctgaaatctgagctgggtagatggtggaagagagaacaccccactgagttgttcactgtgaagtatatcgatcctacctacatgattcgagcagtcccagcaaatgctactgataatctatattgtaccctgttggcgcattcagccatccatgggatcatggctgggttcactggcttcgtacctggcccgataaatgggaattacagctacataccactggaagatattgccgtggccaagaacccagtggatgtgaatgatcacaaatgggcatgggttagatcagtcacagaccagcctgatttcctaaagccctaagattaaggcccaagttctgcggtgccaggaagtagtaagttgatctacccctctctggatgacagtcaaaattattttcttttaatctaggtttccgttcttcaataaagcatcagtgagcgtgttctcggtttgtgtgtttgtgtgtatgtctgcaaagtt

SEQ ID NO: 23941 - DNA, 854 bp, Triticum aestivum
  Clone ID: PAT_TA_23941
aactggtacctagcttttgaaacctctgaatatacaaaatttatttgagtagaacaggagagatgcaatcttatggatatttgtgcatttgtaagaaactttccagcttggcaagagggcttaactagccatgtgtaggactcagccatgctgccttccaaatgattagtcattggtgttttcttatgttcctgttagtccaagtgcatcagataagtagactgttatgttgaaaaaaggaaagagactactcttttgttacttacagtacagatatatgctataatatattacctttatgctctcgatttcagtatacgcctgcgaacaagtaagtcagtaatatcaatgcctaagaattactttgtttgccattttaatcgttacatcagagagcaacggatatagaagaaatatgtaaacagttgtccctagaagaaatatgcaacaacttattcagtagagagcaagggacatataagaaatctccaggcagcttcgcttagatgcatcatcttctgctaggacctaggagtcagcttgaagaacgaccttctcaggagactgcaactgacatgctggatggtgaataaccaaatttgtggacaaagacaaagagttcatcgcaaggggtggtgtttaggatatatatacacaaaataggaaactttcttttgtacataaccaaattatatgatgtaattgaccactatttctaagaaatgttcatcgtgtattaagtacattttattgtgtcactttttttgaggggtagctttattaatcaaacaccaccaaagtgtgcaatagaggtcatcaaaccaaaaaaaaaaaaaaaaaaaaaaaaaaaaaaa

SEQ ID NO: 23942 - DNA, 1138 bp, Triticum aestivum
  Clone ID: PAT_TA_23942
ggtgatgtgcggctccctctggcagctcctggccgtggtcgtggccgtgtcagcggtgacgcgggcggtggccgccctgacggctggtcggagcctgcaccgggacttcgacgacggccgggtggtggagctggcgctggaccgggagacggggtccaggctggagtccaaggaccggtacctcttcgggcggttcgatctcaacatcaggctcgtcgccggcgagtccgccgggaccatcacttccttctaccctcctacgatgagggaggtggctcggcccagccatggccctagcactcgccgtgggagagtagggcggcgccgtcgtggggtggatgaccaggggatatccaggatgccggcggtgggtcgaagaagcagagatgcagcacattctcttcctctcttccttgctgacgacgcgtcccgcaagcatttcgtaggctaaaaattgaaaggagatgtgatgatactgtcttttgactccctccatcctacctgtacagaatttatagttgccaggcatatggtgggctaatcaaatgcaagctatgaggagctaaaagaagtaggatattccgagcaagggactctactttatgggtttgattgttgtggcagaatcaatggactacaccaactgctattgaagaagtatatgtagaatgcatagttatggtgtgatagggccagtgttgttgtctgacagttgtgcattcttcaccttggatggtcaaagatatgctcgctagcctgatgctgctccatcggtggatctacaggataagagccatgaataggagcaaggcagcacactacacctctgagaagaaaaggatatgaagacaaagatagatcagtgttctgctccgaagcaaaaacattttgcatgtaataatgaactgtaatttaccacaatctctctaaaacagcctacttagtaccagtccgttccttgcttttctattaggaaatatgacttggtcatatatatttacattcgcgttgtgtagttgtggtttgtatgcttgaaaatacctttttaatcgagcttgaaaattcttatgtgcagtgaaattgatctaacacttcgtaaagaacaaatgaaacacatttcaaaaaaaaaaaaaaaaaa

SEQ ID NO: 23943 - DNA, 558 bp, Triticum aestivum
  Clone ID: PAT_TA_23943
gaattcactagtgatttcgagcggccgcccgggcaggtttttttttttttttttttgcgagaaacataactccagcgatttatcaatcaacttctcaaggctgcggaagcagtaacacactcacatacgaaggtactaaacatatacattgtcccaaggcaaaatagcacgaacttcaggtctctagatattatgcaggcgctgttgtggcaggccacacacgacagatactagggtaaacagaggggagggggggaggaactgaagcgcttagtcgaacagactgaaacccatgtcttcatcaagattcttccttctcttcaaccttctcctccttctttgactcagcaagcaggtggctgcgggcaccaccagatgcagcagctgggcgctcccacagcaatgggcaccccacctgaaggcacagcggcaaacttctcccttccagatgcaatcacttctgtgatgtccttgcctttgagttaacaagaaggaactcaagctttctcaacagctcaagcaccaactgagtcaaggtgttcttgactcagcggcact

SEQ ID NO: 23944 - DNA, 1054 bp, Triticum aestivum
  Clone ID: PAT_TA_23944
gctcgccagcagccgccggccgacctcgtctctccactcgcctcctcctctcctctatcatgtcaccgtcgatcccaccgccagccttctcctctgctcgcctcctcatgtcctcttccatgtcaccgtcgatccagatcggacataggtcgtcttcgcggtgcggatggggatgtaggggaggtgtaggatgcggacgacaagggaaggaggaggccggcaaggaaggcaagcaacagcggggaaggagaaggtgagcggtcctagcatggggaaggggcagggtgaggcctcgcgcacctgccggcggccggcaggtcgacttgttgcgccaccgcatcgtcacctcctctgcaccatgagaggcgcatcctctgcgccatgagaggcgccacctttgcctccccccactgggcaagtagctcgaggtgaacaggcggtgtgggaaggcttgaggaaccaggagctcatccctcctcccatgctgcctcgcggatctagagtataaggaggcaacatgtgcctgttgcaggcggctcgagcgatgcaagctggcggcgaactagaaaagaaggcctcctcggacattaagaaggtacaattaggtagaacttggcagaagctctacatatgcaaatggaggttcagacacagctctaataggatggtgttgttgtcggcacatatttctgataacaagaaggcctccttggacaataagaaggtacgaggcaactcgcctccaggaggcttccccgattggttgttcgttggtcgtcggatctgcttttttcgtgcatctggaccattgatcttcacagcagttaaactcagttttcaccccgcagtcgttttcgtcgtccaatgattggtgggctcgcatcgcacgttggttggctgggttgcccgtttgcaggtgcaggtggtttttcccaatcagctcggcgcgcccgcacccaatcacccgcgtctcgccccactcccaccccagccgccaaacgaaccctagccctctttctctttcccatcgatccccacgagccgccgcacccct

SEQ ID NO: 23945 - DNA, 786 bp, Triticum aestivum
  Clone ID: PAT_TA_23945
gaattcactaagtgattagcgtggtcgcggccgaggttttttttcacagagaaaatcaagatcctttcaccagataaaccattcagaacatcaaaagatcatgtgcactttcatcgaccgcaaacatcaagacatatgcgagaaacataacaccaatttatcaatcaactgctcaaggctgcggaagcagtaacacactcacatacgaaggtactaaacatatacattgtcccaagcaaaatagcacgaacttcaggtctctagatattatgcaggcgctgttgtggcaggccacacacgacagataccagggtaaacagagggtaggggggaggaactgacgtgcttagtcgaacagactgaaacccatgtcttcatcagattcttccttctcttcaaccttctcctccttctttgactcagcagcaggtgctgcggcaccaccagatgcagcagctggagctcccacagcaatggcacccccacctgaaggcacagcggcaaacttctcccttccagatgcaatcacttctgtgatgtccttgcctttgagttcagcaagaaggaactcaagctcttcttcatcagcctcagcaccaactgagtcaaggatgttcttgacgtcagcggcacttggggaagagttcccgcccagataggcgagaaggtaggctgcgatcagcttcatcgtggaaactaggaagcacctccgagatgcgcaggagaagacgcgaggacggcggcggagggggttcgtgcgtgagctagggtcccggagaggccggc

SEQ ID NO: 23946 - DNA, 2167 bp, Triticum aestivum
  Clone ID: PAT_TA_23946
taggggccttttttttttttttttttagcaaaactgataatatatatagcttggacgaagatacttgtagcgtattgaagacaaatagtgccgtcccgattaacaacaagagcaggaatcataaaaataatagactatactaattcactcagcagcctctgaattcttgctttggtgtatccatccatccatctcctcgatcgtgcctagccaataataatatccatctgatctacgctacagaaaaaagaaatattacaatcaaaacatcttgctttccccaattccatcttattcagcacctaggtcaggtggagggagtgtgttggcctttcaaggatttagaagctcgtcttgcgcggtcatctcttgtgattttgtggatagcttgtttaggtcagcgacaaccatgagccgtctctgcaagattgccgccatgaagaggaagattgaacacatgccaaacatgacggtgatagggaaagcattcacattgtagagcaccacacagacaaacaggttcagtggaatgcggaagaagttcatgatggtgcttcttgcctcctcaggaatatactgagatctcattttcatgatggatggccagaaaatgccgacgcatgactcgaaggtacagaaaccaagcagctgtagagagcccccaaacgagatgccgcttcctttcactgaagacgtcggcacccagaaggctggtggcaaccgggaggaaaagggtgaaggctgatactgcaaacacgatctgcatataaccttcgaccttcatcttccgggccaacaggcgtgatgcaatggagctacccagcatagacgacagcatgaaggtggcaaatatgaagccatgaggaatgtcttcgtcatttgggctcaaggctggagtccagaggaagacaaaggtgtacatggagccctcgaacagcgactgaatggctcccagcaatgcgattttctcatctgaagcaattgccttggcggcaaccttgaactgagacatgagatccttgccttcagattgatctccgtagttttcactccatgaggacatgatgatggccatgcctattgccaggaagcaagcggcagcatcaaatggagcgacagggctagtctcgagttttttttttttttttttctatatcggtttccatatatgatatggaaacatcttgcatgtcaaacagtattcagagaaggcatgcctatttcaccatttgcattgataatttaatagagcagacattgacctattgcaacaacctgctactgcgcatgcacaccttattacaaagctgacaggacgatcacctaaagaagcaacaaaacagcggacacggcgaccgcgccgagcagaccaactccgccggagacggcgtgacgggaagaggagcttgccggaccaggcgctggggcgggcgcgtgatgatgtggtgacggcgcaggggaatgctgagtgggcgcgtgagccgccgctgtaacttgttggctgccaagccgctcggtatggttggggacggatgttgacgaggacggagagtgcgccggaacatggtgatgatgatgatggcgatggcgatggtggtggtggtgagccggcgccggtgctgtagcgtggtggccgtggtggtgcgggcttggtgccttgtgtagctcgtcggcgtcgaggtggtacggcgacggcgcctcagagtgatggccgcggtaccactccgtgtctgtagaagtgtccagctcatccgcgtcgatgtggtggctcggcgacggggccggagggtggtgatggtggtggtggctcggcgacggggccggagcgtggtgatggtggtggtggctcggcgagggggccggaggatggtgatgatggtggtggctcggcgacggggccggagcgtggtgatggtggtggctcggcgacggggccggagcgtggtgatgatggtggtggctcggcgacggggcaggagcgtggtgatgatgagcgctcggcgcgggggcaagatggccaggatggtgagcggggctgggcgcttgagccggcgcgtggtggtggtcctcgtgcgccgaggagagcgcgaccagcgaggccagcagcagtgccatcaccacggcggttggcgagagaggagtcgccatggcaacaagcttgggagtg

SEQ ID NO: 23947 - DNA, 761 bp, Triticum aestivum
  Clone ID: PAT_TA_23947
ttttttttttttttttttagagaaaatcaagatcctttcaccagataaaccattaagaacatcaaaagtccatgtgcactatcacgaccgcaaacaccaaggcatgagagaaacataactccagcaaattatcaatcaacttctcaacgctgcggaagcagtaacacactcacatactaaggtactaaacatatacattgtcccaagcaaaatagcacgaactttaggtctctagatattatgcaggcgctgttgtggcaggccacacacgacagatactagggtaaacagagggtaggggggaggaactgaagcgcttagtcgaacagactgaaacccatgtcttcatcagattcttccttctcttcaaccttctcctccttctttgactcagcagcaggtgcggcggcaccaccagatgcagcagctggagctcccacagcaatggcacccccacctgaaggcacagcggcaaacttctcccttccagatgcaatcacttctgtgatgtccttgcctttgagttcagccagaaggaactcaagcttttcttcatcagcctcggcaccaactgagtccaggatgttcttgacgtcagcggcacttggggaagagttcccacccagataggcgaggaggtaggcagcgatcagcttcatcgtggaaactaggaagcacctccgagatgcgcaggagaagacgcgaggtcggcggcggagggggttcgtgcgcgagctagggttctaccgaacccggccggc

SEQ ID NO: 23948 - DNA, 2549 bp, Triticum aestivum
  unsure (1)..(2549): unsure at all n locations
  Clone ID: PAT_TA_23948
taggggccttttttttttttttttcgagacaagaaaactagacaaatcactaagacggcagaaactcctctgcctagaagaatcctcactggcacccggaatagggtatacaggggtacaggctatagctttcatcaagagactggttggatttaaatacaaataccatcatcctattagcaaacgtaagaataggagggaaagtacagatccggtactatgccaaagctctactgtgcagtgcatatatctcaatacatgccgagccgtgtcctctctcccgacaaaactgaataccgtgagagcacctaacaaagcaaactaaacgaggttttgttgcagccttcggtttcccatcttattcagcagccctgcagagaagcagatgaagttggagaccgttccatgcccggttcacgtcaatggctgctggtgtgtttcaagggtttagtggctcatcttctgctgtcatctctgcggctttagttgatctgtgaaggtcggacacggacatcagccgcctctgcaaaattgctgcgatgaataggaaaatggagcacatgccaaacatgacagcgattgggaaggcattcacattgtaaagcaccacacatacaaacaggttaagtggtatgcggaagaagttcatgatagtgcttctcgcctcctcggggatatattgagatctcatcttcatgattgagggccagaatatgccaacacatgacgatgagatctcaatatatccccgaggaggcgagaagcactatcatgaacttcttccgcataccacttaacctgtttgtatgtgtggtgctttacaatgtgaatgccttcccaatcgctgtcatgtttggcatgtgctccattttcctattcatcgcagcaattttgcagaggcggctgatgtccgtgtccgaccttcacagatcaactagtatgttgtctttattcgtttcaattttgatgcaagcaaatgccattttctctcttggaattagactccgacttaacaaattgctaaccacaagatcaaattcctgcagaagccgcagagatgacagcagaagatgagccactaaacccttgaaacacaccagcagccattgacgtgaaccgggcatggaacggtctccaacttcatctgcttctctgcagggctgctgaataagatgggaaaccgaaagctgcaacaaaacctcgtttagtttgctttgttaggtgntctcagggatatattgagatctcatcttcatgattgatggccagaatatgccaacagatgactcgaatatgcagaaaccaagaagctgtacacagcctcccaaggagatgcttccacctttctatgagaggggtactatgaaattggtaacaacagggaggaaaagagtgaaagctgatatcgagaacacgatctgcatataaccttcgaccttcatcttccgagctaatagacgagatgcaattgagctacccaacatcgaggagagcatgaatgtggcaaatatgaagccatgaggaatgtcttcgtcatttgggctcaaagcaggagtccacaagaaaacaaaagtgtacattgaaccctcaaacagtgactgtatggctccaagcaatgcaatcttttcatcagaagcaatggctttagctgcaaccttaaactgggccatcaagtcctttccttcagatgcatctccatagttctcaccccacgacgataagatgattgccatgcctattgctaggaagcaagcggcagcatcaaatggagcgacagggccaaaacccaagttatcagccagtagatttgcaaatagccctgcgacaatggcaactaggccattcccaagaaatatagccttggagaatgttattgacagccactgcggatcaaaacctctcttgttgtgctccgcgacgagccacgactcgaacgccgagaagagcagcgatgttgcaatgcctccaagcacgcggccaatcatcagaatcctgtactgcggggagtgcttcgtgatgcagctgaggatgtaggtgatgcagtaggtgatgcacgccctcttccttccctgcttgtcggcgagcgacccgacgatggtgccgaagagcatggaggagccgaagccggcgatgaagaggcggccgatgtcgcccttgtcgaacccgtactggctgtagaggtagtacacgtagggcccctgcagccagtccccagacatcatgagggagtagacgaggacgtagttgttcttgaaggagttgaaggccgtcggggtggccacgcggtccttgccagacttgccgagctccagcgccgccacgacggcggcgaggccgccgaagacgaggtagtagaacacctccatggcggggccgaggtgcggaggggatcgcgattcgggggctggcgaatgcgattgggtcggtttgttataggagaatggattttatacgcgcagcggcgggcgtgtcatctcattctcatctgcgtcgaatttcggagcagtgggcactgagggtgcgcgtgccagacgttttggttgggtcgc

SEQ ID NO: 23949 - DNA, 851 bp, Triticum aestivum
  Clone ID: PAT_TA_23949
gcacagagaaaatcaagatcctttcaccagataaaccattcagaacatcaaaagatcatgtgcactatcatcgaccgcaaacatcaagacatgtgcgagaaacataactccagcgatttatcaatcaacttctcaaggctgcggaagcagtaacacactcacatacgaaggtactaaacatatacattgtcccaagcaaaatagcacgaacttcaggtctctagatattatgcaggcgctgttgtggcaggccacacacgacagatactagggtaaacagagggtaggggggaggaactgaagcgcttagtcgaacagactgaaacccatgtcttcatcagattcttccttctcttcaaccttctcctccttctttgactcagcagcaggtgctgcggcaccaccagatgcagcagctggagctcccacagcaatggcacccccacctgaaggcacagcggcaaacttctcccttccagatgcaatcacttctgtgatgtccttgcctttgagttcagcaagaaggaactcaagcttttcttcatcagcctcagcaccaactgagtcaaggatgttcttgacgtcagcggcacttggggaagagttcccgcccaggtaggcgagaaggtaggctgcgatcagcttcatcgtggaaactaggaagcacctccgagatgcgcaggagaagacgcgaggacgcgacggcaagtggaaggcggcggtaaagcactacaaggcgctgctgcccgcgctggggagcgacaaggtgcggaacgtcatggacatgagcaccgtgtacggagggttcgcggcgagcctcgtcaaggaccctgtgtgggtcatgaacgtcg

SEQ ID NO: 23950 - DNA, 640 bp, Triticum aestivum
  Clone ID: PAT_TA_23950
atgcaagaaacataacaccagcgaattatcaatcaacttctcaaggctgcagaagcagtcacacactcgcatacgaaggtactagacatatacattgtcccaagcaaaatagcatgaactttaggtctctagattatgcaggcgccgttgtagcaggccacaggcgacagatactagggtaaagagagggtaggggggagtgactgaagtgcttagtcgaacagactgaaacccatgtcttcatcagattcttccttctcttcaaccttctcctccttctttgactcagcagcaggtgctgcgccaccaccagatgcagcagctggagctcccacagcaatggcacccccacctgaaggcacagcggcaaacttctcccttccagatgcaatcacttctgtgatgtccttgcctttcagttcagcaagaaggaactcaagcttttcttcatcagcctcagcaccaactgagtccaggatgttcttgacatcagcggcacttggggaagagttcccaccaagataggcgaggaggtaggcagcgatcagcttcatcgtggaaaccaagaagcacctccgagatgcacaggagaagacgcgaggtcggcggcggaggggggttcgtgcgcgactagggttct

SEQ ID NO: 23951 - DNA, 458 bp, Triticum aestivum
  Clone ID: PAT_TA_23951
ttttttttttttttttttacataagcatattccatttgtcaaatattatatcttatacattttttcgaggacaaatgtactgttcataatcatataaattaaatttcaggcatggggagctacagcaagcctgttccataacatggcgcaggctgatcttcatggaaacctctgacgatgatcagaccgcagcactaaaccctctcaatttagcatcacaagttcacagcgacgatccaccaaaaacaggacgtaaaattaccgctcgccacccatgcctccaaacattccgctcatctccttcgatcccatctgtttcatcagagactgcagaccgcccatgccaccaatctgtttaagcatctgcggaggaaggaccttgctcatgtgctgaacattcatgttgcgggacagtgcactcatctcccctttctttgggatcttgagacccttcatct

SEQ ID NO: 23952 - DNA, 1300 bp, Triticum aestivum
  unsure (1)..(1300): unsure at all n locations
  Clone ID: PAT_TA_23952
gaggaattcggcacgaggaaattcntgcaggatgttnccataagttcttgaaaagcagtaaatctgagacaatgtcatgtgggaaggataccgcatctcaatcttcgttgaaatcttctctagtgattcatgccaaagaagcagcaaccgactcaaaacaacctcttgggcccaagaggaaaagatcaaataaaatccctgtgggcagtgatcctagggttgacaataaaagtaggcatggtagccaacctgctgatggatctggtgtaacctcggccaaggatcctacaagcgtgaaaacaccattagacaggttaaagcagccaatgccttacagagggcggaaggaattaatgagcttcttgcaggaggcaatggacagtcccaaacaaaatataccggcagctccagtttcccataggaagagggttgctgctcccggcgcgagggtggatcggaagttatttgtacttactccaatgcccctgcgttgtgatggtaatgctgttcctggttctgggacgattaacagcaaaggaaatggaaagcagcgaagagaaggtccatgtgttggaactaaaggattccgagctccagaggttcttttgagatcttctcatcagagttgcaaagttgatgtctggtcggctggggtgacactcctgtacttcataatcggcaaggcacctttcggcggagatcctgaacagaacatgaaagaaatagcgaagatcagaggcaacgaagaattatgggaagtagcaaaactgcacaattgcgaatcttcctacccacaggagctatttgatgtcaaattgcttcagtcggtggatctcagggagtggtgcatggccaacgcccgcaggccggagctcctcgagcaggtcccagactcgctgttcgatctggtcgacaagtgcctggcggtaaaccccaggtgcaggatcacatcggaggatgctctgtcacacgagttcttggctccgtgccgtgaaagcctcaagaagaacgcgcttaggattaggtcagcatcagcttctcaccctcctccctgcttgcctcgagatgccatggttaacgccaacgagttgtagcactcgtttcagaccttacttgacctgttttgacctgagtaagcttaagctgaaactggtaactgacgtgtcgtgtgtggctgtgtgccaatagcttgtttatctgtttattactgctgtaaatgctgtacttaaaaaatgtaacaatctaatgttcccgtgtgctgacaaggttgccagaaaaaaaaaagacgggcggaggaaaa

SEQ ID NO: 23953 - DNA, 381 bp, Triticum aestivum
  Clone ID: PAT_TA_23953
gaaaaagatcgaatgcatgagacgaacacgtatgcaaatgcaatgcacatgatgacatgatataagatgcataacaacgacaacaacacacggagagaaagacccgaacccgaggaaataaattaacttaacgccggaaacggcaagagttggagtacaaattgggaaagttatatccggggtgttacaacactccaccactacgaaaggatctcgtctcgagatctaggactgaaagaacaccgggtactcagaacggaggtgatcctcgcgttcccaggtagcttcacggtcggaatggtgtgaccacttgactttgagaaatttgattgacttgttgcgagtcttgcgttcagtctcttcaagaatagcaactgggtg

SEQ ID NO: 23954 - DNA, 816 bp, Triticum aestivum
  Clone ID: PAT_TA_23954
ttaggctgcttcaatctgtctgtgaaaggccacgcagactgcctccgttttctcaggtcattcaatattcctataatggttttgggaggtggaggttacaccatcagaaatgttgctcgctgttggtgctatgagactgcagttgctgttggcgttgaacctgataacaagttgccttataatgactactacgagtactttggccctgactataatcttcatattcaaccaagaattgtggaaaatctgaatactacaaaagacttggagaatataaagaacatgatattggatcatctttcaaaattagaacatgtcccaaacgctcaattccatgaaagaccatcagatcctgaaggtccagaagagaaggaggaggatatggacaagagaccagctcagcgcagcagattatggagtggaggagcttatgattctgacacagaagatcctgacaacatgaaaactgaggctaacgacttatctgccaactctatcatgaaggatgcatcaaatgatgatttgtagactggctccccgaattactgtttactcctgggttttttacgtgcatggtgaagagtggggaagtgtttgaagatactaatctctgtacccccacctgaccattttgtaaacccgtgttgtgaaacagttaatgcttcgggcacccctaacatttccgctttcattcggcacatcgacatgtttatgctggaactattcgtgcattcgtatggatttgtattcctccaaaaaaaaaaaactgtactctaccccgggttagcatgagtcatgattttttgtttgtggtcc

SEQ ID NO: 23955 - DNA, 645 bp, Triticum aestivum
  unsure (1)..(645): unsure at all n locations
  Clone ID: PAT_TA_23955
gntttccaatttcaaatccttcgatcgcgcagcgccgcccgccctctcgcagctctctccgatggcccgcacgaagcagacggcgaggaagtcaactggcggcaaggcgccgcggaagcagctggccaccaaggcggcgcgcaagtcggctccggccaccggcggcgtgaagaagccgcacaggttccgccccggcaccgtcgctctccgcgagatccgcaagtaccagaagagcacggagctgctcatccggaagctgcccttccagcggctggtgcgtgagatcgcgcaagacttcaagaccgaccttcggttccagtcctccgctgtcgccgcgctgcaggaggccgccgaggcgtatctggtgggtctctttgaggacaccaacctctgcgccatccacgccaagagggtcaccatcatgcccaaggacatccagctcgcgcgccgcatcaggggcgagagggcctgattgctgctctgtcttcctgtttctgtaatgtctgaactaggcgatggactctatcgcttcttgtcctgcaatcgtgtaccgatgttcttggcaaatcaatttggctgttatgaatgtgattcagtgatttgatttataacttttttgttccaaaattggaacaatcactgatc

SEQ ID NO: 23956 - DNA, 1118 bp, Triticum aestivum
  unsure (1)..(1118): unsure at all n locations
  Clone ID: PAT_TA_23956
gcgtctngaaacaggaagcagccagcgcgggagagaggcgaccatcgccgtcccgacgcccctgccatccccggccgccgacgcggagagcctcaggaatgccgtgcaaggctggggcacggacgagaaggccctggtggagatcctcggccggcgcaccgccgcgcagcgcgccgagatccgccgcgcctacgccagcctctacaaggagtccctcctcacccgcctccacggcgagctctccggccacttccagaaagcgatggtgctgctggcgacggagccggcggagagggacgcgaagctggcgagggaggccctgggcaggcggggcgacgacagggacgcgtgggtgctcatcgaggccgcctgcgccgccacgccggaccacctcctcgccgtccgccgcgcgtaccggtccctccatggatcctccctggaggaggacgtcgccgcctgccctgcgttccaagaaccgctcaggaagctgctggtgagcctggtgaggtcgtaccggtgcgcggaggggagcgtggacatggccgtggcgaagcaggagcccgcgcagctggcggaggccatccggaggaagaagcagccgcacggcggcgaggtcgtccggatcgtgagcaccaggagcaagccgcagctcgccgccacgttccggtgctacaaggaacaacatggcagcgacatcgaagaggacatgaagcagtacagcagcagccagtttgcgaggatgctcaagattgctgtctggtgcctcacatctcctgaaaagcactttgcagaggttatcaggtactccatcttaggacttggaacagacgaggacgcgctcaccagggcgatcgtgtccagggccgacatcgacacgaaaaagatcaagcaagagtacagggtaagattcaagacgacggtgacggacgatgtcgtcggtgatacctcggggtattacatggatatcttgctggccttggtagggaaggagtgaagattgaaatatttttttcatttctactgcgagacaagatattggtgcttgcatcaaataaacgtctaatagacagctcaactgnttaagttggttggttgggaacatcctgtccacaaaatcc

SEQ ID NO: 23957 - DNA, 1050 bp, Triticum aestivum
  Clone ID: PAT_TA_23957
attcggacgcgtgggcggacgcgtgggaaaatttgttgggtgcttcttggtagttatcttggtatgggaaatcccaggtgtctttgagatagtctggagcccattcacttttcttctaggttatgatgatccttctaaaccagatctccccaggttgcatgagtggcacttccgatctggactggatcgctacatatggattgtggggatgatatatgcctattaccatccaacggttgagaagtggatggaaaagcttgaagaagctgaaacaagaacgaaactctatattaaggcctctatagttacagtttctttaacggctgggtatttgtggtatgagtacatctataagctggacaagattacctacaataaataccatccctacacatcctggattcccataactgtttacatctgcctgcgcaacttcactcaagaattccgggcatgctctctaacgctatttgcctggcttggaaagattacactagaaacatatatatctcagttccatatctggctcagatcaaaggtgcccaatgggcaacccaagtggctattgacaataatcccagattacccactacttaacttcatgctcactactgcgctatatgttgcggtttcccataggctcttcgaactgactaatgctttgaagatagcatttgtacctcgtgataacaagcgcctctcatacaattttgtcacagggattgccatttcagttgcactctactctgtatcatttgccttagttggcatagcaggatactagcaaatctagccattagtttgttagttctagttatagtctagggtatcaacaaagctagtttgattgtcggtgagataaatgtcaacaggcgaagccacatcgcataaactgcttctctttcaccctggacttgagtcggcgtgcacacgtttagtcttgaagagtgtaaaatgtacaatgtgccccaagtgggaatatgataagggtacacacacgtacacatatgtacacacacgtccttgacattgtcggtcgtgattgtaatt

SEQ ID NO: 23958 - DNA, 570 bp, Triticum aestivum
  Clone ID: PAT_TA_23958
cccgccccgacgacgcccacgacaagaccgccgtgcccgtcgtcgagaacatcagctaccaggacgtggtggccaccggcgtgtggaaggaggcggcgaggatgcagggcatccagggcgcgcccttcaagggcatctgcatggccaacgtcaccgccgagatgaccaaggagaggaaggtgtcgtggaactgcgccgacgtcgagggcgtctcggccggcgtcaccccagcgccatgcgcgccgctgcagggcacccacgccggctcctgcccgttccccaccgacacgctcgccgtcgaccagatcaccgtgcagcagtgctcatactcagtcgcacctgctactacttcaatggctgggacaaagtagctcaactatgtagtatacagcttcttgctgcaccaagtgatgaggccattggatctctaagtgagaacagtaacaataaggagcgtgttgtcaagtggctgctttggtaactttagacgtaaaaaaagttgttgtgggtaccttactgtttcaatgcataaagagctataaatttagaattgtccattttgttgcatga

SEQ ID NO: 23959 - DNA, 191 bp, Triticum aestivum
  Clone ID: PAT_TA_23959
gtcagaaagcagagccagccgacgcagtgcccatggaaatcatgagcaagtgacgaacatatgtgtgtgatactactattatttgtatggtattactgtttttcgtttttctttgagcacatatgatactactatctgtgtactgcatagtacagtagaatatatttctacgatctgtatgtttccgctgt

SEQ ID NO: 23960 - DNA, 1086 bp, Triticum aestivum
  unsure (1)..(1086): unsure at all n locations
  Clone ID: PAT_TA_23960
gccggccggngtgcgnagactcagcagtaagcagttttttctcaacaaaagaaagtaaatagaggtagatttcacatttcagagggaaaaatggtggccgtcgacccgaaagcccttccctccgccaaagccgtgaaccaccagttcaacgtggtcatcgacggcgccgagacgaccatccacgagggcgtgctccggtgcaacggcggcacgctcaccgttgtcagcccaggcgtcctcgaggtcaacaggctgcagcacgtggtcgtgcgcggcggcggcggcggcgacgtgcgcttcgcccggtgcggcttcgcggcggcagaggcctgcggcgccgtgtccttccacaggtgcgacgcggtgcgcgtcgacggggccggggaagtcgccgtgcggcggtgcaggtccgcggccgtggagcgcgcgggcacggtgagcatccggaggtgcaagggcgccgcgcgcgtgcacggcgccggggagctgcgcctcgggcggtgccgggaggcggacgtgggcaactgctccgacgtggcgctggggcggtgtcgcgaggcgcgcgccgactggtgcggctcgctcggcgtcgcgcggtgccggtcggcggacgttagccgctgcggcgccgtgcgcgtcgaccggtgcggcgacgcgaacgtggcgagctgcgggagcgtgatggtgcgacgcggcaaggtgaacatggtggaggcgcatcagccactgcagggttggcaggagcagcccctgtgtcagaaagcagagccagccgacccagtgcccatggaaatcatgagcaagtgaagaactatctgatgaaatgcggattatactagtgatattatgtgtgtggtactactatatttcctttttctttgagcacatatatggtatactactatttgtttactgcatagtatagtagaatatatttctacgatcaccgctgtgctccattaagttctcgacaatgtgtcgtctgaatttcaaaaagaagaaaaaaaaaaaaaaaaaaaaaaaaaaaaaaaaaaaaaaactcgagggggggcccggtacccaattcgccctatagtggctcgtata

SEQ ID NO: 23961 - DNA, 599 bp, Triticum aestivum
  unsure (1)..(599): unsure at all n locations
  Clone ID: PAT_TA_23961
ccgaggtcgagttttttttttttttttgtatgtagcttgcttcttcctctttaatcagcaccggaaaacagcatgcttcaatattactactccgtcccatgatgtaagtcgtgttttgacactacacattatgggacggagggagtattttgtaatttcggtacataggatattcccagaaaggaagtacacacaacacatgcatgcagtttcccagaagtctgtttgtgtgttcataacctcatatgcagccatttagctcggagcttcactgcagaatcggtgggtggcagtacgggccgctgagccagccctctgcgatccgtccgttagcggtgtcgctcaagtgcgtaccatcccagaggagtggctccccgggtcatggcaaacactcgagccatccatcccgcacatggtgagcagtcgaatcgtacgtccccgcccgggcgcgggcgcgacacctaatcaantccgcggcgccatgcggccgggacatcactcggccaatccctatatgatcgataaatcacggcgtcgnttaaagtctgacgggaaacctgngtaccaactatcgctgagaaatcccttccagctggtaa

SEQ ID NO: 23962 - DNA, 653 bp, Triticum aestivum
  Clone ID: PAT_TA_23962
cgccgccaagcaaaaatcagagggttttaggggttctgaacgagcgggacggaaaaatcaccagggttttagggttctaagaacgagcgggtcggcgagaacagccatggacgcctcccccgagctgcaacagttcctggagcaagagaagcacaagatgatgatgagtgagatggtaaccaagctgacgaatgtgtgctgggacaaatgcataaccagcactccaaggaagcaagttcagctccggtgaaagtacctgcctgaccaattgcgctcatgaggtaccttgacatgagcgtgataattgcgaagaggtttgaaatgcagataaggcgtctcctaacttcagccggttgttgcgtcatcaaaaagtttccaaactccaagcttcctttgaacatgccaacaatggcgagttttaacacgtgaaaatattgaatcttccgtcgtaaacgcttggttaatagttgtatctgtggtgaaccttgatgtgtttagctttcttgtgaagctactgtcatttgattctctgatcacttagttggtttcgtttcaagtcaatctatatgaagtctggcaacaagtcatgaaattaaggggttgtttggattgtgactatctttgccatatattgtcacatgatttttgtcaca

SEQ ID NO: 23963 - DNA, 2090 bp, Triticum aestivum
  unsure (1)..(2090): unsure at all n locations
  Clone ID: PAT_TA_23963
gccgcggctcacccccatgcgaccctagctcggacgcgtgggcggacgcgcggcgccgcggctcacccccatgcgaccctagcttcgctcgctctccggcgtagcttctcccttttccctgccgcggcggatctgcgtcggcatttgacggcggggagctgacattacaggcctggtctgcaccaatggaggcaatgcgcaaaaaggaggcaacagcaacggcttgttctgaagacaaccgtaaaggtgtacatggtgtatccatgaatgggctatacgatccttggaatcctgcctaccctccacgtgatcctagtccatgcgatgctgacatggctgctcatatcgcatcagtcaaggagtggatggacaaaacacaggctatacttgctaactccagagcaaccaatataatcataccagatcgtactccgcagttcgtaaatgatgtgctcttcgatatattacccgccttggtgccaatcttggaaaaggataatgtcagatctttccttcgcttcttcaatgagaatggaagggccatgtcttggggtttcatcatcacgccagaaactttaaaccagataatcgtgtctaatgcagtgcgatgtgccaaagttgtcttggttggtgatgatcctgagcttcatggtttccgagccaatcccaactgcatgacacaatatgggtacttttccctccaccgagctgctgatatgttctctgttgatatgattgagttgctcttgcgccatggtgcgtctgccaatctacgcacatctggtgatctagtccctgctgacctactcccactccatgttgcggttgagaacacttccatgcataagtaccttgaggacagtctaaatcctagtcaacagcgtgtggactgcagccaggcagacatcaactatatcctcaagctcatccacatcctgtgcttacctgaaatgaaaatcttcttggatacaactaggctgctagccaaacacacagatgatctgttagatgagctctgcaagtacatagtagatgggaagatcgtccatacggctgttttgctcctagcagctcaaaagcagatccgcgggctatcttcctgcaatggatgtgggagtagtaagaaagatgggtttggtactatcactaactttgtcgtggacaacattactgctataaagatgcgccaaaacagactggaaatggagccactagaggtgaaaaaggagcttcttgatgttacattgaatcttgttcatgtaattttcaaagctggtgaagctcttgatgtttacataaggtctcatccaaagattccctgtgtcatggaagtggcccatgcggaggtctttgaacatgttacgctcattctgaaggatcatggatttttttctattggagatggcatagatattggaaatctccacccctatcggaatgtgctatcctctcaagagctacctcacaaattagcggagatggctaggatcaaagcaggtctgaaagtgccttgtctgcgaaatggaaagcctaaagtgaagaaagatcccaggggatgggagctcaaatttgcaaggagaagtttcttccaatctcaaagatcagtgttaacatcagagcttagtgtgaagttcttcgctcataaggagaagacctcggataagtcaaccggcaaagcatctatgttcatgggcggaactctgcagccaaaatttaattatcagcccagaaggatgtttggtacagtggcattgacgctgttgaaagcgctaaggaaggcatgacgaaggagttggcaatatcttgcaatttacccccaatcatgtacctgcattcaagtattcagtgtgcaggatgtgctaaacgtgggatgtcgtagcaaagtagcagtaacttaagctcaacttcgcaataattctgaatcatgttttgtaaaggaagttaaaagcccatgcgagtgagacaatggttgcggtgtggctgacagtagccacaactattactcttttcaatcataatggtgcaagaatgttctattctccttaaaaaaaaaaaaaaaaaattaatttaatgttgtgttgattgttana

SEQ ID NO: 23964 - DNA, 820 bp, Triticum aestivum
  unsure (1)..(820): unsure at all n locations
  Clone ID: PAT_TA_23964
cggacgcgtgggcgcaaagcccttgagatccaccgggagcacagtgcccctgcgtccctggaggaggcctctgatcgccgcctgatggcccttatccttgacgccaagggtgactacgacggcgctctggagcaccttgtgctggcctccatgaccatggttgccaatggacgcgacgttgaggttgcaacgatcgatgtcgcgataggcaacacttacctggcccttgctcgtttcgacgagtctgtcttctcataccagaaggccttgactgtcctcaagtctgcccgtggcgacgaccacccttcagtggcatctgtcttcgtccgccttgctgatctctaccaccgcacggggaagctccgggagtccaaatcctactgcgagaatgctctccgtgtctaagcgaagcccgcgcctggtgctgcccctgatgaggttgctggaggcctaatggagattgctgccatctatgaggcgcttggagaccttgatgaggccctaaagcttcttcaaagggccctgaagttgctcgaggactcaccagggcagtggagcactgttgctgggatcgaagcacaaatgggtgtgctgtactacatgatctgcgagaatgctctccgtgtctatgcgaagcccgcgcctggtgctgcccctgacgaggttgctggaggcctaacggcgattgctgccatcctgcangcgcttggagatcttgatgaggccttaaagcttcttcagagggcactgaagttgcttgaggactcaccagggcagttgagcactgttgctgggatcgaagcacaaatgggtgttttgt

SEQ ID NO: 23965 - DNA, 1209 bp, Triticum aestivum
  unsure (1)..(1209): unsure at all n locations
  Clone ID: PAT_TA_23965
tggtaccgcctgcaggtacacaggtccggntaattcccggtgtacgaccccacgaccgtccaggtcatggcactgtctacaagggcgtcttgaaggataacagggtagtggccgtgaaacgctcaaagataatgaacgtggctgaaactgatgaattcgtgcaggagattattatactttcacagaccaaccaccggaatgtggtcaggcttctagggtgctgcttagaggtggaagtccccatactggtctatgaatttattccaaacggcaccctttttgagttcatccatcgtagctacgggagtccacctccgtcgttggacacccgtctcagggttgctcaagaatccgccgaagcactggcgtatctgcatctgtccatgaaccaccctatagtgcacggggatgtcaagtctatgaacattctcttggacgacaactacatggcgaaggtgactgactttggggcatcaaggacactccccaaggacgcggcccagttcatgacattggtgcagggcaccctgggttacctggaccccgagtacctgcaggagcggcagctgacagagaagagcgacgtctacagcttcggggttgtgctgctggagctgatcacggggaagacggcgatctacaatgacgggcccaatgaaggcaagagcctcgtgcggtccttcctgctcgcgatgaaggaggacagcctcgaggacattctggacccgagcatcgtgcgcgcagggacggagacgctgctgggagaagtggccgagctcgggaggatgtgcttgggtcccatgggtgaagagaggccttccatgacccaggtggccgataggctgaaggctctgcgaagcacctggagggaagagctggtgttggaccgtgccgtgacggaaaatatggtcgtgcacatgccacctgcagcagctccagtgcccggggatctcgcgtcatcgtcatcgggagccccctcgacggtgccggacatgtccggaatgagcatggaggcacccagatgattcactcccttccagtcctgcctgtgcggctgtggggcctggagcttctgggtgcccgtccggctttgcccttcgcggttgcccggccagcagtttggtataggttcctgcgttgtgttagaggtgccaagtactatgtatgtaagtagaagttagaatttgttgtgtgcgtgtgtttctgtgt

SEQ ID NO: 23966 - DNA, 624 bp, Triticum aestivum
  unsure (1)..(624): unsure at all n locations
  Clone ID: PAT_TA_23966
cttcagttcagttgcttattctgtcttgcctgcacacactgagagcaagatgggtggcaaggttcttctgatcagtgccgtcttggtggggcttgtttcactgagctcgtgcaggagcctgggagagttgcatgagcagaagacccactatgggggctcaccaactcccacgcatgggtcaggaggaggctacaatccgacaccgacaccaacttacggcactacaccgacgccatcttacggcactacaccgacgccaacttacggcactacaccgacgccatcttacggcactacaccgacgccatcttacggcactacaccgagcaccccaagtacaccttcccatgatgtccctgcaagtccaaagaagcatgggttcattggatcctgcgactactggaagaatcacccagatgctatagttgcagctattgggtcccttggcaacatcggcaagacatttggtgctgcatgcagtatgataggtggcaagaagctaggaaatatgcatgatgcactctcaaacactagaactgatggtattggcgccctgatacgtgagggggcagctgcatacctcaactncattgtgaacaagaagttcccatttaccacccagca

SEQ ID NO: 23967 - DNA, 1175 bp, Triticum aestivum
  unsure (1)..(1175): unsure at all n locations
  Clone ID: PAT_TA_23967
gaattcccacctgttcagttcagttgcttattctgtcgttccagttcacgttgaggatgctgattcgttcctgtctgcacacactgagagcaggatgggtgggaaggttcttctggtgagttctgtgttggtggggcttgtttcactgagctcgtgcacgagcctgggagagatgcatgagcagacgaccctctgtgggggcccaccaactcccacggatgggtacaggaggaggctccaacccggaaacctacaccaatacaacgtcacgacactacagcaatcaccaagttcacggccactacaccgaacgccaacttacggcaaccagaacgacccccatctcacgccactaaaccgaccccatccttttccgactacgccaacggcacctatgatcattgaatcatcagcctacaccccaagtacaacgtccgatgagttgcagctataggttccatggaaaccatggggtcaagtctttggtgctggcatcagtatgataggtggcaagaagctaggaaatatgcatgatgacactctcgaaagcaactaacgaaatggaatggtattggcgccctgatacgttgggggcagcgcgcgtaactcaactccattgtgaacaagaagttcccactaacccaccaagcaggtgaaggaatggcgtcgtcgtggccgtgagctctcggtggggctgcttcctcgcccatgctgtggtcttcaaggacggcaaatgcattccactcactaattttactgattgagtgtttcttggacttcatttcttcctccctcgcatttttcttggtttatgctatcttgtggcgtgttataattattggattttggttgcttttattatgtaatatccattatctatgacattgtgtgtgtaataaatgaatgcgattttttcgcttatagatactaccttgattttctttatataatcatctaaaatcacgattgatgtatctatggaagtgcactaactaaagagattcccgagtgtaataaatccatctctttccaaaaaaaaaaaaaaaaaaaagaaaactgatctcatagcagaccgcgaaaacaacgcgcgccaatccaccaaagtgatctactcgagtcaccgccgtcntttaaacntcngacggaaaacctgggttaccaactaacccntgagg

SEQ ID NO: 23968 - DNA, 644 bp, Triticum aestivum
  unsure (1)..(644): unsure at all n locations
  Clone ID: PAT_TA_23968
cccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctccgagttcaagcaagttgggttcatcttcccgttgagcacaacgcactcctgggtactacgatggcccgggtatttggacatgtnggaactgcctatgttccgggtgcactgaccccacacaggtgatcaacgaaggtggaaggaggccaagaaggataccctgaccctattccccaccaccggttccacaacatctncagggcaatgcgtcacttaacgccttaagccaccgggctccaagatccggaaggctaaanatcatcangacagcatattaatgcattgcatttgcaaccgaatgcttggttcctcccaattacttctattgtccnaaanagttagcccatngtttcatgtcggcaaatccttcctntaancacg

SEQ ID NO: 23969 - DNA, 179 bp, Triticum aestivum
  Clone ID: PAT_TA_23969
cggacgcgtgggtagaaatgaactaatatatagataatcgaaattgaaaagaactgtctttccttgagcagaaaattctcccctgattttgtgttcttgtcatgtactccttccgttccatattactttgtactaaatcagcgatgagtaatatggaacggagggagtatgtatatagt

SEQ ID NO: 23970 - DNA, 657 bp, Triticum aestivum
  Clone ID: PAT_TA_23970
acaaacaagaaagcagattcttaggaccctggagcctgtgcaaaacgatcaaggtcgcacgtacataggaaacactaaatcactcgtatgaatttcagaaacaacacctttttccactgcttacatgcatatacttcaagaagcatgatatatattctctatggagaattggagatacaattagattatactccctctgtaagaaatataaaagcgtttagatcacttttttacggagggagtagataagaatatatatcgccatcttcatacatggggacgtacgtgatctttctgctgccattgctgatcagtctctgctcggcgctagcttgctgaccggcctctgctccgagtggcaagacgtaagaaggcgaatcagtactggctgggccagaggaaggcgcccatggcgaacctcctcttgtcctcgacgtcgccggcgacggggaggccgtactcccggagcaggcagtcgacgcgccactccggcatcgcctcgtagtccgccttcctgtaccgcgggtagtgcagcggcatccggaagccgcagctgaacgtgccgcgctcctgctgctgccgccggccgccgacggccgccgtgccgccgctggccttggccatgctcacgctcacggcagggcccaaggatcccat

SEQ ID NO: 23971 - DNA, 636 bp, Triticum aestivum
  Clone ID: PAT_TA_23971
acacagaaagcattatattatacgtatgaaaatcagaaacaacaccttcttccagtactgcttacatgtaagaacatcagaactgctccaacctccaagaaacatattttttctatggataattggagattatgattagtgatagataggaatataatatcggcacgaggtcttctgcatacatggggacgtgaggctgctgctgccattgctgatcagtctctgctaggccctagcttgctgatcggcctctgctccgagtggcaatatgtaaaaaggcgaatcaatgctggccgggccagaggaaggcgcccatggcgaacctcctcttctcctcgacgtcgccggtgacagggaggccgtactctcggagcaggcagtcgacgcgccattccggcatcgcctcgtagtccgccttcctgtaccgcgggtagtgcagcggtatccggaagccgcagctgaacgtgccgcgctcctgcttctgctgctgcttctggccaccgacggcagccgtgccgccgttggccttggccatgctcacgctcactgcagggcccaaggatcccatctctctctgtgtgtgtttctttgctgcctctgatcaccttataaattacaagcaactcggttcgtgag

SEQ ID NO: 23972 - DNA, 739 bp, Triticum aestivum
  Clone ID: PAT_TA_23972
caacgtcggacgtacacagaaagcattaatttacatgtgtaagaagataaaaaaaacacattcttccactgcttacacgtaaacgtaggcacatcagaactgctccaagaaaatatttgtctatggagaattggagattatactgtatttgtctatggggggttggagattatgatagatgatacgccctccgtaaactttaatgatataaacactcctataataatttacgataagagtagataaaataatatggacacgacgtcttcttcatacatggggacgtgatgttgctgctgccattgctgatcagtctctactaggcgctcgcttgctgatcggcctctgctccgagtggcaatatgtaagagggtgaatcaatactggccgggccagaggaaggcgcccatggcgaacctcctcttctcctcgacgtcgccggtgacagggaggccgtactctcggagcaggcagtcgacgcgccactccggcatcgcctcgtagtccgccttcctgtaccgcgggtagtgcagcggcatctggaagccgcagctgaacgtgccgcgctccggcttgctgctgcttctggccgccgacggccgccgtgccgccgttggccttggccatgctcacgctcacggcagggcccaaggatcccatgtctctgtgtgtgtgtgtgtgtttctttgccgcctctgatcaccttgtaacttacaagcaaaagcacccccggcgccga

SEQ ID NO: 23973 - DNA, 1334 bp, Triticum aestivum
  Clone ID: PAT_TA_23973
aagacgatgctctcgcaaatccttgctagttgtattgcaaatatggtacatgtaaaaaaatataacaaatcacaataagaagattgttcttgtaatcgaaacataagcgatgaattgcttattccgttgtacacttatctatatactataatatcactatatgaaaccagcagtatatacacagaggtgccatcatttgtccggcctgtagcttcaaccttcatagtaattaatggtttacgcagctgttgagcagcttgtctatggggtctgctgtctccgacgagtgggtgtaaccatccagcttcttgtacatgcaatccatgacccgtgcaaggttcactacacgtgtcagcacttcaacaggcaccgtggtattagtgaggaactcctcgttgatgctcctccactgctcctccacaaggcggcctaatgcttcctttgcttgatccacggtgacaccatgctctttgatatagcaatcaactgccgtcgcaacgttagacctctccttctcacactcatgtccagaaatatcgtccattaggcgtgacaccattgctgcattctctatgatttttgggaacgaggttgcccaggtgaaaacgtcatcgcctgcatccattccggtaaatgaaatggacgccaatgcccagtagaacgtgcttattgcagttatcctgagatgatcctgaacaggtggcacttgctcctcttctctccatagcacctcttgcaacatgcatctgcttacatgcttgataatctctttggtgcaggcgattcctatggctgaagctccgtcctccacaaattggttcagtatgctggaaatatttgacattacatacccgtagcacttcccgatgcgtctcgcatcttcttcatcccatctttgtaccgcttggttaaactgacgaagctcttccaaggtgccatacgaatcaaatgtatcatcgaaaaatgagaacatctttataagtttggcaaacatcatacgtgctttggcatactttggctcgtagaacacaccaagggcccaaaagtagcactccaccggtctttctcgaatgtattcacccagcgcgctgccagaattaaggtccttgtaccacaaagatatgctcttgatctcatcccggtgcatcagctgcaagatgtggaagtccagcttagcaagctcaagtatatcctggtcgccttcatcatccttctcatagatggagatgtaaagcttggcctccagccttttcatcctccgctgcgatggcgtagccagtgcatgccgtactctgttgatgagatgatcgggtagctggttgcggacgcgtggg

SEQ ID NO: 23974 - DNA, 1073 bp, Triticum aestivum
  Clone ID: PAT_TA_23974
gattgtaatatcaccttataataaggggcagatgtagtattttacatgatggattgtatttttttgataatttggcatgccttgtttcccgatcaacaatggaccatattcattttccacgtatgccacaaaggccagaaggatgtactatgttgttaatcaactaaaactgccatttttagtaccattatttgctctgttgttgcctggtggaaatcacatgtaatattaattgcaacaatatatgtttactcacaaagatatgctcttgatctcatcccggtgcatcagctgcaagatatggaagtccagcttagcaagctcaagtatatcctggtcgccttcatcatccttctcatagatggagatgtaaagcttggcctccagccttttcatcctccgctgcgatggcgtagccagtgcatgccgtactctgttgatgagatgatcgggtagctggttgcctccagatagggaagagaggcagctggtggtgaatcttatagcatcagtgagagattcctccccacatttagcaaggtgggctgcctcataaaggctaagtagagtgccaatgtcagattgcacatcgtcttggaagtgctcacccttttcatccttgaaactcttcaatacttcttcacaaggaatgtcatattggtgttgcctcaacagtcggaaccgtagggcaactccggccaagtcattctcatcaatcgatgtgaagatgaggacatccatgaacttattgacctcctcctcaaagtggtaaccaacaccaaggcgctcaatggcatcaactgccctcatcccctttgatatatccttcttgctggacgtataccttttgatcatgcagcataccttctgcacaagctcatcccttctatccttgatcattttctgagactggccagagcaaggcaactggacagcgtccagaaaatatcgggtccacttgctgtcctctagctggccaataacccgtcgctcaggtttttgctgctccatgtagcacttcaagatcccgcaggtttttgttgggcttgggcgccttcttcagcactcaaaat

SEQ ID NO: 23975 - DNA, 861 bp, Triticum aestivum
  unsure (1)..(861): unsure at all n locations
  Clone ID: PAT_TA_23975
gcacgaggatggatctggcaacgggcgccatgggctccctgctccccaagctgctggagctcctcggcgaggagtacaagctgcagaaaggcgtcagggaaggcgtcaagtctcttgagaaagagatgaggagcatgcacgttgccctccgcaaagtggcggaggtgccacgggagcagctcgatgagcagatcaagcactgggcaggggaggtgagggagctctccttcgacatggaggacatcgtcgacaagttcctggtccatgtcggcgagggctctgagcccgcagcaaactctaacaagctcaggcggctcacgaagaagatggccggcttgttcaccaaggggaaggctcgccatgagatcgctgacgcgatcaaggacatcaataagcaagtccaagcggttgctggaaggcgtgcaaggtacaatgtcgacattaccgtcgctaacctcccgactgtgacttccatcgatcctcgccttggggctatgtacacggaagcaacatgggctggttggaattgccggaacaagggaccaagagatcatgaagttgctctcggagggggatgacatgtccaagaagaatttgaagattgtcncgttgtccgatttggaggattggcaagacactcctgtcaaaacggctaaganaagtnggaggcgataacgactgcaagnctttgttcctgtcgtccaaaggntgaggaaaaacggtttcaaaataccttctaanctggggtgatggaatgagccacaagttnaagacaangctcacgacaaatccggaattccagnanagagnacactgtaccacatttnaaggcccacttnggngaacaccatccaaatnatc

SEQ ID NO: 23976 - DNA, 658 bp, Triticum aestivum
  unsure (1)..(658): unsure at all n locations
  Clone ID: PAT_TA_23976
tttttttttatattacagagaaggccgatcatcatataaatacatttgaacagaagggcatgttgggtgcacatcggctgccctcctcaaggcagactcgacatcactgttcttgtggacggaggatgtgacacctacacggatgtgctcgagggctaacaggtgctccatccctaatggtgtagcaccaccccacccatcatgtacttgtagatggagctgtcgcagcttggggcatcgcccctgcctccgaactccatgcataccatagcagaataaattacaaaaaaccatcacaatttgagcaccctaatggtgatgttttttttgcaatttactccaccatagcatccatccagagacgagcctaaggtcttccaagaactgggaaataaccctggtgcggactattggcggcaccactatgttcagtgatacccgacacagagagaaacatgtcaatgagggaggcagttttccgacaacgtgaactcattatnccatagctactcaaccgacaaatcaggcgcggaggaatggaggcncaatccattgggaatctctcatatacatcctacatataaagaccccattggaaaggggttgtaacagtctccgcacaanagtnaaaacnncattcntacaagagtattgggcc

SEQ ID NO: 23977 - DNA, 935 bp, Triticum aestivum
  Clone ID: PAT_TA_23977
ctctcgaggatgcgctgccccgcaggaggggcctctcgaatttctacgccggcaagtccaaatccttcacaagcctggcggaggctgcagccaaggcggctgccaaggagatcgccaagccggagaaccccttcaacaagcgccgccgcgtgctggcggcatggtcgcggcggcgggcctcctgcagcgcgcggggctccacagctcgttacgccactccggtccctcgaccacattgtggtggcgcggcccagcgagaggggcctctcgaacttctacgccggcacgtccaaatccttcacgagcctggccgaggctgcagccagggcggcggccaaggagatcgccaagccggagaaccccttcaacaagcgccgccgcgtgttggcggcatggtcgcggcggagggcctcctgcagctcgctggtcaccacgtacctgccgccactcctctccctcgaccacactgtggtggagggggacgaggaggaggaggaagaacgctcggacgacggcgacgacgaggataacggcagcggcaatggcaggagggagaaggccccggcgtcgcccaggttccctccgcgcagcctgcacagcgcgtcccagaaagcgagcgtcatgagtaggaacacaatcaatccgaacacgagctcattccgatctccaaggtcattctccctctccgatctgcaaaacgctggatacaactagctgaaacgtaggccgaatttaggttggcgagatggtgctgctgccactgctgctactgtataatcaagaggtctctacacataagagaacattaatttgttgtgtttgtcagtatgtctgttggcctcttcttgaatcaccgagcaggctccggcatttcgcatgacgctttagacatgcttcagctgtttgctaccattagccagctaatctaaaagctt

SEQ ID NO: 23978 - DNA, 501 bp, Triticum aestivum
  unsure (1)..(501): unsure at all n locations
  Clone ID: PAT_TA_23978
cccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttccggggaaggcgcgcgtcaccatgcgcaaagaccgcggccaaaggccaagcggtgtccgtccgggcaccccttggtacggtcccgaccgcctgctctacctccggccgctatcccggcgaccccccagtacctcaccggtgattcccccggcgactacggatgggacaccgccgggtctccggccgacccccaactttcgccnaaaaccggaactggaggtgattcactgccggggggcatctgggcccctccgtgctcttccccggactctcccccgcaacggtcaattctggcaagcttttgttcaaggcgtcccnatttttaaacaagggggctcaatactcgggaccaacttcttatcg

SEQ ID NO: 23979 - DNA, 557 bp, Triticum aestivum
  unsure (1)..(557): unsure at all n locations
  Clone ID: PAT_TA_23979
ccgatcctggctcgtcccgcccccaccttctccctcactcccggcgcctcccgacccccatcttctccctcactcccggcgccgccccgcccccacctcctccctcactcccggcgccgcccgacccccaacctccctggatccgcgtgcgtcgacgccggcttcgcagcggcgcttgatgtcgagcgcgccggagtagaggagcgggccttcttcctcacctcacagcgctgtcctcctccacgaccacgcagccgcaagcggcggaggacccgaatccctagccagcaagctcaggcagccatgggatccatgggggccactccgcgggggcggcccaccgcacccgctcctctcgtcacgcctggcgccgccctccctgggggcatcagcccgcgccggccggctcggcagcggccgcgcggccgcgccctcctgccgggcctcggctcgccaaggggcagggagccatgcacggctgccctcctccccagctgcgaaaggttggctgcaggtggttnnaagtctgaangccgaaaacaggggggaatttttaa

SEQ ID NO: 23980 - DNA, 614 bp, Triticum aestivum
  unsure (1)..(614): unsure at all n locations
  Clone ID: PAT_TA_23980
gcacccacctctcctcgccttccttccaccaccaagcaaaccaaaaccaaggaagccaagcaaccatgtgcccgggcctccgcaacgccatggccacccacgaccatccccagccctcatcctacctgctcgacctggccgccgccgacgacctgcccgccttccgccgggccgtccaggacgacaacctctccctcgtcgccgcatccccgtggtacggcccttcgcccaagacagccaagaccaggaccacccaccatctggcgctccacctccgcacccccgccatggtcgccgcgctctacggcagcaccgccgtcctctcctacgtcctctccatcgccccctccgaggccgcccgcgcctccgcctccgacggcgccaccccgctcctcctcgcccaagccggccgcaacctctccccgccccaccccgcccccctcctccccgccgcccgcgcgtccgcccgcccccccccccctctccaccgcccccgccgccccaccagaccccccgccggcccctccgcggagcacccacgtcccgctccctcctcgcccccttgccccaccgcctgggngntctccaccagcttcgactattcgggcttcgcc

SEQ ID NO: 23981 - DNA, 647 bp, Triticum aestivum
  unsure (1)..(647): unsure at all n locations
  Clone ID: PAT_TA_23981
ttttttttttttgacagagtctaataacttatccctgacagaaaacaaaggtccccccgatacacccatatacttgcatggttacaacatacactacacagtactcatctctactggccggtggcgtcgatcttcttcaggagatctttcttttcacatattcccatctccttgtcccacatagacgcaggcggtgctcttggttccctgcccctccaccaaaccacatgaccgagaaggacacgagagccagtgccaagcctgacgaaaggacaagtccacatactttgatcgaggtcatcccaaggtcgagcgaggcgtcatacttgggctcggagatgtctttgtttatcttggcgacggtggcggtgatagagtcaattttgtcgaagggtgagcccgaagcgatccttccggtcggctttcacccggcggatctcggagcgggccttgtcaacggtggactgcgaacagaggcggcgcggggtgaagtgggcgcggggtggagtgcgctgaggatggganacggcggtggcctgggatgggggcccggggcgtggagggcgtannagagtatnggaggactatgcacacancagactaagagggtggttaagtgggtaagataaantgctacaaccaggagn

SEQ ID NO: 23982 - DNA, 835 bp, Triticum aestivum
  unsure (1)..(835): unsure at all n locations
  Clone ID: PAT_TA_23982
aaatgataaaccctagcaggcatgctacatgcagccttagatatcatttgctggttcaatccttcttgtcaaccaaaatattccatcagccacatacaaccaaccaaacggacacacatggcagtcaccataagattgttgtaccaatttgtaaaactatcttaccccgacgacgacggaaactagatatatatggtatgtgtttaccggcaaactatatatggtccatacaaagtacaaacattctatagcatatttcaggttaacttgtgtagtagcgcccactcgtcggatcaaacgtttctcgttcgaccgcgtcaatggctcgttaaatttttttttgcgacatggtgaagaacccatccggattagtcccaaggctcgtggaggttcaggctctccatgttcgcctcgatgtcccccattgatttcaagtcatctgttccaaagtacgatagtctggcttcatgcaacgagtctgcatttattcccttccgtgcacagcgagtgttttccttttcttcatagaagtcaaagtcatccagaattgatgttccatggcgataagccttgaaaattttcaacacttccagaccctnnngaaggccaatctcttgagtatccctgctgaatgtaacaggtctgttgtcattattttctagagtgatatgtttgaagagcctattcggaatgtcctttacaatgtgccagacaacagggaaaaagccattccatttattttgnnnnnngaagtccatggtcttcttgaaatcaacaggacctaacatctcagcnnatcctacaaactgcccactggtattaaccgaaaacaaga

SEQ ID NO: 23983 - DNA, 644 bp, Triticum aestivum
  unsure (1)..(644): unsure at all n locations
  Clone ID: PAT_TA_23983
agtgagagcgccacgatcgaccgggagtagcgatgtcgaggacatttcaagttgctgctagttcttgcactaagtaggaatagttagagtgagtggttcccgcgctcataagaacgtcacccacggcccgcacagctgcagcggcgtggatgtcccctacccgttcggcatcgtggaggatggcggcggtggcgactaccgcgctgggttccaatgtcatgtgtgaacgcccggtgaagccggtactgcacaccaaccgggcgggcgacggaaagccccgttaaagatcggcaaacttctccatccaagccgcgcttgcccgccccgccctgccggctggccggctgtgcggcggctcctcccggaccgccgccctcccgggcctacaccgacctagggtcaacactacgggcgtgccccgcatctcccacgccaaagggcggcgctgtggcccccgctgctctccacgcgccctcgcgagcaacccctccagttccgccgggggntcgcttacccccttcgcggccgctccgccccgaaccctccccggcgcctaacgggctccccggggaagcgcctgcgctaanatcgccggactacganaatgggggctcanactcacaaacncaggcantnaccctgga

SEQ ID NO: 23984 - DNA, 444 bp, Triticum aestivum
  unsure (1)..(444): unsure at all n locations
  Clone ID: PAT_TA_23984
gtttaacctcacttcgttcgttgcgcaacgcgagaaaattaccctcctctcctctcctccagagccccaccccggcacagcacagcacggcccgaccgagacccccgtaacgggaagggaaacggcaggggcctaaagaccccgaggcctcgagccacccaaccaaccaccggagcggagcggagtcggagccccccccgcaccggcgcagccccccgccggcctccgctcggtgccggccggcggcccaagcgcgcgcgtctccgtcggcccgcgcgccattggaggagccccgccccgtgcgcggctgccttggagttggaggggaantgtttcaagttcccgtcccttgccttgctctggtggcgggttctctcgccgccgcgatgccngaggccggcggtanaccaaaangaggacaaggaatctgaanaacgtctgcgg

SEQ ID NO: 23985 - DNA, 361 bp, Triticum aestivum
  Clone ID: PAT_TA_23985
gatggtgctcgcggcccacggccacggcggcgcgcacgggcgcttccgtttttgaaagcaagcgctcgatcgttcgtccgtggatgaagccgcatgcatgcatgcctgtgcatgcgtcgtcctcgccgccgctcgaacgataatccgctaataaaatacttcacctacgtagctcgttctttctttctagttttgagcagaaacctctgtcaaataggacgccctcaccacgtacgtacgactgaatatacacttgtagaaagttgtagctatgtactgcaagcatctgtatatacgttccatgatttagggttattgttgttgttactttcgtcgtttttgtaaggaagttgtgctgatt

SEQ ID NO: 23986 - DNA, 1204 bp, Triticum aestivum
  unsure (1)..(1204): unsure at all n locations
  Clone ID: PAT_TA_23986
ccgngttcagcgctcgcttaactctactgagctagtgtcagcggggcaggcgcgagggtgcctagctagctcggtcgctcgtgtccgacgagatggcgagcgccggcgcggcgatcggtgcgcgcgcggcccgcgcctgcgacggctgcatgcggcggcgggcgcggtggcactgcgccgcggacgacgcgtacctgtgccaggcgtgcgacgcctccgtccactcggccaacccgctcgcgcggcgccaccaccgggtgcgcctcccctcctcgtcctcgccggccgccacctcctcccttcagcacgccgaccccgacgagcccgcgtggctgcacgggctcaagcgccggccgcgcacgccgcggtcgaagcccgggatggtgggcaagcacggcgcgcccgccaccgcgaaggccgcggctgcctcggcggtccccgatctcgaggcggaggactccggctccggcatcgtgggtgacaacgacgaaggccacggcgtggaggtcgacgacgaggatctcctgtaccgcgtcccggtgttcgaccccatgctcgccgagctctacaaccccgtgccggtcgacgagttccgggagcccctcgagcagaagccttccgtctgctgcttctcgtcgcttgccaatcagccgtcgtcggagtacgcctcgggcgtggcggaggcggccgacgggttctccgggttcgacgtcgtcccggacatggagctcgccagcttcgccgcggacatggagagcctgctcatgggaggagtagaagaggggttcgacgacctgcggttcttggacgaagagaagccccagctgaaccttgacttcgacatggcggacttcgatgatcagagcaccgcggcgcctgcgccggagcaagagttagaggacaggaaaaggaagcggtcggactcggggatgatacttaagctcgactacgagagggttatcgactcctgggcccatgacggcggctcgccgtggttctacggcgagcgcccccacatcgaccccagtgatgattcctggctggacttgccggcggggagccggggattcgggctcggcgcagcggtgacggcggtgaccggcggcgagcgggaggcgcgggtgtcgcggtaccgggagaagcggcggacgcggctgttcgccaagaagatccggtacgaggtgcgcaagctcaacgccgagaa

SEQ ID NO: 23987 - DNA, 1880 bp, Triticum aestivum
  Clone ID: PAT_TA_23987
ccggcctacgcgcccgcggaactctgctgggctactgccaccggcgcaggcgcgaggcagcctagcccgggccgtcgcttgagtctggccgggcgtcccaggcggccgcccccgcctcggcggcagcgagggcgcgacgcggcggtgaaacggagtagctgctggcttggtgcggggcgcggtgcgccagcggctttggttttcatttgatgagctgctcggggaaggcggcggacggcgcgatggggagcaaggcggcgcgggcgtgcgacggctgcctgcggcggcgggcgaggtggtactgcgcggcggacgacgcgttcctgtgccaggggtgcgacacctcggtgcactccgcgaaccctctcgcgcggaggcacgagcgggtgcgcctgcggcccacgtcgccgctgctccctggggcggccccgcgggaggaggccgcgcggacgaggacgtggagccgggcgtggttcaagcgcaaggcgcggaccccgcgctccgcaggccaagagcgtcggggcgcctgctctccgaggcggctcgtcgtgccgcacgcgtccctgcggggactcgccggaggagcagtactgcgacgtggagaccgacgaggaggagcggctgtaccgcctgcccatcttccaccccgccatcgctgagccctgctcgacgcagtctcccgaggtagcgacgtcttccgtcgcatcttgctgcagtaagcactgtgcaatcggagagcccccgacaaagcgagctgctaagtcgtcaccggtgccgattcggatctacccagaccaactcgtaagcttgggcccgacggacgccgagctcatggagttcgccgcggacatggaggcccttcttggccggccgggcatggacgacggcgacgaggaggaaccgttctgcatggaggcattgggcctcatcgagccgatggacgtagacggcgggcgagtcaagctggagatcgaccccatgcgagcgtgcggcctcgagcagaagccggaggtgtccggcgatatgttcgacatcgacttcgactacgactcgcccctggggacaccggacgagaacgcggcaagcagcggtgccagtgcggacgcccagttcaccccgaggagcctcgcgctcaatctaaactacgaggccatcatggagaactgggggagctcgccgtgggccgacggcgagaggccgcacgtcaagctcgatgactgctggccacacgactactactcgctgcaggagggcgcttggatgatgggaggagtggttggccatggcggggaggggttggggacgccgaggctgaggatggacggcggcagggaggcgcgggtgtcgcggtaccgggagaagcggcggacgcggctcttctcaaagaagatccggtacgaggtgcgcaagctcaacgccgagaagcgcccgcggatgaagggccgcttcgtcaagcgggccaacggcgccggaggcggcgtgcccgtcgccatcgccacggcgtgcgtcgcgtagctgccgatcgtgcaatgctgtcggtgtgcatgcatggctctgcaggctgcatggcgcgcgcgcacacacacaaaacaactcgtcgaaactgctcgtaatttagttactttcctttttcagttattacggtatatggtgcattcagctgagtatccaaggaatttcaggtcgctctgatcagctagctcgcgctcgttagagtcgaagaaatgaataacgggaataatattaagttgttcctgagaatggtagagggagatcaagcctagttggtgtatgtcaatgcatgccttccagcctttcaaaaaaaaaaaaaaaaaaaaaaaaaaaaaaaaaaaaaaaaaaaaaaaaaaaaaactcgagac

SEQ ID NO: 23988 - DNA, 587 bp, Triticum aestivum
  Clone ID: PAT_TA_23988
gaataatccagatcttgctggtgatagacgaagaacagttatgcggcctcctcaagttcttagggaaggcacaaagaagacagtttttgtgaacttcatggacttgtgcaaaacaatgcataggcaacctgaacatgtgatgatgtttttacttgctgagatgggaacaagtggatcccttgatgggcaacaaaggttggttatcaaaggaagatttgccccgaagaactttgaagctatactcaggagatatatcaatgaatatgtcatatgtaatggatgcaagagcccagataccatcctttccaaggagaatcggttgttcttccttcgttgtgaacaatgtggttcgtcaaggtcagttgctcctatcaaggctggattcgtggcgcaggttgggcgtcggaaggctggaacttaagtttggtagtgtgcggatttacaacaatctttattgtcctgttttcactgtgcctagaccgctttgtggattttgttacttcctgtactatgaatgctgctggtgtgaatttctatttatctcagaggatctaagtttggggcctattgccggctcctttgccttt

SEQ ID NO: 23989 - DNA, 939 bp, Triticum aestivum
  unsure (1)..(939): unsure at all n locations
  Clone ID: PAT_TA_23989
cagttttgttgcatcagtcatgtacggttatgctatcgtggtacctgctgcattctttttcctgtttcagtactttggatcacgcccaagccttatccggttttggtgtatgtggggctattctctgtttatcttcgtaccagcatctatactgctacttattcctgtggaatttcttcgctgggtcatcatagctggtgctggtggtgcatcatcttggttcatctttttaaacttgaaggaatgcaccnaaggagctgatatgatggctctgatcgcaagtgcatcagtgctgcagtttgctctggcactgttcatcaaagttttcttttttgcctgaganctattcntgggtgcttcaggtgagctggatgttttctttgtgcatcacttgttgaggctggagatggtgaagacactcttgatgatcgttggagaggatgaacaaggagaagggattgtgctgggtggagcaacccaatacccatgggaaggaactgatagagattacaaatatgatgagctgcttggcagagtcttcaatatcctgcgtgagtaatcctcttgatagacgaagaacagttatgcggtcctcaagttctttgtgtccccgtcgttctgttctgccattcatctttctgaggaccaggcagtggactagtttcaccctacatacatattgaccctagatttgatagaccttgggagtgtctgttttcaagatttttgactcgtgtagttaagggaatttcactgtgtgcgttccagtgcgaagttactaagtttgcatctaaatttgtacctggtgaactttctgccaccgtgttgtacaacaacggtggttagcaagaatgtgaagctcttttttgtttgtacaatccattgctgtgaatgcatggttttctcatgtttctaaaaaaaaaaaaaataaggtcccta

SEQ ID NO: 23990 - DNA, 1938 bp, Triticum aestivum
  Clone ID: PAT_TA_23990
ggcacgaggacgactgaaaccctacccggagccccgccgccgtcgcctctccctctcgctgtttagagccgtcgcgccgccagcagaagagggggtgaagaaggccagcgtcaccatggcggacgaggagcagatggagcggaaggaggaggcaaccgagattgcaccttttgatccaaccaagaaaaagaagaagaagaaggtcgtcatccaagatcctgctgatgaggttgataagctggcagagaagacggagggcttgtcagtcactgagtctggtgaggcaagcttcgtgggattgaaaaagaaaaagaagaaacttgtggaacttgatccatcacttgttgaggctggagactccgcagttcccacccactaaaaaccttcccccctcccccccgcccccggctcctcgacccgaatctccgctccggcgacgcgacgcggccatgcgcagctgcggatgggcgacgactgcagcgaccacgggtgagcggccatggacgagggctacgccagcctccccaccagccacttcctcggctccgtccaggctgtggctgtggctcccgataagaggaagcccggtgctcccgccgaagttggaaatgccgctgccacctcgcgcctgcagcagtttccgcctgctcctgctgccaacggaggagggtaccagcctccagggagtcctctaggtggagatgtagaaacacagacaaactggaaaggatacttcaatgttgcctcttatactccatatttcaatgttgatactgatgtcgttgttgacagacttatcagttcagtttatccaatggagggatttttcaggaagatagatgttaatcctcacatgtatgcgcccttatggatcaccactacactgatatttatgctggctgaatgcggagacatcgccacttatgtaatggagaggaaaagtgatctgaatatatggaaccttaatgtaaggtatttcagtttggcggcatcagtcatgtatggtgatgctatcgtggttcctgctgcagacatttttctgtttctgtaggttgaatagcgcctaagccttatccggttttggtggatgaagaaatattagctgattatctacgtagatgcatctatagtggtgcttggtcctggtgaagacattcttgatgatctagttgcagaggatgaacatggagaaggtattgtgctgggtggagcatcccagtacccatgggaaggaactgatagagattacaaatttgatgagctgcttggcagagtcttcaatatcctgcgtgagaataatccagattttgctggtgatagacgaagaacagttattcggcctcctcaagttcttagggtaggcacaaagaagtcattttttgtgaacttcatggacttgtgcaaaacaatgcataggcaacctgaacatgtgatgatgtttttacttgctgagatgggaactagtggatcccgtgatgagcaacataggttggtgatcataggaagatttgcctcgatgaattttgatgctaaactcaggagattgatcaatgaatatgccatatgtaatggatgcaagagcccagataacatcaacgctggttagaatcggttgttcttccttcgctgtgaacaatgtggttcgtcaaggtcagttgctcctatcaaggctggattcgtggcgcaagttgggcgtcggaaggctggaacttaagttgggtagtgcggggatgctctatcaacgtaatccaacaatttgccgatttacaacaatctttattgtcctgttttcactgtgcctagaccgatttgtggattttgttacttcctgtactatgaatgctgatggtgtgaatttctatttatctcagaggatccaagtttgcctttttttaaaaaaaaaaaaaaaaaaaaaaaaaaaaaaaaaaaaaaaaaaaa

SEQ ID NO: 23991 - DNA, 600 bp, Triticum aestivum
  Clone ID: PAT_TA_23991
ttcgtctacggcagcacctcgggcgggtggcgctccgccctctttgtcgtcgtgatggaggtcgccagcgctttctcctactacggcgtgtcggcgaacttgatcacgtacctgacggggccgctgggccactccaacgccgctgccgctgccgccgtgaatgtctggtcgggaacggccacgctgatgccgctgctgggcgccttcgtggccgactcgtggctggggcgctaccggtccatcatcctcgcctgcatcctctacgtcatgggatatgccatgatcactctatcatcggtgctctcgacacatcatccatcattacccgacgacacctcttcccatcccttgtcgctgcaggtggccttcttctatgcctccctctatataattgccattgcgcagggtgcagacaatccatgtgcactggcctttgctgctgaccagttcgatcccgaccgccctagggagtgcgccgcccgcagctccttgttcaactggtggtacttctccttggctataggtatcaccatttctgttggtgtagtcagctacatccaggagaaccttggatggggaattggatttggcatgctctgt

SEQ ID NO: 23992 - DNA, 690 bp, Triticum aestivum
  unsure (1)..(690): unsure at all n locations
  Clone ID: PAT_TA_23992
gttggttggaggcgccggctcccctctccgccgcagacgctgaggagccagccacgccacgccacagacaagtgaagcacaagcgccgaccagccggggactccgacgccggcgcagcgcccccgccctatcctgcaggatgttggccaggtcgccggcgctgcccttccccttcccgacggccactgaagcttccgcttcgccggccttctttcaaccttgtcatctcttgggcttccccaactgtgatctttttccaacaaagaaacatggaacaaagattaactgtccaagccaaacattcaagcacggaaaagcacagcacgcaagcaggatccacacaagatggcgggcgtctcatctgaccccggtcaaggccgccgctgtccttggatcccggtgacagcaagacatgggaaagagtgcaagcaagtatcacctcactggtttctccaaccgaaagcccccgagaagctgctgaagggggcggccggctggtccaattcgccgtactggcgnntttaaagaaanaaggagttccccaangcggaggtggaaatggagtgctggacaactcaaaggctccggtctcggaagaactttaaaanngccaaanccccgggtgcntggggggcnttccaaaacaagngaactnattcggaactggnaatacgggggaaacggaaaatc

SEQ ID NO: 23993 - DNA, 629 bp, Triticum aestivum
  unsure (1)..(629): unsure at all n locations
  Clone ID: PAT_TA_23993
gcnaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttcccgtgaagcacaacagctcccccgggtactacgatggtcgatactgggacaatgtggaagctgcctatgtttcgggtgcaccgacgccaacacaagtgctcaaaccaaggtggagggaggtcaaagaaaggagtacccggccccctgtccgcgtatcggcttcaanaactgcgcaagtgnatgcgtnactcaacgcctnaagcaacgggttcaaganctgcaaggctaaacacantnaacaatggccatttaaagncnttgtaactaatttgcacatctcngncacaangaantttatcaangccgttttag

SEQ ID NO: 23994 - DNA, 666 bp, Triticum aestivum
  unsure (1)..(666): unsure at all n locations
  Clone ID: PAT_TA_23994
cngcgtgcctgaagctttntattnccccgaaaggntccggttctcccctgggaaactggtttaaaagaccgttttggacnntnagtccggttaaacgggtcccttnagccatcaggtggagcagaantagatacccnctggttttcncnccggttgatatgacncggcanatnatcagggctttccggggacgggtantttgcgttgtgtcggcgttnangccggnttnagcataccgcgggcgcagcccatggcatnttngacacntgtttngacttcagcggcccagtccaggtcagcttaccaaccgtcgtactgtgttctccggtgggtncnccgtnaacntcgcttcttgacggaatcattttgggcagctgcnttgctttcgcgnccaacagcgacgacagctccntcggcatcatcggcaacgtgcagcagcgcacgcttgaggtgctgtatgacgtcggtggcggcgtcgtgggattcaaggctggcgcatgctgatcggcgcgcacaagcacgccattgatactattgggatctccagttcgtcgtatacttgtttgctgctgcgaggggccaaaccatcagcgcactatagtgcttcgacttgcaacgtgatgcaagcgtcccgtcccccatccggcacgtgcttgtaatttattg

SEQ ID NO: 23995 - DNA, 1077 bp, Triticum aestivum
  unsure (1)..(1077): unsure at all n locations
  Clone ID: PAT_TA_23995
tcactcatgccccatgagctgaacccagtccagtctccagtctcgagcgtaatccattcattaatgggggaggcgacggcgacggcggaggcagaggcgccggtgagcagctgggtggtggagatggagaagacgatcggcgagatgcacatcgacccggcggcggagatggcgcggtggaagcgccactccatctaccgcgtcccggagcggatcaagaacctgcacaacagcaaggcgtaccagccggagctggtctcgctggggcccttccaccacggcgacccggagctgctccccatggaggagcacaagcgccgggccgtggtgcacctggtgaagcgctcggggcggccgctgcgggagttcgtggccgccgtcgccgaggtggcgcagcagctgcaggacgcctacaaggacctcggcgacgagtggcgcggcgccgccggcggcggcacggaccgcttcgtgcagctcatggtcaccgacggctgcttcctggtggaggcgatgcggatggacgcgctgcggggcaaggtgcacgaggagtacgcgcccaacgaccccgtcttcagcaagtacggctacctctacctgtggaactacatccagtccgacatggtcgtccgtcgagaaccaagctgccgctgctcctcctccagaggcttctcattgtcctccgatcatcacaaatatcaagaacgcttcacgagtgagcaagttggtgcttgatctctattccgtggcgggagaacttggntgggatcaacaccttgggtccacctctcgacatcttgttacacaanctcaaccacggcgacatcaagaccacggttgacgctattcatccctccgcgatggagnttacaagcggatcattaaggtgagcatacgaagctctcgacgtcacttnaactggaactaacatccggcgatnaggtcatacagacgagaagattttaactatgngtcacggtcaccgggtgaacactacggttctattagaaatatatngcaaatgggtgtaatcaaatacattgtgacacagnggccttaancnaangggttnccctcagn

SEQ ID NO: 23996 - DNA, 1132 bp, Triticum aestivum
  Clone ID: PAT_TA_23996
gagacttagccatcctgacatgctaaatgtcacctgacctgatccattacatattatatttagctaacgcaacgtaacaataaagtaataacacacagaaataaccaaaaagctacaaatatctactccatatatctgctaaatgtcacctgaactgatcgacatggtcagaaactacagacggccataacaagttcaaaacttcttctttccttttttctcttgaatgggggaggccgggcagcaagtgaatggcattccgagatattcagagagcacacgaggcttgagttgttgttcaatcctgtccttgtcatttccacaaagaaacttacgggaacccacagggtgcaaaatgtcccagttggcaggacagaatgcgcagctcctcctgtatttgtcaagaggctcttcaatgacgatgcacacttcaacgatgggatttggatcgtagtgcacctcagcaaaaaatcgcttgatcttattgcttttgcggctgcgagcccagaagttgacgtggacccacagctgattcctgaagctagcattggattccatcagaggcttcacaacatcaaactcgtcacccgggtgcctggcattgtaatggcggatagcatggcggacgtgaggcatgatggaggagtcgcgcgttccttctgagtgggtcgaaggtaatggagggcacttcttactccatcgcttcactttgcgctcgtgctcacccagttggctctgcaatcgtacccgctcctcacgtgacagctgtggcagcaggtgctccaacgatggaccgataaatggctcaaatccttccaaattcagcctagaagatcccataattgatttggcaatacactccggctgaaagtgatgcgccgacgaaggtggttggcgtctggactccaacgtcaggcagcaaaccaagaggcgcgccggcgtctgctccgcaggcggcaggaggagggtgggggacgagcggcggcgaagcgtgtgcgccgggaggggaacggccgaagacgatgggcctattcgagccacgcactgaaaatagaagaatcgccactgacaatatttgcatcaaactgaacatttactaacattgcaatcaccgcttgctacggacgcgtgg

SEQ ID NO: 23997 - DNA, 652 bp, Triticum aestivum
  unsure (1)..(652): unsure at all n locations
  Clone ID: PAT_TA_23997
gaacctcctacggtcgaaacgggggtcctgttgatcgggaggggtgtggcataccacaaaacggaggaaacggacctcctacggtcgaaacgggggtcctgttgatcgggaggggtgaaggcgtaccgcaaaacggacctcctacggtcgaaacgggggtcctgttcatccgggaggggtgttggcgtaccgcaaaacggacgaaacggacctcctacggtcgaaaccggggtcctgttcctcgggaggggtgttggcgttaccgcaaaaccggactccnacgggatactgttcatctccaccgtcgacctcctccaacctccacagggctaccgtcgacctcctccagcctccaccggcccctgttcatccaccccccctcgcgcgcccccccaccgcctccggttcacccccccctcccctccacggggtcctgccccaccgcccctcctcgggcaccctccaccccctgcggctcttcccgccctccaccgcaccccccgggcctggtcatccaccgcaaccgcgccgctctctcttcggctcccacgtcattgtaacaaattcccccggaanctnatgtaacaataattggtnaatncncattcaaggatcccaacggtaattaacncnttanccggtaatacaaact

SEQ ID NO: 23998 - DNA, 304 bp, Triticum aestivum
  Clone ID: PAT_TA_23998
ctcgccctcgctctacctaatcctccgctgaaggtgggggaacggaacggaaaagaaccggtcttgcgcgcgtcctgatctcgccggcggagatggtggtggcggcggcgatcctgccggagctggccacgcagctggtggtgccggtggcggcggcggtcggcatcgcgttcgcggtgctgcagtgggtgctcgtctccaaggtcaaggtcgcccccgagccgcgcggtgagggcgggccggccggaggaggagccggcgccgggggcaaggacggcgccagcgagtacctcatcgggggggt

SEQ ID NO: 23999 - DNA, 925 bp, Triticum aestivum
  Clone ID: PAT_TA_23999
actcgagaagcatgacttataaactggagcggaggaagtacccaagtatcaatttacaagtaagtactcagaacacttgcaagtatattaaacatggtcttcaacagagataaagtgcaatcagcttacaagtgcagaggtactcagtttatctctaataaagacagcacaatccattgtttcagagcgcacccacgcgaaattgacgagctgcaagcataggtccagcacactggaacacttgtgcgaaccttaattaaccagggccgacctttgggatatcatagtgctcactaagatttgcgaggtactggttgaagtcctggatgcggtccctgtgcgacttgtcagccaccttggccagcttgtgtacatcgatcttctgcttctgttcaatgtaacgcctctcggctggagtgaggtggtcataatcggcttgcgcactcccttcctctcccagcttgtcagcttcactgaattcattgtcagggtcgcctggtaattcagagcttccaccttcgcggagctcgctgtgctcgccttgagacgactcctcgcggcggtgcttcttcttattcttcttcttgactccgccctccttgacatccagcggtttccccttcagtttgagcttccccccaacgacgttcttgtactccgacatctcgactgcctgacgggaggaatcgcttcgcgggagcctccgatccgcgccgatccggtggaggacggtaggcacggggaggaggacgaggagttcgaggcgcttcggtggttggctcagcggcgacggcgacggcgccggcgccggccgaggaggagcttcgggccgaggctcggtggctccggcgaaggtcgagggctcggcggcggccgatttgggtcggggaaggggatcctaatggtgcgagaccaccagggtcgg

SEQ ID NO: 24000 - DNA, 1274 bp, Triticum aestivum
  unsure (1)..(1274): unsure at all n locations
  Clone ID: PAT_TA_24000
ttttttttttacaaacaagacatgggtttgacttggctgaacgaaatcagttcactgagcacaacattttggtggtcctttggtaacggtaacggaaaaaacatgctatcctccactggtatgtgtgatacgttaataggtaaaccgcgtcctcttatatcttgtgctacagctgaatggccgaacgccccatctcaactgctgatctgatcttccactgatggagaacataggatgaaatgccgtctttcaggtgctcaacaccgagtcggacttcggaccaaggtactgctgccagatctcgccggatcctttttcttggtgctggaggccatcttcagtgcaaacattcttgggtccatcatagtagagaatgtctgtgttagcgtctgcgcgcttccagttggtagggagctttagataatcgttatagaaggccagagtcattgccaacataacgctgtcccttggattagctagtttgacagccatggtccaaaaggcgatagagtcaatcagattcctctttatattacgtggctccaccaggagcacatcaaaatcaagaaagcacgcatccttgtcaaaagtttcagtatgatgtaccacccctcttggagctgttctttgcacagcattcagaacatccatactgatgtaatctccaaggcgcatgctacaatcttcagaagcacccacggcataactgcccaaatcaatgcgaacaaggtcttcaatttttccctttatgattgagtctgctgagatataaacatatctcgttcgtgagagagcccttgcaataacgattggtgacagttcattggggaatgacacaaaaaagtttccttctggagtggcaagatttagcttatccttgattttcttctggctagtaacagtaatatttgaatcaggtagcactgcttttatcttgtagtagggcacttgatcattgcctccttcaggtatcaagaaattgaaggatacatgatgcggatcacttgagctggacagggtggagtttgtcagcacagcaagagtacgaagatccagacagcttatcgaagagtagacatctacagtttcaacctcatgggacagatcctgggggtggcgcgaggagtcgaaggggacccaggtgcgggagcggtcggcggggtggcggaagtgggtggccggcaggaactggaggcccccgagcacgaggacggcggcgagggccagcatctgcatcccgggccacgcccgcggcgccggcnccggacgcgggg

SEQ ID NO: 24001 - DNA, 513 bp, Triticum aestivum
  Clone ID: PAT_TA_24001
tttttttttttttttttttttttgaaaagaactggttttctttagtcatgaaagtaaacagaagcatctgtcaccagaagggtggattatgaagatttcagaacacccacagccacaggtttttccaaataaaaaaacaaataaatcctatatacctcctcctagattgtgcaccttacacggggactagctttgacgacttttttgcctccagccagtgcttggcagcaacgctcgtcgtcaggaaccagccggccttgtcgggagcgccatggaagggggcgtcgagctccttgagatgcgactcgaacacggaggccagccctttgtcggagtacatgttcctcccctcccctgtgtggattccgagcagtggtggcagctcttcgccgctctgaagcgtcgtgtacaggtcgttcatccagacatggagagtggtcagggcggcgccgaccgagaggcctctgaggtgcagcgaccactgcgtctgcgtcctcgtctgcacgttgctgt

SEQ ID NO: 24002 - DNA, 684 bp, Triticum aestivum
  unsure (1)..(684): unsure at all n locations
  Clone ID: PAT_TA_24002
gctctttgcccgtaactctctcacgcaccactctgtcgtctcggagctcttcccccctctctcaaactctccatccacctgggtcacacatacacatgcatatctcactcgcactcgataggcccatctagaactctatctctctccctcgttctctctccatctcacacgcacacacacacaatctcatgcctagctagccaagtatggtggcctctcactcaattgtaggcacacgcagtcccccctatatgtatatgactagctaatcttagtctccatcacaaacatgtgcatgggtctatctcgatttctctccggggcatctttctatcgcgcacgcacctccctcgatntcccacccatatatcccctcacgatctcgaggggatctctctatcacaaacanaccctctcgcctccccatgcgtcatgttctccatgtgtactctcgactttgtccttggtgggcaaactctatgggaatgtgctanagggngtcncccccgttgcaaaaananaactactactcgggtanaccngctccctttctatccggggatgatgcntagatgttctaagaacaaaataaaacnccaattacgttgtgcanttccttaaaaaacctttgaaatacattccttaannttgtttcttgnnaganccccggcaaaaattntnttn

SEQ ID NO: 24003 - DNA, 643 bp, Triticum aestivum
  unsure (1)..(643): unsure at all n locations
  Clone ID: PAT_TA_24003
gattncgccaagctcgtnattaaccctactaaagggaacaaaagctggagctccaccgcggtggcggccgctctagaactagtggttcccccgggccgccgctcgcccgccccggccgcctccatcgccgccgcctgctgatctctccctagggttagggtttgcggccggagcggagacccgattggattggattggattgaagcggccggcgcagcgtggtggaatcgaatcgaaaagattcgatggacgcgcagcgtgctctgctggacgcgctgatggggtcgtcgcgggacctgacggaggaggagaagaaggagcaccgggaggtggcgtgggacgaccccgacgtgtgcgccccctacatggcccgcttctgcccccacgacctcttcatcaacaccaagagcaacctcggagtatgcccaaagatccacgacccggccctaaagcaaagcttcgagtcctccccccgctacgctgccgccctccccaaattcgaggccgacctcgcccaccgctgcgagaggctggtccaggacctggataagaagatcaggcgcggccgcgacaggctggctcaggacgtcgtcgagctgccgccccctgctgcccacgccgaaaaggtcgagcagctctccat

SEQ ID NO: 24004 - DNA, 404 bp, Triticum aestivum
  Clone ID: PAT_TA_24004
ggaagaactccgggtcttatttagtccgtgatcggaggctaggcacggacgatttcttgcttagtctttgcattatacaaagtactagcacgtttgtacacttaatacagattagccagcagagcagaggtacagtgggcgggagctctcctcgaacatacagtagataacactgagtagtagctagggatcacatactggactcccaaacatacgtagtatttggaaactggccggccgagaaagtagagagcacggccaagctaggccgtgctttccgggcagatcgatcagctagcgtgcgctagctaccgcctgaaacgtgcgggcaacgtgtggccactggcctagaggccatcgttgccgtcgcactgccccttcccgcccccctctgccgtcggtgt

SEQ ID NO: 24005 - DNA, 683 bp, Triticum aestivum
  unsure (1)..(683): unsure at all n locations
  Clone ID: PAT_TA_24005
cctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcaagcaaggttgggtttatcttccgtgagcacaacgcatcccctggggtactacgatggccgggtactgggacaatgtggaagctgcctatgttcgggtgcaccgacgccacgcaagtgatcaacgaagtggaggaagtcaagaaggagtacctgacgcgtatgtccgcatatcggatccacaacatgcgcaagtgcagtgcgtcagctcatcgcctnaaaccacgggctgcaaggatccggaaggctaaacactcatcacacgggcacatataaatgcaatgcggtttgcactcganatgctttggttcctttcattacctctgttgtccagataaatagttgtctctccctccatcagcaaatcctgctatcacangtantatcancaanaat

SEQ ID NO: 24006 - DNA, 615 bp, Triticum aestivum
  Clone ID: PAT_TA_24006
tccgggaacccttacaaatcttagcattgtccctcccatattcatctagccatagcttcgatcgcctctcattgacatacgtagatccgcaccgcatgtctacccttgaggccatgatccttctgctgctgctgctcacgcccactgccgccggcgagggggcgaggaggccgccggcgacgtctgcgccgttcagggcgcggctgcacggccggcagccgctcttccgtggtcgagcggccaatgggtgcatgccgcggggctcccgcgtgccgccgtccgctcccagccggtacgccaactaccacaccctcgacgcgggcgtgtgcgaccacgccggtggccggagccggaagccgtgagccgagctgagcatcgtatcgtgttctttctttggagaaggtcatcgattcttctttttttcttacgaagaatatatatacacaagttatgctgaaagatgaaggatacataatctgtccaattactggatgtttttctccctcttcttcaaagaagaaacggggtttgattatggatctagactgtgagatttaatctcctgtaattttcgcgtctcagaccgttaaataagttctggtcaatttttcgtat

SEQ ID NO: 24007 - DNA, 852 bp, Triticum aestivum
  unsure (1)..(852): unsure at all n locations
  Clone ID: PAT_TA_24007
ctcgtgccgaattcggcacgagcaggtatcacttttcacgatacctaaaaggtggaatagcgattttcgaaccatttcctataagagaatggtttccattactttgagaaatggattcttatatcaaactatagctattgcattaaagaagaaaagaaactaatagaagtcgaagacgcggaatgatagtgaatagagagaaagatcttctgattttcttgtttctatctactaagacgccgttagagaattggagaattttcatgtctttcaattctccgtactccgtaattnggaaagttctgggaaggagacccatcattttgcaatggaaaacaacatataaaactcctggacatttccgaaatcaggccaagcgtctttaatacatatgcaaaaaaattcattattgggcccaccattggattagaagattagcttggtatgaatccgctattgggtttggatacgaataatgacatccgctccaggttgtgatgcagtcacctctttcctcatgccttcttagagctactctataccctctcccccgtgcctccccgcgggccccgtccaatccccccgacccgcgagtgccgccccaccgcggcttcattgccgcgacggggacccgagtacatggggttncaattccataaattgcatatagcaataaataancaacaaatccttccnaatattttagatagaagaagtcctccnaccaaatatnagaagatgtacctccntcaaatcaattgcacgataaataaaccaaatcagnatagagataatgaattgnggtgncagtagatactcaaatacgcaaatttgatttccgnagaaatcntn

SEQ ID NO: 24008 - DNA, 643 bp, Triticum aestivum
  Clone ID: PAT_TA_24008
cttctctactagagcagccgtaggcgaatgttccattccattttccctcttcccagagaggacaccagaggcggagctcgagccctctcgcagctcgcggccatggccccctcctgcggcgccgccgtgccgtacaccctcctgggcgcgctcctcagcggcggctcgtatgccccgtcctggccggcgtgcggcggccgcgccttcctccgcgactacgcccagcgcggcaccaacgcgatgctgtggctgggggtcctccgccgtcacgttggtcctgctccgccgcatcgccgcgctcctccgcctctgggccctcggctcccgcctccccggcccaccggccctcctcgccgaccccggcctcgccgccgtctgccgcgccggcggcgacatcaccggctatctatcaaaattgcatggcagttttggaccaattgtccgattgtggttaggccctcctcatctccttgtctcgggtcccgatcctgcccctatcaaacggaggctttccacggcggaagctaagttaccgcggaccgggcggccttccagcttagcttgggcaggacttcgccttttctttgcctcttccccgcaggcgattgtaccagggcgtccctgcacctattcttgaatgaaa

SEQ ID NO: 24009 - DNA, 1090 bp, Triticum aestivum
  Clone ID: PAT_TA_24009
ggcggcaccccactgcccgatctgcacgtctacgtagcacgtactacacaccatggcagccatgcagcgacttgtgctccttctgtccgtggcgatcgcggcgtcggcgcagggcccggccgtggcgcccgcggcgccgacgacgcccacgaccccggcggcgcccgctccggcggccggcacgacgaacatcacgggggtgctggccaaggccgggcagttcaacaccttcatccggctgctcaagtcgacgggcgtggcggcgcagatcgacaaccagctcaacaacagcttcggcagcggcatgacggtgttcgcgcccaccgacaacgccttcacctcgctcgcctccggcacgctcaactcgctgtccgacagccagaagaacgcgctcatccagtaccacgtcctctccaccgccatccccatgtcgcagttcgacaccgtcagcaacccgctccgcacgcaggccggcagcagctcgcccggccagtacccgctcaacgtcaccgccgagggccagcaggttaacatcaccaccggggtcgtcaacgccaccgtcgacaacacgctctacaccggcgaccagctcgtcgtctaccaggtgaacaaggtgctcctgcccatggccatcgccgggacgcccgcgcccgcgcccgcgccgctcgcgcccaccaagaccaaggagaagacgcctacgtcgacggtcgcggatgcgcccgaggccgaagcgtcgacggacacgtcgctcgcggcgccggcgcggatcgtcactgggggtggtgtcgcggtggttcacgtgcttgccctcctggcctgcgtctggtgggggctgtgacagcgccgcgcccgatcagagtgtgagccccaacctgaggtctagatccatgcacgtcgatcttttttgctcacttttcaaaggttgttggtctttttcgtttgatttgttcttatttcagctaatttttatacctctgtaattgctagggacatgtaaagtgaagtgtactattacgggagtcacatttttatgtaatgttgttattaaataaatatacatatttttatagtgtaaaaaaaaaaaaaaaaa

SEQ ID NO: 24010 - DNA, 1012 bp, Triticum aestivum
  unsure (1)..(1012): unsure at all n locations
  Clone ID: PAT_TA_24010
aatggttgaattgcttgtttctatgaactgagatcgccaataatgtgaaggatgccagtcttttcatcctattgtagattgcttagatctcgatatgccaaaagtaatcgcatgaaatatacagtaaaagccagtgtgatgtgtttggctacaactagtctgactacacgtcctcatataacatatcaaggacgcaccatcttaccagattaaccattcgacttaccaatgcagtgtggggagaaagaagtattgggactgcgtatccaagcaattgatgccatggactccttcgtagaaccctgtaagcgaaaaagaagttgcagtgtgcctgtacaaagagctagcgtaagttcagttacctgcttctcggaattttagttagctatttattgcaaaattgttcaattatgttgcttggcttattttagtttgctactgattacataatgccatagcctgttaatcctattatagactgcgcctatctatgtgtttgatacttactcttaagagttacctatttgcctgaacttaaatagatacttaagcacgtagatagctggtcatatgtacttatagggtgcagcagaattcacgtgtaatttacgttctgataccctgtttgtttaattggtttgctgttatcacttgttgcactagtaatgtctgtatgttcatagttacacaattgtcaggtttatttgcaagacaccgtctttttaacttatatatatgtgttggaatcattttatttacatctggacattgtatcatccacctgtgtggaatggtcaatctgcatatgaatncaatgatgatgctcaaagntaacaanggaagaagaatctgctcgcactnnaataantgcatttgagaacaatacacatncagcatctnagcacattatattgggattaaacaacagcanacgnccatgtaggccaaggaaangataattcntggaacaaggaagtctccctggactgtgttgcanacacacatntaatng

SEQ ID NO: 24011 - DNA, 434 bp, Triticum aestivum
  unsure (1)..(434): unsure at all n locations
  Clone ID: PAT_TA_24011
ctcgtgccgaattcggcacgagcagaagctgagacagggcgaatcatgcagcgctcttcttcttccttggcactggtggctctcctcatatgctgttccctggcaacaagctcggcggcggcggcggcccaaggtgcttctcgcggaatccgcgtgccggctgctcctccgtcccctaagccccggcagccgaatcggcccggcgaggaaccggtcgatccgccgccgccaccaccacaagagacgtccagcgggcgagcacgccgcaccgggaagaccctgcaagctgctgcaaactttttgttaattaatagtatgtacatgatgaatgcctgctcgatccgaattatttaatgtgggatacaacttgttgatttgtcctgtgtgttttccccccgcccgcctttncttntgcttgtgtgtgnaggtttgtg

SEQ ID NO: 24012 - DNA, 637 bp, Triticum aestivum
  unsure (1)..(637): unsure at all n locations
  Clone ID: PAT_TA_24012
tttttttttttaaaactcaatacaatcccaatttattaatacatgtgaatacaagaccaacatatgaacttaggacagtgtacaaatgcaccaagcaagcacgtacaaactactaacacttagattgatccatatttcctttccacctcttaacatttactaataaatactagcaaatctgcagtagattctcatatcattcttcttcggcatcgatcaatccaaacaagagaattattttatatctggatcctgaattgccgattaattggaagtacttgtatccttgccatttttatccggcttgttccttagtgctttatctttcttcttttcaccattagaagcaggtggtttctgcacaggcgctggtggtttcccttgcgcataagtttccagtccaggcataggacctctattactcggcgccttcgacttgggcggcatgttgtttggagtaagagaggccttgatccctaacggggcccggtccccatgcgccctaaaggancctattaccgcgccacggcctcgttacaantcctgacgggaaaacctgggttcccantaatncctgcacaaanccctttccancggngtatacaaaggcncacgatgcctccaaaattccaccgan

SEQ ID NO: 24013 - DNA, 724 bp, Triticum aestivum
  unsure (1)..(724): unsure at all n locations
  Clone ID: PAT_TA_24013
attatattaatgcacgcacgatattacagcacacataagagctctcattagaatccagtgatagcacacaagggattacaggggcgcccctatattagaatatcctctgcattacaaagttcctctcacgcctacggttgtccccttggttctccgctatgatccgtgttgccgctttgtgtcgcactagcagcagtccactcttgaagctaaacactgcaatgacttacaaaattggcaccaaggcattgagtgccattctggatgcaatgaaactcatacgctccccacctgttgattcttgttcaagaatatgatcctaatgactattctaactcgtgccgcggcccgggacacagcatgggaattgcattctttggggcgttgtgattcatcatgaagtggggcaaccaacattgtatgcaatgaagcggaacctccaagaatatgcttcctcttccnttctttaacatgttccctttgtttatcctgtatttaanatgtacanaagttccttgtcaaggaaggggcgcaagaaatctgcatcaacaactgataaactggccgtacttgatngaaangttcaaatactaacggaatacacaccttttcaagctattcacttccaattananacnggtaagggtacccgtatgtcacagatcgccaatgagtgtccctgtacangttgaaaaanccaaattncagaccacacgcatncctn

SEQ ID NO: 24014 - DNA, 696 bp, Triticum aestivum
  unsure (1)..(696): unsure at all n locations
  Clone ID: PAT_TA_24014
cggccgagnnctcggcagggcagtgacccggaaagaaatgaaactctcatgcttggtgctgactgggccttgaagctgttacatgagctggaccccgcaancttatgattctggacagcattcagcaactgtcgggatacgctcgaaggtcaaatccgttcgcagacttgaagaattcattctggtattcactgatgaggcacgaagggaaattaaacgatacaggaacgacaagaaaccatcaaatctcctcgattatatcttgcagctgattcttgtttcatggctacgacttctcagcttcgcgtccgaagagtgcagcaaggattcccatgccaggcagctaagttgtggcggtgagctcttaaccatcgtctggctcatgaatcaacaccgtgaactgaagatcgttgccaaatacagataaactgccccgcatcgtatctcctctgccctgctctgctttgctttctagtattacacatttcagcaattactagtattactgttccaccctctttatttgtatctatttacagtttcctaatccgttccactgtgtgtacctgcccgggcggccgctcgaaatctgaatctactacgttaattgtcatgcctaatctagattggatctactctctcaatattgtataggatcgttcaaataaatgtcttaactgcttgaaaaaaaaaaaa

SEQ ID NO: 24015 - DNA, 825 bp, Triticum aestivum
  Clone ID: PAT_TA_24015
cccacgcgtccggtgtgaggcagcggcgtgcatcggcgccggaggcgcgctccgcctctccgctcgccctgctcgccgcggccgatgaccgcaccacccgagaccgcggccacccgaaaaaacggcggcgatgaggaggcccggcccttggcgccgacccgcgcccccgagcggcggcagcgtcggatccggctgccccgcggggccagccctcccgtccgcgccgcgccgcgtcgccgccggcatggaggcccctgctcgggcagcctccgcggcgtcgtcggcgtcgctgcggcggcggggtctttggggaccgcgtggcgggggaccggcgcggcttccggtcgagggttctggcgacgccaagccgtagatctgagccgccgtttgcacctcgcttcctcccatgtttcgatttggattctataaacgaaaaaaaaaaggtttcaagcattgcttggtgcatgtacattgaagaattcatggattgtgggggtatcagttaaagctggatttaaattccttcacgagccccccgcataaagagattatacaaacgagagagaaaagaggctccagaagtttttataacccagctcaagtggtttcaagcattgcttggtgcaactatatgtaagaattcccagatcgtggagtatcatttagagctggattttaattccttaatgagccccagcataaagagtgataaaaagtgagttttgtttcttctcttttgatcaaattccccatgcaggcaagtatattgctgatgcataatttgttgcttcagggatctcaaaaatatgatttgtatggagcggt

SEQ ID NO: 24016 - DNA, 1357 bp, Triticum aestivum
  Clone ID: PAT_TA_24016
tggcatcatggcgtcagggaatgcaacacaaaaatgcgataagcacagccacagagggcttgatccaagctcaacttgagctctaccaccactccttggggtacgtgaagtctgtggcgctcagggctgccacagaactaggcatcccggatgccatccatcgccacggcggtgtcgccacgttgtctgacattgccaccgaaaccggaatccacccgagcaagtactcccacctccgtcggctcatgcacgcgctcgccgttaccggcatcttctccgtcgaaggctccgacgatgatgccgggtacaagctcactgctgtctccagcatccttgttgaaggcggcgagagcatgtgtaacctgtctcccatggtgcatgtgcttgtcgaactgctgaagctgaccatgctctgcagcataaaagagtggtttaccgacgagcgggcatcagccatgactctgtttgaggtggcgcatggctgcacaccgtcggagatgaaagccaagaagggcacagttggcatgttccaggccgccatggtcgccgacagcaacctcgtcatggaggtagtcctgaaagagcatatcggcatttttaagggggtgagctcgctcgttgacgccggcggtggccacggtgccgcagcggcagcaatcgccaaggccctcccacacgtcaagtgcaccgtgctagacctcccacacgtgattgctggcgcacctaccagccgcgacgtgcagtttgttgctggcgatgtgtttgagtacgtaccacaagccgacgctatccttctgaagtggattctaagcatgtggcgagacgagggtgccgtcaaggtactacgccggtgcaaggaagctatacctgctggagggaaggtgataatcttcgatggcatggtagattctgggacgtcacaggatgttattctcaaggagacgcaagttctattcgatatcgtgatgatgggtgtcgatggggtcgaacgagacgagcagcagtggaagaagatattcgttgaagcaggatttggggactataagatcactccagtgggacatcgatccatcattgaagtctacccatgaatgaatgcatacatggtttggggtggttcgtctactattgaatcctaccacatggttttctaccaaaataagctcacttttgagcactccgttgtattatttgggttctttcacacacccaaactgctgtgactttcattttgagcaacacgagattttcatcctttgttccataaaaaaaaaaaattcctattttttttaatgctttcatgctttgttctttttttttttttaataaaaaaaaaggggggccgtttttggggttc

SEQ ID NO: 24017 - DNA, 793 bp, Triticum aestivum
  unsure (1)..(793): unsure at all n locations
  Clone ID: PAT_TA_24017
ccgttttcttccctttgcctcttctgattccagctgcgatcggcaggccccgagatccggcggcggcaggcactggcgatggccctggcggcggtgctggccgcagtggatggtgctcaggtggccaccgctgggggcaggcacacggtgggggtgccgcgggggctgtgggacaagcgcacgttgcatgccgggtgggtcgtcgccagagtgttccaccccggcgacaagatcaccttcgcgtcctcgacggagcttctcgacgtggtggaggtgggcaaggccggctacgacgcctgatccagcgccaacaacgtctccgccttccgctccggcaacgaggtcgtcgccctcaccgccgtgggcacgggttcagccctatgcggcctcaccggccactgcgtcagaggaatgtcgtcgcggaccgtgctggtcgccgcgtctaccggtcccgcggcggcaccgcccactgcgacagccgggggtaaatcagtcgccgaccttggcgcgctcgtggtgactcaggctctcctgggcagcatcagcgtctggtgaagtgtgtacgtacgtccgtagtatgcttttggtatcgcttttttttttggtgcttttggtatcgctgcttgtgattgatatttcagtttttactacgcggtggatatcgttttcggattaaagcgctttcgttttaacctgttgtgatggaactttcccccctgcctcccggtggatcgcgtgttcggattaaagcatacgtttataacctggtatcctgnaaatttcccaccagcca

SEQ ID NO: 24018 - DNA, 824 bp, Triticum aestivum
  unsure (1)..(824): unsure at all n locations
  Clone ID: PAT_TA_24018
gcacgaggaagtctccctcgcaacaactcgcccatttccctccacacctctctttctactactccagcccagtcaaacttctctcgacctcgaagcatcagccgccgcaccatggcccccaaggcagccgagaagaagccggtggagaagacccccgcgggcaagaagcccaaggcggagaagaaggtgccggcgtccaaggagggcggcgacaagaaggggaagaagaaggccaagaagagcgtggagacctacaagatctacatcttcaaggtgctcaagcaggtgcacccggacatcggcatctcctccaaggccatgtccatcatgaactccttcatcaacgacatcttcgagaagctcgccggcgagtccgccaagctcgcgcggtacaacaagaagcccaccatcacgtcccgggagattcagacctccgtccgcctcgtcctccccggcgagctcgccaagcacgccgtctccgagggcaccaaggccgtcaccaagttcacctcggcctagtttcctggtctgattcttgtgttcccttcctggtccttgtctgatgaattctgtaggtagctgtgttctgacagtgtcatgcgacattgtcatcttgtaacagagtttctgcttgtgggtttgtggctgttattcggtctggttaaatagtcaacttcacctcatcctagtattctcatctaatgtggtgaactgtagttagatgtgttctgaaagtgtcatcatgtaactttgtgctgatggtggctgttttcagtctaaataaatagtcatgttgctgctaaaaaaaaaaaaaaannaaaaan

SEQ ID NO: 24019 - DNA, 635 bp, Triticum aestivum
  unsure (1)..(635): unsure at all n locations
  Clone ID: PAT_TA_24019
acgaccaggnagctgctggctctggtgactacaacgacgatccgaatgcgagcggtcgctcgtatgatgatcttgactgaagcgcctgcaaggaagagggcaacaggggggataaggaggggcaaacggactggctggaagaaggaagggagtctgaatgcgaggaagagaagacaagaagaaggaagacttatgttgttgttgttgatccaaattgaattggaagcttttttggtgatgaagagtggcgccgtccgtctattgatctccgttgcctcctctcccctcccctcccctctttgcctgtcatggttgtagaaagagagagagaaaagtagagatgatattcttttgttgcctggtctggtctggtctggtctggttggtgggttgacttgactgaatatataccttcttgtgggaaggaagaagctccctccttcctaacttaaaaaaaaaaaaaaaaaaaaaaaaaaaaaaaaaaacaagtgaccggccttcctttcccccctgcccccccgggggggggtggggaagggaactctagcgatccgatccgaccctcttatatatacataatgtgttatacatgaatcagtggagtatgtttaaatggaaaaaaaaaaaaaaaaaac

SEQ ID NO: 24020 - DNA, 627 bp, Triticum aestivum
  unsure (1)..(627): unsure at all n locations
  Clone ID: PAT_TA_24020
ttaaaaaagataaattgaatctcaaattctttgtgtcttgacatcaggaaaggaaactaagcaatggtgaggtcgaatataagaattcaatatagaaagcatcattgttgtaagttcgtttattgtaacaattaggctaatgaacaggatcaatcagctaaatctcgcagtcgaggacctacttgaccagctttccagcaagcgtcgcgtcttgggatgcgcggctgggcgaggtagtactgtcacaggttgagcggttaattagaattttatgaaacaataagagatagaacagtacctggtataattatccaaggaaactctgttgagcagttaatacacacgacacatcaaactacaatgcatccgcagtatatgacaaccaaagacattcccataacctagaagacagctatgcctatcatatagattgaagaanggaagaaacagtgaaatccgaactcataccattaaacggttaaggcttggctccctgtccctacaacgtccttttcaaccctctaaaggtnactcctcaactnaacaactcccggcagttaacaccatgtacaacaagtgaattacaaacttttaccncatgggnaccgcagcctgtcggccgttact

SEQ ID NO: 24021 - DNA, 668 bp, Triticum aestivum
  unsure (1)..(668): unsure at all n locations
  Clone ID: PAT_TA_24021
ctcgtgccgactccggcccgagatccaatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtgggtatgcagatctttgtcaagacctcaccggcaagacatcaacctggaggttgagtcctcagacacattgacaatgtgaaggcaagattcaagacaaggagggatcccccggacaacaacgcctgatcttgccgggaagcactccaggatggccgcaccttgcgggttaaacatccagaaggagccaacctccattggggtaaggtccttgggggaatcaaatattgtgaagacctcacgggaagacatcacccggaggggggcatcgaacaacaaacttaagggaatttcgggagggggggcccccccggcgcaaacccctcgtatggnaaaa

SEQ ID NO: 24022 - DNA, 2839 bp, Triticum aestivum
  Clone ID: PAT_TA_24022
ccttgccttagagctttgtatgcagaagcaacagagctagttggcatctatgggaagagggatcaggagctcatgaggttgctctccatggagggtgatgatgcctctaacaagagactgaagaaggtctccattgttggatttggagggttgggcaagaccactcttgctagagcaatatacgacaagattaaaggtgatttcgattgtcgggcatttgttccggtcggtcagaaccctgacatgaagaaggttttaagggatatcctcattgatctcggcaaccctcactcagatcttgcgatgctggatgccaatcagcttattaaaaagcttcaagaattcctagagaacaaaaggtatctcgtcataattgacgatatatgggatgaaaaattgtggggaggcatcaactttgctttctccaacaggaataatctaggcagtcggctaatcaccacaacccgcattgtcagtgtctccaattcatgttgctcgtcggccgatgattcgatttatcaaatggaaccgctttctaccgatgactccagaaggctcttccacaagagaatatttcccgacgagagtggatgtccaaatgaatttgaacaagtgtctaaagatatattgaagaaatgtggtggggtaccactagccatcattactattgctagtgctttggccagtggccagcacgtgaagccaaagcgtgagtgggatattctgctcctgtcccttggctctggactaacagaagataacagtctagaggagatgcggagaatactctcgttcagctattataatctaccccctcatctgaaaacttgtctactgtacctatgtatatatccagaagatcgcgagattgatagagatggactcatatggaagtgggtggccgaaggatttgtccgccatggagatcaagggaccagcctgtttttgctcggattgaactacttcaaccagctcattaatagaagtatgatccagccaatatatgatcctctcggccaggtacatgcttcccgtgtacatgatatggttctggaccttatctgcaacttgtcacatgaagcaaagtttgttaatctattggatggcactgggaatcacagcatgtcttcacaaagtaatgttcgtcgtttgtcccttcagaataaaatggaagaccatcaagccaagcctctcacaaatatcatgagcatgtcacgagtgaggtcaatcactatctttccacctgccgttagtatcatgccagctctgtcaaggtttgaggttctgcgtgtacttgatctgtcggactgtaaccttgggggaagtagcagcctgcagcctaacctcaagggtgttggacacttaattcacctgaggtaccttggtctagcaggtaccagaatcagggaactcccggctgagataggaaccctgcagtttctggaggtgttggatcttggatgcaatcatgagctagatgaagtgccgcccactctttttaaattgagaagattaatctacctaaatgtttctccctatatggtggttccaactcctggtgtgttgcagaatctgacatccattgaagtgttgagggggatcttggtctctctgaacattattgcacaagagcttggcaacctcgcaaggctgagggagcttcagattcgcttcagattcgcttcagagttagcttcgtatgaaggtttcgtgaagtctctgtgcaacctacatcacatcgaaagcctaagtattagttgcaactctgaagaaacatcttttgaactgatggatctcttgggagaacgctgggtgcctcctgtacatctccgcgaatttgcgtcatacatgcccagccaactctccgcactgcaagggtggataaagaaagacccctcgcatctctcgaacctctctgtgttattcctcgattcagtgaaggaagtgcagcagctggacgtggaaatcattggggggttgctgtcccttcgccgtctctacataaggagcacccaccaaacacagcggctgctagtcatccgtgcagatgggttccgctgtatggtatggtttcagttgaattgtggatcagcagcgcaaattaagtttgaaccaggagctttaccgagggcggaagcagttgagttcagcctgggcgtgtgcatggcgaaagaagatggaaactgtggtttcgacttgggcctgcaggggaacctgttctcccttcggcagaatgtccgggtttggatgtattgcggtggagcaagggttggggaggccaaggcggcggcagctgcggtgaggcacgtgctcgaagcccatcccagccatccccgtatttatattgggatgatcccggatatagcagaagatgctcatgatgacgatttgtgtgaggacgaggagaactgatttctgatccagagcgactcacattgcatctgatgtgctctcaggtagcaggggtgcgggacggtggggttactgctggtggcatcagagatgaatgtttcacaaacattttgggtgggcgctggctgtgcaaaggtttcaaactttgctggaagttgtgtgatgagcttcttttaaatggcactcagcttgcagaaagagatattgcttggttttgtaatgaataagtaagggtgttggtgcgaattgatatcacaaggatagctttgcagtgcttcagttgagggccatcgccgctgctctgttttgcatgtttttacatgggagggctagcccatggcatgctggtgttttttgtttttaagctgaactggacaaacatcagggtgtattatcaatttcgtgatgaatgaattgccgtccacag

SEQ ID NO: 24023 - DNA, 3752 bp, Triticum aestivum
  unsure (1)..(3752): unsure at all n locations
  Clone ID: PAT_TA_24023
atgcagattgtcatcggtgccattggcaacctgcttcccaagttgggggatctgctcacggaggagttcaagctgcacaaggagtacaagaaaaattttgaggacctcgacaaggagcttgagagcatgaaccaagccctcatcaagataggtgaggtgccggatgagcagctcgacgaccaagacaagctctgggccgatgaggtcagagagctctcctacatcattgaggatgtcgtcgacaaattcctcgtagacgttgatggcattcagtctgatgataacgaccacaaatttaaggggctcatgcggaggacgatagagttgttgaagaaaaacatcaagaacatccaagagcaactccaaaaggtggctaataggcgtgacaggaacaaggtatttattcctaatcctacgccaccaattgctattgacccttgccttcgagctttgtatgcagaagcaacagagctagttggcatctatgggaagagggatcaggagctcatgaggttgctctccatggagggtgatgatgcctctaacaagagactgaagaaggtctccattgttggatttggagggttgggcaagaccactcttgctagagcaatatacgacaagattaaagatcttgcgatgctggatgccaancagcttattaaaaagcttcaagaattcctagagaacaaaaggtatcncgtcataattgacgatatatgggatgaaaaattgtggggaggcatcaactttgctttctccaacaggaataatctaggcagtcggctaatcaccacaacccgcattgtcagtgtctccaattcatgttgctcgtcagccgatgattcaatttataaaatggaaccgctttctactgatgactccagaaggctcttctacaaaagaatatttcccgacgagagtggatgtccaaatgaatttgaacaagtgtctaaagatattttgaagaaatgtggtggggtaccactagccatcattactattgctagtgctttggctagtggccagaaggtgaaaccaaagcgtgagtgggatattctgctccagtcccttggctctggactaacagaagataacagtttagaggagatgcggagaatactctctttcagctattataatctaccgtcccatctgaaaacttgtctactgtacctatgtatatatccagaagatagcgagattaatagagatagactgatatggaagtgggtggccgaaggatttgtccaccatggaaatcaagggaccagcctgtttttgcttggattaaattacttcaaccagctcattaatagaagtatgatccagccaatatatgatgatataggccaggtatatgcttgccgtgtacatgatatggttctggaccttatctgcaacttgtcacatgaagcaaagtttgttaatgtattggatggcactgggaatagcatgtcttcacaaagtaatgttcgtcgtttgtcccttcagaataaaatggaagatcatcaagccaagcctctcacaaatatcatgagtatgtcacgagtgaggtcaattactatctttccacctgctgttagtatcatgccagctctgtcaaggtttgaagttctgtgtgtacttgatatgtcggactgtaaccttggggaaagtagcagcctgcagcctaacctaaagggtgttggacacttaattcacctaaggtacctaggtctatcaggtaccagaattagtaaactcccggctgagataggaaccctgcagtttctggaggtgttggatcttggatacaatcatgagctagatgaattgccttccactctttttaaattgagaagattaatctacctaaatgtttctccctataaggtggttcgaactcttggtgtgttgcagaatatgacatccatagaagtgttgagggggatctttgtctctctgaacattattgcacaagagcttggcaaactggcaaggctgagggagcttgggatttgcttcaaggatggtagtttggatttgtatgaaggttttgtgaagtctctgtgcaacctacatcagatcggaagtctaattatttattgcaatcctggagaaacatcttttgaattgatggatttcttgggagaacgctgggtgcctcctgtacatctccgtaaatttgagtcttccatgcccagccaactgtctgcaatgcgagggtgaataaagtcgcatctctcgaacctctccgagttaatcctcttgtcagtgaaggaagtgcagcaggaggacgtggaaatcattggggggttgctgtcccttcgccatctcagcataaagagcacccaccaaacacaacggctgctagtcatccgtgcagatgggttccgctgtatggttgacttttacttgaattgcggatcagcaacgcagataatgtttgaatcgggagctttgccgagggcggaatcagttgtgttcagcctgggcttgcgggtcgcgaaagaggatggtaactctggtttcgacttgggccttcaggggaacctgctctcccttcggcgtggtgtccggatttggatgtattctggtggagcgagggtgggggaggcaaaggaagctaccctgtagactgtagctgtgtcaatttttaggctttctctaatctgtaaattgtttgtcatgtaaaaggaagatagaaatggcgtagcaaattcttttctgtcaaatatgctgtgtaattctttttaaaagccaacggagtctgtaccagaggcttcactaataaatggttttctagtcggcaaaaaaaaaaaggcgtgggccccccgccctcgctcgcccctgcccggcccgttcccccgagacccctcgcatctctcgaacctctcccagttaattctcgattcagtgaaggaagtgcagcaggaggatgtggatatcagtggggggggtcgatgtcccttcccggtctcttcctacagagcgcccacctaacgctgcggcggcgggtcagccgtgcagatgggttccgctgcgcggcgggggtggacttgatttgtggggaggcggcgccgagtttctgtgaggaagttgtgtgatcgtgggttcttcgataaatggctcactcgctttgcagaaaggagatattgctttggtttttgtaatgactaagtaggcgtgttgtagtgaattgatcctctcaaggatagcttgctttgcttcagttgagggccagcgcggcggctcggggtggccttggtagccggggccgcggtgacgcacgggctcgttgcccatcccaaccatccccgtatgggggtttcgtcgttcccgggtatagcagaagatgctcatcatgaccatttgtgtgaggactgatttctgttccagagcgactcacattacatctgatgtgctctcaggcagcaggggcgcgggacggtggggttactgctggtggcatcggagatgaatgtttcacaaacatttttgggtgggtgctggccgtgcaaagatttcgaactttgctggaagttgtgtgatgaacttcttttaaatggcagtcacttgcagaaagagatattgcttggttttgtaatgaataagtccttacaaggatagctttgctttgctttagttgagggccatcgttgctcctctgttttgcatgttgttacatgggagggctagcccatgacatgctggtgtattttgtttttaagctgaaccggataaacctgagggtgtattatcagtttcat

SEQ ID NO: 24024 - DNA, 431 bp, Triticum aestivum
  Clone ID: PAT_TA_24024
gattcattcttatcctcctccccccggtacctttatagctcccgacccccccgctccgtcctccaagccatcgtcctgctagcacccgtgaactccagccatttacgctgcgtcgatcgtttcgggagatcgttgctgtgatcgtgtgatctgctcgggagatggaggcttacatgatgttcccgcggagcaatggaaagagctgcgaggaggagcaggaggaggacatcggctgcccgtccgagtccgaggtttcggcggcgggctccatgctgtcgtcggacgaggagctcgacgacgacgccacctccaagctccagctcgtccggattcaaccgacaacttccagatgtcctccctcatggggcaactcccgctcaaggacggggccctccccgggcttccacggcttcggcgcccgcgcttgatct

SEQ ID NO: 24025 - DNA, 1080 bp, Triticum aestivum
  Clone ID: PAT_TA_24025
cctaaacccatcccgtccccgccgccgccgccgtccgccgcagccttccaccccccccccccgccggaccccgtacgcctccgcggccatggacgccgccaccgacggcgagcagcggcgcctcctctccatccccaaggagggcgagcgcgtcatcgcgccgacgcgccgcccggacgggaccctccgcaaggagatccgcatccgcgccggctacgtcccgcaggacgaggtcgccatctatcagtccaagggcgccctcatgaagaagtcagggccggacgtgacgccggggtacgaccctgcgctcgatgccaagcccaagacgaaggcggccaagcgcaacgagcggcgcaaggagaaacggcatcagggtggttcaacaaatgataaagggaagagcttggatatagaggaggctgatgctggagaacctgacaaggttcattcttccaaaactaagcagaggaatacagtggacagtataacagagcagataagtggcattgctatttctgaatctccagctacagcaaccccttccacaaatgccgccaacaacttacaaacagagtcatctgttacagagatagataagaaaatccgagcgctgaagaaaaagatacgcttagctgaaacccaagtgcaaggggacccagaaaaattgaaacctgagcaattggagaaaacgaaaaagattgaaggatggcgtgaagagctgaagcttttggagtctacaaggggtcatgctgcttcgtaggcaaagcgggcttggccctgatgtaaactgagctgtcatttctgcacgcccacttggcgttgttgctgacccgaaattcaatcgatcatgctatgcttcttcagtacctacgggtttgctggaaatgcattccggtgaacgtggggtttgcacagaatggaagatttttcaccacatttgttgtctcatgtaacacttgtcagttccaaaatttatattgcaatatccgtttgtcaaagatcatacagtggaggcgataactgatttgccatgggatggctgttgtttcagtgtgttaaaccaatttggggtttcatttg

SEQ ID NO: 24026 - DNA, 606 bp, Triticum aestivum
  Clone ID: PAT_TA_24026
ttttttttttttacaagaagaaccggcaggttaatttccttaatcggtctcataaatctgggcccacatgtgatagctcgccagatacccaccacgtggtagcttaaacttgttgtagctggactgctgtataagcacattcatatgaaaattcaaaaaaacattcatatgtgcttgagcagttaatcaaaaaggaaaggaaaaaaaaaagaaagggcttctctgctttcctagtctgttttctatgctctgctttagtgctcttgtcatgtcctgtgtgtgcgcgcgtattggtgtctacacacacaggccgagagaggtgctgtgctcatgctcgcaactagtagtactccatgcaacttctttcttatgagcacagccaagatctgtggccaagtatactctgggagttgggttgagataacccagaaagtttaacattattttccctcaacttgtttatcatatccttggtgtgcacatcaatgtgcttgtgtgaccaccagtgcaccttgtctcccatcgtcatacacatagaatggttgtggctctcacggtgttcagtaatgcacctacaggacctgctattcttggcctccggcttcc

SEQ ID NO: 24027 - DNA, 664 bp, Triticum aestivum
  Clone ID: PAT_TA_24027
gaagaaaaacatcacaacttcataatgttgcaatcatgtagtaactggtaataccaactcgtctccgaaacaatcacaacatctgcggccagctttatgcagttacagtataaccaccaactgagataccctctgtcaattagtttgatttcctgtatgcccactgcttatcccaaggcatgatgtacaaactagacagcatgtccatgagaacaactgcagagcaaattttccaagttccaagttgcatggagtcctcaaataggataatttcatctagcgctgactatttcgtccttgtcgggttacatgtttctggttccatctacataagcttctagaatccggatgcaaaggagggatcaacagtccacgaacaatcggagtaatcaccttaagacagagttcccatgttctactaactttctaacatttgaccattgtctcgaacttttgtcagaacagaacctcacacacctctgttggctggaacaagtttgagaagctttgccagatcatatgagttgaaatcccttccgaaacataagctcaggtccaatggagtcttcccaccattggttcttcttgtctgatcagcaccattgacaagcaatatctttggtatatctcgatttctactctgtactgccaaatgcagtggtgt

SEQ ID NO: 24028 - DNA, 502 bp, Triticum aestivum
  Clone ID: PAT_TA_24028
agaaaactgaagctctagtctcacgagagagacacagaaggctctccggctctacgcctccgagctctacaccccggcctctacacctctaatgggggagcacgcgtacgaccacagcagcggcggcggcggcggcatgagcccgtcgacgccgccggtgcagcagcagcagcagcgtaggggctcctcgcgccacgcggtggtgcccagggccgccacgacccggccggcgataagggatcatccacatcatcgcgccggagatcatcaagaccgacgtcggacaactttccggggacctcgtgcagcgcctcaaccgggaaggcaccgccaccagccgggccgacgccacggccgacgaacagcgcggcagtgacggtgggcgtggcgcacgacgccgccgtcgccggtagaggagaagccgcagccgcaagaagaagaggctggcgcctgcgccggcgctggcggacgacttcgtggcgcaacaggagaacaggaggag

SEQ ID NO: 24029 - DNA, 566 bp, Triticum aestivum
  Clone ID: PAT_TA_24029
cactatcagcaacaaataactcccgcaattcaggatccaatgaaatcccagatggctgcgcaaacgatgtgttggtggggcttgaaccattcagatttttttcggagccattaccactgaaaacttcagttacactattaagggtgttgtgtttccagatttgatgttgtcccgccatcgcaatgtacacggtctcctccgagggagcatagcagacatcccatggtgaatttagaacctgattagttcctcggcctcctccttcgtagtcggaacctttggtcccatttccagctagtgttctgacagtctcattaacaaaatcaacctctcgcagtgcatggttctcagtgtccgctacatataggatattctttttgaaattgtatgcaagaccttgagggcgattaaacgaggcagtatcaaattggccatcaagtagtccttcttccgaacttccaacttggcatataaattccccgtccaggttagtgaccacaattcgattgtggttactgtctgatataaataatcgattgttctgtacctcggccgcgaccacgcta

SEQ ID NO: 24030 - DNA, 392 bp, Triticum aestivum
  unsure (1)..(392): unsure at all n locations
  Clone ID: PAT_TA_24030
gtgccgaattcggcacgagatcattttgacctctgccaaatgggttttaaaccaagagttagcctgcagatgtaaattgctacattccaagttctcagttttgatgtatgttgagttacggaattcaagttattgaaggcaacccgactgttaactgttgtaccgggagaaaattgcagtaggagcatgttaaacctacaaacttttaaatgactggccacagaagcttaggtgagggctcaggagagcggtctaattcccccttctgcaattggtctatttatgaagggtccaacagtttgggangccccccgggganatgaaaccgctaatgancaaactcgcagaggctggacaatgacatntgaaaccacctgactcttnaaccttgt

SEQ ID NO: 24031 - DNA, 662 bp, Triticum aestivum
  unsure (1)..(662): unsure at all n locations
  Clone ID: PAT_TA_24031
caggggcggggagtgaggagagagaggtgtggcggaggagccgtagctagggagagagagatggaggtggcggtgcctgtcatggcgccgagcgcgccgtgcagcccaagaaccgcggccgccatgggcggcggcggcggcagccacctgcccagctactgctacttcttctccagcgcccccaccagcccgtccagggccagcagctacgccgcggacgagcagggcgacgccgccacgttcgacttcgccttcggcttcagcggccagctccgggagtccacgcccatcctcgccgccgccgacgagctgttcgagggcggcaggatccggccgctcaacggcccccgctccagcggcggcggctgctcgccgacgaggactacgcctccctctccgtctccccccggtcgcccagaagaccggggccgtcctccgcgccccgcggccgcggcgcggccgagccccccccagcggcgccgcttggggcctccggccggcggncctggtctctntcgtcggcntgtntctccaaaagagggcaccgtcttgtccnttaagggaaccatcacacaatntgtctccaactcctccgggcgctctatccgttcgacgaaccaatgggtaagactttctttcaancttgggcncacncgaagncc

SEQ ID NO: 24032 - DNA, 629 bp, Triticum aestivum
  unsure (1)..(629): unsure at all n locations
  Clone ID: PAT_TA_24032
tcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaagtggaggaggtcaagaaggagtacctgacgcgtactccgcatcatcggattcacaacatcgtcaggtgcantgcgtcagtcatcgcctnaagcaacgggctgcaagatccggaaggctaaacagtcatcacacggcacattaagtcctgcctgggtgccgtctgcttgcttcgcctcctccctgtctccnatttccaaaa

SEQ ID NO: 24033 - DNA, 447 bp, Triticum aestivum
  unsure (1)..(447): unsure at all n locations
  Clone ID: PAT_TA_24033
gaagaaaccacttgaatgtgtttcctgtttaagaactggaatcagtgcaccaccgatttaattctttgaatgtgtggtttccaaagtaatctggaacgattttacggactgagttatttggcagtagtgaaattgccatcagttcgttgcacctgcggcggagtaagatctaagctgctgcacaaactcgtcgatgtatctctcatgccgctctgtatcggctaccacctcctgcatcctccctgcgcctgctacgaagccccccccgccccgccccccgcccgtcatgcccccgaccgccgccgcccacgccccgggcggtcggcacatccaacngcctcntccctcggcaacctgnacccaacttcctnggcccaatttgccngcgctttcggccctggnccccgnaaaatggnacatgacaagggntnaccgancaggngcctc

SEQ ID NO: 24034 - DNA, 665 bp, Triticum aestivum
  Clone ID: PAT_TA_24034
tgggctctcgccgccgtcgtccgaccgccaccttggtcctcgcgtcgttgctatgcctctacctcgcgccgcgcggggccttctcgctctccttcagcctcgactactccgacgccggcgccggttcgtcgatcgtcgtggctggcgacgcactcgtcagtccaccggcgctccagctgatgaaaaacagccgggcgtcgtaccggtacaaagtgccgctgtggaacggtgccgccggcgaggtggctagcttcgccaccgccttctctttccggatcaccccagacaaggacaaggacagcccgccgcagcagccaggcggtaggatggccttcttcctcggccaccacccttccgtggacgtcccgcgcagcagcgccggcggaggcccggccatcgtgacggtagggtttgacgccttcctcaaccatgtcggcatcgacatcagctccgtcaactccacggcgcccgcgcacacgacggcgacatggcccggcaagaacctcacgacgtccagtgtcatggaggccaccgtgaaataccacaacgactccaggacgctggctgttgctctcctcatcgatggtgccctgtaccaggccaatgcaaccgttggtctcagcagaattctaccggaggaggtcgcggttggtttctccgccgcc

SEQ ID NO: 24035 - DNA, 545 bp, Triticum aestivum
  Clone ID: PAT_TA_24035
ttttgactttattttatattttatttaataattaatataagtggcaatgtgcaacacaataatacaaaagtcagggattttaaccatctgtacaaatccaaaagaaaaaaaaaccacttgctccctccatcgatcgttgacgacagggcagatttcttctcgagacaccattttttggacatcgcaaactaagccctctcatttcaagactttgaaacaatcctaccaccatccacaagaacgtctggcgcaacgaaaagttactcccttcaatccatattaattgccgttgatatagtataaagttgtactagatcagccacaattaatatgaatggaacggggtactaaaattatgtatcgccatcttcttcctcttcctcgagtaaaaatcccaagactgaaccaagcaaagacccgcggccgttctcaaaacgtgctcatatcttcatgttggcgtacatgatgagctggagctccttgacgcagtcctgcatggccggccggccggcgctctcgaagcagacgcagcgcgcggcgaggcc

SEQ ID NO: 24036 - DNA, 630 bp, Triticum aestivum
  unsure (1)..(630): unsure at all n locations
  Clone ID: PAT_TA_24036
ctcaagctcatatatgccccgcctccatctcattcctcagtagctagtaggagtacccagttaagctcagccgtgctcctgtgttagttcaacacccgagcaaagctaggtagctgagccccggccgagcgatcgtgatcgtgatcgatggagcccaggcgccatcgtgtgccgtcgtcgtcgctgctgctcgtgctcgtggcggtggcgttggcggccgtccgtcgggcgctgcggcgcgcagctgccgatcccggtgaggacggacnggttcgtgttcgggggccacgccggctgcgccggcgtgtgggcgacgcggtggatcgccgaggccttcttcgacaccgngtctgccccngacagcgcgacgcctggccgccgctgcaaanggccgccgcnaactaaggggcccgccgcgtcnccttntcgtcaactcttccgtcccttacaaaaaangcttcaaggctnccggtcnatncacangtgcanacctaaatgctcagcgtgttccctgctcgaaaantctcattacaaganggttttacnacacncgacatcacaaaacatnaanacngtggtccccnaatacaacaactngcccccctcattgggagcaanttgnggaaaaaa

SEQ ID NO: 24037 - DNA, 786 bp, Triticum aestivum
  Clone ID: PAT_TA_24037
gattgattcttgaccatcacttgatcaactatattcattttctaatacaaagccacttcgctaattactcttatgactacttgaagggtttaaaatattcaggtatttcaagtgaccaacaagtgttatttcagtaatttgaaatctcctgtattcagagtttagtcaactcttagtcatgttctttaataatcattaggtctaataaaagtttagaacgatgcactattttcctgaattttgactaggcaagtgcatctttggttgcgccgatcggatcggattcaatgcgtacatcgtattgatggactgctgaccgcttcatctggtgtttcctctgtcgtgtgagttgcatgttgttttgagagcttgaagcaagcagaaagccgatggagggtcttagggatgacgaaagcgtcagtgacgacatcaggcgagagagatatcgagactgcaaatcgctttcctgtttttgcatttcttactgtttatgtaactttgtcagtattcagatcatatagcctatggggagcagtgtaaaacataatttgttgatgcttaaaatttggagtgatatgtttgatacatctgcactgttgacatggtcttctttaatgaataacaaggtggtccagtagaattgtaactttagagccctgcaaattgtctgtgcaaattatgatgctggtttatagaactaaatttgtggcgtgcctctattttatctttagttgtaggtttctccgaagctttattgtgggttgtgttacttgccaaacaagttct

SEQ ID NO: 24038 - DNA, 243 bp, Triticum aestivum
  Clone ID: PAT_TA_24038
accttcgcctttctgcttacatgtacgatcattcatggcatatatatacacacagggagccaccagagcccgcgacggggcgcgacttcaccggcgacatgcctgagattgagagtactcctctcatctgtagaaactatgggctgtacggacactatttaccagctactccatctctagagaaacgtaagagcatttagatcactaaagtagtgatctaaacgctcttatgtttctttaaca

SEQ ID NO: 24039 - DNA, 707 bp, Triticum aestivum
  Clone ID: PAT_TA_24039
gaattcactagtgatttcgagcggccgcccgggcaggtaactagtctcgagtttttttttttttttttagctgcttacatgtacgatcattcatggcatatatatacacacagggagccaccagagcccgcgacggggcgcgacttcaccggcgacatgcctgagattgagagtactcctctcatctgtagaaactatgggctgtacggacactatttaccacctcggccgcgaccacgctatatttaccacctcggccgcgaccacgctaagtagcataattacatttgtgcacgagaactggtgcgcactatcagtacgcactcgtcatcacgtagctataggtataggctcggctaaatcgcctagaggtcgaagctgtggctgttgaaatggaagacggcgccgccgcggcgaaggttctgcgacctgcactccctggccacgctggcctgcagccccgacggcccgcacaccagcacgccgatatcgaccgccgcgcccccgccccgctccgcgaacgccgcgaattccgcatggaactttggccggcacccgtaccgcgtcgtccgcagggcggcgaggctcgccgcggaggcgtcggctccaccagcagcgttcgttgtctgttcggcgtccgccgtggcacgggcgtcgacgtcccacctgtcgtcctgcatcctccgcttctccgagaggtgccagag

SEQ ID NO: 24040 - DNA, 646 bp, Triticum aestivum
  unsure (1)..(646): unsure at all n locations
  Clone ID: PAT_TA_24040
ttgtaaactaccgatcaccgctatcagttatactagcccttgtagttgggctagtattttggacgcaatctatcaacgcactcaaaggacccaaaatcactaacaaggtatattttgatattctccacggggataaagagctaggacgcatagtaattgggtctctacggtggtactgtcccaatcacagcaagagaactttccgagctttgggcaaccggcgaaaaaggaggcgacttatcatttggaaggatcaacctccacccgtgtcatcaaagaacttcaatgatacaaggaggagtttttacaaagggtgacggtacaaggtggaaanccaatatacggtgataattcccccgacgaaaacttccagtttgaaactccctccgaaaggncctctctcctaanggcaacgccggaaaaataccaatggtcctcatcctttattacactccaccctgggtancctgaacggtaaatgcctttttggggaattttggnaggtccaattatttacaanccaggagtccccaaatggtgaaagccaaagaacttcaaatactaagtgngaattccgttcaaaaaaggatccgcatccaatcataccccagccacgtatccacatnncaaatgtaaancgtgcttt

SEQ ID NO: 24041 - DNA, 432 bp, Triticum aestivum
  Clone ID: PAT_TA_24041
agaagcgcaactccagtgcctcggcgacatctatacagttacaatgatgttgatgtctggtacacatagaatagatacactgagtcctaataagtgactcggtacctgaattaccataaggtgtgtagtatgatactataagcactctaattattacagtaattactagcacccgcaacatgaatgtggaccaagaatgttgtccatgaatctgaagagggactgtcgcagtccaacttcacctgccatccggatgcatgatctgcgagaagacggcgctcggcgtcagcccgtccgagtccatgctcgcgatgctccgtcccgtcatgctcatcgtggtcgtgctcgtcgtggtcgtgcttgcgtccatcgacggctcgtccgactgcagtctggtcatgacgaggggcgacgcgcccgacgacgacagcg

SEQ ID NO: 24042 - DNA, 957 bp, Triticum aestivum
  Clone ID: PAT_TA_24042
cttgcctcccgtgtcttctctttttctttcattgtaccagctagggcctatggatcgcgtgccgacgtgtatccccacattttttttatcaatcgtcgcttccttatcattgctttcgtgcttcaacaatggttttatttcaatcgtcgcctccaaatctatgctgaatcgtgtgcaccgttgttgagtccgagaacagcttctactatgatcgagtggtaccgacagactgcacaagtgattggtgcatgagatggtggatgggtggatcatcgtccctcgccgccagcgctgagccgggagaagacctggctgtcggcgaggctcggtcagccccagtcgcgtctcgtccgcgtcgtccatcatgagcagagtcggtccgacgatcggcacccagcccggtcacgacgagggccggcgcggcagctgcggtcggcgaccgccgcctgctgtccccggtggcgtccccgctgtcctgcggctcctgcgccagcacgcggttcccgaggtccccccccacggaccgcctgtcgacgctgcggtcggccacgcatttctccgcggtctccgtggtcttggggaaccacgggggcgcgatgtcccccagctgccccgggtccctggcctgggcgagctcgccctgcttcccgcacccgtgcgccctgtcggcccactcggcgatgttgatctggtcgcggtcgaggctctggtcgatgaccgggcgcgcgcagagcacctcgaagagcaccacgccgaaggagtagacgtcggagcggtccgtgagctgctgcgtctggaagtactccgggtccaggtacccgaagctgcccttcaccgccgtgctgacgtgcgtcgcccccagcgtgggcccgatgcgcgacagcccgaagtcggccaccttggcgatgatggcgccgccgccggtgctgccgccgtcgtcggtcccgaggaggatgt

SEQ ID NO: 24043 - DNA, 520 bp, Triticum aestivum
  unsure (1)..(520): unsure at all n locations
  Clone ID: PAT_TA_24043
ctcgttcgagggagctgccgtgaccgggaggaagcaaggaggcgaaggagccacagcagccatggctcccgccacttccacctcgccgctatcccgcctcctgctcagcctcccgaagcccaacgcccagccgcccctgtgcgccaagccgccgagcgcggactccggcgcgggcgccaccagcaagaacctcgtcctccgccggcgcgaggccgcggcaccgtcctatccgccgtctcctcacacgcgtcctccccgcagccggccgcggcagatgagtgcgcgctcnaagcgcccctccggcctccgctttctgcgacgcgttcttcggaaccggcgcccgaggcctttaaaggcagtcatcaangcgactaccgggggatctggtaggacgaacggtttcaacacactacggcccgggagcgctgacacatggtgcctgggagttattaaggtgggactntcccccccgggnaaaggttccccataaatcgtggnaaaggactaagtcccggactgg

SEQ ID NO: 24044 - DNA, 636 bp, Triticum aestivum
  unsure (1)..(636): unsure at all n locations
  Clone ID: PAT_TA_24044
gccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaaggccgccggcgccaccctcctcgtccgccgccaccgccacccacaaggcgagctccggcgggatggagatggcggcggaggaatggcggctgcggctgcacccagtgcaagtgcggcaccagctgcggctgctccctgctgcagctgctagattattgatcatcgattatgccatgcacccgcgcgcatgcatcatatctatgatccgattcatccatccatctagtacaatgtttacgctacttgattcaaggcctttgtatgtatgtttaaaacctgccaacatgagcaagcaagggnaacccccatcatgttaaccgaccctaaataatctcccgtgggtttaacctaaagttttgtttataacactctggcanttacaacaatncaangctggtncaataacaactaatgncctaancacttcacncttgaacgttacttcttaaaantattatttaaggtnanatcgcancttgaaacatgntgggaatgtantt

SEQ ID NO: 24045 - DNA, 816 bp, Triticum aestivum
  Clone ID: PAT_TA_24045
ctcgtgccgaattcggcacgagcctccgtcttcccctttcctacctcccctcgccgcaccgcgctaatcaaaccctcgccgcaccgcgctaatcaaaccctcgccgcaagtaagaaatcgaggagcgaaatccaaaaccccgcgagccaagccggcccgcccgctcacccacccgcccggacccgccgccatggtggtctacacgcaggagcacgtctaccggcacccgtgggaccgcgtgacggcggcggcgtggcgcaagttcacggacccggcctcccgcacggcgctctcccacgtcgccgacgtgcacaccctgcagcgccgcgtcgacacggacgccgggcggcttcaagccgcgcgctccatcaacgtgcgctccccgccgctcccctttatcctgcgccgcctcctcccgggcgccgccggctccccctcgggcgccgcgagccgccccgcttccgacacctcccgaccccacgctgcccccgcaacgccgcccagccgcacccccgaccgggggccccccgccgcttccgcccacggccccccgtggggccccaagcgggtcgccccgccccgcccggtacccggccttagtggcttcccaacttgggatcgtgggtgggtttgggacggggtggctaccttcacaaacatgattaggcttttttccaaggcccgatgggtgaccttccttggggtccgggggcccgttcttctaacttcacaaaaagaggtgtagtggaataaacgctccgccgcgtgggtggcgcccaccaaaaaaaacggtgtataacgactatgcgacgagaa

SEQ ID NO: 24046 - DNA, 701 bp, Triticum aestivum
  unsure (1)..(701): unsure at all n locations
  Clone ID: PAT_TA_24046
ctcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaagagctcgggaagctgctggccggcgtcaccatcgcgcacggcggcgtcctccccaacatccactccgtgctcctgcccaaaaaggcggcgggaaagcggcggcgagcggcgaaggcacaaagcccaaaaaggcgccaatcccaaaaagctcacaatgaggcttaatcccgttgcgttcaattcgcccaatcggggttgatttcccccaactccctgtgtctatggcgtcctcatgtcctcatcaccccttgtgtcttaagggctgttctcctcaacngagaaatcttcaacatcanactcnttgtgtactaaaaaaaaaaaa

SEQ ID NO: 24047 - DNA, 603 bp, Triticum aestivum
  unsure (1)..(603): unsure at all n locations
  Clone ID: PAT_TA_24047
ctctacggctcccccgggctgtaccccatcggcatccaggcgcacgcgtcggcgctcccgggcgcggcggcggcggcgcaggcggagcggcagcagcaccagcagcaggacgccgccgtcctcgcggccacgccggcgcgcgcgcgggcgctgctgggcccgatgccgttcctcgtgggcggcgacgaggaggtcagcttcgggtggcccggcagcttcaggccacccccaccgggcgccggcgtgctccccctcctccactcaggccccaacttcggcagcagcagcggcagcggcagcgtcgtggtgcaagccgacgaggagccccgacctgacgctcagactctagccgccatccgttacgcangccgtccatctgctgcgcttatacgtacgtgctaggttggtgcaactcgtcaggctcccgacgccgatcaacggatcatggtggtagacgacgaccctatttgtttcatgcctgcgtgcgtacgtacgggcgtacgcccgtggttgggtgcccgcgctggtttggtgctcctctgtcctattggtcgcggcgcgtaccctgcgtcttcccccggtttatcaaagattannatcttt

SEQ ID NO: 24048 - DNA, 435 bp, Triticum aestivum
  Clone ID: PAT_TA_24048
gcggaggatgagaagaagcacgagaaccacgagaccgagcactgggcccgagtaccggtaagttagccgtggcagaggcgggaagatgggtgcgatacaagcgcatggtggtccccgctgtcagtgacggcgcccggtcgccgatgggtgagctcgagccgcctcgagccgtgccccaggatgggcgcgggctcggggtaggggagggtaggggaggcggtgaccggtgactggcctagaaatgcgagttttggaatgaattatccgtggtcttttgctgtttggcattttgctcttgggatcatggtgctcaacgaacccaacttgttgtgttgttgttgcgtgttgcagccgtatcgatgcatggatggatgtacataccaccacccctgaaataataacaggaacgtgcacacaaggtgtcccgttcgtgtt

SEQ ID NO: 24049 - DNA, 635 bp, Triticum aestivum
  Clone ID: PAT_TA_24049
ggaaaggttttgttaagatcgctatggagactggttctcctttagtcccggttttctgcttcggacagagccttgtgtacaagtggtggaggccaggtggcaagttgattgtgaagattgctagagcaattaaatttactccaattattttctttgggaaatacgggactcccatccctttcgcgacaccacttcatctggttgttggaagaccaatcgaggttcagaaaaatcctcagcctacatatgatgagataaacgaggtacatgaacaatttgtggttgcgatgcaagaactattcgaaaagtacaagacaaaagctggatatgacaaactcgaattgagagttctatgatggccgttccaacatccagatataggatctttcaaagttgcgtttacagggttcagtagcattcaaactggagtgtgtttatgtcaagccttcgccagggttcagtagctctgaatgtgtaggaaatcccagcagccagaatgacatgctcacctggccttgcaaaacacataaaatgtaaaaattgtatacatttgcgtgctcataaagcgctcaagagctaagacataggatgtaccgattgtatatttgtttgctcataaagcactgagtttcttc

SEQ ID NO: 24050 - DNA, 1054 bp, Triticum aestivum
  Clone ID: PAT_TA_24050
tagcgtggtcgcagccgaggtctgaaatcaaggaaaggttttgttaagatcgctatggagactggttctcctttagtcccggttttctgcttcggacagagccttgtgtcaagacccacatgaacacttttgatgtggacaaaagaccgcaccttggtacaaaatagcggctgcagcagaaaagctggcacagtgccaagagactatgttgattcttgatcgtcaactgcaaactatgcgtcctccagcagagtcaatgggtgcctcgccaacccggcaacgaatggaggacttcttgcaagacgcggcaggaacaaccgaaggaggcgagtatgcccaagaaaccatcaggccagcatgatagagatcaggaaatgctggagtcagggaatgtatctcccctcaacggatacaagacccacatgaccccttctgatgtggacggaagcccttccctttcaacaaacagttccaagcgcccaaagcataggtcgcgatcctcatcttcttcctcgtttgctaaccagttgcccgagaaacaaagccgcggctttagtcggttcttcgccaagggcaaagagtgaacattagctggattgcaagattctgtgatgttggcttgttgattcttcggcgaatggatcgatgacggatgaatgcgggtcatgggtttctatagagctactcggcgaatctgcttgtgtattattttgaggtgacgcctccggtggttcagttgctggggtaatacttgccttgcagtcgagcggttatgaccaggttgtgtgtgtgtgagaatgtgtgttagctgtcgttatcttctgctagagttttttctgggttgctgtttgtctgaaacctcactaaaacctcactgtacatgtgcttacctgcatgaagaagagagctgctgtttgtttgtgttccaaaggggggggcccggtacccagtccccctcgtgggggccctatctggcttcatgtacagctaagttaacctgcgtcagtttgaaggttatcattgtgtttatttccaaaaaaaaaaaaaaaaaaaa

SEQ ID NO: 24051 - DNA, 1053 bp, Triticum aestivum
  unsure (1)..(1053): unsure at all n locations
  Clone ID: PAT_TA_24051
ctcgtgccgaattcggcacacctgtacgcggtgtcctctacgaacctgggagtgaaatattctcccagagccaagttcagccaaatttcgcaatatcaaagaaagttggcccacgaggcaaaaatccaaattactcatccacgtcgattatttcgctcccaacgagctttgactcctatcttcgtctcatcaagtctacaagtacgaccaagtacatcctcatcccgatgaccacacccctcttcgaccttctctggcccccagttgacccccgtacacaggcccacgcccgatcctttgtacccaatggtagccaacagagcagggcgcgcaaatctcgcaagatcgtaattggagatgcacgtgagaggaatcaaaggaaaatccgccattgatgatacaaaggccaacgggtttaacttcgaagggtgtgtagatgcctgtattttgacaaccgagtttttcgaatttggcattggtgcaccgccaagagccctcccttggcaggagtgcattatgaaactggaacacctgtacacggtgtcccctgcgaaccggtgggtgaactgtgcgcccagagccaaggtcgactcatttttcgcaattatcaaagaggggggcccgcgaggcataaaattcagattactccaccatgtcaatctttcacccccaaagagtccgattctcaaactaagcttcatcaagtctacaacgtacgacctagtacatcctccgtttcaatgaccacacctctcgtcgactttctctgggcctcaagccggctcaccaaatacacgcccacgcccgatatttataccccgacggaggaagcaaagcgtggagcacaattctgggagatagctctttgggacggacgtgagagggatcaggacaagtttacaagatgatgcagaagagggatacattctcgacgggcgtgaaatttcgaattttgggaagagttttacgaattgagctttgtgcgcgccaacactgccgcttcgcgcgcgctgcagctgccgccgtggagggtatgnccccctggggntcccg

SEQ ID NO: 24052 - DNA, 677 bp, Triticum aestivum
  unsure (1)..(677): unsure at all n locations
  Clone ID: PAT_TA_24052
gccgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgattcatcaagaacatgatcaccgggactcccaagctgattgtgctgtgctaacaatgactccacactgggtggttttgaggctggtaactccaaggatggcaaacccgttaacaagctctccttgcttctctccggggggcaaaaatagctgcggctccaacggagcgcgcccccacctcctcccccggcgtttgatgtatggaagcctcctctactaggtggtggtccttcctgtcctcccccgtccacccggtcgggngnaaatatnaagncacacctnacgnaaaggccacctncaggctgcaatn

SEQ ID NO: 24053 - DNA, 675 bp, Triticum aestivum
  unsure (1)..(675): unsure at all n locations
  Clone ID: PAT_TA_24053
ctcgtgccgaattcggcacgaggaggagtcacgcgataatgcacaaggaccagataaccttaatcgtcttgaagagttagttgtgcatgcttgtgatcaaatcaattggcaaggctcgatagtcttacctacttctcttaggaagctaacactttattccccaggctgttccatggataaccttgtgagctgcttccgtgacctcacctccctcactcatatggaaataaggttcggcagatcattgacatccatccccctcgatgtgtggagtagcaaccttccatccctgggaggatctatcaattatggattgctaccgccttgcatcaataagcgcctctggagcaagcagcagcagcggtgttaaaggattctcagcccttgctaagataaaattttactcatgtcgcacattactgagccttgatgaattgctgacgccagactatctacctgccgtgaagacgatttctgttacacactgtgaagcgttggcatccgtgtctgtcgacaggctccacggccggggagctcctgggggcctggccctcgccacatctgctaggactccccactgacgtcctcccctaagctgctcggcttgtttagttctgacgnatagaatcatcgactcaacaatagcatctcggagtctcaacactgaaggnactn

SEQ ID NO: 24054 - DNA, 1891 bp, Triticum aestivum
  Clone ID: PAT_TA_24054
cccacgcgtccggctcttcacccagaagcgcctcgaggcgctgcgccccatccgcgaggacgaggtcaccgccatggtcgagtccgtccaccgcgccgccgccggccccggtaatgaaggaaagccattggtagtgaggaatcaccttgctatggtgtccttcaacaatataacaaggctagcttttgggaagcggttcatgaatgcagatggtgacattgacgaagaagcgcaggaattcaagcttattgtcaacaatgggatcaaaattggtgcatctctttctgttgctgaatacatttggtacttgagatggctgtgtccacttaatgaggagctttacaatacccacaatgagagaagggatcgtctgaccaagaagatcattgaagagcatgcacaggccctcagggagagtggtgccaaacagcactttgtggatgctctgttcactctcagagagaagtatgaccttagtgatgacacagttttcggacttctatgggacatgatcaccgccggaatggacacgacagtcatatcagtcgaatgggccatggcagagctggtccggaaccccagggtgcagaagaagctgcaagagtcgcggcagccacaatggaccccgcgtccctgcccccggtcgcccccggtcgcctccattcccggccccctggcgcgccgctccggctgcgcccggccggcggccgccgggccgcgcccctgccccgtggtgggctccccccggctcgtcacccccgtgcgctcccgccgcctccccggcgccacgccgcgcctggagaatgaggagctctacaagagggtcccggtcgagatctgagcggcctgtgctgctttgcttggggtgttgcgctgctttcagctaggtgctggatggagctcgtgttgttgtaaatcgtgaggtgtttgactgccttttgaatgaatctcataaagcgacgacggcagatcgcagatcatttctccctttattaggtgttccttcggatataatagttttgtttttatgttaataacagtttaacacagcaaatcattctagacaatgtatttctccacataatatagagctggacagcgtggtcggccgcgaccgcgtcatgtccgagaccgacttccagaacctgccctacctgatggccgtcgtgaaggagtccctccgcctgcacccgccgacgccgctcatgctgccccacaaggccagcgcgagcgtcaaggtcggcggctacagcatccccaagggcgccaacgtgatggtgaacgtgtgggcggtggcccgggaccccaaggtgtggagcagcccgctggagttccggccggagcggttcctggaggagagcatcgacatcaagggcagcgacttcagggtgctgcccttcggcgcgggccggagggtgtgccccggcgcgcagctcgggatcaacctcgtcgcctccatgatcgggcacatgctgcaccacttcgagtggtctctgccggagggcgccaggccggaggacatcagcatgatggagtcccccgggctcgtcaccttcatgggcacgccgctgcaggccgtcgccacgccgcgcctggagaatgaggagctgtacaagagggtcccggttgagatctgagctgcttggagtgttgccccgctcgctgctttcagctaggtgctggatggagctcgtgttgttgtaaatcgtgaggtgtttgactgccttttgaatggatctcataaagcgacgacggcagatcgcagatcgtttctccctttattattaggttttcgttcgatataggtccgtttttctgttaataacagtttaacacagcaaatcattctagacaatgtatttctccacataatatatcttgttctggactg

SEQ ID NO: 24055 - DNA, 596 bp, Triticum aestivum
  Clone ID: PAT_TA_24055
aacaatctttcaggcccaagcctgcaacaccatttcctgcttgcaggaatacgcgtccccccttctatcagagaagcaaaaacgccaaatcttgtgggaaactggctgctcggagcatcttttaaggctcaagttatgtttcttatcaggattgatcctagcgagcaggaagctactcttgaatatgtggccaagtgcggaccaatatgtgagaaggcatcatccatggtagttcaatcaagttaaattagtgcagagtatgtcgcgagaatgtatgcataacccattcagcccaatcaagttcaatgaacaagcacaattcagctctaaagaaaataatggtttcacaactacctcatgctgcacccgagctgtccagtgctgggaacaatgtcatgccaccatctacaagcatgtgttaaagcaataatcttttgctggacttcagaaacgtggccacgggtttcaacctcagccagcgtaatgtgtgcgtcccaccgtcccagggtggggtcttatacataaactcatttcttgtcagaattttgttgcaacatattttggtctatcatgtcttgtggcgcaaataactgaat

SEQ ID NO: 24056 - DNA, 766 bp, Triticum aestivum
  Clone ID: PAT_TA_24056
ctcacattaagaatctttgcctgacgctacaaaaaatatatatgttttgtagcaggattagtgatcaaatatatcctttttgttgtaaatattttagtctgctactttgttcattaatttttctgggcatttttgcttaagttttatttcaaagcaaaatcatatcgagctatctacaagttgtatatctctataattctccatctaagatagtactaaagtttattgatgatgcttagtttcaggatatgccttacaagccatccatgtgagatatccaaggggttcaagacggattgaaaaggagctggagtaggtggtcgattgaggaaggagctagagcagaggtggaatcgaggctgcccctacgtgcgctaagaagttgccagaaattatgaggcgcctgccatccggacactgctgcgctttctccatctctcaagataattttcttcagttcatcgaactacgtgctgaaacatgtgtattgtttctcaatatatcgggcatcaacccacctcccatgagatctctgaattttcgacgcatattacatttgctgaattatttcctccagataactatgcttggattcacaaatgcgcgcaatgctttcaagtagaggttagttctacttaagctgtgctattccactttcaagtttttggtcctagaagtgtaatacttggtaggttagctgtagaagcagaatgtatatggcctgaatttatatttcagagtgtataatctgatttagagtattttg

SEQ ID NO: 24057 - DNA, 606 bp, Triticum aestivum
  unsure (1)..(606): unsure at all n locations
  Clone ID: PAT_TA_24057
atcctctccagctccggcgccggcgatggcgatggcggatcctcgggcgtggaaccccaactacggtgtggtgggcagcggcgaccgccggctggcctactcccgccagccctccttctcctcctccccgcgcccgggccccggcctcgcccgttccgactcctccatctccatgcccgcgcccctcgcgcagccgcccaaggcacctgacgtccggtaccgctggcttcgccacccgcccgatgcgccgcctncgcgcttcctgctcgccctcaaacgccgcctactccgccgtnggagctggccgtgggcctcctcaccgggcgcgtgggcctcgtctccgacgccttccacctcacctttcggctgcggcctgctctccttctccctcttctgccatggcgcgcctcccggaccaagccagactccacatacacctacgggtgctcggcttgctcccctccccaccggatcgatacatagctgcccggcgttctcggcttcacctcggcggcattcctgcgtccccctggctgggcttccctctcacgcacgtacgtgaggttggaggtcctcgccgccttcaccaatgccctgttcctgctg

SEQ ID NO: 24058 - DNA, 669 bp, Triticum aestivum
  unsure (1)..(669): unsure at all n locations
  Clone ID: PAT_TA_24058
cgccggtgccggcaacaactgccacggtgactacggctagaagaaactgccccgacacctgtggttatcaccgctgcccgtgtccccgccggggccggcctccacgcccccggcctcgtcggcttctcgcttctgcccccgccccgctgaccaatgacagtcatcccatgctgggcaactcaatcttggaggtcagtttcccttccgatgtacccgactcctacctgttcaccaccaagtatctcgtacaccgtgnaagatgatccccggtgtacgcgactactcccatccactggggagctccaagctaggccctttgccatatccggctgggcaaaacatatccttgttcgttgttggctgccggcgtcaaggctccctggtcaattgatactccggccgtttaaggccgggaatggtccgtcgtccggtgcaaaagctcaaancaatgngaaaactaacttgggggaaactttgaatgcaatggttggccccggatgctgttcaatggatatacaagtgaaccaaaggngtcaacctgggaattcgcgcataaaaggtctcaaagtcaaaaaaatgaagcctaatggcatatatgnccaattcacccattgggaaaaccggttaaannaggaaantacngattgcatccacaccantgcatgaggg

SEQ ID NO: 24059 - DNA, 638 bp, Triticum aestivum
  Clone ID: PAT_TA_24059
gccggccggttcgggaaaccttcgcccttccccccccctctctccttccgctcctcctcccggcaatggcgtcgcgcctccgctccttctcccgtcccgtcgcagccgccttcctccgctcagcttccgcccggagccccgcggcctctctcccccgcgctctcgctccaaccccaagggcttcttccctggggcggcaggtggcgctggcacgatctctgcagccgctgcacagcgcaatctcggcggcgaggctaacgtcacggcttggggcagaggtggcccgggcagtgtcgcaggaaactggtctgagtgtgcctcgataatgaaagaggttcggacagacgcagcggacttgtcaagaaatttattcccttcaataacgggttttgcttgttggcattcttccgcacattaatatgctatgtactgctcagaagcaattactatgtgcacttcatatcagctcgagccttaactgaacggagttatacttgttaacgatctagttatgggaagaactgctgctctagtttgtccttttaattgaggatcacctaatcttttaccatgctcaaaattactgtatataacccagcccttattctatactatggaacatatctattttatttcac

SEQ ID NO: 24060 - DNA, 1129 bp, Triticum aestivum
  unsure (1)..(1129): unsure at all n locations
  Clone ID: PAT_TA_24060
cgggggcaacctaggctgaggggcagatgtacgactgctgggtgaagaggcaccggaacagcagctcgatgcggcggaccacgagcatgtcggccttcgcggagccgccggaggaggaggcggggcgccagcccacgcgggcggccaggggcgcctcggcggcgccggcgcagacggagtggggcgcctcctcggccgccttccagaggcgccactcgggggacttccacgcgtccgccgacgcgtggggtggagacggccgccttcctccggccctgcggcctctgctgccgccgcctcggccccggccgcgacaccttcactatacatgggtgaggtggccttctgcagcctggagtgcaggcagcagcagatgaacctggacgagctcaaggagaagaagtgcttcccggcgaccggcagcggcggctccgacggcaccagcggcaccgtggccgccgcctagcatcgaccgatcgagctaaaacaacagaaaatcgttggcgccctctaccagggaaccaaacccgttaattagtttctgtcagcatatgtgcatgatatatatcctatgtcgtgttattgtgtatattgctggctcaggttgtgagccaggattaatggaaggggatgtagagattggaattggggctaggtgaaaagcttgcaggtggcttcggcgcacctgttctcaggtgtgccgagcacaaggggggatattttgtatcctggtgcagaattaggtcatgagatttggagctagtactgttaattttttccaaaatgaatcaagaacttgagctctccacgttatctaatttctgtcagcatatgtgcatgatatatatcctatatgtcctgttattgtgtatattgctggtcaagttgttgagccaagattaatggaagggatgtttgaattggaatttggactaggtgaaaacttgcaagtggcttccggnnacctgttctcaangtgttccnaancaaaacgggggatnttttttacccgggngcaaattagnccagaaattttgggcnaanacgtattttttccaaatgaacaanattaacncccaatttctgaaatccgtcccttgttgaatccaaaatgttgngtcgtaaaact

SEQ ID NO: 24061 - DNA, 725 bp, Triticum aestivum
  unsure (1)..(725): unsure at all n locations
  Clone ID: PAT_TA_24061
ggtccgtggcgaattccggaagaagaaaacccgctcgggcacagtcgacaaaagtaatattcgacactcagttcattcgccataaaatctaattatttcgccctcggaacaaaattaaaatgaagcttaacatttcatttcctgccaatggcagccaaaaacttatagagattgaagatgagcgaaaattacgtgtgtttatggaaaaaaggatgggtgctgaagttcctggcgacagtgtcagcgacgaattcaagggttatatttttaaaataactggtgggaaacgacaaacaaggtttcccaatgaagcagggagttatgcacccgacccgtgttcgtctactattgtcagacggccactcctgttaccgtgctcgtcgtactgggagaaagaaaacgaaaatcagttcgtggatgcattgtccccatggatctttctgtcctgggctttaagcatcgttaaacaagggggacaatgacattccaagattgaccgatacggtcaacctaaaccatgggtcccaaacgtgcaacaaaatcgaaagtcttcggctcgcaaggaaatgatgccccagtccgtttcccgcgcccgtccaacccnaggaaagaagctacacaagntcaaaaatcangcantacactangctcagacagcgcacgantgatcaactccatgctaagacaggacacacatacaatntacaaccgcacagtaagncaag

SEQ ID NO: 24062 - DNA, 786 bp, Triticum aestivum
  Clone ID: PAT_TA_24062
ctcgtgccgaattcggcacgaggtgctcccgatctgcctgcttctctttcttctcctcgccatcccgctcaccctcttcaaatccaggcgcccagcgcctcatcgtgggccccggcggcagggccgtgcggctcccgccggggccgcgggcgctccccgccagcggccacctgcaccacctcgccggcgctctcccacaccgtgctttgcgcgacctcgggcggcgccacggcccgctgatgatgctccgcctcggcgagctcgacgccgtggtcgcgtcgtcccctgacgccgcgcgcgagatcatgaaagacccacgacgcctccttcgcatccagacctctgacttccatgcagcagatggcgtacggcgacgccgagggcctcatcttcgcgccctacggcgacgcgtggcggcagcttcgcaagatatgcaccgtcgagatcctcagctcccgccgcgtccagtccttcccccccccccgcgaggacgcgccccgcccccccctccgcgccgccgcgccgcccccggccccgtcttcgccggcgggccggcccgtccgcgtggcgccgcacggcgcggtttctacggtgcgccccatcctcggcggccggttcaagcagcgggacacgtacctgaagatgctgcaagagggactcaaaatcgtgcccgggatgacccttcccgacattttcccctcctcgcgcctcgtgcggctcctcagcagcgtccccggcaggatacagcgccatagccaaggcatgaagctgttcatggacaccatc

SEQ ID NO: 24063 - DNA, 617 bp, Triticum aestivum
  unsure (1)..(617): unsure at all n locations
  Clone ID: PAT_TA_24063
ctcgtgccgaattcggnacgagcggcaacggcacacaatacacatcaaaaaagaagcagataggaggagcaagaagaagatcgaaggcgatggagtacgagtaccactacaacagcagcggcagcggcagcttcgccaaggagaagcggcctccggcgaagagggggcaggtcaagctccagatagcgagggcgctgagcaacctcgtgtctcccggcggcgccgttgatggctcgaagcaagcaaatcgtaacagcttcagaagggaaacaagctacaactgaacaagaaacttagtactcccgccggacggagggagtaatatatggtgcgtgtgacaaagtggggtagttactaagttgttttccttttgaggattttagcaagatggtctctcagtttaatatgtactgaccatctgtttgatccactatactgtaactttgcttgagtgggaacgaaaggaatcccatgtgatacctgtgcaaactttgggcatatacatgcagcagggtgtgcttgtggagtacttaacctttcaattatctctcttagtttgttgggaagtattgtgcagtacaatgagaanncattaggctttcaataaaaaaaaaaaa

SEQ ID NO: 24064 - DNA, 731 bp, Triticum aestivum
  unsure (1)..(731): unsure at all n locations
  Clone ID: PAT_TA_24064
ccttacncgaacttcttggcccgcggctcccattggcggccttcggcnncaggagcaggacgactgaatccgcgagcacggcgacacggcccccctgttcctcgccggcgacagcgcgggggccaacatcgtgcacgacatgcttcatgagggcgacctccaacgacggcagcccgagggtcgagggcgcgatactgctgcacccgtggttcggcgggagcaagccggttggagggggagcacccggccgcgcccatggtcaccgggatgctctggtcctacgcgtgcccgggcgcggtgggcggcgcggacgacccgaggatgaacccgctggcgccgggcgcgccggcgctggagaggctcgggtgcgtgaggatgctcgtgaccgcggggctggcggacgggctcgccgcgcgcgaccgcgcgtaccacgacgccgtggccggcagcgcgtggggcggcaccgcggcctggcacgggtccgatggggagggtcacgtgttcttccctccggagaagcccgggtgcgacaacgccaagcagctcattggaccgcgtcctccgcgttcnatagccggcgcctgatggtcgagttctcctgcatgtctgcttcttcctgttcggggggagcttgctctgcatggcgccttcctcgttttctggttcccttggttgccatttaaaatcncaatttgnctccnagattaacatcnttttttaaaaaaaaaaaa

SEQ ID NO: 24065 - DNA, 610 bp, Triticum aestivum
  unsure (1)..(610): unsure at all n locations
  Clone ID: PAT_TA_24065
cttgagttcagcatctctctcgctcgcgccctcgcccccccccccccccccccccctcgcgcgctgagctgagccatggcggagctgccgctcgcggggggcttgctggacctgcgccccggtggcaagctctccccgaagcccccgcccccgccgctgcccatgccctgccgccggaccccgccgcgctcccaggtcgccgcggccgtggcatcgccgtgccgcgccgtccccgagctccactccaccaccgagctggcggacgggagcgtcgtgttccacttcgcgcacccgcctgtcaaagaccgcccggagcccacggcgtccggccccgaccctgggcacgcggatgccccggcctcgccgcgcccggagctgcgcgtcgaggagccgaatccacacacggcggctgacgccggtgagatttcgctggcctcgtcggaggcgcccgaacaggccgcccgccgtgtcgtgttnaagcggaggcgggtgggtaatggaaggnaatctccggcgactgcaactcatacgacggatngagtaacttgtgctccagaaattagcntgaggnggaaaanggccgtgttnagagnggatcgatcggactctn

SEQ ID NO: 24066 - DNA, 688 bp, Triticum aestivum
  unsure (1)..(688): unsure at all n locations
  Clone ID: PAT_TA_24066
cgttttactgcttgttactgctggctacctccgttccgtggtcatggcggcttgcctctcccccacgctccctcgccagaccatccaccgccgccgctgctggaccacaaagcctccctcctccccctccacggccacctgccaccagcgccaccaccatcataagctcatcggaacgcgctacggcgccatctacgcacgcgcctcccccgcggaccctgtcgcccagggcctcgacgccgacgatttccgccacccgctcgacaagcagaacactttgctgctcaaagcaattccagggctcaacgatataaggcaaggctttgctagggccggtttctgagcaagttatggttcttcaaaacattgggtcatcggttctcgtctctgaaaaccagttacctgaacttcaacaagctcatgaccgaagctgcgaaaatcctgaacacggaacacccgattttacatacggaaaacctctcctaacgcttaaacttaacgataaatggaaaaggcgtcgtcgtctcaaacaacctctggactgccctaaaaggaatncagcttttggaaataactggtactaagtcattatggtcnggttacttcaaatactacatggacaaanacttccggttgaagttcggttcttaaaattttggngtgacccggntactnaaggggnnttctn

SEQ ID NO: 24067 - DNA, 646 bp, Triticum aestivum
  unsure (1)..(646): unsure at all n locations
  Clone ID: PAT_TA_24067
gagagagagaactagtctcgactcgtgccgttttcggctcgtggtcatatcccgtatcacattttaggggctagataatttgagatgaaactagaacaaattttcgacttctaatcaaagagaccaaagcccatatcttcatctgactcctctttttcttcttccttttcttcttctttcttatcttcctcgacagctgcgcccgcagaaaccccgccggaagttggggcggcagcagcacctccgccggatccaacgttaagtagcagttcctttacatctttgccttcaagcgccttcgcgaagaggttggaccatataggctctacatcaacaattccagcagccttaatgagtgtctgtaatttatccggcagtgatctcgagtccatccgtccggaaagaatcagggcagcataggaaacagcgagttctgcggtcgacattttgagtagtgaaaggaaattagtcaagatgaacctcgtgccggtggcggcacgtgggggggggccggtaccaatcgcctatatgancctataccgcgctaacggcgtcgttaaagtctgacggaaaactgggtaccaactaacgctgagaaaccccttccagtgggtaaaacaaaggcccacgttgccttcaaagttng

SEQ ID NO: 24068 - DNA, 901 bp, Triticum aestivum
  unsure (1)..(901): unsure at all n locations
  Clone ID: PAT_TA_24068
gcgaaattgaagaatgtcaggatggtcatgaaaataagaggtttgtaaaattctcttgtgacaatggccgcacacaaggaacttcggcgtctgtttttgggggttatgctgcaaatgggaatggctccacttcggagatttgcccagaaaaccaggttgaagctaaagacagtgccatcagaagggaaacagagggtgagttccgtctactgggaaggagggaggcacccaatancanattcaatggtggcaggctctttggagtggaagaagcggaacgagtgccaagtatggggcgcaaggtatcattcaccatggaggacagtaggctgtgtcccaatgcctgacccctggggagacatctggatatgcagtgggagaagaagaagaagaatgatgatgccatacaccgacctccatgatattcccgggggcggccgggcacctgccctcatctccacgctcctggatcatgtgaacatgctgggtcttaagtaagacaacgctaaggttgcgatacctgatcaattggttaagtgacctcgctactgcagcttccgttgcctgattctgggagacggtgatggggttcccccttgtctatatctatggccccgaaagataaaatatgaacgangagcaacattgccttcaatataaaggactgcaacaccggacttcactgatnaatcctgaaactgtncagaagatgcaagagaaagaaggctcaatttggcgtccgtttctgatcatataccctcatgncaacagaaacatgggtggtgatgttggccaaccctcctgttcggctangtaaacggcgcatagaagaaatacaaaatgcattgttggatnaatctcatgctccctggtcctanaanttgcanncaaggtatgcatt

SEQ ID NO: 24069 - DNA, 1111 bp, Triticum aestivum
  Clone ID: PAT_TA_24069
gaaaagggagctcctcccaccccccgaccgacgccgcccgccgcagatctattgcaacacctcagcgactgtggggaggggaacaaggggggagaggatggcggggaagagggagaggattgcgatacggaggatcgagaatctggcggcgaggcaggtcaccttctcgaagcgccggaggggcctcttcaagaaggccggggagctctccatcctatgcgacgccgaggtcggcctcgccgtcttctccgccaccggcaagctcttccagttcgccagctccagcatgaaccagattattgaccggtataactctcattccaagatacttaagaaagcagacgagccatctcagctggatttgcatgaggacagcaattgtgcaagactaagggacgagcttgcagaagcaagcctctggctccagcagatgagaggagaggagctccagagcttgaacgtccagcagcttcaggccctagagaagagcctcgagtccgggctcggctccgttctgaaaaccaagagccaaaagatcatggaccagatcagcgagctagaaagaaagagggtgcaactgatagaggaaaacgcaaggctaaaggagcaagcgtccaagatggagatgcaagtcgccgctgattcaccggtggtgtacgaggaaggacagtcgtctgagtccgtcaccaacacgtcgtatccgcgccctcccctcgacaccgaggacagctccgatacctctctcaggctcggattaccactctacaactcgaagtgattggctggaaattatccgaagcaaagttgcttggtcacaacaagctcctgaatcgaaccgcgcgctgcatcgaataaacagtttgagtgcgctggatgatgtgtgtaatctaaaagaagactggcttctgttatatagtatagtgtggcacaataagagaacaggttcttttgatattacctgctactggtttttcccgtccttgtcctgtgctgtaaggttttagtagacccctgagtgtccatcagaactctgagttgcttcaacccctgcaagtaaatcaaccactggcacagtggcatattgatttcaacataagaagaaaaaagtttg

SEQ ID NO: 24070 - DNA, 639 bp, Triticum aestivum
  Clone ID: PAT_TA_24070
ttttcaccccttgtattaacaccatcgctgctcttcactcggagcacaagatcacacgcataaaatggtgtaggaaacacaggggcacaagaactcgagcaccagccactccagctgcctgctctgctcattggtttggtagggagagatgaaggcgatgtccgggacgaagctgctcctcgtccgccagccgtcgagcaagtacggtaacggggcggtgtcgccggcgacggccacatccatctcctggcgccgcttctggctcgtcgcgttcctcgcgctcttcacctgcgcgtccctgctcacggtcttctccacggcgcgcgcgccgtccggggcggcgtcgccgggggtcacgttcgtcgcggccggcgtcggtgcgggcagcgtcggcggcgcgtcggcgggcggaggagcgctcccggcgtacgtgttcgacgcgctggtgcggtacgctgcggcggcgggggcgaactcgacggtgagcatgccggaggaggacgtgcgcgcgatcgcgtcggtgctgcggcggcgcgcgccctgcaacctgctggtgttcgggctgggcgcggagacgccgctgtggcgcgcgctgaaccacggcgggcggacggtgttcctggacgagaacccattcta

SEQ ID NO: 24071 - DNA, 759 bp, Triticum aestivum
  Clone ID: PAT_TA_24071
ctcatggtgcagggcaacccgtgcccggcctcccgctaccacggcggcctcgacgcattccgcaagatcgtagcctccgatggcctctgtggcctgtaccgcggcttcggcatgtccatcctaacctacgccccctccaatgccgtgtggtgggcgacttactcactgtcacagaagataatctggagcggaatcggctgctacctctgcgagtacggtgtgggtgttcaagaaatcgatgacggcgacggtgaaatctcattgcagccaagctgcaagacactcatggtggtgcagggaacgagtgccgcgatagccggtggcgccgcggcgcttgtgaccatgccgctcggcatcatcaagaccaggatgcaggtcatggacggccaaggcgagccaatcaccattgggcggacggtgcgggagctgatcaaggaaggcgggtggggcgcgtgttacaggggcctcggcccgaggtgggcgtccatgtccttgtctgccaccaccatgatcaccacgtatgagttcctcaagcgcctctcggcgaagaaggggcaggagagtggcgttccctgacttctgatggcaagtatagataatgcaaattaggttccttcccttggtttgtttagttcttttccacagcttatctgatctttcaggtgttgaaaagaaaatggtgatcaagtgtgtgtagatagtgtcttagtttgtaactccaaatcaatcaacgaaatccactttatttcaaaaaaaaaa

SEQ ID NO: 24072 - DNA, 1929 bp, Triticum aestivum
  Clone ID: PAT_TA_24072
gccggccaggaagtgcgccactagacctcgctccgcccccatactcctactcacctcctactacggcacccagcacggtcatccacctcgccgaagcagagtagccatggccgcgcccccagcgatcccgcgccgcggcctcttcatcggcggcgggtggcgcgagcccaccctgggccgccgcatccccgtcatcaacccggccaccgaggacaccatcggcgacatcccggcagccaccgcggaggacgtcgagctcgccgtcgcggcggcgcggtctgcgttcttgctcgacggtgggagccgctgggcgcgtgcttccggggcgacgcgggccaagtatctgaacgcgatcgctactaagattaaagaaaagatatcgtatctggcattgctggagacagttgattctggaaagcccaaggacgaagcagttgcggacatggacgatgtcgctgcatgctttgagttctatgctggtctggctgaagccttagatggtaaacaacatgcgccaatctctctgcccatggaagaattcaagacctatgttcttaaagaacccatcggggttgttggactcatcactccctggaactatcctctgttgatggctacttggaaggttgcacctgccctggctgctgggtgtacagctgtgttaaaaccatctgagctggcttctctaacttgcttagagctcggcgcaatatgtgaagaggtaggactgccttcaggagttctgaacataattactggtctgggccctgatgctggtgctccaatagcttcacatccccatgtggataagattgcttttacaggaagtaccgcaactggtaagacgataatgaccgctgctgctcaaatggttaagcctgtttcattagagcttggtggcaaaagtcctcttgttatctttgatgatgttgctgacattgacaaagctgttgaatgggccatgtttggttgttttttcaatagtggtcaagtttgcagtgcaacttctcgtctacttctccatgagaaaattgcagagcgatttttagatagactagttgaatgggcaaagaacataaaaatctcagacccactggaagaaggttgcaggctgggttcagtcatcagtaaagggcagtatgaaaagattaagaagttcatctcaacagcaagaagtgaaggtgctacaattttgcatgggggtgaccgaccaaagcatctcggaaaagggttctttattgaacctactattataacagacgttagcacatcaatgcaaatttggagagaggaagtctttggaccagtcatctgtgtcaaagtatttaagacagagagcgaagccgtagagcttgcaaatgatacccactatggcttggctggtggtgtgatctctgatgatctagagaggtgtgagcgcattgcaaaggttattcactcgggcattgtttggataaactgctcgcaaccgactctggttcaagctccgtggggagggaacaagcgtagtggttttggccgggagctaggagaatggggcctcgagaactacctgagcgtgaagcaagtcaccaggtactgcaaagatgagctatacggatggtaccagcgcccatccaagctgtagatgacttgagatgaggcattcatgtcatgagaatggagcctcgttcactgaaaaggcgagttctatcctggctgggacttctgtacagtgctttcgcaataagccattatgtggcaaacttggttatgatagtgtcatcgagcctgtgacagatgcggttggtcaaaaacttgctaaagtaaaaaacggcattacgttcttctgctttcgttatatctgtttatgttatttcattgcaatttgttgttgattgcttaccaagctgtccgcttggttatatctgtttatgttcttttggtgag

SEQ ID NO: 24073 - DNA, 566 bp, Triticum aestivum
  Clone ID: PAT_TA_24073
gccgaggacagctacactccatcccccactcccgacgaaggctgcggcggctctagctaaccgaagatgacgacgctggcatggagttcctgctggacgcggttaacagatttcccctccgggaagaattcgcgggcagcttggaccacctagatccggttcctctggcggggcttccgaggattgatggcacccgcgttgagccggctgactcgatcgctgggtctgggtgtgggcaccgtattgacagcgctaaccaagggcgcccagacgccgacgagattcgcacaatctaccgagagggtgaatccggaggcacctggataggcaaaaaggttacatcgagggagcacgccgcctgatagaaccccatgcccatctaggatgagtgccctagagcagtcaatccgcaagtatgcagaggaaccaacggaagtgtagttcgtcctgaagtgggacggagtttcgacttactcggcgaggcgtacgacttctacaatttgtattcatgggagattggttttggcataaggtgtgggaaaagctgattgaccgcgaagaggatc

SEQ ID NO: 24074 - DNA, 1376 bp, Triticum aestivum
  Clone ID: PAT_TA_24074
gcggacggcgctcggtcccaccccacgccctcatcgagaatgtcgtcgccacaaccgccggcagccgagcccgccacccccaccgccgcggagatgtcgccgcccggcgcgcggctggcgatgatggagctggcgcagatgatcgccgtcccgatggcgccgacggccgtcatccggttgggcgtgccggccgcggtgtgggcggggcggctgccaacgcgccgctctcggccgccgaggtgctcccgccgggccacccggacccgtccgtcctcgagcggctcctccgcctgctggcatcccgcggcgtcttctccgagcacgccgccgacccctccggcggcccggagcgccggtacgcgctgaccgccgtggggcgcaccctggtgccctccggcccctccggcgcctcgtacgccgactacgtgctgcagcaccaccaggacgcgctggtgctggcgtggccgcgcctccccgaggccgtgctcgaccccgccggtcccgagcccttcgcgcgcgcccacgccggcgtccccgcctacgcctactacgggcaggaccgggcggccaacgaggtgatgctccgcgcccatgaccggcgtgtcggagcccttcatgcaggcgctgctggaacgggtacggagggcgggttcgagggcgtcgccgtgctggtcgacgtcggcggcaggctccggcgcctgtctgggagatgattccgcgccctcggcctcaccgccggcttcgccggtctacggcgacttgccctcgaccgtcgccgccgcgccccccagtgtctcagtaaagcatgttggtggagacatgttcaagtccatcccctccggcgacgccatcttcatgaagtgggttctgacgacatggaccaacgacgagtgcacggcgatcctcaagaagtgccacgaggcgctgccggagggcgggaagctgatcgcgtgcgagccggtggtgccggagacgacggacgccagcacgaggacgagggcgctgctggagaacgacatcttcgtcatgaccacctaccggacccaggggagggagcggtccgaggaggagttccggcagctcggcctcaccgccggcttcgccggcttccgggccctctacctcgaccctttctatgccgtcctcgagtatgtcaagtgatcggtggcttattagatctcacctctccacccaattgttttctcccatgtaaaagaatttgaacaaggaggtcgggtgtatgactcctgttaggttggacatgcgttttgagttctgagatgttatcttgagatagagtgaatcaagcgcatttgtcggaactcgaaaaaagttacacacatgttgaattaagggcatttgtattaccctaaagt

SEQ ID NO: 24075 - DNA, 605 bp, Triticum aestivum
  unsure (1)..(605): unsure at all n locations
  Clone ID: PAT_TA_24075
gcagtgtatattgaatttgtacgtggcgccgccgccgctgcagccgaagtgcaattgcctccgcaattcaaagcagaaaaaaaaaaaaaaatcactaataaacaaaaccactatccactccacgcggccgccgcctacgccgaagtgccgcagcctcctcaaagagcagcagtcaacggagcaagcagcagcaactcgcggcagcagaagctacccgtccatgctcagctcgatgcagtgctcctcctcgccggcgggtgagtgctccaacacggccgcatcgatccaccagcaagcaaagctagcctctatctagctaatcgagccgctcgatctgctctcacgtgtactagaccactagtagtatgtatatagctagctaatcgatccactcgattgattcctatgtgtaacagcagtacgtactacatatgtgtgggcgtttgtagccggggtgtatacatatacatttgaatactcaaatacctggggtgtgtacgcatacatttaaatacctgcaaaccacaataccactgtggacccacgttataacgagggggggcccggtacccaattcgccctatagngagtcgattacaattact

SEQ ID NO: 24076 - DNA, 1311 bp, Triticum aestivum
  unsure (1)..(1311): unsure at all n locations
  Clone ID: PAT_TA_24076
ggcagaatatctccatggnagaaaataaattgttgcagtcacagcattgcaagatgtccaatgaagatgctgttaagcatgaggtttcattctttaatttgggttccaagagagagaagagaatatctgttcgtttggatgatggggagaaacagacgtggtgtagtgctagtgtggtgtttatctccaaggggccgcttgatgttgccttgcttcaaatggaaaagatcgcgattgaattttgtgcaattagaccagaatttgtttgtccgacagcagggtcgtctgcatatgttgttgggcatggtcttcttggacctcgatcaggtctatgttcctcgctttcctctggggttgtctcgaaagttgtccaaattccatcagctcaacattctcatctgcctagcaatgtgcagacagacaatatgggcctgccagtaatgctgcagacaacagcggcagttcatcctggatctagtggtggtgtaattgtcaattcacatggtcgaatggttggactaataacaagcaatgctaagcatggcggtgggagcacaatacctcgtctgaattttagcatcccctgcaaatctctggaaatggtcttcaagtatgcagcgaatggagattacacaattttggagcagctggataaaccaaatgaattgctctcatcagtgtgggcactggcacaagcaccatcatctctcccatttctcagtagcccccctgggaagagcggagaggggaaagtttcggagttctcaaagtttcttgccaatcagaaagaaggtttgacatctataagtgatttggaggctttccttaaacacaagattcccagtaaaatttagatgggattatttctgcaaagcacaaatggatagtactagtaccctcaatacataggagtacagaggaggaaaagaatgaaaaactaaggattcgggtagcctgagcaccaaaatggcaggctctaatttggcgaagttcaggtaacctgaacactgaaagttctacaagatttggcctgccgctacaagtccttcaaagcatactcgcagattgagattgctaaccaggcctgtcgctaatgaatgagcttttctccccaaaagatgcatgttgattcatgtatagtttgtttccaagtagaagggtgttacaatagcgtgttgaatttgatttgagatagtggacatatcttcaggaagtgtatgaggatactggaagcagtacaggttgtactaactgaaaagataatcttctaccattaaaaaaagagttgtactaaaaaaaaaaaaaaaaaaa

SEQ ID NO: 24077 - DNA, 424 bp, Triticum aestivum
  unsure (1)..(424): unsure at all n locations
  Clone ID: PAT_TA_24077
agttctctcctccaacaccatggcccccgccgtgatggcttcctcggccacctccgtcgcacccttccaggggctcaagtccaccgccggcctccccgtcagccgccgctccagcagcgccggcctcggccgcgtcagcaacggcggaaggatcaggtgcatgcaggtgtggccgattgagggcatcaagaattccgagactctgtcttacttgccaccctctccacggaggcctcctgaagcaagtcgactacttgattcgctccaagtgggtgccctgcctccagtttaacaaggttggttcctcctcccgtggagcacaacagttccccccgggtaatacaacgggccaatactgggcaatgtgggaactgcctattttcgggtgaaccacnctagcaagtccaaccgggggaggagncaa

SEQ ID NO: 24078 - DNA, 1126 bp, Triticum aestivum
  unsure (1)..(1126): unsure at all n locations
  Clone ID: PAT_TA_24078
cacnttntttngaattgggaggancaacaattttttcccaaangcatcttcactctcttattcgcagggagtcacgtgcttccaaagactcgccccccacgccgcgtttcaccttattccgctcacccggtcccccctcctttgtcggtcgcctttcacctggcacgggtgcttgcgttgcatggtttggcgcctccttgccgtcttcgcccgcgtccccatgctccctctctcgctggcttgcccccatgatgatgttcaagcatagttcccagttagtgcccgaagaacaccagcggagcgaaggacttcctcttttattgcccacaggaatggcaaggagagcaccagcaacagagaagacccaagttccgagggcattggcgacggtgcagtcctcgaggtgcttctcgccgctgccgactcggtccattgctcgcttgcggcggggcccgttgccgtgacgcggcggcggatcagcctgcgagcgcccaccccactccgcaccgcctccgccccggttaccctcgacctagccctccccggctcccaagggtttggcaggcgatggagaaggggaagtcggtggtggcggagctcgccgcgtcgttcagcggcgtccaggtcacgccgcgccggaaggccacgagcacgccgccagcggccagcttctattctcccatgaagaaggccaggcctcggaaattggtcagtctgtgcattggcgtcctcggtcagcatcttgaagatattatcaatgatatttctgaatttactgccttcttcccaccacacattaagttggcaattatgtctatcgcaaggaggagaagattactaaatgacgatgttctggtttctcttgttgatagctcctggaagatcctagatatatctgggtctgaggttactgatgttggcctggctactgtggcacgtacttgtagtaacttatgggcagttgatattagtcgatgtgaaaaaataactcctgctgccgtttcagaaattatatgccactgcccatccctggagatattaagatgcggaggctgttcaagaagcgaattcactgcccgtgggtgtgtcaatctcctggaacccanaatccaagaaactaatttat

SEQ ID NO: 24079 - DNA, 441 bp, Triticum aestivum
  Clone ID: PAT_TA_24079
cggccgcgtgggcggacgcgtgggcggacgcgtgggcggacgcgtgggaagtgatgagaaatctcagtccgcgtccccagctctgtcactgtctggtagccctaatcgtggaggcaagaaaggtttggtttcctacggggatggctcacctgattcagctgggaagtaggtttccaccggggcattgaaatgtatcttacaccgttagccattggctgttgatcaggtccatcaatactttttgttatatttctactgtaagaagcggtttggtccttgagctgcccagctgttacatatgttgtttgggatgatcggctatgtcctttggttatcacaagagtcgtaatttgagcttaggttttgctgttgctaaacatgtagcacagattcagtgtgggattttgatgttatataagcttcaacgcaaagaatcattac

SEQ ID NO: 24080 - DNA, 607 bp, Triticum aestivum
  unsure (1)..(607): unsure at all n locations
  Clone ID: PAT_TA_24080
gtgctcccttcctcctctctaaccaagcacctcctcttgcgctgcgggtgctggctacctagaggtggcgtgctggatggtcgctgaggcggtcgggttcatgatgtcccgcgcggcggacggcggcaccatggcgccggagctcgtcacccgggacttcctcggcggctgccaggcgcccgcccccgggcgatgaccccaggcacgacgcggccgcccggcacgaactccgtcatgcccggcaagccaaccgcctgcaagaagcaccgggagcccgccgccgtcnggccaggggggacctcaacctcttccccgcctccggcgcccccctggcgcccctccccccgatggcgccggcggcggactgcgccgccaacaacacgtaccacagcgtgtgcacgatngagaagtcaagacgcgctggagcggttcagcgccggaaacaagggcaagggaacacacacaacaacaacacacggcgccggcgcnacgcgggcgctcccgtcctctctcgtcacantctcgtcaacgcncgggacccgngcctgacaagcacgtgcatcccgtccggcgggattgcncgatccgncgctcttatgnatgccgn

SEQ ID NO: 24081 - DNA, 476 bp, Triticum aestivum
  unsure (1)..(476): unsure at all n locations
  Clone ID: PAT_TA_24081
tctcgatcctctctcggccgccggccgattccggtcgttgccggtggtctccggccccgcccagcactccctcgtgttcttctcgatccggcctatcttccccaccaactcgattcgacgctcgcctcctccttgtgcgcccgtggttaaccctagccgccactgtggcaagcgcacggcgccgtcatggacgccggcgcggctccggcgcccctggtgctcatccttgacacctcctgcccgctctcgcgcgtcaccgaggtcgtcggcctggagtcatgccccgacgcacgttggctgcccgcaagcaggccatccggggccgcctacgccattgagtccgccaagcccccccccagtccgtcctcgtctctgtctctggtcgggtgacaacatgtaattggagtggaggatcttggatttgagtaccgtgaggggaggaggagcaagacaaaattgntaaggnaaagaatttn

SEQ ID NO: 24082 - DNA, 361 bp, Triticum aestivum
  Clone ID: PAT_TA_24082
gaactacatctgttccgtcggtggtggcagtatttagatgcatcagtcacctaggcagacgtagacgtaccatgtgtctcttttctttgccttactagatttgagtgatgaaatgtaatgggactggtagggcagcagcaagtaggtcctacaaaaagttgctgctattttgcaactgacgagatcacttgctgtatgcgttatgtatcctagttcgtggttgtgttttggtaatatttggatttgcacatctgtttcggtctaccatttgtttgctgacagaaccatgatatgaacttgtgacaatggtttacaaaaaaaaaaaaaaaaaaaaaaaaaaaactaagttctagatcgcgaa

SEQ ID NO: 24083 - DNA, 745 bp, Triticum aestivum
  Clone ID: PAT_TA_24083
cgggggcattgcagatgccaaatcccaaggcagccctaccataggtcgtgttgcttacaaagatggaaaacagttttatccaaacgagtcctcggagtcaccttactttggctcgtctgtgcattacggtggccgggacttctatgacagctctccacacaagcaagccgatgagtcatccagaaattataaggaggataatgcggatggctccctggctaccagaggtgattggtggcaaggttcactttactactaaaaacactttgcaatggactctcctactgtgaacaaggaataaaaaggagtacgtcgagctggtaggctgtagagttgacatgagtcatcaggcataagaaaagtcatagtggaactacatctgttctgtcggtggtggcagtatttagatgcatcactcacctaggcagatgtagacgtactatgtgtatcttttctttgccttactagatttgagtgatgaaatgtaatgggactggtagggcagcagcaagtaggtcctacaaaaagttgctgctattttgcaactgacgagatcacttgctgtatgcgttatgtatcctagttcgtggttgtgttttggtaatatttggatttgcacatctgtttcggtctaccatttgtttgctgacagaaccatgatatgaacttgtgacagttatttataacctggtgcatttcttaaaaaaaaaaaaaaaaaaaaaaaaaactaagttctagatcgcga

SEQ ID NO: 24084 - DNA, 1188 bp, Triticum aestivum
  Clone ID: PAT_TA_24084
cgcaagcagcgacatgcgcacaactgcgagctctcccccctcctccgcgccgccccccaccgcggccaccaaaaacgcccaatcctcctccctatccctcctcttctccttcgtttggatcgtctccaacaccggcgccaataggcgcgcacaggagggcgccgcgcccgcccgcgccgcccccggcgccgccccccgcgcccccaacggattcttcatctgcgtcttctccgcccccgcctcgtccgcggaaactccaagaggcgcgacgcatatacacctgtacacgatactaaacacacagaaccacaaggggctgaggggcgggcacattacagaatgccaaatcccaaggcaaccctactaatggtcgtgttgcatataaagatggaaaaacattttatccaaaccgagtcctcaaggttcccttattttggctgtctcttgtgcatttcggtgggggccgcttccatgactgctctccccaccaacacgatgaagcatcatgaataaattataaagaataaagtggatatggctcctgggtccctggatgtgagaggtgacaaggtgcaatgtttcactaaacatatttaaaaacgttgcctcgtactgtgaaaatggaataaaaaggagtacgtcgagctggtaggcctttgaggttacattggtcaactgggatataagaaatcatagaggagctacaactgtcctgtccttggtggcagtgtttagatgcatcagtaacccatgcatatgtagacgtactattgtgtatcttttctttttctttccatttctgagttatgaatgataaagggaatggtaagggaccgggaagcaggaggtaggtactacaaaaagtagcttgctactttgcagctgacgagatgacttcctgttggcgtcatgtttcctggttcgtggttgtgttttggtgatatttggatttgcacatctgtttcggtctaccatttgtttgctgagagaaccatggtatgaacttgtgacagttatttaaaaaaaaaaaaaaaaaaactccagacctcggccgcgaccacgctaatcactagtgaattcctactatgttctttcctgtttatatggcttgtattcctagattgtcaatttagtcaatgaaataaaattatatgcagaaaaagatattaaactgccaaaaaaaaaaaa

SEQ ID NO: 24085 - DNA, 602 bp, Triticum aestivum
  unsure (1)..(602): unsure at all n locations
  Clone ID: PAT_TA_24085
ctaatcttcttctcatcacacacacagctctcagcgcgcacatggacgcgagccaaggcgtcctcctgtccagcgccctggtcggcgccggcgccaatggcaccccggcgtggccggagctgctgggctccgcgcactgggacggcctcatcgacccgctcgacctcacgctccgccgcctcgtccttctctgcggcgacctctgccaggtcacctacgactccttcaactccgacgcccactccaagtactgcggcacctgccgcttctccaagggccacgctcttcaagcggcaggcagttcccggccgcgggccgacgtacccntggccgccaacntctacgccaccgcncggcacgtgggttgcccccgngggctatgggggaatccctctcccgccaagcctngagcaaggggcccatcgtgtgcacctccgtcctgtcgcgccgccccgccccgtgccccgggcctagngtatctactcgcgctggnggaacatccgcaactnnagtggtcangtgtcaagccgactggtcgccccgangcatntgctgaaggnnancggcccngcanncccctataanggtgtncgtatataant

SEQ ID NO: 24086 - DNA, 463 bp, Triticum aestivum
  Clone ID: PAT_TA_24086
gagagagagagagagagaactagtaaaagatacaaatgcagcgacgttaggagctcgggacgtagagcgaggccggtttcgaaggaagttatacctgagggtcgccgggatgtcgctaggtgggcggcgggaggccggatctgcccacactacggcagcgaggaagaaggggtgggaggcgctccctcgccagcgatgcttgggagagaacggcaaggcacgctgatcgagacgcgccggcagtggataagggccatcgccgaggacgaccacatgaacgttgcaccttctcaccttccccggtgaagaggatccggctggatctgtgaccagtggtgagtagagagagagagtgtgtggccaccgctgtcgtgtttagatctagagaggacgagacagtgtggagaactagttttcttttgtctaccagccggagccctgcctatatagtggagtactagtt

SEQ ID NO: 24087 - DNA, 685 bp, Triticum aestivum
  Clone ID: PAT_TA_24087
gcaggccttccggccccgggggtgcggctggaattaatactgtcagtgactgtaaaggggtgcgttcactcctacttatctatgaaactttcatcatgactggcgaacagtgctttcagagtattctctggctctccagtctttgtcgcttgttgctccagaaatgtcattgcctgcattaccggtctcgccattgtcaggaagctcagaaggtatctccagaactgggaattgcaaatttagctccctgttgtactccaacaaatatttgtcacaatcttgcaagcaattacctgtgccacagatgttcggatcaatgctacacaaagctggtgtggggaatgatatttatgggctgtgtgatattgacctgaaagattttagcttgcatttctccccttccccattgtccagaagctagcaaggtaatgtcagaactggaattgggattctgctgttggttgtgctcctcaccagaatcaactctacctgagaaaagcacgccatgtaccgagccaggagcatggtaattttccccgctgtgcaagccccgcgttgtaaattatgtcgcattgcattcttgtaaatgagcctttcccttctccccttccattttgtccagcagatagcattgtgatgtgctagagagccccgttgtcccttttgagacattatctctggaagt

SEQ ID NO: 24088 - DNA, 457 bp, Triticum aestivum
  unsure (1)..(457): unsure at all n locations
  Clone ID: PAT_TA_24088
gggggacaccatgtgttcagttctttaaaaacaaagaaatgatcaggactttctctggtgtgaagatgaagaaggaataccgggagttcatcgagtcgaacaaatgatctgagctcaatgttcgttccagggttttgaggtgtaatggcctccatttacacatatattgactatatttagaagccacgctggtgggcaatttttggtcaaaattctcagatgagcctggtgcagtccgatgccataggaaattaaccgaccgcccttattgaatccaaaatatattctttgttgtacaatataacatcttgttgaccccttgctcatgatcgtctcaacaatgtgcatagtatcttttatgtctttactcagtatacagatcatatgcaatctattgctgtcaacacaactttaaagggcccaaaaaaaaattaagattgagatgaaacaaanctnt

SEQ ID NO: 24089 - DNA, 1541 bp, Triticum aestivum
  Clone ID: PAT_TA_24089
ccttcggcacgaggttgaaagatacttagtctccaatgatcttcttgttgaatttcaccagcctgttcgtgaagagaaaaagaaggagattgaaggcaaagatgtcgagatgggcttcgacattactcacacaaagcacaaaggacagtatgcactccgcaagttataccatggaagtccaaggctcattttggttctatatacttctccaacatgtggtccctgcagaacattaaaaccaattttgaacaaggttatagatgaatatgacgaatacgttcattttgttgaaattgacatcgaggaggaccctgaaatagcagaagctgcaggcataatggggacaccatgtgttcagttctttaaaaacaaagaaatgatcaggactttctctggtgtgaagatgaagaaggaataccgggagttcatcgagtcgaacaaatgatctgagctcaatgttcgttccagggttttgaggtgtaatggcctccatttacacatatattgactatatttagaagccacgctggtgggcaatttttggtcaaaattctcagatgagcctggtgcagacttttgccataggaaattactccaccgccctagctgctacaaggtcaaattgaacttgatagttctggatatattttggttgatgaagggacagcaaaaacttcagttgatggcgtatttgctgctggtgatgtgcaggatcatgaatggaggcaagccgttactgcagctggatctggatgtatagctgctttgtcagttgaaagatacttagtctccaatgatcttcttgttgaatttcaccagcctgttcgtgaagaaaaaaagaaggagattgaaggcaaagatgtcgagatgggcttcgacattactcacacaaagcacaagggacagtatgcactccgcaagttataccatggaagtccaaggctcattttggttctatatacttctccaacatgtggtccctgcagaaccttaaaaccaattttgaacaaggttatagatgaatacgacgaatacgttcattttgttgaaattgacatcgaggaggaccctgaaatagcagaagctgcaggcataatgggaacaccgtgtgtccagttcttcaaaaacaaagaaatgatcaggactttttttggtgtgaagatgaagaaggaataccgggagttcatcgagtcgaacaaatgagctgagctcattgttcgttccagggttttgaagtgtaatggcctccatttacacatatattgactatatttagaagccacgctggtgggcaatttttggtcaaattatcaaatgagcctggtgcaatccgatgccataggaaattaaccgcccgcccttattgaatccaaaaaatattttttgttgtacaaaataacatcttgttgaccccttgctcatgatcatctcaacaatgtgcatacctctttatgtctttactcagtacagatcatatgcaatctattgctgtcaacacaactttaagggcaccgctattgacagccgtttcatgtctattc

SEQ ID NO: 24090 - DNA, 1345 bp, Triticum aestivum
  Clone ID: PAT_TA_24090
gatgttccggttgaatcatctttcaagcctgaagaccctgaaatacctgggagagtattcgagagtacattattgttgaatgatgatccccttgacaaacccaggagcaatttaatttctatcagaggtggctttgtgaacatcacctcggtgactttcagcaatgcggtttgctcttcaattcgatttgtactttgttctcaccctgatgacaggtgctatgtgcaccctaaagtggagggtgagcttgtattatctgttgaaaattatccagttggcttcactattttcaaaaatcaagttgaggatgatgctgttcatttcatgagacggagtgacacaatattcgaacttcccttgtctcggcatgttcttgcactgcctgttgaatctcgtgtacatgtcttggggactttgcaactcgcgccctcggaggtgcttgttcttccctctctggtgcgcgcctagtaaagactatcatactttatgataatcgcggtggtactttaatctacgagtcaaaggaaggagaaaaggcccagtttattaaaagacgctccatttggttatcagaggatataggaagaaaaccttatgctttcatggaatctcttgttctcaaaggcccgagccgtcccatgactgctcatgatgggtactggatcattcaaactgatgttccggttgaatcatctttcgagcctgaacaccaccctgaaatacctggtcgagtattatatttgaatgatgatttccttgacaaacccaggggcaatttaatttctatcagaggtggccttgttaacatcacatcagtgacgttcagcaatgcggttcgctcttcaatccgatttttactttgttctcaccaagatggcagttttactaaagtggagggcgagcttatattatctgttgaaaattatccatttggcttcactattttcaaaaatcaagtcgaggatgatgctgttcatttcgttagacagagtggcacagtatttgaacttcccttgactcggcatgttcttgcactgcctataggatctcgtgtacatgtcttggggactttgaaactagcgactttgaaagtgcttgtagatcagtatctggtgctcgacaagaatgttgcatgggctggatggactgtggagacgggtctgtatgctgctatatgcattgaggcaagttcttttctctagagcttagttataggaaatttggaattactgtactggttattattttctggctgtacttgtagtagtttaattagcccattgtaatggatttggtgaccatgtgcgaatgaaataatagtactaaaaaaaaaaaaaaaaaaaaa

SEQ ID NO: 24091 - DNA, 811 bp, Triticum aestivum
  unsure (1)..(811): unsure at all n locations
  Clone ID: PAT_TA_24091
caccttttcatagnaaaaaagcttatatttcgtcactatgcctatttttaaaaccatagactactagatgttgcattattagcaatatagactgatgtcaatatttgtttggctgtcaacgtccactatgaccattttttaaacaatttcctctacattttctcattttatatgtcaaagtggtaagtattatgctatgcaaaatttatttgtttggctatcaatatttgatgttttgctgtgtaaagttcaaaaggaagtgttgtccaaaattcaatacaaatgttgcccaattctttctctcatatctgttccgttgttacaattttcgtagaagaattcatagaagaaagcttatttttcattactatgaccatttcttgaaacaataggctgttggatgtttcattttgagcaatataaacggtttgtcttccaaaacatgggtttaattgctgcagaaaatcaagacagtggactaaaacaaaggttttacatgtaaaaaagattttggtggcagctggcttacaagccggctcggttttagccgacccataccttaagcgagccgagccgcctaaagtaggcttgtgtccagccctacctacaattccccaaaggacaactagtagaactttaggtgtcagctggaatagcatgcttccatattttttgagtcacatggttgggtgcccccattgtccaaaggctgctcccagttgcaatggattgattttattctactccttgcagaatcaagtggattgatattgtttgaacccccctgctaaatcaaaatattggttgcctc

SEQ ID NO: 24092 - DNA, 651 bp, Triticum aestivum
  unsure (1)..(651): unsure at all n locations
  Clone ID: PAT_TA_24092
aaaaaaatcctctcccgccggattcgcccccagacgcccccggcgtttcgacccggcggggcatgcccgccgcgggggtgaggggactgccccttcgcgggggccccggcgcccccccccccgttgaaccccgccggcacccccgggttccggccggaggggccttcgccagcgccttccccatctccttttccccctggggtcctcgtccagatccacctcccgccgggttcgccccggaggtcccggaagaggcgcgcccaccgtgtggcacatgcagcaggagctcatgctgaagatcaccaccgcccgctgccccgccagcttcgtcacctgctccatcaagcccacccgaccttgatcttcttcaccacgaactcaagaagaacaatgttgtggatgtacaagtcttcagtgctacctgtacgagtcnttgagctgtgctcgcctgcntggagttgggcacgggaggcctgcttatataccatggnaatgtcaccggccggctggataacttggagcaattnatggaccgagaaaaagtatacggaggttcggtaatatatccgactccttaactggcggtcactatatagtcaacaggtgggcacaatattcaacgaatggaancggaacacagttcataggatg

SEQ ID NO: 24093 - DNA, 498 bp, Triticum aestivum
  unsure (1)..(498): unsure at all n locations
  Clone ID: PAT_TA_24093
ctcgtgccgaattcggcacctcaaacagtgctaccactgctcttagtctccccaagcactattgctctatctcttgctcatccctgtgctcctcctcctccgggcaacaaacaggcgatcggccggcgagcgagccgcagcggacaaccatgggggccgtcccctcccttcgcctccgaacaagctccctctcatcggccacctggcacctggtcggccccgacccgcacgtctccctcgccgccctcgccgccaagcacggcgacggcggcgctcaatgctcctccgcctccgggcaagacgcgcgccctcgtcgatctcctccccgcgcgccgccgaggcggtcctgcgcacgcacgancacatcttcgcctcgcggccgccgaacgcgttcgccgacgccctcctggacggcggggccgacgtcgccttcgccccctacggagagttctgggcggcaggccaangaggntgggtcaccacgcacctgcttaagng

SEQ ID NO: 24094 - DNA, 281 bp, Triticum aestivum
  Clone ID: PAT_TA_24094
cgagtgttctcttctcaatagtgttggttctgatttacaggtaattaatataaacaagggaatacgtcatcatctgtgtagccggcactcctgccacgtgcgatgcaattaatgcaggcggtatattttgctaggattatgtgcaccaaaggttcgtgacgacgtagtgttttgaattcttgtaaggctcctcttcaaagcccacgccgaagcacatctgagtacttcaaatttaatgtatatccatatgagcaatctaacgagttcaagaattttaattt

SEQ ID NO: 24095 - DNA, 966 bp, Triticum aestivum
  unsure (1)..(966): unsure at all n locations
  Clone ID: PAT_TA_24095
tgcagggatttcggcacgtggccctcctcgaccgtccgaccgaccgtgcgctccccgccgccggcgccctggctgcctgcgaccccaccccccccccggcaccttcctcacctgctgtttctggtccacctgtggcgggcgttgctggccgcggctcttgggagcgcggcgccgatgggggcttgcaggcgccgcatcttcgctccagggggctcctcccgtccagggtccgcccggctgtccgctggcggggcgggtccatgcccagccctgcgtacgcttgcccccggcctgctcctcgtcctctggctcatgtttacctctcggctccaagactcgcagcggatgctgtaccgttcgcgcctcgtccgtcaggttccggggccgcttcaggttctccgcggcctgtgccgttgcagtgcgcgcagctcggcgcgtcccccggcggctcgttcgtggttgggccatccacaccggtgcgacgtgtggtgcctatattaggtgtaccagatgcccttgtgcctattgatccttccagtccacaaataaacctacttcctggggagacaactgcagtatgggtctcactaaatgtcccttgtgggcaagagcctggtctatatgaaggagaaatatgtattactgctgtgaggacagactcagattccaaggcagactcgttaccaaaatctgagagataccagctgtataaagaattaaagacttgtcttgatatcactgaatacagagaccactcatcggtcagaggaaatgatactaagatnatcatcaacttcaactacactgagggaggatgctagtacttccagcattcccaggactgccatgagaataatgggattaggggacatgatggatgaagatgttatgaacaatgttgctgttcgtgtcaagttaaacttgactgtgtgggaattcactcctccacngacaccttccttaccg

SEQ ID NO: 24096 - DNA, 714 bp, Triticum aestivum
  unsure (1)..(714): unsure at all n locations
  Clone ID: PAT_TA_24096
ggaaactccgcctcacaaccccatctcgcccccctccccccccccggtcgccgatggctccccggcggccgacgctggggcggacggggaggagccggcgggggaattcagcgcgggcctcgaacccctgtggtcgctcctcttcggcaccccggaggagctggagcccatgtggtcgccgcccaggggattcgacgtcggcgccgagttcgccgccgcggcagcgggcccggatcccctggtggacgacggaggagggccctgggacggtgccgagtggaggtcaacggggctcgtcgccggcgagggcgtgtcggcggcgacccgggcgccatccccgcccaccgcggcgccgggcttcgcggagttcgagcccccagcgtcaagattcctcggaaggcgctccaggggtgaggccgcttgaacaccttgatgattattcacgcatgccggaatctcgtcacncctgtgctgtaacatgcggaaaanctctgtcgtcttatcantcgggnccgatctctcatacatgggtctgcttgaagcatcaaggaatgancactcanctaaacattcatgcccaaanttcgcnntatacatttatgagaagatcaatntccncttaaaaatnccacannagggcttattaaccganataccagggatccatgtggaccaaggacattatgaaancttggatcggggtaanaagggaaa

SEQ ID NO: 24097 - DNA, 350 bp, Triticum aestivum
  Clone ID: PAT_TA_24097
aggatcggcggcggcggctgcgaggaggggaatgcgccggcgcacaggggctccgcgcgcaggcgcggggcggcgcagctgggcctcgacgccgacgagctcctcacgctgatgcacggctcggatcccgtcaaggtcgagctcaaccggctcgagaacgaagtcagggatacggatagggagctgggcgaggcgcaggcggagattaaggcgctgcgcctgtcggagagggcgcgggagaaggccgtcgaggagctcactgatgaattggagaagctggatgagaagctcaagttgacagagtctctcctcgatagcaaaaatctagaactactagttctagatcgcga

SEQ ID NO: 24098 - DNA, 455 bp, Triticum aestivum
  Clone ID: PAT_TA_24098
tgcttttcgtctagttataaagctcttttttatgtttgtttgagatggccaactgcacttgccatggtgtcagctgtagatagtcttcttcacttctctttacacttgctaaggttcttgacaggttactgccatgttcaagttgagcagtgctacacacacgacgcttgcacgacactgcatcacaaaccatccactggcaagtctgagcagccgtaggcgcttggatcagctatcgtgcatgcgtcgttcaacaaaaaatcgtccgtcaagtagttccggttcaagttcacctcacgcgtgtggaacattatgcagcgctgccttaaaatgattttgttgtagatagcaaacagagggtaccttacaccatcaattgtttcactgcacaaatttggattgaagaatacatgggcaaacttaacgtgtttgaatctgatgaagataatacccag

SEQ ID NO: 24099 - DNA, 1081 bp, Triticum aestivum
  unsure (1)..(1081): unsure at all n locations
  Clone ID: PAT_TA_24099
gcacgaggctctttacgaggttttgtacattcaaaaaacttgaattcctctagttccataacatgttcatctgatggagaaatcatcttgattaagggagaggagacatattttttctctactctctgtcaagatgacatctacaggcatgtagacagtattaatatggtatacagaaaagaccgccctctcagggaagaatcttcctgtgtggttaagtctcccaaagaaaagaaaaagggcttatttgggatgattatgaaagacactaaagggagcaaggcaaacgagagttatgcaaatggcaatggacaattcatcgcaacaacatctgaagaactggcctcaatattttcatcagcgaacttcactccaccatctgcgaggaggagcagttcactggaagatgatgaaaatattgagctagacatagatgatatcgacattgaagacaaccacacaaaagcagaaaggaccgcacttcgcaggtctaagcaaacagaaattcagcaagggactccaggctcttagaccaaaactgaagcccagaacagaagaaaaggtgaatacagaaaataagaagcctgaagatgaaccatcagttaggctagttgacccgtcccagttgaagtatggatgtccggcaagtcacctctcaaccactgtccccataatcctgggaggccagctgcatgtgcacatctgcttcctgcagggcattaatcttcggtccgcagacatggctcatggtgctcaatccttctcgtcaatggcgaaagagctgctccgaaccacgaaaaacgagaagagctcatcatagcaatggcagctatatccagttccttttcctctagttgtaaagctccctttctttatgtttgttcgagatggccaactgcacttgccatggggtcagctgtagatagtcttcttcacttctctttgcactcgctaaggttcttgacaggttaccgccatgttcaagttcacctcacgtgntgtggaacattatgtagccccgccttaaaatgatttgttgtagatagcatacagagggtaccttaaaaaaaaaaaaaaaaaa

SEQ ID NO: 24100 - DNA, 676 bp, Triticum aestivum
  unsure (1)..(676): unsure at all n locations
  Clone ID: PAT_TA_24100
ctcgtactaggacatggcagtacgtagttagttagggcgggcgcgtgagaagagaaccggatgttacagtagctctagtagctgtagctagagcatggaaggcgccggcgacttcaccttcgccgtggccgcgcctctggcaggcgccggcggcccacgggttggccccggtctgctctacccggtcttcggccagccgcgctcaccggcgcgccagcgggctctggagacggagacgacgacggccaccgagcgcgtgccgctccggccggcttctgctcgtcgacgcgttcggcttcggggcagggagcggagcagcatgcggacggcgtggacaagcggccggcaaagacgtgctcctgttcgtgctgccccggttcaccgttgacggcgtcatccccgggcgcgctgccggaagagcggtccacggggtcggtcctccggtggagccaacggccatcgggccggggcacancgacggcaaggagaattcgtctcccggacgcaagccttcaacccgcctcaagcgcaanggggtaagaacggcgaacgatcccccggccgcgccantctggactctacnccaaaggcggggaataacgccccnaggcttcncctaaagagactcncggtctcacaaccacgattcggggacatacnnttanaatatgttctn

SEQ ID NO: 24101 - DNA, 443 bp, Triticum aestivum
  unsure (1)..(443): unsure at all n locations
  Clone ID: PAT_TA_24101
cgcgcgcccctcactccagctttgggagggcaaagggttggtgtgttgggttggcgggctcgagcccgttggcaaaggtcgtcctgctnggaaggaagtgcagcaggttgctgatgcgcgcgctgttgggcgcgtgctcgctacttggatcttgtggtgcctgcgttgtgacgcacgccgggatcccacctcctttgtgaaaggagggaatggccccccagtgagacgtcactggcgtggtgtggagtttggccccaagaagccgccctatgggccgtcgggcatgtgcgccgcgggaaatgttccccggccgtagcccagatgtgtgcttgggtttccatagaagagatggcctcgggtggcctgctttcattgtccacgggttcgctcacttcaaccccatacaccaactctttttgggagaaaaaanannaaaaaaacnc

SEQ ID NO: 24102 - DNA, 560 bp, Triticum aestivum
  Clone ID: PAT_TA_24102
gtacgctggaacatatgacggtgaatgtcaacatggctgggcttcctgcattggttgtcccttgtggattcgtcgaaggtgggtccgcgggtctcccagtcgggcttcagatgataggatttcccttcagtgaggggaatttgctgagagtaggccacatcttcgaacaaacgctgcaggatctcagctttgtcccgccgctgctggcagatgcatgaccgccttcttggtgtctcattcagagccactctgcaagcagttcctagggctccgcgggtttcagaggggccctctttccattcattcctaaagttttgagatatatttagttgttgtatggcgaggatactatttgtacacaatgtgtgagatttccccgtgggagtggttgggccgttggggaccgagcctgagacgccatgtgcacattttttttgaggggttgacgccatgggcaaagccaacagctgcggtgctcacattcaatatgggccgacatggatgacatgttttttgtaatcctggttcacatcagtgattttcgcagatcctttgactcg

SEQ ID NO: 24103 - DNA, 766 bp, Triticum aestivum
  Clone ID: PAT_TA_24103
ggctgggcttcctgcattggttgtgccttgttaacattcaccgtcatgatgtctccggcgtacatagctaatggatcatgacggtgaatgttaacatggctgggcttcctgcattggttgtgccttgtggattcgtccaaggtggatctgctggtctcccagtcggacttcagatgattggatctcccttcagtgaggggaaattgctggaagctggccacatcttcgggcaaaagatgcttgatctcccctttgtcccaccactggtgccggataactagcgcccttctcatatctcctgcaggatctcagctttgtcgcttcatagggctcagataactagcgcggttctctcttctcgttcaatccgttactagggcgccacgtgtcttagagggttgccgttttcacccgttccgcgcattttgagtggtcgatatttcattgttgtatgccgaggaaaccggttctcagcaatgggggtggtcggtggagatctctccctcgtgggggagttgttgagaaacaaaatgagacaggtacatgtgctgtttctgcaagccaactgctggatgcagtgctcgcattcagtgtctgcccacatagtagatgataatttttttgtaaccctggttcacatcagtgatattttgcaaatccttttgattgattgactgataatagtgcaagctgttcatggcttcatgcccaccgcgttttcgtgaaaaaaaaaaaaaaaaaaaaaaaaaaaaaaaaaaaaaaaaaa

SEQ ID NO: 24104 - DNA, 448 bp, Triticum aestivum
  unsure (1)..(448): unsure at all n locations
  Clone ID: PAT_TA_24104
ccctagctagattctctgccaccgtcgatcgaccgagagaggcagatagcccgggagcagctggaggaggcgccgacgtccacgcccacggtggcgctggccacgtcgcccaagccggcgccggcgagcaacggccgcaagaagctgccgtcgcggttccggcgggtgtgcgtgttctgcgggagcagcccggggaggaagccggcgtaccagctggccgccgtgcagctcgggcagcagctggtggagcgcggcatcgacctcgtgtacggcggcggnagcgtcgggctcatgggcctggtgntcccgcgcggtgaacggnnggcggcgggcgcntcacgggcgttgtgccccggtcggtctcccgcgggaagctcatcggngaaaccccggcggggaagaagtaaanggcntntccggaatgcacaangcaaggccnanttggccc

SEQ ID NO: 24105 - DNA, 490 bp, Triticum aestivum
  unsure (1)..(490): unsure at all n locations
  Clone ID: PAT_TA_24105
tcctctcactctatcctcaaagggggaagaagggatagagtggggagcggagctgagcccacttcagcgggagctctactcatggccatggcgacctccaccttctccgcccacccgctctcgctcaagccccagctcggccccaggccccaccgcctccacctcgcccccttcccgcgcctccgctcccaccgccgcctcgccgccgccgccggggaggcccccgtcgaggcgccgcccaagccggcggaggcggatccctcccccgccgcctccaacgggtccgccgctcccgctgccgctgctccggtcgccgccgccgccgctccggtcgccgaggcgggggcgtcgcccaagttccaggactcgaggtgggtcaacggggacctgggacctcagccggtttggcancaccggcggcgccntcgactgggangccgtcatagacgccgangcatgaggangaaatgcttgatcattccccggagca

SEQ ID NO: 24106 - DNA, 447 bp, Triticum aestivum
  Clone ID: PAT_TA_24106
gattcaagtctatagtgcttcaagtagattcatagaagcaattccgttagtatgtgaacaaaaacctcatcttatatgtgtggccggagttgcagaatatgaataggggaatgatcatagatgccaacacctacagtgtgatttatcttgatagaggtgcaatggattcgtaagtagttttgatgttttttctagatagctcaagtacttaagcttctgcagtcatgaaaaacaaaagaagggaccagtagtcaggttccattaatccttctataggtgttctctttgatgcctttcccccttcattaccatgacaatgatgctttctctgttaaccttctcggtggtgttgggcgctgtgctcttgaccttgaaagtgtatttgcaactttactcataatacctttgtgtgatagtgaggcaatttagttgcatgccttcagttac

SEQ ID NO: 24107 - DNA, 524 bp, Triticum aestivum
  Clone ID: PAT_TA_24107
ttcgagcggccgcccgggcaggtactaggccgcgtcccctgagcctgcatggctgaaggcggtgcatcgatcgtgccggccagttccctaactaagcgaccacactatacatactgaagtccaaacgacatggtgctgaaactcccattcctcccagttggagaccgagagttgtacctcggccgcgaccacgctagtgaagaaggcggtgcaaagagtgctaggacgcgttccctgagcctgcccgcctgcctgaaggttcccagccagttccctaactaagcgaccacactatatgtacatactgaagcctaaacgacagcttggtcgacatgcatggtgctgaaactccattcctcccagtcggagaccgagagttgttgcacatttttgcagcactgcaatgagtaggtaggcgcggcaatcacctggctgaactgaaccaactgaaccctcatggagttcccgtgtatatgtatatgcaaataaatataaatacgtacgtgttgctaacggcccggagc

SEQ ID NO: 24108 - DNA, 370 bp, Triticum aestivum
  Clone ID: PAT_TA_24108
cttcaaatacctgaagtcctttcggcgcccgttcctcagcgcggcttaagatagccttccattccatttgatgaagtagtggtaatatgccaatgtagtagtggcagtcagtgatgtgtataagctgaccagcaatctcttttgtaacctgtaagctaggaatgatctatgtaggagaacatggctgtaccacttgactacttagctagcatcgatcattgcttggcgaagttatagtttgtttataacggcttccgtcacattatttcttgacggggattgagtatgtatcagagtggcaacatgtgtattaattgagtatgtaacaggaaagtgagctcttttgtccccccccccccccccaccccgc

SEQ ID NO: 24109 - DNA, 707 bp, Triticum aestivum
  unsure (1)..(707): unsure at all n locations
  Clone ID: PAT_TA_24109
ttttttttttttaaatctggaatcaggtttgttgcatcttttggtccttgtgtttgcgctgggttcaaccgaaaagtgcagctgcactttttagcatttatttaggcattaacatttggacgaacgggacaagacaaagacagcatcctcttttactggctagcttaattatccacccatagctctaagcaaactgagctagtacctccgccccgtccgcgcgctacagaagaccagcacctcgtcgagttcgaccttggactcgtcgccgaacaggctctccttgccgtcctccctcttcgcgtaggacagcccaagccgtgaccgcgcgcgccggaggtcgccgacgccaacgctggcgtcgggccccgtgaacacccccatcacggcggtgagcggcgggccgatgagcagcccgtcggcgccgaactgcggccgccccgtgagtagtcgaacagcgcaacaccgctcccgcccacttggggcagcacaaccggaacggcagcggcggtgtctccgggcgctgccggcggcaatagaagaggaaggcgtcgagcgtgtctagnatctccgtgctgcggancctccgggctgaaccgccgaactgaaggagctccgccttancgacacaccaggggccttaatccacgcggggaatcgtcngctaancgtaacggggccgtaaacacnacncngtcccgaggggg

SEQ ID NO: 24110 - DNA, 630 bp, Triticum aestivum
  Clone ID: PAT_TA_24110
aacagcatatgccgagggcgtccatcgacaacctgcccaatgtccggattcaccgaggagtacagctagagacactattggttgcctgcaggcctgtgagttgagttgctgcttcgttggagatgttgatgttgttcgagacgcccgctggattcacccttttcaaggttctgaattagggcaagctcgacaaggttgagtggtacaggtatgatcttcatggagctagccatcattggatttggtaatacataatcacttattcagagagcccaaggtgagaagggacgagcatctagaacaccaccacctactaatcagcgagctactatctgtctttgaatgagttacttaacaagagaaggcaggagtttcctacctttcttctgcaaatccggaatgcctttatggcatgatcatgtgaaaaagtaccttgatgcagtaatggatttgattatcactggttactctgttttcacgaattactatccaactgtaagtctgttctataccctaaggcccatgtaaatctgatagaagattaggctatttaattgtaactaaataggataatattctttcagtcgcttgaatctgtccagacctgaaaaatacttatactttgaaagc

SEQ ID NO: 24111 - DNA, 593 bp, Triticum aestivum
  Clone ID: PAT_TA_24111
gcgggagaggggcagagcggcgcaagccatggccatggcggaccagcagcagcagatcgagcacagccacctcgccatcagaggcctcaacctccacgtagcccaagcaggcacaggcgagctcgggacggtgctgttcctgcacggcttcccggagatatggtactcgtggcgccaccagatagctggccgtggccgccgccgggtaccgcgccatcgcgccggactggcgggggtatggcctctccgaccagccaccggagccagaggcggcggtgtaccgcgacctggaagaggatctccttgccgtcctggatgcactatccgttcccaaggcttaccttgtggcaaaggatttcggagccatgccagcttatgattttgctcttcgtcaccccaaccgcacatgcggtgttatgtgtttgggtatcccttttcttcacggtggctcctccttcactgccatgcccgaaggcttctatatactgcgttggcgggaaccaggaagagcagaggcagactttggcaggtatgacgtcaagcgagtcgtgcgcaccatctacattctcttctctagaagcgaaatcccgaca

SEQ ID NO: 24112 - DNA, 720 bp, Triticum aestivum
  Clone ID: PAT_TA_24112
cccacgcgtccgcccacgcgtccggtggagcagcagcagcagatcgagcacagccacctcgccatcagaggcctcagcctccacgtagcgcaagcaggcacaggcgagctcgggacggtgctgttcctgcacggttagtcctagatatggtactgccggcgcctctcgacggtcttgcatttcaagccaggggctgtgactctatgaggatattgtttagtgtgaactgcaactttttttggttggtagagttcctcgagcattgcttaacttgaatgataaactactgagcaagttggcctgagagcagagaggttagagctccagatggttcttggttgcaatggggggagatgcaggggagggtgaggaggctaacgatagggtgaagtagcccggcgacgagtgcaagcagcatgaggcattgtatgggatggatttatcatgctgggattagctgtagacttccttgctgaaccctacagggagcaatgcatccccagtttgcttccagagaaggaaggggaagagggttttcttgttgctgctattcctcgtggatattcaatatgcaacttggcacctaatgtcagcaacgtgcttatcggtgacgagggaaatgaaagaaggctgcaatggaatttgtactaggtgagttgagttgctgcttggttggagatgttgatgtcgttcgagacgcccgctgggttcacccttctc

SEQ ID NO: 24113 - DNA, 706 bp, Triticum aestivum
  Clone ID: PAT_TA_24113
atttccgcctactgtcgttgttaccaaccagccggcagtctccatccacaagctctaaagaaagaaacgggcaaccagaaagccttccaagtgacgggagaggagcagagggcggcgcaagccatggccacggtggagcagcagcagcagatcgagcacagccacctcgccatcagaggcctcagcctccacgtagcgcaagcaggcacaggcgagctcgggacggtgctgttcctgcacggcttcccggagatatggtactcgtggcgccaccagatgctggccgtggccgccgccgggtaccgcgccatcgcgccggactggcgggggtatggcctctccgaccagccaccggagccggaggcggcggcctacagcgacctgacagaggatctcctcgccgtcctggatgcgctctccgtccccaaggcttaccttgtggcaaaggatttcggagccatgctagcttatgattttgctcttcgtcaccccagccgcacatgcggcgttatgtgtttgggcatcccatttcttcacggtggctcctccttcactgccatgcccgaaggcttctatatactgcgttggcgggaaccaggaagagcagaggcagactttggcaggtatgacgtcaagcgagtcgtgcgcaccatctacattctcttctctagaagcgaaatcccgatagcgaaggaagatcaagaaa

SEQ ID NO: 24114 - DNA, 993 bp, Triticum aestivum
  unsure (1)..(993): unsure at all n locations
  Clone ID: PAT_TA_24114
cggacgcgtgggctagccgccagacgaaccctagcccccttgcccaatgccccccgatccccacagccgccgcacgacctcgctccttcttccctcccgccgcaccctctccttgctcgcagctgcctccttcccacctccgcccgagctccgccttcctcgcctgcctcctcctccttgctatcggcggaagcctcaagccccggcatcaccgtcaccagatccacctcgcaacctctcttcctcccctgtctgactgctgcatggtcgcgtcaggcccatgccggggttgccgccaccgctgcagccgatgccgctggatgtatctatcggtccctcccgctccagatcgaaaactgagagagcgacgggagggaagaaggggatcgnggggagggtagagcacgggagagaaggcgagctcgcggctgaccgcagcgtgcgaggcggatgggtgagaaaaatttgtggtcgtgccgctggtgactggagatttggaatgcggccgtggccatgggcggtcctggagcgggatcgcgtgtgcgctgcctccaacctgctttgctgctcctgcgatctcaagacgtgtgcagatctgaggacgaagggaagaataagaagaattttagctagagatctgaagaagatcaagaagatttttctccctcctgttaagctttgttatctccttttgatgctattgtttgtgattgatgtaaacatgaggaagataagagatcacaacgaggctaaatgagatttgtggtgaccaaaattctttctttgtttacctacagaactttattgcactattgattatgtactattttcctttcctaaaggaagatgccgtgtcatgtaacatctttaaagaagagagaatcttcattttgttcattgtgctatcagttagggtggatttgtgttttcagaaaattggcaaccttacatgtacatatttacaaattttctttataacactaccagcacaca

SEQ ID NO: 24115 - DNA, 945 bp, Triticum aestivum
  Clone ID: PAT_TA_24115
cccacgcgtccgccacagtctctccgctcccgtcaccacgtcctccgccatggagcctcgccgccacgtgcgtctcccttctccaccatgctgcccttccacctcgccttcctcctcttctttgtctatgcggccatcggtggcggctggttccaaatcgggcgcggattagccgagcccggtggtgaggtgaaggagaagggtgggcggcccgtcgcgatgggatggggctagggaagagggaggaggccgaagggtgaacgtccgcggacgcgtgggcggtcacataggcgccgccgctgtccagggtcattcgccgtcaccggcctcactcgcctcgtctcctatctcttcatcactgcatccatgtgaatttttggagaatggtgctccgatttggtccccatgctacaggcctgcaacatttatagacgaggattgcaggtgtcgatacaatggagcaatttctggctttgtagttggagcatagcctcgattatgcatgattttggggttttgctctctccctgtgtgctacacatttctgctctccccagtagcaattggatgttaatctgctttgggcagcggcggtgcatcaaggtgcaaggcagcagcgacatgttcatagtacgctaaaggatgagctcctacttttcctgatgctagctccttgctgcagatatacaagcctgcttacatctcccaatatctcctcctggtcaaggcaattgcacatgatgaagacgctcattttagatcagttcatggcatatgtgtctatttgtgtctatttcctttagatggttcttctgtgcgacgactggaaaatataaggtttctcatgtgatattgcaatcaggacaaaaaacagaatgattaattttcacaatttgatatttcatattttccagaaatacgactacctttcgaacagaacccttt

SEQ ID NO: 24116 - DNA, 1326 bp, Triticum aestivum
  Clone ID: PAT_TA_24116
gggtaccgcgccatcgcgccggactggcgggggtatggcctctccgaccagccaccggagccagaggcggcggtgtaccgcgacctggaagaggatctccttgccgtcctggatgcactatccgttcccaaggcttaccttgtggcaaaggatttcggagccatgccagcttatgattttgctcttcgtcaccccaaccgcacatgcggtgttatgtgtttgggtatcccttttcttcacggtggctcctccttcactgccatgcccgaaggcttctatatactgcgttggcgggtttttaccctaacctgaaagtcccatgtcaagcacatgactagagagttcttctcatgatatcatacaaaaagcttgcgctgtgcaggaaccaggaagagcagaggcagactttggcaggtatgacgtcaagcgagtcgtgcgcaccatctacattctcttctctagaagcgaaatcccgacagcgaaggaagatcaagaaatcatggatctcgcggacctgtcgactccccttccagagtggttcaccgaggaggatcttgcagtctacacgtccctctatgagaaatcaggtttcgtgtatccactgcagatgccatacaggtctctccataagaggcatccaatcgaagacccaaaatttgaagtcccggtgttcgtcgtcatgggggagcgtccggtccttcttcagttcagctacgctgggcactgtttccacttcttgtttcttacttattcatgtgctttcagttagggcggatttgtgttttcagaaatgaggcaaccttacatgcacatattcacatatttcctttataacactaccaacagacatgagttcttgtgtttttagagcttcatggaaacaggattcggtgcttcccacttagtctttttttgcagatatatttcctttatcactcccccagcagacgtgagttcttgtggcggggtttttcatgccgccatgttaggaatttattatcagattgtagaaggccaaaaaaggcggagacgagtcatggatcctgctggcaatggctactggttgtagatggaatttaagcagaggaatcgcaaaagttgtgccccatgaggctagcgaccaaaggcccgatttcttttcgttgaagctcatgaaaagcttgatccttctttctggcgctaaggtgtgaaacctgacatgtgatgatgcatcagcgagttagcaatagaagatgtcagtgaacacgagtgccagtcaagagcaatgaaacgctagatactttagagtgtaattttatataagaataaataaatgacacttaagtc

SEQ ID NO: 24117 - DNA, 1263 bp, Triticum aestivum
  Clone ID: PAT_TA_24117
gccggccgggtcgggaatacgaccgggtcagggagagagaggagagcagagaggggaaggcgatgggggcggcgaagagaagcgggggtgagaaggggctcctctggaggctgccggaggtcacctcaagggagctcggcaagatcggccccgccttcgggctcggcatcggctgcggcgccggcgccggagtcggcttcttcggcggtgcaggattaggttatggatttcctggactcactttaggcttcggagttggagctggctgcggtataggatttggttttggttatggcttgggcaaaggaattgctcatgatgaaaagaaaagacattcaaacgttggtaaaatgttccaggaaactccaaatctgcctaaggacaccattgccggtttatttgacgagttggttgtaaacaccaaaaagcttgccaccgcaacttcaaaacagattgaaaaatggcactgagctgcacccccagatggctgctgctatttgctatcttagatggtcccacgttggatagagactactgtgtcacattaatatcccattttgaacatttgtaagtaggtttgtattcaagtagggttctgacattatgctatagggcttgtttgaaattctcaaaatgttgaacattgtggtagttaagaaagaaagttcgaaccgatggatgcttcttatgataaaagccagtgtccgggtgtaatctgccttcaatattgcttcacaaaaaaaatagcaacatcaaaaggctctctcgaacttattatatcatgctctctaacttcttgacatttaatttcaattaaacaaattttgtttatagagaaaaatatattttatagaaaaatagcccttcattctgtttattatctcaagctacttttactgtagtccttgcttaaaactgatgtttgtcttgtgattgattcaggatattttgtgggccaacccctacagaataatgcccagtttaatttcagcagtgggcatgacagcctcaaactttttttttcaatattgaaaaagcggcttactcagatcaatgggaatgcccttagaaaaatagctaaagagtacgagatattcctagagtaaataaagggcatgctgtgctcataagttagacagaagcaaaatgttatttattatgctcctgttggatccccggacatttttttccccctaccaataccccagtattgaatatttactttccccccgtggtacagaaactgatgttagtatttgtgcc

SEQ ID NO: 24118 - DNA, 1294 bp, Triticum aestivum
  Clone ID: PAT_TA_24118
ttctcgagcctctcaagaagtgacacgggagaggagcagggcggcgcaagccatggccatggcggagcagcggatcgagcacagccacctcgacatcagaggcctgaacctccacgtagcgcaagcaggcacaggccagctcgggacggtgctgatcctgcacggcttcccggagatatggtactcgtggcgccaccagatgctggccgtggccgccgccgggtaccgtgccatcgcgccggactggcggaggtatggactatacgaccaatcaacggtgcataaggtggttttaacctacccgctgacaatttttctcaagcttgcgtgctattagagtacattgtgagtagcttggttagagttacctacaaaactatttttgctagcgcttgcagatttctatttaggaatcagatttctctactgaatatgcgattttcacttccaagtggtaaaaactttgatctttttgcaatctattttggaacggagagagtacctatctaaggagcgggaggtgaaagtgcaaatcgaaatttctattttggaatgcaatgttctctactaaatgtgattatcactttcgtgtggtaattaatttctgagcctgtcaaggtgtaaggcagcagcgacatgttcaatgtatgctaaaggatgaactcctactttttctgatgctagctcattgctgcagcctgcttacatctcccaagatatcctcttggtcaaggcaattgcacatgatgaagccactcattttagtggtataccacactctgagcaataggaccaaaaacaggaagataaattttcacaattcgatactacatatattttataggatatgcattgtgcttaaacatgagtgcttgctcgccgaacattggccctcggatgaattcggcgcttgaatcgagctgacgagccccatgggggtgagaggcggataacaatatgagaaggagcatgccatggaggagtgcaagcagcggcactcctccgcaatggggtatggctgcaggggaggggacgcagccaacgacaggaagaagaagcaggtcgtcgaggactacaagcagcaggtttcctttgactggaagtctgaaactgaagatagggcatattgttttggttctgagtggccggagatattgttgcttgatgtccctagagcactcggacccttccaagatagaagatctttgggattgactttctgatgagaaagtagcatacggatggattgacatgaactattcagtggtcgaactgcgctatatttctttcattg

SEQ ID NO: 24119 - DNA, 2221 bp, Triticum aestivum
  Clone ID: PAT_TA_24119
gaaaaccgcgggggcgaacgtgacctcatccgggcgcgcacggacctccaggtcggacggcgctgggggccgcgccgttggccggggctgagtgaggggctcctctggacgcttccggaggtcatctccagggagcgcggtaagaacggcaccgttatcgtgctcgtcaccgtcttcggtgcccgcgccggtgtcgtcttttccggaggtgctagtattaggttctggctgtcggaggctcactttgggcttcggggttggacctggcgcaaggtacacggcgtctgatctggttttggctagcgcaaaggagttgtgcttggggaagtgtacagggcaattacaggttggtaatatatcccgaggcaatcggcaagtccgtcgaaggaaaaaccgagccgggtgtcatttcgactagagtgttgccgcctacatgctacgtcaggaaatgtcataccagattcagaggtgcaggtggatcgacacgagaagacgggcatcgctattgagtatgtttatgggtgcgtatgtgtataataatatttggttttcagtataatttcccgtgttgttcatttaccacaaagttgataatacatggaagtagtcggacagtttagtctgaagagtgctcgcgtagcttttagacacaaataatgctgtgctgctattatttcggctaatgaagaatgagtacgagatagaggtaagggaggtcgagacccttatatcaaagtgcggtctagataagttttaccggaattataaggacgcgaacattgtgtgatgcaatgagttttgaaggagagcgcttcaaggagaaggtcgatgtgttcggactagagttctagacgaattcaggtgtgtcttgacgaactgacccactgtcatgcttggcctgcactgggtttcatgagagctaggatgttctggatatcatccaagagattttaggcaggattgcaggggagaatataccactcttttcgcatattaagaaagcttataggcacgtaatgagcagtacaaatagattaatggataagacagttacagtttatttttgttggcaaaaaaggaccttaaagtgttgtaaagtttgtcgctagtgaggcgcgatttctatgcttggttgtcaacatagggaaatacatgttcagcttggcccttaatctgggtgtatggttatcttcatctctatacgcgcatgcatggacgagcttcagtttgaagaggagaaaacaatcatgttgagttttaataagaacaggtcgacaaccatgtaaaagtttggaagaactgttctatttttgcatctggaaccagatgctgctgcttaagatttgctctccttttccaacatggcttattgtagggcatgatgtgctcataagttagacagaagcaaaatgttatttgttatgttcctattgaatcctcggacattttcttccaactaccaataccccagtattgaatatctactttcccaccttcttacaaaaaataatttttgcccttgtaaaccaagtaacaacatacagagctaacatggttgctgacgcgtaaataattatgttatattctgcttttgtcagtttgctggtccatattaatttcctcgagcttattttcacatctcgtcatatttacacctttctgccaactgccacctatcatggagggagatggcttggccaggccgtcaacacccatcggcaacttccggcaggcgccgtcccgttcttcctccccttactctgatgccttcatggccaaaatcattagcaggagcaagaaggttaagcgccaattatggttaaagctttgtctcttttgtgtactatgcatgattgatctgattttgctggccagcttacaaattcaagtaatatggctattgcaatgcatcttactacgtgtgtatttatttgcattgatattttctcctttttggagcccaagaaggggtgaaaaatgtcactgcagctttgagtgcagtcataggttaaatggaagtattggatggagcaattcagtggggctgctgcaggaggatacatagtaacaatgatggaaagaaccttccccactcgctcctgaaccttataatgtgcctttgtgtgtatatttaatcattcacggaaacctgatttctattttaatggtctgattagacaggactgataatcgctgagccaaatttacatgtgattttttg

SEQ ID NO: 24120 - DNA, 695 bp, Triticum aestivum
  Clone ID: PAT_TA_24120
ggtctagcttagttgcgaaatatgacccagaggctaaagatccttatctgagtggggcactagcgacagtactttgggagcttagccttctgcagaagcattatgatgaaactgttagtggaattgcttcaaatatcttgagcatggcaaatctgaacgccacccagaatccagttcaactttctagctcaaatcctcttgaagcatacaaagacttgtcgatgggacgtgaattatcaaagccaacccacaaagtgtcacagacattgaagtgcaaaaggaaacgacgcagtaaggagtttgtcgctctaagtccagatgtgctcgagaaggcagattgcacggtgggcgaagatgaactgagagagaagttgcaaagtcatttcgcggtactaagaggcatttccgagaatgagagattgaggaccgagttgaaccatgctttgtcatccataaacatgtacaaggaatacaagaagcagaaaaaggtaagtaagaaatcaaagaaagctgcaaaggcttagttgtcttgtgttctgtggatttttccccaaacttgcggtaggtgtgcccctattttgttgtagcatcactgtatcgatttatcgtagttccctgtgacacatttgcggtttctgtgcaagatacaattgctgcatccttgatgattttgcatagtcctcgcggccgcgaaa

SEQ ID NO: 24121 - DNA, 884 bp, Triticum aestivum
  Clone ID: PAT_TA_24121
ctcgctctccaccctcggtggtagctcgcgcgcgtgcagcagtgcacacaagttacagcggcagccggcgagaatggcagctaggacgtcgctgctgcttctactcgcgctggccgcggtggtggctcacgtcgacggtgcgaccgtggccgcgccggcgccggccgtggactgcagcgacgccctgatcagcctggcggggtgcctgagctacgtgcaggaggggaacacggtggccgatgccgggaggcgacctggctgctccgggggctcaatgggacgtggtgaagaaggaggtggcctgcctgtgccacgccttccagggcggccaggacgagggcgtgaccctcacgtcgaccaaagccctacaactgcccggcgcctgcaaggtccatgcacctccattcagcaagtgccacatttccgccccgggcgtaaccggggggtctccagcacctgcacatgccccgtcttccggtgctccgttcttcgggggctcgccgtcaccatccacgccctcggctgaatcaccagccgcagccggaaccggaagcggcgactccaccaccgctcgagctccatcgccgtcggcctccgccgtggtcaccctccgccactcaccacgcgtcctcctagccccccctacccgcggcgcctgcccccgcctcgcggctcctgcgggccgcgggatgcccctgtttctccgcacacctgtccgccgtcctggcgaccttttcccctgcacccgcccgacacagctgagaaagcgcagaccaagccttgttgctggcttgctgcatgtaccgagatgtatcttatctgagagtttccattccatttttatacagatatattatttatacacgtttaaaacctcgtgccga

SEQ ID NO: 24122 - DNA, 646 bp, Triticum aestivum
  unsure (1)..(646): unsure at all n locations
  Clone ID: PAT_TA_24122
taccaagccaccgaccaacatggcagcgtctctccaagccgcggccacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccgggcgcgagcgcggagggggcgcccaagaggctgaccttcgacgagatccagagcaagacctacatggaggtgaaagggtaccggcaccgcgaaccagtgcccgaccatcgacggcggcgtcgactccttccccttcaaaggccggcaagtacgagatgaagaattctgcctggagcccactccttcaacgtcaaggccgagggcatcaagaagaacgagccgccggcttcaagaagacaactcatgaccgttaactacaccttgacaaatggaaggccgctcaagtcgcgccaacggacctcagttcaggagaaggcggatcactagcggcgtaacgtcaactccgagggaacgctgccttctctcacgtaacaatcgtccacggaaccggnncttacggn

SEQ ID NO: 24123 - DNA, 405 bp, Triticum aestivum
  Clone ID: PAT_TA_24123
ctcgtgccgaattcggcacgaggtgctacgaccgagccggctagttgctgcaacgacagaggcttccgacgtgctacgagacggccctgtccctacgtggtggcggctaggtgcaacgactacctctgctggatccggcgagaaccggtgcagcgatggcggcgagccggcggggcttcgaagtcagcggcaggggcggccatggcgggctgcgtgagtgaggcagcggatgtgctggagattttttttgttttgttttccgtatgatgtatgaggaaggaaaaaagagggccgggtctgatggcacagggaactttaatcgtacgggtatgcgttgaccggctcaattttggaccggtgcgccggcgcctattactcgcctttttcttttggggtaaaaaaaaa

SEQ ID NO: 24124 - DNA, 468 bp, Triticum aestivum
  Clone ID: PAT_TA_24124
agcggacgcgtgggcggatgaaggcaactactcgccctccttcgtgctctacaacatgtctgcgggcatggcgtacagcttctcatgtgagttttttttttcttttctcgataaaaggagcccagctcccaatttcattgctgaaattgcttgttttgtgagcgactcactccatgtatatgcatggctaattatccttacttaaataggttaataacttgattgagaatgtgtagaaaaggagtgagaataatttttgagaaaaacgtgtcagtcagacatgtccttttcccctaaattctttttctttagtttgagggtcaaaagtcaaaacacctagtcctagaaaaaagaaaggaatttagtttgatgagatctaagtagaagatttccagggacgagctacgcgaaaagagacttgacatttcaaatctgaaaatgccttttgaaaagcatatccgcaagttc

SEQ ID NO: 24125 - DNA, 765 bp, Triticum aestivum
  Clone ID: PAT_TA_24125
gagagctgctcatgaagcacttgatgccaaagatcaagagctgaaggcagtacttaaaaaatgggatgtgaaggagagggaactacgtgagttggaagagttaccggatcccagtgccacaaatgaacttgctggtttttccagtgagacaacagagggcggtattgtaggagagatggagctgccagagcttcaaattgatgctgcggaggtcgaagcacttgctgctacgactgcattgaggaagcttgcggatatgactaaggatttcttcaaacacggcaaagctgattctggtattgacttggttgcatcagagagtcaaaaaatcagtaaatgtgatcctaaaatggaagtacacaagaagacggatgtgattcttgaagctgaaaaagaaatagttaggctcttctcattgacaaaacagattgtcactgatgacacaataaacaatcttgaggaatgatagcttcaaactaaagcatgtagtcttccaattctatcaaggtagatcttccaagatagcttcagagtagagatataccagatagatctttcaaacattgatggacagcgacgtcgcccagaaggatgagatcttctctggttgatatcacaactgccattttgaaaaagggtaacatgttgagcagaagctggtcatctgatcttttgtgctctttttgtattgtgcctcaaactattcctcagatctttgttcaatgtgtttctcctaaatatacatggggaaggtacttggtatgg

SEQ ID NO: 24126 - DNA, 862 bp, Triticum aestivum
  Clone ID: PAT_TA_24126
tgtccgccgccggcctctccgcactccgcaccccattccccacctcctccggtcctcgcctacagccgctcctccgcgacggcaccagccctccaggtgccgccggcccaggcacgccgcctgctctccatgcgccgccgccagcccacgcacgccggtcaaggccttgccccaggccacggttgggcgccgtgatcactcatctcctctctgtggcaccatctctcagatccaggctgctcaacactgtcgagccccaaccagagcgcccgtgcctcactgtccttgtgcgtcgtgacactgttttcaccccgtagcctaggccacgcgggctgacaaccgtcgccgccatcctcacaagccgagccaggttgaaggatggccgtccgccagctgcgagatccatccacccagttttgcatccatcaagcaccagccaccagtgatctgcgatgaggcgtggtacgactccttcagcatgttgggagactcggccggctccaaggacgacaacgattactccagcgtcagtggaggtattctgctcgcccggtttctcatgcccttcagtgcagtttcaggttcccagtgtactcagcatcagatgttccccatccgtgtaaatccaaatcctctccgggtctcccgaaaaacgtcgctggcagggacgattccaaggggggacgaggggggctaaacccccctgacgaacttgtttcgcctcaatagcgattaggcaggctggtatttaggcagtgttttgactcaattttcctcaattcgcccccctgtccggctgtcgtgcgtaaccacatgaaacccccagggccgccctagcccatgtacactacatagcagatcc

SEQ ID NO: 24127 - DNA, 660 bp, Triticum aestivum
  unsure (1)..(660): unsure at all n locations
  Clone ID: PAT_TA_24127
aaaaancntncacccccttattngggggggantnctttttnatttaaaagggtttttccccaanttgggccatttggttaaaaaaaaggggtnttttnaanaaaattttaccnggatttttnnnaaaaatttaacccttcnaantttgccntttncccattangggtggccantntttnggaaaggnnatncggtnggggccttttgggntntcnccccctngnaaaaggggantttnttccaaggnnnttaatttgggtaacccnanggttttccnagtccnanggttttaaaacncgggccantgaattntaaancnncccccnnnagggnaaattgggnnccgggcccccccccnngttttttttttttttttttttnttttttttttttttttttgcatggcaaagctttttcgcccatacaactagcatcttacagacaatgaggttccttcttctggttgcaaaagtgcaaagctattgacagaataagtaacaactaacatccactatgatatgattcacggcgccattggccttcgacttttaagttaaccccccccccaaaatacacagaataaaactatcatccccgttctacctgctgaggattccncatacagttcgggtgccgcaggctcaanaactttttanactg

SEQ ID NO: 24128 - DNA, 564 bp, Triticum aestivum
  unsure (1)..(564): unsure at all n locations
  Clone ID: PAT_TA_24128
ctcgtgccgaattcggcacgaggcaagaagaagcaagcaactaattatatagcttagcttaatggcgtcgactcacagctcgcgccgcctcgacggcacactgtttgcgcttctgctcgtgcttgcggccgccaccgcctttgtcagtgctgccgcggcgcgaggggacgcgctggccgcccggcacgagcggtggatggccaagttcgggcgcgagtacacggacgctgccggtaaattacgccggcaggaggtgtgcgccgggccaacgcgcggcacgtcgaggctgtcaatccgagcgggcaaaccgggacatacacgctccggctcaatcattctccggacctcaccaagcgaaagagtcgccggagaaacactccgggtacgccaccaacacgngtnggacagacgccggtggccccggtgaactctccgctgtcaattcgatccnacgccggacagcgtggactgganggccccggngcctcaccaaatcaagaacaaggnaatcgtnttctggcntcccggggaacggaangngggccntaagnacactggaactac

SEQ ID NO: 24129 - DNA, 686 bp, Triticum aestivum
  unsure (1)..(686): unsure at all n locations
  Clone ID: PAT_TA_24129
gnccgatcggcgccaccggcggccgtcgggcgcgctgccatctcctggatcgaaggggacgccttggggtctcgggcccctcccgggcggcgccgtgttggcggctggggcgtcgccggccgcaccgaccgcggtgctgcgctcgactcctggcctcgcccgcggtcggcccgccggcgcccccctcgcccgattccccgccgtctcctccggctgttcctccgcgcgagtcctgggcggacctcgctgaagctgccgatgtggctgtgggccgccccatcgcctgccgcgaccgcatcccgccccgcgctccggtccggccgcctccatccgtccctgccggcggcccgactcccaggggtgggagttcggcctcccgcgggaccgatcggcgccaccggcggccgtcgggcgcgctgccgtctcctggatcgaaagaggacgccttggggtctcgggcccctccccggcggcgccgtgctggcggctggggcgtcgccggccgcaccgaccgcggtgctgcgctcgactcctggcggtcccccgcgttggcggcattcgcctctgctccggccggccagtcgccggcggcgacgctcgcgctctcgggcatccttgtccggagagcccccttcgtgaaggaaatatgtcctagaggcaataataaagttattatttattttttt

SEQ ID NO: 24130 - DNA, 630 bp, Triticum aestivum
  unsure (1)..(630): unsure at all n locations
  Clone ID: PAT_TA_24130
aaagtagaccagtagggggaggagccccttcgtctttttaattaagagagggaagtgtgtgtctctcgtcggaaccaaggttcgaacacgcgccagctgtagtgcaaacaatacatcttatttacaaatgttgaagactgtacctatctaaatcaccatctatttacaaatagaattagagaagttctaggtacatcagtagtacttgaaaaacaacataagtatcagtctgaagataataggcttactggacacctatctcttttttccaaatgagtaggaaagagagatttttattttactacttctatctagtcgaagggttggaatgccgcggcgctcaatgacgaaagaagtactaagancatnttggcgctccctcacttaaacatnggcatccaatcnaattttccngcaggacagagccacaagaagtnatcgcncactggtcaagggggggccgtaccaattccccnaantggntctataccncccaaaggcntcgtttnaactcngacgggaaaccgggttncactatcncctntgaaaccccttcacggggnatacncaggcgcccatntccnccaattcccccanggaagggaccccttgggtatacncggggtgttn

SEQ ID NO: 24131 - DNA, 989 bp, Triticum aestivum
  Clone ID: PAT_TA_24131
aattaccccttctcctcccgacccccggctggaaatggcggcctcctccccctccgccctcgcgctctccccctccacgcgggtggtagctggtccgtccctgctgcttgctgtgaagcggacgccggcgacgcgagtggccgccgctccctccggccagctccccgcctgctcttggggccctctccggccggagctcgccccggcccctggcccctgcgccgcccgctgcagggcgcctctgctccggcctcgcgcatggatgtccacgtcccagattgccagctccgccttcacactgggcaccgtcgccgtcctccccttctacacgctcatgatcgccgcccccaacgccagcatcactaagcgcaccgtggagagcaccgccccctacgtggcgctcggcctcctctacgcctacctgctctacctctcctggacccccgacaccatccgcgccatgttcgccagcaagtactggctccccgagttgcctggcattgtgaggatgttcgcgagcgagatgaccgtcgcctccgcctggatccacctccttgccgtcgacctctttgctgcaagacaagtgtaccatgatggaatcaagaacaacatcgagaccaggcattcggtttcgctgtgcctgctcttctgccccatcgggatcgccgctcacgcgctgaccaaggtactcgcgggttccacaggtcgatcacactgacgaccgattgcctgtaggcaggctccccttgtttagatgtctcagatcgtgaggttcagatatatgaataaaattgatttggtgcaccatttgttctatatagatttcacattgattgttcccacccattctattggaattggctcaggaaactgaatctactcgccatcatgggttcatagaagggctagtagaacaggttatttgtaccatcgagtcatgacaccaagaaatgtacaactaatttatatcatgtctcagatttaacggt

SEQ ID NO: 24132 - DNA, 540 bp, Triticum aestivum
  Clone ID: PAT_TA_24132
tggcacttccgaggctactgttattgaacactcttgacagtagtgtcacagcttccgggatgccataaatactgcgtaggtaatctattgagggtgcgggtacccagaattacaaaatgggccattgagctcttaccattcgatataacttacaaacctcggcgagctataaagtcacaagttttggctgactttgtcgctgaatggaccgaagccgaactccctaaagagtacggcgcatactccaattggattatgcacttcgacggctctaaaatgttggccggactgggggctggcgtcgtattgacgtccccgaccggggacacagtccaatacgtacttcagataatgtacacggactccaacaacgcagccgaatacgaggcccttttacatggtctccggatggcaatctccatgggcattcaacgcctagaggtgcgcggggattcaaacctcgcaatatcccaaataaatggagactttgacgcccaagatcccaaaatggcagcatatcgcaacactgtcctaaacatg

SEQ ID NO: 24133 - DNA, 845 bp, Triticum aestivum
  Clone ID: PAT_TA_24133
gccttgcgcaacggcgctgccgtgtctcgttccgtgcccgtgtaatttgtgagactcgagtcagcgtattgcacgagaatgaccatagaattgtactttacgtttggcgctgatcgaagggcccctgaggctcgccactttacagcagctactgcagctccttggcatcaaatagataatagaataaaaatatttgaccacactggatctctgcagtttataaaggaatttgaaaaactgtatcaggttgactggaaaccagaatctcctgaaagatttgttgacattgctgagctcacgatatctttgaatggcttaaaaattgaagaaacaaagaagcaaggacaaggttctaaatcggcacaaacatcaggcaaggctcctgtaaatgtagcaacaaaacctgcaggagcataccgtccacctcaatcaaagcacactgcagcgcttcaagacaagcttttcggtggccttgctcctaccggaggagagatgagcaaaactgcattgagaaataagaagcggagggagaagcagaaggagaagaaggctggggaaggctcttccgctgatgacagctgatccactggcttgttttggcatttttcgctgctgagtgaaattcatagtgacgaatagttccttcattccgaagaagaaatggctatgcatcttgtgaatgagaaatgacgctttccagttacactgtaatatgtgagactcgagtcagaggcacaagaatgaccatagaattttactcgacttttcgcgccgaacgcacggacagtttgtgtaactatatcacagaaaacagtggagctattttattttgtttgtcagatgca

SEQ ID NO: 24134 - DNA, 674 bp, Triticum aestivum
  unsure (1)..(674): unsure at all n locations
  Clone ID: PAT_TA_24134
ggacagtatacagagtgttgatgggccaggcagcataccgagtgttgatgcgccggacagcatacagctgatggaactggactcaggggaacttggcagggaggctgatgatcttgatgcactaatcaaacctcttcggatcatgagaacggcaagagtgtgacaggctaacagctgctggaacttggactgcgggaaagttcaacatttcagcgtgcgggccttcataatcttgatgcacaagcaaagccgcttcggatcatgagggtaaagagtttgatggctgatgggacagtgctaaggggattcaagttttggacatgcagattggtgctcaagctgactcggaccggcgagaagaacaagggtttgacaagtttttcggttatctcggatacccgctgttgatatagtgctttgctgcgccacaccaagctgcggcgctgactgggttttctcttcgacatacccatatatagatagggaaaacatgccttgtcatccttttttctttccttttttaacatctcgtttccattcatcttgtacttatacataggttacattgtctcaaacatagagtgggagcaactggctgtattacctgtgtgttgaatgtaaaaacacatatcatatctgtgaaagaagcaatgcaactttatttctagccnnnn

SEQ ID NO: 24135 - DNA, 485 bp, Triticum aestivum
  Clone ID: PAT_TA_24135
atctgtcatgtcgtgcaacgttaacgttaccattgcgtttggggatcttggcagtaaattcaggtttacttgtgaagacaaaaaccctgcgatcccttcttcagcggaacaggtacctccctcccacggtccttcttcagcggaacagggcatgaacgactgtggcacccaaaatttccacgtaaagtacttgggcaacatcaacggagcatcagctgatggtatggaggacgaaaacgaatcgctggacccaaaggactaaaaggaatcgcccgaagtaaaagggaaaaactaagaatatggatttgataataacggagaaagtgctctgttcacattcgtccctataggcatcatgttgggcatatatttgtactttatcattctaccctgtggattcatgtttgactattattactggtatgatatgtaattgggatgataaatgatgcttggtaacttgaataattatataaaagtggggg

SEQ ID NO: 24136 - DNA, 353 bp, Triticum aestivum
  unsure (1)..(353): unsure at all n locations
  Clone ID: PAT_TA_24136
cctcaccctcccaatcccgccgcgctccagggatggccgccgccgccgccgccaccgccgccccgcccgccacgccctcctcccgtcccctccgcatgcctcccgcgccgtccaccgtccatccacagctcaggtgccatgccggccccagcccctcgctcctcgcgctgcgccaccgcgccgcccgcgccgcgccggcccgggccctgctcgacaaggccacgcccttcaacttcggcgacggcgaaggaggaacgacggcgacgaccaaccccgcgcaggagtgcggcgtggtcgctcnntttgggggggacccggaggcgtcctcgctctgctatctcggctggcaaacg

SEQ ID NO: 24137 - DNA, 917 bp, Triticum aestivum
  unsure (1)..(917): unsure at all n locations
  Clone ID: PAT_TA_24137
cnaatgcctttttttggaaaatnaatccttgtgtacacatttgacattagggagtgtgacagccatgtctaaataaaggaggcatttgcntgcagttataaatatcttagcaagctttgtncaacataatatcagcaacaatatcccttgtgtgctcgtccgganttcggcacgagggcgtccgtgaagtcgccgcngcgttcgctcttgtcgccgtgtgcgccgcgctcgcggcgacgccggccacgggtacccgccgcccgagagctgcgcgacgcagggcagctacttcatcaactgccttcgccgcgggttcggcggagaggtgctgcgccatggtggagaaccccaggtgcttctgccaggtggagcgggaggccgagatccggtgcgtgcccgggcggagctgcccgagccgtggcattgccaaggtcgtcaagatccccgagatgcacctctcctgcatgaggaacctcaagtgcaagcgtgcctaagtttcgctgcttgcttcatttttgtatgttttctctgctttctcgcgatgtgctggtcgtgttgacgtaactatgtgtggtttgttttgtttgggtcggcggtagctgtggtactctttgaatgctcttcatccgctccatcttaggacaaaggtggcatggtttctatcatgtgagttgctcttggtgatgaatctgtgctagattgttatgggtcagtttgtcgttcacagtatcttcttcaaaatatgtctttttttgtatggattgtgtgcgcagttaactgatctgtactatgagtgtccgatctgtgatttaaatcacgcatgtaactgatatgtactatgagtgtcattctgtatgcttatgagtatcattccaaaaaaaaaaaaaaaaaaaaaaaaaaaaactcgagactagttc

SEQ ID NO: 24138 - DNA, 656 bp, Triticum aestivum
  unsure (1)..(656): unsure at all n locations
  Clone ID: PAT_TA_24138
ctcgagttttttttttttttttttaagagtcaaaacagacggccgcagcaacacgcgccatcaaggatctattatttatgcagattaaccaacatacaaatgtttctttatccctatgtagctatatccgtcggaatattcgcatagttgccctagtatcagagattattgaagggatacaaaaaaaaagatacaaaagttgtgtggtgtggctagctgctagtgtgttttctggtagctattttccggcagatgtatgtaaggccatgggccgcgcccggagcacaccgtgggccctgtcttcctcgatcaacatagggcatgtgcgtcccaaacaccctgtcccatgtcacgaagaagggctgcgagaagttgtatccactaagtgcgcagctgatggtgggacatcgtggtacgccgtgttgttccagaagcaccggtgggacatttcccggcagccacatgccgcagtggtctcgacggcctgacggtgcaaacctnaagaanaagtganacccccggggaatgccgaggcaaggaaccaacgcgccccaatgggtcaaggangagccccatgggtggtttaaggcnccaagggttggacacagggggtctccacatggacttccgtnaagacttttnggcatcacggtcaa

SEQ ID NO: 24139 - DNA, 609 bp, Triticum aestivum
  unsure (1)..(609): unsure at all n locations
  Clone ID: PAT_TA_24139
cccctcgccgccgccccctcccccccgccgccgccgccactccgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtccgtcaccgatgtcatccacgacccgggcgtttgtgcgcccgcttggcnaaggtgacttcccgcaacccgttcaggtacaagcacaagaaggantcttccttccccgccnagggttnttnnaacgggcantttgtcnaatggggggacccgaacaacntccccgttngnaatttctccgntcgntccgtcccttanggaagggtcatntgaaanttaaaaaaatttggaactggtttttncnaaggcccgggnanaccatntattancaaaacccaaaaggactaagttaaccccctgggcaaaaaatttccaaaaattccttcaaaatggcagttcgggtggaagactaaaacaatccaagggggaacctacaaattnctntaaagaacctgccagggcntggttganacccttgg

SEQ ID NO: 24140 - DNA, 1760 bp, Triticum aestivum
  Clone ID: PAT_TA_24140
gggcggcccgtcgcttccccgccccatgccgctcgggggcggggccccaccgggcgcggccgccgctgcccccgccctgggacgctcgcctctcacatgcggagaccgcccatcctgatgagcttgatgaagagtttgacactttcccctacatctcgtccacccgatcatcgtgaggatgcggtatgaccgcctccggagtgtcgctgggaggatccagactggttgtggaagcataacattggggtccttgagctgggtatcttgactgcgcagggcctgttgcctatgaagacgaaggatggacgcggcacgactgacccttattgtgttgctaagtatgggcagaaatgggtgcgtacaaggactatcattgatagtttcactcccaagtggaatgaacagtacacttgggaagtgcatgatccatgcactgtgatcactattggtgtatttgacaactgccacttgaatggcggggaaaaggctaatggtgcacgggataccagaattggcaaggtccgcatccgcctctcaacgctagaaactgatcgggtgtatacccactcataccctcttattgttttgacacctgctggcgttaagaaaatgggtgaggtacagcttgctgtccggttcacatgctcatcactgttcaacatgatgactctgtattcacagcccttgctgcccaagatgcactatatacacccgttgtctgtttgatccaggttgataacctaagacgccaagcaaccaacattgtctcaaccaggctgagccgtgcagaaccgccactgcgaaaagaaattgtggagtacatgctggatgtggattctcacatgtggagcatgagaaagagcaaggcaaacttcttccgtatcatgggtgtcttgagccctctgattgcagttgctagatggtttgatcagatctgtcactggaggaacccactgacgactatactgatccatgtcctctttgtgatactggtcttgtatcctgagctgatactgcctacaatctttctctacctattcctgattggagtgtggtactaccggtggcggtcgaggcagcctccgcacatggacactcgcctctcacatgcggagaccgcccatcctgacgagcttgatgaagagtttgacaccttccctacatctcgcccacctgacatcgtcaggatgcggtatgaccgcctccggagcgttgctgggaggatccagactgttgttggtgatcttgcaacacaaggagaaagactgcagtctctgctgagctggagagacccgagggccaccgcgctgtttgtgaccttctgcttcatcgcggcaatcgtcctgtacgtcacaccattccgcgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctcgctccgcggtccggcgccttccttgtttcggtggctcgatgctgagcatgttctatagctgcaactgagatgaagctggggtcgaagcgcggttgccaaaaaattgaactgaactatgtcgttgtttgtagtcttttcagttacctgtgtctgttttgggacggttttgaacctttcttgttaacgactgaaatgcttgatgtgtgactagttattatgcatgtatgccgcctgaagaaattgtgccatcacctgagcta

SEQ ID NO: 24141 - DNA, 739 bp, Triticum aestivum
  unsure (1)..(739): unsure at all n locations
  Clone ID: PAT_TA_24141
cttaatagcaaaaggctacatataccagcccacgaaggtagagacagaaatttacaccgcatatcgctaaatttattggagattggtaggcagaacagttgtaacatatctccagatactactatgctcatatggccttcaattgaaaaattacagaaaccagatgagcagtagaacatctaagaaaaaaaataagaatcactaaagggagaatggaaacgagatttctccaacaaataattgccatcccatgacaaaatctaggaaccaaacaaaaagattacactctatgtaccccccctatgcaacctcctttggaaaaaactaaaggagaccaaccaagccccaacaaatttgtgacgatgcgtcctgcaaacgtaccatacatcacaagcaaccatatgtgcatcatgaaatggctttgggtgctctagatgggggcctgcttatctctggtgttgaggaggattgtgattcttcatatctttgaatctcctgcgataatactgctgctgaagcggattttcgagattgcagttgattcctcaaatgggttccgtgctgctgctgcatgctccaaatgctggagacaagatgaaaatcaattgcgtatagttggcgcacctgattcnatgcatctcgtcacttgtaaatcganatatgattgcaaaanagtcgctnagattnacnaaggattctnatcatcccaagtttnaagcgacttttagnaaacanagga

SEQ ID NO: 24142 - DNA, 714 bp, Triticum aestivum
  unsure (1)..(714): unsure at all n locations
  Clone ID: PAT_TA_24142
gccagacacgtgagcacgctctccttgctttcactcttggagtgaagcagatgatctgctgctgcaacaagatggacgccaccactcccaagtactcaaaggcgcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaaagaacgttgccgtgaaggatttnaaccntggtttgttgcatcaatccaaggataacctgcaaggaggancaaattaactccaagtaacatcataacacctgncaaattggaanggtancccatgtngntgcanacnccaaatgcgtaaattnctaacgggcaaanttaggatttgtagggaaaagccccaattccaaaangng

SEQ ID NO: 24143 - DNA, 914 bp, Triticum aestivum
  unsure (1)..(914): unsure at all n locations
  Clone ID: PAT_TA_24143
gntgctgcaaatactgagcgaccttctctcgtggtcaacaacttatttataggtggggctctcgctgcaaggtctaagtacaccctccagcatttgggcattacccatatactatgtttgtgttcgaatgagattggtcaatccgatacccaatttcctgatctttttcagtacaagaacttttcaattagtgtccgtgatgatgcaaacatcagcgatctttttgaagaagcatcagattttattgaccaggtcgaccgtgttgggggtaaggtcctcatccattgctttgaagggaaaagccggagcgccacggtcgtccttgcctacttgatgctcagaaagggcttcacgcttgcgaaggcctggaacttactaaagaaagtacaccgccgcgcgcaaccgaacgacggcttcgccaaggcactgctagctctggacaagaaactgcacggcaaggcgtcgatggactggcagcagaagcggcctgagatgaaggtgtgcccgatatgcggcaagaacgtggggctgagcaccagctcgctgaagctgcacctgcagaaggcgcacaggcggctgtcgcagggcagtgtggacagcgccatgaccatggagatccagaagtcgatcgagtcgctccggatcagccgcggcgggagcctcagcccttcccagaagctggccaaggcgttcgccgacgagctcaccttctgatctgttgttcttttgttgtatgtacacaggttggcacacttgtactgtagtgaatacatgccccaagaggaacccaacttttagggtacagggagtgagactcaggtgtaatatcaaacaagaaaatgttcaggtttcaagtgcaagcacacaaatgttcgggattcggctcaaagcctacaaacaaatacagaatacag

SEQ ID NO: 24144 - DNA, 788 bp, Triticum aestivum
  Clone ID: PAT_TA_24144
ggtcaacattcaagtcgctcaggctgcaaaaggcgcaggtgtgcctgttatcttggatgcaggtgggatggatgctcctgtccccagagaactactcgaactggtggacatttttagtccaaatgaaacagagctagcacgtttgactgggatgcctaccgagacttttgaacaaatcagccaggctgcaggagcatgccataaaatgggtgtgaaagaagttttgggttaaacttgggatcacaaggatctgctctctttgtcccagggaaggagggagccaattaggcaggcgataatacccgccacagaagtagtagacaccaccggtgctggctgacaccttcacctcagcttttgctgtagctttggtggaggggaagccaaagaaagagtgcatgagatttgctgctgccgccgcctcactgtgtgttcgagtgaagggagccattcccagcatgcctgacagggaaaccgtgatgagccttctagaatctgtgcaagctgaataaccggagaaacggtgactttagccctattcatcagcaataatgtgagctgttaagcttcaatctcctttttcggttcattttatttcgggtatatatatatttgtagccccgtgtcaagttatggtagaggaaataagagaaaatggcattcctcgcgccgtcctccgtagaaacagaaacgctggttcaggagttcgaggtctgttgtttttatagccattccctgttatgccatagctttttctattgttaggcatcgcctgttatccttctcca

SEQ ID NO: 24145 - DNA, 881 bp, Triticum aestivum
  Clone ID: PAT_TA_24145
ttcggcacgaggcagaagcaaagcgtttcaaggcaaataaatccagtgatgataatggtagtgtcagaaaagatgctgaagctgattcaagaaatgctagtaaggctgttgaccaaaatcccccgccaccaaagcaagatttcatccatgtgagggcaagaaggggtcaagcaactgacagccatagccttgcagaaagggcacggcgtgagaaaataaccgagcggatgaaaattctccaagatcttgtccctggatgtaataaggttattgggaaagcatcagtccttgatgagataatcaattatgtccaagctttggaacgccaaattgagttcctgtccatgaagctcgaggcggttaacgcccatgcccatgctcacaacggagttgaaacatttccaactaaagacttcgctgcgccggcatacaacacagctccagggttaacatttgacccgcaaacaccaagggagtacgcccagggctcgccggctgcagaatggcttcacatgcagattggtggcacctacgaaagagtgacgtgagcagaacaaaagtccagggtggcgcccaacaaagcgtgccatgaatcctcggccaagcaacccccactttcataccgtagatcatttttttttgcgccaccatctcgttccaaatgcggttttattcatagtttttggagctgttattgccggtagagacgtcagacatgtatttagagagaaccgccgagcacggtgcctttttgttttgaccttcggattcaggactgttcctcatgttttcgcaaccttcatgtattccagggatttctgtagctggtaatcattcttaagatgaaaggaagcgactttttttttaaaaaaaaaaaaaaa

SEQ ID NO: 24146 - DNA, 700 bp, Triticum aestivum
  unsure (1)..(700): unsure at all n locations
  Clone ID: PAT_TA_24146
tntgttccttcagaaatgtcgacttggtacataaataattacggcctgttgttgccttgcctctttctagaagagttgacatatgcattatcatgcgaattaagaaaatcgttactgcagggaacaagctaagaaagatgtactgccggaagtgctcatttggcctccggggtagctatgccagacaaagtttcagaataacaagtgaatcatatccggacgacgtaggctcggagcctctcggagcagacgaagcagtgcgggaagtagaaggccaccacgaaccccacgacgaatccgacggccgctccgatgctcgactggtcgttgatcctgtgcagcctgattcgtatcggtctccatctcctccgaggggtggagcactcatctaaaggtgaaccacaaagcccttggttaccagcaaagtttgaagacgaaaacttctgtagcaaagtaggaacaggccctgataacaagttgcccgcaacattgaacgtagttaaccgagtaaccaaacggattcccgggggtatccctccgcggtgttccggaggctggaggctgaggtgcttctggtatgtccggggggtgcccctctgcgggatcagccccggaatgctgttcggcgcacgttcctccgaggtcggctggtgccgtttccggcacccgtaggtaaaatcgtacaaagaattgcttaatn

SEQ ID NO: 24147 - DNA, 624 bp, Triticum aestivum
  unsure (1)..(624): unsure at all n locations
  Clone ID: PAT_TA_24147
atggaaggttgcctctacatatgcagtgtaacttacaattaaagcatctcttccagcagccgcctgccgccttgccgccatcccaccagggggacaaccccggactttcccttcgtgtgctgccccaggcaggcggctactaccttggagcaatcagggcgaggcgataccgcgagaaggtaatgttgtgatttatgaactctgggcaatcacgttagcaatgggtgccagggcgatgaaactagctgacgagctagcatcaagtcagtttcaagcacgccccacaagtcggttcccaccttcagagcccaccttcgtcatcctcttcctccagcgatcggcacttggacatcaccttcctccaatagttgcaagtgccccagtttcctccgttgactctcctcgaccgttatcggccccgtcgcgccatcactccacctccatagtgcacacggactccccgggtcccatcttcaaccttctgcgagctgcgagccctcggcctcangacaactaaacatcggaaggaaagntagataccatacagtgcaactcaactatcccntgtgaaaaagcaactgtgattncnccctccagnccaggaggccncanttgnttaatacc

SEQ ID NO: 24148 - DNA, 845 bp, Triticum aestivum
  Clone ID: PAT_TA_24148
ccaacgccttctcactgttcctcccctgagcgcaccccgcggctaaccctagggaccgagtcgggcttgccggcacggccgcgtcgtgtgctgttggcaccccactccacctgctatgttgcgccccggtctccaacagccattccgaggaacccatctcgccgccaccatcgtctgctatcctccaataagtgtgttgcggtacgccgatgtcctcccatcggcaagctccgcccctgctggcatcgtccactcacaccatgtcctcctctttgccaagcagcgttaagtggtgattatgcagaagtccaagaccacactgtaggcaggaaaaaggaatgttcttggttgctcgcgggtgacttctcaggtgtcacggcgcttgcattgtagattagtagagggaatattgagacgacgaggagagcgacttaactgcagtccgcacaacaccatgaaccaggttcttgaagtccgccctctcattgattggaacagggtgaaagttgtggaatttttgctgtgaccgcctggactaagatgacagggctgacaaagatgaaggcaagaaggttataggggtggcccagatatcatggacaggcgccgtgctcggcccagtgaggagctccgggtcaacattgtggctgcgtggtgggcatgaaccatggcgactgccttccggctttattctcttggctcgtatatttgccgctagctattcttacagaatcatgaattagacttaggagaattggcatgtcatcacatgaatttttttaaactatgaggtgcaacaggtaaacatggtgaattcacacttttaaactgcctggtgattttct

SEQ ID NO: 24149 - DNA, 646 bp, Triticum aestivum
  unsure (1)..(646): unsure at all n locations
  Clone ID: PAT_TA_24149
ctgacccacaagtcatttcctcgttcttctgtctgacccgggtgcctatctttcagagaaaaggaagcggctctggcaaaaaatgacctcgatcttgctgctgcactaaaggaggctcagaaaagactgcacttgctgacaagaaactagcctcagtcagggcgctggaggaagaaatcgccaagctgaaggcatctcttaatgaatccaaccgagaagcgacccatttngaagaaaaaataaagtggccctaaatgagaagattgaagttattctccgtaagagaaatgattctgggaaacttatctggggggcactccccaagaagctattcctcatgctccgagggtatcttcctttgtccgacggttaaccttcgtccgttcactaagcaactgtcgatcattaccctttgcgcttggtanattctgccaaactttttaagaanaatccgtggtttaaacaggctgggaccaacctttcccctatggngatgaggcacataacttatcaacgggaccatgttctggtgtacggcactgccacnaaggtgcgttccggtcatcaccttggccaaaaaccaaatactnanctgtaccancanaatccgcatgagatgnatnggcccgcggcataccgtcatnac

SEQ ID NO: 24150 - DNA, 633 bp, Triticum aestivum
  unsure (1)..(633): unsure at all n locations
  Clone ID: PAT_TA_24150
ggacgcgtgggcgacaccatagagtgattgcgcgagccttgctgaaaaactatgtgcctcctggttgcccaatgcacatgtttatatgcccttaaccattgttttgccagatatttctagaaacagccggtggcgtgtgtgctattgacgcgacatgtgtcaacctgaagagtgggttgtggtggcaagtgtctttgcgcatgtccaaacataaaaggggcatggcttgcgagctagcttctcggctagcttgggagagactttcaaataagaagaacgggaagaacactgccgtgcctggtgtaggatggcggcatcagagagcgatgtgtatggttctgttttgacaggacacatgactcaaaagtccttgaaggcatgcacaacggccgtgaggtcattgaagaaggtgttgcttctgcggcgagtgtgaaccagttctcagctacgcattcggccggcagtgcagaatcagagctgtcgagtgaatcctttgagcggaggtcgcccatccagatggttttcaggtcattgaagaaggtgttgcttctgcggcgagtgtgaaccagttctcagctacgcattcgnncggcagtgcagaatcagagctgtcgagtgaatccttnnnnnnnn

SEQ ID NO: 24151 - DNA, 919 bp, Triticum aestivum
  Clone ID: PAT_TA_24151
gtgagacccaaccacgacgagggaggagaagggaaggatctcgttgcagctctggccatggcgaaccagggatccaagaagattgtggagaggaacagggaagcgcatggaatctcctctggcgcataatcctcgtgtccaacgttatttacatagtagtgaggatggctgtaatgtactcttctttcacctggaaagcattggattggccgcgtggtcacctgcgctgtatactttctcttacacacgcaactcgctagtatgacaaagcccgaatattctgacgcggacaatcgtgaacttctgagttcgggttatgacttggccaccggtgggctttcagaatatatagaggatgtgatatacatcacagcatttgtgcagcttacgtccattatttctggaaaattttggtggacatatctggtgataccagctttcggtggctacaagatcttttttctgttgaagggaacattcttcggtggtggttcagagggtgaagtcgaagatgagaagtctcgaaagaagagggagaaaatggagaaaaaggcatctagagggaagatggtcaaaaccaggacccgttgatatgacacatacataccctgtggaagagtaggttggtttctcatatcatagctgtccaagtagagtgcaagctgttggtgagtttgctaacatggatgatatgattcatgtatcatttgatccgacagctagcacaaatgtcaactaatcttaaagttatgatgaataccagcattggtatttgtatatttcctgacccttctggttatgtaaaccaacaatgaggcatggtaacccagacatcttagtgacaaatttaaaaatattttttttcagtatcccgtcattgcggcgcgtccccggtctccttggtacgcacttcatatgt

SEQ ID NO: 24152 - DNA, 521 bp, Triticum aestivum
  unsure (1)..(521): unsure at all n locations
  Clone ID: PAT_TA_24152
ttttttttcattgcaacgatctttctgggctcgtttaaccatcattttcttacacgggtgcaatgcaagctcgagtcatggcgcgaaaaggcgcagccctcgcagacgcgcattgatgcgttatatgcacacatatactacctctatgtacactattcatggttctgtacacacgcttaggtgatcagatcagatctctaggaagcaggcggcctgcacgtgcccggagaactccggcggcgccggggcgcgcgcccaggacgcggccttgccgttgccggcctcgtcgcgcagcatgtacacggtctggtcgcctccgtggcagcctgagccgatcaccacgacgcggccgccggggatggcggagacggtcgacgccgtgcgggcgtcccccggcacggacgccaccgtgcgccaccccgccgaggcgccgccgtcgcgcgccacgnnnttcccttcgcggagcatgtacatgcactcggctccgggcgccacgcagcaggttctcgggcacgcgccgt

SEQ ID NO: 24153 - DNA, 1151 bp, Triticum aestivum
  Clone ID: PAT_TA_24153
gcgccgccccgcccccgcgcgtcggcctcctggggcccctcgcgggccctctgtcctcctccgccgccacctcctccccttcgcatcttcccttgccgccgctggaggcagacgccggcaagcccacgcggtcgtcgatgagggcggcggcgaggtcttcggccacgattctttctcgggaacgggcctagggttccaggcggcgacctggtggtgtgggcggcgccgtcccggcggcgttggctggagctatggccgcctcccctcggctgcatgggtggcgagtcggtggtggacctgtgtgtcgggcggcaggacccctgtgacctgcttcgccagatctaaagattgcgcccgttcgcttgcatcagcgtcttcctcgtctggtccggccggatccggacggatccggctgttggctgcgtggatttggtgtggggaggtctgaatcgggggtaaccccttggccggcggcggcggccacctcgtcggtggcgcttcgggcgatgttccccttcttgaaggcaacattgaggttcacctccccctcctcctccttcccctgcacccgggtgaaagcccaaatggcggcgccatgatggtgccgttaccttcttgaaggtgccgttttgggtctgtggggaggcgggtcggttgctgcgtgctcaggtgctcttggtggcggcagctacttcttcaagcggtaacacttcaccatggatgaccggtccgctcctccggccaccgtgctctcctccgtgtggtcctgtcagtccggcggatcgacgccctcggcctgggcaagaggggatagtggtcccctctacgtcgattaggatgtgatggtaggtgagatggtggccatggcgtgctctgtttcctcctggtggctttggtgttccaatcatggccgtgtcttcttgggatcccctgttctatagctagcgtgtgtggcatgcttcaattgtgggcagcagcttctcaagctgtagtctttttcttcattggtcgtagcgtttttgctttctttcagctccttgtatcagccgttgcggggttgcatccctgctttattttatgtcctggttgtatggtttgtatcgatgtatcttggctggttgatggctttgttaatttaaagttgggttatg

SEQ ID NO: 24154 - DNA, 807 bp, Triticum aestivum
  Clone ID: PAT_TA_24154
cttctcttttcccattgttcccttctcactttcctcatcttcattcgcaacgcaactgctgtgtccacgggagacgctggagacgatgcacggccgggtcctgctgcgaagcttccgtcgtccgggcactccgatgttgccggagaaggcactctcgtgctcgcctatgcaagctgcgggttttgcaaggcaggggctcactgctgctagccagcacgagctgctcgaagggctgggacaacactggtgacacagtgtgtcacaactcacaaaagccccggccttttttttgtaaggtgaccagaaacattggttgctacagcttgaggagtgtagctggtgctccaagccgactacgtgcggctctccggagttactcacgcgacgcgggaaggaagtcgccaaggaacgatccccgccgccttggagctcgccccgccttcggcccaccacctctccgtcggcctcgacctcctccgcctcgatccgtccgccccgccgccggatccacgccggagcagccgcgtccgccgcccagaccaccagtcaagagtcacctcttgcctgtcctgtggtcgggaggaggacgaccgagaggagcacccattcatccgccgcattggccgccttggagctcgccttgccttcggatcgccacctctccgtcggcctcgtgctcctccgcctcgatccatccgccccatcgccggatccaccgcccagaccaccaaccaagtgccgcctctggcttgtcctgcgacctggtcgaataataaaactgcagggtcctttttgtaagaacgaatc

SEQ ID NO: 24155 - DNA, 648 bp, Triticum aestivum
  unsure (1)..(648): unsure at all n locations
  Clone ID: PAT_TA_24155
nnggaccttgccgtgatggcgttatttataaagtcgggctcctacctttactctaaaaaatggaacacggtggctcaacatgtttatctatacatagcaacacgcatgtgttcaatgagtcaataaaaacaccctttaccaggaaaacatgttttcatcgcgtgcgccccccccggctggtgcgagggcccctgttaaccctcctcagagagccgacccctttaattgtcaacccaagaacatgttaattgtgctaagttgacgcgatgcccaagttgtcgctagccttctgggcgtagaacgccggcctagatggggcagagagaggcacggtatcgcttccgagcatcatgaccacagacgacataagcggtcgatcagccgggttttcttgaacacacagaagccctatatggatgcccccggccgcgcccccccctgagaagctagcgttcatgctcggatccatcatgtccaacaccgttcttgccctccgccgcgcccacgccgcattcagaanatcttgagattccttanaattactgtagtcaattgttcttcttcccgttanatctcaagancatganccgaangctgaatgatcangatttacanantagttccacgctnacgtactctggngccata

SEQ ID NO: 24156 - DNA, 829 bp, Triticum aestivum
  Clone ID: PAT_TA_24156
tcagaagattacctccagtggaacaagattgtactgcacatgtttcaaaggaagaacatgcccaagaacagcattccttggaccaggaagacaaggcacaaagcaacacccttgacctggtcgtgcatcccgagaatcaacccttactggatgcaaaccaactaggaaaggaagcgttgtctggcaatgtcctgccccctgttgacgtgggagctctagtttctgcaaatatcggcccagctgatcatggacagccctgctcaaatccagaagccccgccacctaaactctgtggttttgttgtctcacggacaccaaggtccgcgcaactcatccaggagatgcagaaggaaggtgcattactgtttgctgtgcagcaggtgatgacagaacctggctcagtggtataggatcagaacatgtccgtggcaaccatgctgtggtttcagagcatacttgtggtttcagaggaccatacctggagctgttgcctcttaaggcgcggcgcgctgcggtggtcactcttggggcagaaacaggctagcagtagacctgagagctctttagcttcagtgccggctcattgtgcctcgcaccttctatgtccgcctctgtgcttgtctgctatggctagcccctgtcatgttcaggactggactgtggcggtgtttcgctctctgtatgttgtattaagagccgacttagctgagcttacttttctgttgtgcaagttgtacaagttttgagccaattttgccgattgtactgtaaaagcatctcctctgtttatataatggcatgcaaattatcatcagttcatcccgtcatt

SEQ ID NO: 24157 - DNA, 312 bp, Triticum aestivum
  Clone ID: PAT_TA_24157
ggagttatattgttgtatgtatcaccgatcttgtttggacgacaatctttttatattctcttactgccggaggataagcgcagaagataccacaagagcagcggggtatttgggtgcataccaccaattgatctgtgcaaacaacatccgcgttaggttcaggtatattcacaagtggggatacttatttatagttgatgttcaccgatgtacatacaccactgatatgttgatatgtcctgttggttgggcacctgacagtatgatcagggttatttaaaaaaaaaaaaaaaaagactagttctagatcgc

SEQ ID NO: 24158 - DNA, 653 bp, Triticum aestivum
  unsure (1)..(653): unsure at all n locations
  Clone ID: PAT_TA_24158
ctcgtgccgaattcggnaccgccccgggcggacaagagaggaaaccaacacagcacattggcgccctccacgcatcgtcgctaagacggatccatcatccatggacgccctcacgctcacctccctcctcaaggccgccgccgccgccttccccgaccgccgcgccatcgccgtccacgccaagatcgacctcacgcacgccgcgctcgacgccctcgtcgacgccgccgccgcgcgcctcgccgccggccccgacggcctccgccccggccagaccgtcgcgctctgcttccccaacaccgtcgagctggtggtggtgttcctgggcggtgatccgcgcgcggggcgtggcgggcgccgctcaacccggcctacacgcaaggacgattcgagttctacctctccgactccgggcgcgcgcctgctcgtcaacggggccgcagggaacgcgcccgcgcaagccgccgcgccaagctcggctcccccaggccgtccgccacgctcacgacgccgccgggccgctcggatnacggctcgtcgaaggaacccgcgcgcagaccacggacctcatataaagaggagacgagcgtcgacttgcctgtttnaaactcggacaacagcggcaagggngcgtaanangaacngggctcgta

SEQ ID NO: 24159 - DNA, 620 bp, Triticum aestivum
  unsure (1)..(620): unsure at all n locations
  Clone ID: PAT_TA_24159
tcgaggacggcgtcgatggcgtcgctgatggcgccgatggccggcgccttcttcctgctgatggacccgagggacatgctgctgtacacgagcacggcggtgatcgggacgtgcacgggcgccatcacctcggtggcggtgtcggcgacgagcgagctgttcggcaccaagaacttcggggtgaaccacaacgtgctggtggccaacatccccgtcggctcgctctgcttcggctacctcgccgggttcctctaccagcgggaggcgcgcggggccaaccgctgcgtcggccccgcctgctaccgggacaccttcctcctctggggcctcacatccgccgtcgggaacggcgctctgcgccgccctctacgcgcgctcccggcaagaagagcggcgcttacaaangaccggattttctggtacgcagggtgttactctaagcgcacatgattcaagtgaataaaanaagattccgtactagggatttaatctccttggtctcccctcttttccancaaggaaatctttgttgttggtaattctgacaaactcctgtaaggtntcaaacncaccagtnaanacacagncacacatntttaaactgntctaaaaaaaaaaaa

SEQ ID NO: 24160 - DNA, 984 bp, Triticum aestivum
  unsure (1)..(984): unsure at all n locations
  Clone ID: PAT_TA_24160
cctccgcgtcaccggcgtgcgtgcgtcctcagtttgctccagttcagttgagttcaacagtttgcttctcgctttccctcccgtgatggacacgtcggcgtcccctggccccagctcgtccgcgccggagcctcggcaatgggccggcggtcgccccgggctggggtccgcggcgcttgagctggcctgcaaggtgctctgcgtcgtggcgacgtgcgccttcgccgcggtggggtcgctggtcggggcggtgtcggggtcggtgatcgggctggcgacggagagcggggtggtgcggggcgccggcatcggcgccatctccggcgccgtcttctccatcgaggtcgccgagtcgtcgcgggacctctggcacaccagcgactcctccgtctggagcgtcctcttcatggtggacatcatcctcagcctgctgagcgggaggctggtccgcgagaaggtggggccggcggtgcagagcgccgtgcagagtcagataagcgccatcagctcgccgttcacggagcccagtgacctgttcgagaccggcggcgcgagagggctgccggcgcacgcgctccggcggctgccggcgatcaaggtcggcgcggacaccgcggtggacgaggccggggaggcgctctgctgctcggtgtgcctgcaggacctttaggtgggccagtcggcgaggcggctgcccggctgccggcacgtcttccacgcgccctgcatcgaccgctggctcgtcaggcacgcctcctgcccgctctgccgacgagacatctgcgcccggccgggcaccgtaggccggccgatcccctgcttgtaactaanttaaatcgtcattgttcgccgtgcgtcaggtgccnntaagggggaccggtggcaaaagaagccactntgtnaccatgccttaatgaattggaaacgtgaattgtgganaanaaaaaaaattttcggggttatntgggttccaaaaaaaaaaaa

SEQ ID NO: 24161 - DNA, 973 bp, Triticum aestivum
  unsure (1)..(973): unsure at all n locations
  Clone ID: PAT_TA_24161
aacacgtagagatccggcgtggcgcgtgcgtgcgtctccatctctgcccctcagctcgggccgacaaaaaggcaacgcggagtgggaggagcaggagagctcgagggaagaagaagaagaggaggaggaagaaggccccctcaaaccctccgccctccccccgccgcccgcggccggagggagggcttcaattgcgacggcaattcacaacaaatccagcataagccaatgtctgacaacagcattcagcgagcattgctacctgagaaccccgatgccaatgtgctccaaagaaagccgtcgcaaggagccaagcggttccggagatgcaggtcggctcccagatcagagaccgatgaaaaaccacaagaaaatggctcgtcgcttccagccaaggagttgttcagcgtggtgcggccgagcttcagactagtagggttcctcctatttctctacctgctagcgggcgtcgtcgtcttttatcttgtcatggatcagttatctggcaagagaaccaacagagtgcttgacgcactgtacttctgcattgtcacgatgacatcggttggctatggagaccttgttcctaacacagacacgacgaagctgctcgcctgtgttttcgtcttcacgggcatggcgatcattgctctcttcgtgagcaagtcagcagactatctcgtcgagaagcaggaggtgttgttcttcaaggcactgcacatgaatatgaagtgtggcgaggccaaaatgctcaggcaaattgagacaaacaagacaaagtacaaattctacacagccgctctgctcttgtgacggcattgttgtgggactgttttccctgaggtgagaagctgaccttgttgaccctttatgtgcgtgcaaacacaacctggtaggggataaagctccgtccaattgggncacttccgggttggaaatncagcacataatcgggcgtctatgtctcctgaat

SEQ ID NO: 24162 - DNA, 830 bp, Triticum aestivum
  unsure (1)..(830): unsure at all n locations
  Clone ID: PAT_TA_24162
nggggccattgaatcccaaatccttgagtgccaccaaacccccaaagtggagaagtcccttgntgtccccatcccaggaagttttggttccanaagggccccanctccnaaaatatggtccaanaattttgggncaaccccaaaaggtggtttcccaaaaagcccccaaaaggggttgtccctaatagggaacatttccggtttttatctcagaaaattccaaaaagtttccagaatgattctggcatcctccaagaattattaggcatgtgccgaaaccaatttgacttaatggtgtatcccgaaacaacttttcggtatcatcgaaacttatccgatgacctctctctgcggtacgattccgctgtccgaaacttttcggtgtccgaaactttttcggtgattttctctcagactccctgtctagtattcagcagatagatgacccttaagcgtgtgaccctataggttcggtgaagtatagacatcacccggaaccccttccgatcaatgatcaacatcggagccgtggacacccatattgacccctatacccacacgaatgaatattcgagtgaacctccagttgccgtgtgctattcctgttgcttcgcgatagttcacaaacacccgaggtgagattgttggcatccccgtgggccaacaccttgtccactatgctagttacctcgttaccggttttgttctcttttctcgtttcgtgtcccggcccccccgtgatcacaatcgcctggcgtccgggccggcccgtgctcgaccccccgacaccgccaactcggagacaatccaatccangggggccgnacatt

SEQ ID NO: 24163 - DNA, 1725 bp, Triticum aestivum
  Clone ID: PAT_TA_24163
gcagaaattgctccacaaaacatgagaggagctcttggttcggtcaatcagctctctgttacaatcggtatactgcttgcctacacattaggcatgtttgttccctggagaattctttctgttcttggcattttaccttgctcaatcctgatacctgggctgttcttcattcctgaatcaccaaggtggctggcaaaaatgggaaagatggaagattttgaatcttcgctgcaggtcctgcgcggatttgaaactgatatctcagcagaagtaaatgaaataaagagatcagttgcctcatctaggaggaggacaaccatacgatttgcagagatcaaacacaagagatatagtgttcctcttatgataggaattggtctccttatacttcagcaactaagtggtgtcaacggcattttcttctatgctgcaagtatcttcaaagctgctggtcttaaaaatagtaatctagcaacatgtggtttgggggctgttcaggtggttgctactggaataacaacctggttgactgacaaagctggtcgacggctacttctcattatctctgctacagggatgacaatcagtcttctcgttgtttctgtgtcattttttgtgaaggacaacatagaggaagcttctcatttacactttgtgatgagtatgctttcactggctggacttgtggcatttgtgcttgcattttcccttggcatgggagccatcccatggattataatgtctgagattcttcctgttaacatcaagagtcttgccggaagcaccgccacccttgcaaactggatgacgtcgtggctcatcacgatgaccgcgagcttgatgctaaactggagcaacggaggaacctttgctatatacgcggcagtgtccatgggcaccctcctcttcgtgtgcctgtgcgtgccggagaccaaggggagaacgctcgaggagattgcgttctcgttccgctgaagcccggaaccacggcgcgtagggtagacaggcaggcgggcgcgcgtcgtgctacttgatggctgtttcgggtcaggcctcgggcctggaccaggtagtcgcgcagctgtgttttttgcaggagggatatttgtatcatgtgtttgtgtaatagtgtactatcagtgtaccatttgtgtatgtgcaatagaatggggaggggtggaatgggcacccaacccccccttgcagtcagtcagtcggtcggtcaggggagtgtgcagtaagtagaagagcaatttggtggtcagtacattgggtttcatatatacagcagcagctgcggccaaaggaataattcagatgtgttgggtagacaggcaggcaggcgggcgttgtgctacatgatggctgtttcgggtcaggcctcggggcctggatcaggtagtcgcgcagccgtgttttttgcaggagggatatttgtatcatgtgtttgtgtaatagtgtactatcagtgtaccatttgtgtatgcgcaatagaatgggggaggggtggaatgtagcaagggacagacaggtcacccagccccttttgcaggcagtcagtcagtcaggggagtgtgcagtcagtagaagagcaatttggtggtcagtacattgggtttcatatatacagcagcagctgtggccaaaggaataattcagatgtaatgtcaaacaataaattttgagctagtttcagtgtgctgcattattgggtatggctgtagt

SEQ ID NO: 24164 - DNA, 617 bp, Triticum aestivum
  unsure (1)..(617): unsure at all n locations
  Clone ID: PAT_TA_24164
ggcgctaagtcgctaaccctatgcccgagctgctcctaaaaaaaactgctccgctgttcgtcaacgctgcgccgccgccgttctccgtcccggcggcgagcttcggcaactgatctgcttcggcgtaggtgccttccactcccccgtactcttcctccgcagccccccacgaaacttctccacaagttaatgtcttatatgatttcgggtaatgaagcacctggggtactgtgttgtttatcttccacctcgacatgaaggctgggcaactgaggagaggggtcgccatcatgcaaaggcatagcaaactatgtgtctccacatccacctgcatgttcggggtccaagatggggcaaacctcccgaacgatctgttgcaatcactatttctcgcttacgctccattcttgacctctcactttgttccaagctgccgttcttggcgggttcaattaacttacacccacccaaatcaacttagcacttttcccgccccccctcagccaacattctgtcaagttcncaccncaagtacaatggcacgcactnaagnaaaaaatttcatnaacaaacaatcacggcttatccaatgtnaaaattcaacatncttgcggctt

SEQ ID NO: 24165 - DNA, 170 bp, Triticum aestivum
  Clone ID: PAT_TA_24165
attaggattcggtctgtcggaaggtgtaactggtggcggaggtcaggtgcaaaagcatgcaagtttacgtgtgacattacgttgtgctctcgtctcgctatgatgcactgagaatgtgtgtgttgtctcgttctgaatgtcatggtaacgtaatgatcaaaaaaaaaaaa

SEQ ID NO: 24166 - DNA, 691 bp, Triticum aestivum
  Clone ID: PAT_TA_24166
actactacgctccaagccgcaccgctcgcccgcatcctccctcccgtccgccaccgcattaattcgctcccaccgcttcccaacaaacccgccgcccgcccttgaccgccgcaggccgcagccatggcgctcgcagcgacgccacgccagcggtcggcgccggccgtgctggtcgcggcggcgctgctctcgctttcactctcactctcatgcgcgcaggcgcaggcgccgcacgtggcggtgccaccctcggctcccccgaaggcggcggcgccgggcccggccgcggggctgagcgcggcgtgcctcaactcgctgctcaacatgacggactgcctgccgtacgtgcaggccgggagcaaggcgcgggcgccggacaagccgtgctgcccggagctggccggcatggcgggctccaaccccgtctgcctctgcgagctcctctccggggccgccgactccctcggcatcgccgtcgactacgcccgcgcgctcgcgctccccggcgtctgccgcgtcgccaccccgccggctcagcacctgcgcaggtagtaataaaccaactcgagtcatcccgctgcaggttgccgctggatttgctgctctacgagtctctattgacgtggatttgatctgtgtggatattattctcgcagcaatgggatacaatgttcggtcgacgcggccgcga

SEQ ID NO: 24167 - DNA, 352 bp, Triticum aestivum
  unsure (1)..(352): unsure at all n locations
  Clone ID: PAT_TA_24167
gttcgtccggccgagctgcggcgcgcgcggcctgattcctctgtctccgccgggggcggtgatggcgcagcggcaatgggcgtcgctgtcgaaggctaggggtagccgcggggcggctctacggtcgacggcctctggctgcccacgaggggaaggggagatttggaccccggggcgtcgnggggactcgcgccggcagcagcgacgacaaancccggcggcctccccctcctccggcctggcgcaaacaacggcggtcncaactccccttnaacatcctccctttctctctctttccctaacaaagcggcttnatcccggcggctcccgacttcggccctnnaacaacaat

SEQ ID NO: 24168 - DNA, 2065 bp, Triticum aestivum
  Clone ID: PAT_TA_24168
gcggagctaccatggcgtcgtcgccgcagcaaggccaaggccaggcccaaggcggcggcggcggcggcgtctgcccggcggagcagttctggtcgctgctggacaaggcggaccggcggttcgcccgggtgcgggacctgcccctcttcggccgccaggagcccgcggagtacggcaaggccttccgcatctacacccagctttggcgcatgcagcaggagcaccgccaccgcctcctcgacgccggcctccgccgctggcaggtcggcgagatcgccgcccgcatcgcccacctctgctactcccagtaccagcgcgcctccgacaccgccctcctctccgaggccttcgtcttctaccacgccgtcctcgaccgcgcctacttcctcgacgaccacctcggggcctccaccaagcacctgcgcttcctcgccaggttcctcctcgtcgcgcttatcctctcccgccgcgcgcagactgtgccccgcctcgccggccaaatccggtcgctccccgccgtctccaagaagaccctccaggaagctgattacagggagtggaagcatgtcgtgcaagaaatcacgaggtttctaaaggctgactcgcccttcatgaacaagagacctctcaggtacagctatgcattcgatcctcccccggaaactcttccgaccatcccacctacagtcaaaaagcgcggtctgctcttaagcgatgccatcctgtgcagctactatcataacgaggtcaaatttaccgacctcactctagacacattcagaatgcttcagtgtcttgaatgggaaccatgtggctcctttgcacaaaacaatggttacagcgcccatgatgaaagtgggcaaaatcaccccaatctcctgaaagatctgagagacgctgcgttgcccccgaacccactgaaaacagttctctatcgcccctcggtgccacatttcttgaaggtccttgccaccaaatgtgaggagctcccattgaatactatgatgttgatatacctttcggctgcaggcgaggtgggatcctctggacttggtcccgatacaagcgagagggttgtgaacagctttagtcagtttgacatatctaataccagggccatcacttcaaaggaagataaagaaccatgtctttggttaggttgccgtgaaggcgaaggctcaaactgcatatacccttgtgatctgatcccgtttacaaggagacctctctttttggtgattgacagtaacatcagctatgcatttaagtcaattcatggggctgaaaaaggggagacagctgccatgttactttctccaagctcccgatcttgcgctgtaggattcagtggggactctactcggcagagtggtagtcaatttactatgttcctcacagctccattgcaagctttctgctttctgatcggcaataatgggctggacattattgacaaggattataacaaagccgaggagctactatccttgtcattgaatgaatgggccatgactttggttgcttcgtcttcacttgaccctgcctgggttgaagttttaggcgacccactcctgaggcggttgcttctcaggtttatcttctgccgagccacgctttcgctgttcaaagcgagcaacgataaggcggaatgcctgccaagctgcgtgcctccattgccggagtcggttgggggagaaagcatgctgtcgcaatgctgtgtgatgcgagtggcatctttcttgggcgccgctgaccaattctcgttcgccgaggttactacatggcctgacattgatgacccaccagcagtggaggtgccgacaaagagttatgaggagaagatccatcggccgtatcatggacccatttctcctcgtagccgctcttgagatttcttcctcctgaactgctagtaacagttgttgatttgtgacctcccgtggtacaaagcgaaagttatagcattcaccccagtgtgacattagtgaaatttgactagagaataaaacccgagtacttgattgatcttgtaaaatcgaattgtgagagttgcaactgaattttg

SEQ ID NO: 24169 - DNA, 1723 bp, Triticum aestivum
  Clone ID: PAT_TA_24169
cccgagcccagatttcgcagatggcaggaaaaccatctggagttaaatatgctgatgcgagacgaggcaaggcgtccggttcgacgggaaggaacccccctcccaatgctccaactccggccgtcccaggccctatgtccaatgcagcgatcttagatcgctacaaggtacttggggcacagtacgttagacgtactgaggcggccgggggattgacaattctcttggagattgggaaggcaggtcctgatggaaacctgaccttcatgtcacttgctcgggccgaggctaacttggttcacgtccttcttaaaagagggcctgggttaagaagtctcgaccaaacgacgcagggggaaagccggtcccccttccgcctctgtacctaaggtacaggacgtgaaggggaagggtccagccgtgtttaacacctctcgacctttgtctcgacttccctccttcggtcgacctcccaggcccagttaaactgggcctgggaagacggccagccgctaaatggtactgagtctctctccaaaaggacttaccacttgtacctacgtttccgaccattccctggactacttcagccctttaaggatgggctaggtccgggcatttctggcccagaccgggaggacttcagggtccccacgaacccgagaacttgaggcttggccccaggttgctcaagtggatgggaaaatccctgaatccggtccagcagtggttgctgttccccttaaaggggggcacgaaaaccaccggaactgaacaagttgcgaagtagattgtctcgcaaaggagttaatcccagtcggagacttgagaggagaaagcaaccgaaggtagacactttaagtgcctgcacgattgctgcaacttggccaaagcttagctttgacaaatttgcttctcatctcaaggtttccaggaggagtgttcacataaccgacttaaagccggtttgttagattcaaaggactcgcgctaagcgccagcttttgcatctacttaggtgtgaacctcctcgtagactgtggtccctatggtatctccaccagtttgagaaaactgcagggggtatcggaggttctttaagaaaccctaatcggtacctcagggagaattgcgtttaacgtaatctcctgcaaagtgtaacctacttcccctcatttacgcagggaccctggagtttatctccccgtggtttccgaaggagttgtcacatagcccgacttaaagccggtttgttagtttcaaaagctcgcggtaagcgtcagcttttgcatctactaaggtgtgaacctcctcctagactgtggtccctatggttttccaccattcaggaaactgcaggggtatcagggttctttaagaaaccctaatcggtacctcagggagattgcgtttaacgtaatctccgcaagtgtaacgtacaccccctcatttccaagggtcctggagtttaactcccgtagttactaagtaactggatgacggccactgttgtatctcggagacttaacagtcacgaggtatgacctgtagaaatacacggccggtcaccctgaggataatccttcccgtcgaagaccagtgttaaacactgatcttcgggggttagaccctcgtttttttctaaaaaaaaaaaaaaaaaaaaaaaaaaaaaaaaaaaaaaaactcgagactagttctctcctcgtgccgaattcggcacgag

SEQ ID NO: 24170 - DNA, 508 bp, Triticum aestivum
  unsure (1)..(508): unsure at all n locations
  Clone ID: PAT_TA_24170
ttcccaacacctttgtctggtaatacattctgattaacacaaaaatatacagtgcaatagagcaagggaagagttctcttgtccactgtcaggttactgtacaaaataatagtacaaatttgtgtataatgatgtgggcagagtacaggttgtcatccaccgaaataagcccatgcctccacacatgtaaacctacctatgatctaagtatcaaaacttacagggggggcacctgttgaaagcacacatcaaccataacccagcacagtggggcgctagcactaacaatggctgcagcgcacttnggtgcgaactcccgagcaaacaggaagcatgttgtcgattttggattattggtagagacaagtccgtcccgtttgggctcttcccagggattcctccagtgatatctccccctaaccaaacgtggctggatgtgcaccgcccctcgaccatcctacccaggtgacacttccgttagcaaggctttccggcttcaancctnana

SEQ ID NO: 24171 - DNA, 715 bp, Triticum aestivum
  Clone ID: PAT_TA_24171
acagatggaatctgctgtcaggaggtcaacgggtaaaaaccaagatggtagtgaagtgtttgattggtttgagaaatatgttctgcgttcgaaattggatgtaagcattgatcacctagagctgtgctcactgttatcacatggtggtgatgcaagagataaacatatcaccttattgatgaatgctggtctcctgacacgccaactaatagatccaaacatgtactggttttctattccaagtattggtcctatcttgaaaggcctatcccaggggaggaaggaagttctttcattactgggccgtcggaagtacaaggagatgctactatcttcactggagaagacgaggttgaggttatcacctctcgacgtgcggttccacctccgcgatctgattgggtctggtcacgtaaagacggttcaaacacccaccggcttacttgctcgcaggtcaactgatccttggacactcctctggtgctcagctgctgcgtcgcggtgtccagcctcttcagctgggcacgccgctttccgccggggtcggcaaggagttgtcacagcttatttgattggttcccccggctcccgtccagggctacttctaggcggggctcctgatgtgttgtcctggctggtatcgtgttcttgcgcgggacccgacatctgcatttcttgttgtcctgtagagtttccaaaaaaaaaaaaaaaaaaa

SEQ ID NO: 24172 - DNA, 662 bp, Triticum aestivum
  Clone ID: PAT_TA_24172
gccggccgtttcggggatgaccgaatccccgcgtcatcttcgtaaccctctgctcgtcctcctcttcctcgcagcagcagcagcagcagcgtcggcagcccccgccgtccagatcgccatggcggccgagccggagcaggcgcccgcggcgcaggaggcggccgtgcacatcgtctacgtcgaccgccccgaggacgccgaccccgaggagttccacatccgcaccctcgcccccgtcctcggcagcgaggagaaggccaggggcgcggtcctctaccactacaagcacgccgccagcggattctccgcaaagctcaccaccgagcaggtcgaggacctcaagaagcaaccaggtgtccttcaggttgtgccgagccagacctaccagctccatggaaatgagggtggacatgccagcacaacccgcaccatgggccttatgtgaaagccccgggtaggctctgttcttctaatgtgggaatggtcgcatctcatggctgtaacctaagaataagagatgtatccacttgactttgaagggatccagttcctgaagtgtgtaaatgtaatgaattaatgcatgatggcgaacaaatgtgctgatctaatctcgtttggctacaagtttgaattgatgtgatggcaaactgatgtgctcgtcg

SEQ ID NO: 24173 - DNA, 741 bp, Triticum aestivum
  Clone ID: PAT_TA_24173
aaagaacttcgcggcgaagaaaaaggccaagaaacgcggagaggccgaagcagggggacacgtcgcgcacacagccgcacggtcattattaagccacctccaaatctacaccacggcgatgaagaccgaatcaccgcgtcatcttcgtaaccctctgctcgtcctcctcttcctcgcagcagcagcagcagcccccgtcgcccagatcgccatggcggccgagccggagcaggcgccggcggcgcaggaggcggccgtgcacatcgtctacgtggaccgccccgaggacgccgaccccgaggagttccacatccgcaccctcgcccccgtcctcggcagcgaggagaaggccaggggcgcggtcctctaccactacaagcacgccgccagcggattctccgcaaagctcaccaccgagcaggtcgaggacctcaagaagcaaccaggtgtccttcaggttgtgccgagccagaccgtccagctccatggaaatgagggaggacatgccaagacaacccgcaccatgggccttatgtgaaagccctgagtaggctctgttcttctaatgtgggaatggtcgcatctcatggctgtaacctaagaataagagatgtatccacttgactttgaagggatcgagttcctgaagtgtgtaaatgtaatgaactaacgcatacaagtttgaattaatatgatggcaaacaagtgtgctggtctaatctcgtttggctacaagttcgg

SEQ ID NO: 24174 - DNA, 873 bp, Triticum aestivum
  unsure (1)..(873): unsure at all n locations
  Clone ID: PAT_TA_24174
ctcgcgccgaacccggccctctccgtaaccctctgctcgccctcctcttcctcgcagcagcagcagcgtcggcagcccagatcgccatggcggccgagccggcgcagcaggcggccgtccacatcgtgtacgtcggccgccccgcggcagccgcgcccgcccccgctgtccatcctcaccctcccccccgtccacggcagggcggggaagaccgaatcgccgcgtcatcttcgtaaccctctgctcgccctcctcttcctcgcagcagcagcagcagcccccgtcgcccagatcgccatggcggccgagccggagcaggcgcccgcggcgcaggaggcggccgtgcacatcgtgtacgtggaccgccccgaggacgccgaccccgaggagttccacatccgcaccctcgcccccgtcctcggcagcgaggagaaggccaggggcgcggtcctctaccactacaagcacgccgccagcggattctccgcaaagctcaccaccgagcaggtcgaggacctcaagaagcaaccaggtgtccttcaggttgtgccgagccagaccttccagctccatggaaatgagggaggacatgccaagacaacgcgcaccatgggccttatgtgaaagccctgagtaggctctgttcttctaatgtgggaatggtcgcatctcatggctgtaacctaagaataagagatgtatccacttgactttgaagggatcgagttcctgaagtgtgtaaatgtaatgaactaacgcatacaagtttgaattaatatgatggcaaacaagtgtgctggtctaaaataaaaaaaaaaaaaaaaaagccttgcttgggnaccagntttgaataaatgtgatagcaaactgatg

SEQ ID NO: 24175 - DNA, 878 bp, Triticum aestivum
  Clone ID: PAT_TA_24175
gtgagaagaggcgacctcgtctgccgcctcgtgcggacgctcctccggtgccagatcccggcggctcccctcccccgacggccttcatggtcgtcggtgtggacgggggtcgccagatcttgcgcgtggaccatgtatagctgtaggtataggttttgtgttgccgatggttatggcggcgacatcgaataagactccagatctttccttgacgaggtagttcgcatggtcaatggcggatctaggtgtcactgtttcgccgcttgattggcatggcggcggtggcgaccacgtgttggcggttgtgtgccccagacctgcctccgcctgagtggtgctgcctccggcatcatcctttggtctgggcgcttgtatcggagatgtgtggccggcgttgttcgacatgatggcggacacggcggtgtgcgcgagaagatgcgatctcgtgtagggtttgtggcttgtggcggcggatccggcgactctccttcgactccgttggacgaaggaaccgttctggggctgaggtgcatggggatagaccccggtcgaagctccacaacgacaatggccttgcctgttatggcgggcttcttcttcaactcggaaagccgattaggcgatggtgcgtcctcagctcatttgatggtggctacctgcatctctctccgtagcggcggcggcggtggaacgattcaggtatttggcttcgtgtgttcaggaacttccagggacttgactgtattcttgtttcttttgtgggagtcttcttcgcacataggctgggacttctgtcctctctcgtgttatatgtatatttctacgtgtgggtcttgtactcctgtatttgttgctaatgaagcacgtagtaatttctc

SEQ ID NO: 24176 - DNA, 576 bp, Triticum aestivum
  unsure (1)..(576): unsure at all n locations
  Clone ID: PAT_TA_24176
gagatattcatcccatcgcaagcctagctcgtgtacgcataaaccgtccgcttgtccccgacaccccgaatcttcaaaaatgcgcactgccactctactcgcatgcgttggtacctcgctagtctctctcgtgtctacagtacaggccagtgattatcattgtactaatggcgcagtaattccggcatcttacatcgtttctgccttgacgagagctagagaggacgcgaacaactatcaatacggtttcagcccgaatcagccgggtgctttctataaggccacgcctacggcgacatcttacgaacaattgtactgggcgcgaaatctctgttgatcccggggcagcgaagtatacaaaatgttaattatgtttacgaagtagtatttaatattccgttatgattgcgctactncaaggcacatcgatatccgatngagagaaacacaacatttccctgttcaaaagctaatgggccgatgcattatacccaatcaaattacntnngaagaagatacgttacgttgggacattcncccattatatggtacttaagacttacttanaatacagtg

SEQ ID NO: 24177 - DNA, 486 bp, Triticum aestivum
  unsure (1)..(486): unsure at all n locations
  Clone ID: PAT_TA_24177
ccttcactttcattcgaaatccattctttgcaacctatctccattccccacatatcgacagatccaaagaaatgcaattaatccgtctcctcgtcttggcatttgccgctttcgtagcagcatctccatactcgaccctcagtcatactgaaggcggcaaaggtggaaaaggaggaaagggtgatgatgacggtggatgatgatggaccacaaacctgcaacgatgctctacaaaactctacccaagtgcgcattgcaatgtgtgagccaaacctcctatccgacgctgggctgcaaatctgcggcaacatttctcttggcacttgcggnacatgacaccancanaagccattnactaagncaanggaaacaccctggngtcctcganccaactggnagtcttcaaggaatccaattgggagncttttggaaaagccgggtcgnccttaatnctgngaatctttgcancggttccttcnaaaagaa

SEQ ID NO: 24178 - DNA, 151 bp, Triticum aestivum
  Clone ID: PAT_TA_24178
cccacgcgtccgtgcagcggcagttttgctgctcgttccttccggcgatgtcatgtagaactcgtatcgtggttgtaatcgttctcgcaagagttctggcgtgtctttgtggttgctttgaacttaatcatgcacgtgtatgttttggttt

SEQ ID NO: 24179 - DNA, 575 bp, Triticum aestivum
  Clone ID: PAT_TA_24179
gcagaccagttctacacttccaacgcacgcaagaaaatcctccaggttcatctacagcataggaagcggggagatggaagggagcagcagccggacgccagagataaccatcgtcccggcgcctaggccggcggcgggcggtggcggtggcggtggcgccatcagcccatcagccagcaaggtgcgccccggcgccgtctccctgcccgggtggaagctcgactccctctgcaaggagtccagctcgccgccggccatgatggcgcgcttcccctatttctgaagccacgcgggcatccttgtcatcctttgctagtactagtattttctggctggtatatgtataagtttgcagcggcagttttgctgctcgttccttccggcgatgtcatgtagaactcgtatcgtggttgtaatcgttctcgcaagagttctggcgtgtctttgtggttgctttgaacttaatcatgcacgtgtatgttttggtttcggagtttgtgtatgatcttgtgaactttaatcctccaaataatgtatagatgacaatataaaaacgcgcaatactgttctttttt

SEQ ID NO: 24180 - DNA, 390 bp, Triticum aestivum
  Clone ID: PAT_TA_24180
cccacgcgtccgcggacgcgtgggcggacgcgtgggcgacacttccaacgcacgcaagaaaatcctccaggttcatccacagcataggaagcgaggcggtgaaggcggcgagcaaggagcccatcagcccgggctcgccgtctccctgcccgggtggaagctcgactccctctgcaaggagtccagctcgccgacggccatgatggcgcgcttcccctatttctgaagccacgcgcgtctttgtcatcctttgctagtatttcccggctggtatatgtaagtttgcagcggcagttttgctgctcattccttccggcgatgtcgtgtagaactcgtatcgtgattgtatcgttctcgcaagagttctggggtgtctttgtggttgctttg

SEQ ID NO: 24181 - DNA, 731 bp, Triticum aestivum
  Clone ID: PAT_TA_24181
tgctgcaccccggttcttcacggccaaaacccgcaggccgaatgcagtagtgcagcagaccaccagttcgacacttccaacgcacgcaagaaaatcctccaggttcatccacagcataggaagcggggagatggaagggagcagcagccggacgccggagataaccatcgtcccggcgcctaggccggcggcggccggtggcggtggcgccgtcgaggcggtgaaggcggcgagcaaggagcccatcagcccgggctcgccttccccggccagcaaggagcgccccggcgccgtctccctgcccgggtggaagctcgactccctctgcaaggagtccagctcgccgacggccatgatggcgcgcttcccctatttctgaagccacgcgcgtctttgtcatcctttgctagtatttcccggctggtatatgtaagtttgcagcggcagttttgctgctcattccttccggcgatgtcgtgtagaactcgtatcgtgattgtatcgttctcgcaagagttgctggggtgtctttgtggttgctttgaacttcctttttaaacatcactacaaaggtaagcgctcatacatcatgccttatgagcaccttcgagagactgagccgacatgtcattttaaaatttacgaagtcatcgtcattgtccctctaaccatccaatcacaggttggtttactggtggcgttgaacttggtcaaaaaaaaaaaaaaaaaaa

SEQ ID NO: 24182 - DNA, 692 bp, Triticum aestivum
  Clone ID: PAT_TA_24182
aagcagatcgctcgggccgacctcggccggggctcgtgccgagcactgaaggcagtagtgcagcagaccagttctacacttccaacgcacgcaagaaaatcctccaggttcatctacagcataggaagcggggagatggaagggagcagcagccggacgccagagataaccatcgtcccggcgcctaggccggcggcgggcggtggcggtggcggtggcgccgtggacgcggtgaaggcggcgagcaaggagcccatcagcccgggctcgccttccccggccagcaaggtgcgccccggcgccgtctccctgcccgggtggaagctcgactccctctgcaaggagtccagctcgccgccggccatgatggcgcgcttcccctatttctgaagccacgcgggcatccttgtcatcctttgctagtactagtattttctggctggtatatgtataagtttgcagcggcagttttgctgctcgttccttccggcgatgtcatgtagaactcgtatcgtggttgtaatcgttctcgcaagagttctggcgtgtctttgtggttgctttgaacttaatcatgcacgtgtatgttttggtttcggagtttgtgtatgatcttgtgaactttaatcctccaaataatgtatagatgacaaaataaaaaaaaaaaaagcaccctaacacaagatgggtcc

SEQ ID NO: 24183 - DNA, 624 bp, Triticum aestivum
  unsure (1)..(624): unsure at all n locations
  Clone ID: PAT_TA_24183
tacccttctcatccctttttgatctcacaagagaaataaccacaagaattgtgccctgctgcccttcccttccccccctgatctcacgagtcacagagcctctagtcttggcgctgactcaaaatgaagattggtctctcttcactcaccatcctctccagtctatttttgccagcactgggactccgtgggctactattgtggatccgatactattacctcggacatgacggataatgctataggagaatcaatgagagttgcgagggaaaaaccagatggatatcttcaaaaatctcccaattaatgcccaaattggaattcccaaatccattttaacagcaggcaagaaccaggcaatactttttggggcacacacaacaagcgaggagatcttccattcagtgtattaatataagccaagggcataaaagcgattgtccctaataaaagtttgggaatttatccccaaggaagtttctccgaatagtgaaggaagtttgattgccccccgcctgctgccttcttagacttggcttaggncanagaataccggtaaggtagctgtaaactacgggcanactagagataggcgagacaaaatnctggttaacaatattgnng

SEQ ID NO: 24184 - DNA, 653 bp, Triticum aestivum
  unsure (1)..(653): unsure at all n locations
  Clone ID: PAT_TA_24184
ctcgtgccgaattcggcacgagagagcaacaactccaagctcgcccatcatgtctctcgtcactggagaaaaatcgaactttcagttcattattcgtctgctgaacactaacatcgaagggaaacaaaaagttatgtacgctcttaccaacatcaaaggtgtgggaagaagatattccaaccttgtctgcaaaaaagccgacgtcgacttgaacaagagagctggagagctcacatctgaagaacttgagcggatcgttacaattatccaaaaccccacccagtataagatcccttcatggtttcttaaccgacaacgagacattattgacggaaagaactaccaagtcttggctaacggtgtcgactcaaaactacgtgaagatttggaacgcctaaagaagattcgtgcccatcgaggtctgcgacattactggggactccgggttcgtggtcaacattccaagactacgggaaggagaggaagaactgttggtgtatccaagaagaagggtggttaagtacactgttttggaagtatggtttgggatacacacggaaacaaaattttactcgtagtgtcggtgctaggggatgctttaagtctcataaaacaactattcccgaaaaaaaaaaagaaaaaaaaaaanaaan

SEQ ID NO: 24185 - DNA, 607 bp, Triticum aestivum
  unsure (1)..(607): unsure at all n locations
  Clone ID: PAT_TA_24185
ctcgtgccgaattcgccaccaccaaagaatacgctctcctctgcttagaaaaccccctgcttgatattcaggctcagggcaatgaagatcttctcaagaaatatggccttgaagccaacaatgctatcctagctgagaatgagcttcacaaatccatttttgaggatctccttaaaaactactcggccaagttaatcgctggaggtggtgcccagaatactgcacgtggcgcacaatacctacttcctcccaaatctgttgttttcctcnggtggggttggggtctggacaaatatgccgatattctaaaagatgctgtcaaagatgcccggactccggagccgagtaccgagtagacgctaaacaaccaactggccgctgtggtgttgttattacaggccacaatccatccatggttactgatcttggggctgctaaccactacgatcttgaccatctgaagtctccctgaagtagggacccctcnanaaccagatacattcgtaggtggnacaccnactttgtcnnctgcganatgganggagagantgcacnagatanaatntctccgcggcgncctcattcnnattttaggccctaannaang

SEQ ID NO: 24186 - DNA, 635 bp, Triticum aestivum
  Clone ID: PAT_TA_24186
ctcgtgccgaattccgcgcgccgctttcgcgacagtccagcccccaaatcgccaacatggtcaacgtgccgaaaaccagacgaacttactgcaagggaagagactgcaaaaagcatacccaacataaagtcacgcaatacaaagccggaaaggcatctttatttgcgcaaggaaagcgaagatatgatcgcaaacaatctggttatggtggacaaacaaaaccagtcttccacaaaaaagcaaagacaaccaaaaaggtagtattaagactagaatgtacctcttgcaagacaaaggcacaattggctttgaagcgatgcaaacatttcgagcttggtggtgacaagaagactaagggtgctgctctcgtgttttaaatgaaaggtacttgtctagtattgttgaatgagtgcaggctatgtagacctgttgtctttgaacccacggttgatgaaggaggtatcgaaaattttctccgtgcaacatgatgggttgggtaagggggctcttatattttcatcttgttttcaacacgatcactactataaaaaatattagctcgcccggtaaccattctggtcctgtttgcctccccacgcacgacatagataagaataatcctccactgccatctt

SEQ ID NO: 24187 - DNA, 1691 bp, Triticum aestivum
  unsure (1)..(1691): unsure at all n locations
  Clone ID: PAT_TA_24187
ctcgtgccgaattcggcacgagctcgtgccgaattcggcacgaccttgattcaagcaatcaatatctgtgtagttcaatctccatcttcggataaatcaaatcacaaactttaccaatcttcaaacatttcaaaatgggtaaggagaaaactcacatcaatgtggtcgtcatcggacatgtcgacagtggaaaatcaaccacaacaggtcatctgatctacaaatgtggtggtattgacaagcgaaccatcgagaaatttgagaaggaagcagcagaactcggaaaaggatctttcaaatacgcctgggtcctcgacaagctaaaggccgaacgtgaacgtggtattactattgacattgctctatggaaagtttgagactcctaagatactacgtcaccgtcattgacgctcctgggacacaagagattttatcaagaacatgattactgggaacctctcaagctgactgtgccattctcatcatcgcgggccggtaccggtgagtttgaggcaggtatttcaaaggatggtcaaaccaagagaacatgcattgcttgcgttcacattaggtggcaaacaattgattgttgccattaacaagatggacaccgccaaatggcctgaagcgagataccttgaaatcatcaaggagacgaccaactttataaagaaagtcggatttaaccccaaggttgttccatttgtgccaatttctggcttcaacggagacaatatgattgataattccgcaaactgcccctggtacaaaggctgggaaaaagaaaacaagactggaaaggttaccggaaaaactctcctcgaagccatagacaacattgacccaccgagtcgccctaccgataaacccctccgcctaccactacaagatgtttacaaaattggtggcattggcacggttcctgttggacgtgtcgagaccggaatcatcaaggccggaatggttgttacttttgccccagctgggtgtaactacagaagtaaaatctgtagaaatgcatcacgaacaactagtccagggtatgccaggagacaacgtcggattcaacgtcaagaacgtctcggtcaaggaaattcgccgcggtaacgtcgctgggagactctaagaacgaccctccaaaggggtgcgggaagctttaatgcccaagtcattgttctcaaccaccctggtcaagattggatctggatacgcccccagtcctcgcactgtcacactgcacacatcgcatgtcaattctccgagatcttggagaagattgaccgaagaacaggaaaagtctgtcgaaagtgctcctaaattcatcaagtctgggtgattctgcaatcgtaaagatgactccatcgaagcccatgtgtgttgaggcgtacaccggactaccctccccttgggacgatttgctgttcgagacatgagacaaactgttgctgtaggtgtcatcaaaagcgtggagaaggttgacaaagcaaccaaggtaaccaaggccgccgtaaaagctggtgccaagaagtaggttaatgacggtggcggttgatgaaatcatttctcttttattcggggagttggaattcatattgattgaaccaggctaggaaattttggcttaaatatagacactatttcctncagagaaaaaaaaaaaaaaagnaattactcnaggggggggccggtac

SEQ ID NO: 24188 - DNA, 675 bp, Triticum aestivum
  Clone ID: PAT_TA_24188
ctcgtgccgaattcggcacggcctcctgccgatcccgagatatttaaaaagctaagtcctaagactcaaggtttactccgagcctcagaaaagcagaaggaagcatcgcacgaaatggctaccactgagcgaacctttatcgccgttaaacctgatggtgtccagcgaggtctaataggccacataatttctcgttttgaggctcgaggatttaaactagtgggaatcaaactcgtatctgccaatgaacaaaagcttaaggaacactatcaggatctttccgacaagccatttttctcagggctaataacatatatgggaagtggtcctatttgcgctatgatctgggaaggccgtgatgccgtcaagactggacggacgattcttggtgctaccaaccctcttgcatccctaccaagggaccattcgtggtgactatgctcttgacgttggtcgtaatgtatgccacgggttctgatagcgttgagaacgcacagaaagaaatttctatttggttcagtgaaggagagatacaatcctggaaatctgcccaaaatgattgggtttatgagaagccgtagactataaaattatttcgtaaatttcaaatttataaatagccatcttacgcttgacaaaaaaaaaaaaaaaaaaaaactcgagactagttctctc

SEQ ID NO: 24189 - DNA, 606 bp, Triticum aestivum
  unsure (1)..(606): unsure at all n locations
  Clone ID: PAT_TA_24189
ctcgtgccgaattcggcacgagccgcgcgccctcttcgccacgccatcccgtacctacaaaccgtcttcagttatctcataaatcttcaccatgcctattcccgttccagcagcctcctcgctccttgacctgctctccctaaaaggaaaggtagtcgtcgtcaccggcgcctcagggccacgcggtatcggtatcgaagctgctcgtggctgtgcagaaatgggagccaatgttgccatcacgtactcatctcgccctgacggagccgaaaggaacgtaatcgaattacagaatcagtacaacataacagcgaaagcttacaagtgtgacgttggctgctacaaatcagttgagcaactaagtaagttccgtcattcaggactttggcaagatagacggatttgtcgccaatgccggacgaacagccgactcgggagtgctagatggaacggtggagcagtgggatgaggttatccaagacaagatctgaatggtgttttccactgcgccaaagctgttggtgcacaattcaaagagcggaaaacggggcctttgtcatcgcctcctccaagtaaacanctnaantccaaggcggtgacaaatga

SEQ ID NO: 24190 - DNA, 962 bp, Triticum aestivum
  Clone ID: PAT_TA_24190
gtacgacgcggcgctccgtgacggcaagctgcctgggcctaggtggcgaccgcagggtggcgtgcgctaccgcgagatcgccggcgcgcaccgcaagctgatcgcccggattcagggactgcgcagccgcgccgccgtcggcgaggggtgcaacatcgattactacgctctgctgggcgtgcggcgcgggtgcacgcgctctgagctggagcgcgcgcacctgctgctctcgctgaagctcaagccggaccgcgccgtggtgttcggtgagcggctggagctggtggacgagcaccgcgacctggaggcggtgcgcgaccaggcccgcatgtccgctctgctcctgtacaggatgctgcagaaggggtactcgttcatcatgtcggccgtgatcgacgaggaggccgccgctaggcagagggcgaaagaggccgcggcgttgcccaagcagcaacaacacgcggcgccgataccggagaatcctcccgccgttaacagctccaccgcgaggacgacggcgaaaccgaagtcgaaggctggcgcgaccgttgcaacggtgtcgtcccaggcgacggcgccggtgtacctcctcgtgtgattttgcagtgttgttgtatacagagaggagctgtgtcgcagcgggttcgaccgctccctcccggtgaaatgcgaggcgatgagctgctgacggcgatgggttccagccgcgcagccaggtgcgatctgatgccgttgggacggggaacagacggaggaagctggcgggaaaaagctgacgcgtttgaatttattggatagaactcgctattgtacagttttgtgttcttggaggaaaagaaaaaaagggggcgacgcatcttgtcttgtagtactactagtatctcttgtgtggaggtgaacgaaatttttttggtttcatcttgttgaatgcgagttgttacagtgcagtaaagttttttttt

SEQ ID NO: 24191 - DNA, 550 bp, Triticum aestivum
  unsure (1)..(550): unsure at all n locations
  Clone ID: PAT_TA_24191
acttgaggttncagatctcattaacgccggcaaggaaactgtcacactcaatgtaggcgcttcagtgtttggaagtgaagaaagctttggcatgattcgaagcggtcgtatagatctcagtattctctggtgctatgcaggtcagtggcaacggagatctagcaagttggatgctaccaggaaaaataaagggatttgggggcgcaatggatctagtcagtaatccaaaacggacaaaggtaattgtaactatggaacatacagataagcaaggcagaccaaaaattcttcggcaatgcacctttccattaacaggtaaatcctgtgtttctttgattattacggatttaggtgtgtttgaangtgaatttttcgacaggattgactctcattgagattgcagaagggatcacagtagaagaaattcaaagcaagacagaagcttcatttgtagtttcctgaaaatcttagacttatgctgtaaagtaatatattataccccttaacgctgtaacaagtcagatntngnaaatcccctcnngccnattcg

SEQ ID NO: 24192 - DNA, 486 bp, Triticum aestivum
  Clone ID: PAT_TA_24192
tttttttttttttttttctaagtagtgggttatacatttcaatggagatatctatacatatgttcgagccggtgtcgcttgcccttcgccccctgactggtgctcaggaggatcaaagctccaacttcaggcattttgaccttctacacctgttattttgggaatcgaggcaaagatactctctcctagaaatagtttgaagttggatatatagcatcaagctcggaaaggagtagaggtctcttccttttcctgcttgtctttgcccttggacccagggccttctcgtctgcagtcctgctcgggctgtagttctcttcccgcggcgccggctgcctcactcttctgcatcccaagtccacgaattggccttgttctacgacgtccggcccattgccatgccggactgcggccgactgcgccccctgttcgggcttgtgggttgaatataacaaaatcatgcggggcctggggcctcctccaaag

SEQ ID NO: 24193 - DNA, 570 bp, Triticum aestivum
  Clone ID: PAT_TA_24193
ctcgtgccgcgtgccgcaccaggcccgacctaaagctcttccattctctcacattgtatcagcatccaattcactaccatggctgaagaaatgcaacaaatcttcacggaagatgccccatatccagctggcccctattcccaggccatcaagacagccaacaacatctactgctcaggtcagattccgtgtgatacgagtggcactatccttgacctctcgacttcaaatatcggtcaaatgacggaagtttgcattcaagaaccttagtgctgtactcattgcagctaactcgagtctcgaacgcgtcgtcaaagtcaatgtttttatcaccaccatggatcatttcaatgagatgaatgcaacgtatgaaaagtgggttcaagcatagaccaagcgcgtagctgtgtggctgttgcgcagctaccgaaaggtgtaccaagtcgagattgaatgtattgccctagcttggaggaggagacaagcacaagagattatggcctaagttcaccggaatcatattgacgtatgggtttcccgctgggcaaggctttaattttcacaattgaa

SEQ ID NO: 24194 - DNA, 485 bp, Triticum aestivum
  Clone ID: PAT_TA_24194
ctcgtgccgaattcggcacgagaaaatcaacatgcgtgctaaatggagaaagaagcgtgttcgtagactgaagaaaaagcgccgcaagactcgtgctagatccaaataaacaaattgaaaaactccgacaattgtcattcttctagagcccttaccaatgtgacaaaagagcattcatgttcaaatcaactccaggccccacgcttgcctcaactgccctcagtgcatcaattacctagttgtcgctgctacacaactagtaaacatgaacaggccagttcgatcaagattaacatcggataagcagagtaagaacttcgaaagaaatatgacaggacaaacagacatcggaaagttgatcaaaagtttgtcaaatataacatcctcaagatatttacgctagtaacttatcacgactatcaaagcaaataaatttctaaataccaaataagaaaaaaaaactcaaactcgagggggggcccggg

SEQ ID NO: 24195 - DNA, 872 bp, Triticum aestivum
  unsure (1)..(872): unsure at all n locations
  Clone ID: PAT_TA_24195
ctcgtgccgaattcggcacgagaaacgactaaccctacaccacagatatatttgagtacgatcggattcgttccatttccttggttactaacaaaagtctgagctccagactcattaaaaatgccctcagaatcaggccaccgtctttacgttaagggtcgtcatctaagctaccagcgaggaaagcgtaacacaaatccaggcacgagtctgatacaaattgaaggtgtcacgaatacccaagccgcaaacttttaccttggaaaaaaagtcgctttcgtctaccgggctcaaaaagaaattcgtggatctaaaattagggtaatctggggcaaagttactcggccacacggaaactcgggtgtagtacgggcacaattcagacgcaatctacctcctaagtcatttggcgcatccgtgagggtcatgctttatccttcgtctatataaagtgctgtagtgtaggcttgcacttcagaacctaggtggctgatgacatgccgttacaactagtaagctggggctggaagagtgcttgggtttgcaagttatctggagatgctgcgaacatgaatcacagtatccgtcgacagtgatttattaggataatacctaatccatgattcgctctgacagttaagcattatcaggttataaaatgccacttaataaggcaaccccgatggaagcatctgccggtataaaataagcttgaactgcatctcacgctaaattaagaaaactatagaacttaatccgttggtacacggccccccgcgataccgcttccgccnccaaggnggggtacnaccgtganggaaggaggaaanganaacnccnggggggggcccgnacccaattcnccctaaaag

SEQ ID NO: 24196 - DNA, 517 bp, Triticum aestivum
  unsure (1)..(517): unsure at all n locations
  Clone ID: PAT_TA_24196
tcacngntcctgcacgtnccaanccaagaaaaatcattctccattacatgtgggtcaggtttgtcttatgacaagtcataccctcgagagctccgttcaagaagggcttagtagtatgaggagtgattccagaagtcaggcggcgtacccgaaagaaattaccgattttgtttataaagttggtggaaagtattgggatatatcctatccaccacactccatcagggttaccaaacaaggcgaagttgatgatgactttgttgtcctttaaataatgaaggtctcatcctggggaggattgcacctcngcccaaaactagccctccctagcatttacccgtgcaatttccccgacggaactgagttcatgccttgaccctctttatacatttngccaaccaatattaactacgaaaatgtcatngttnaanatggaaaggntgttcaatccnnaacttcacccttttgtaaaaaaaccnccccanggggggcccggtcccattccccnaaaggancc

SEQ ID NO: 24197 - DNA, 488 bp, Triticum aestivum
  unsure (1)..(488): unsure at all n locations
  Clone ID: PAT_TA_24197
cggcacgaggggagatgaacctaccatcatctttccctcgtgcttggattgaagggagctctctctctctctctctctctctctctctctctctctctctctctctctcggatctgtcaaatatgttttcaagtctgcacctaacttctttttttcctcttaattatttgcagctgtaaacacactaaaagatcgatggcgcaagcggcatgcagggagctaacaagaaaatcaaatcactatgcttgtatgtatgcaaccagcgtgtagtgtttctcctcctttctccccttttgggaagaaccatgtgtaatatcctgtgggccctgagtggtcatacagtggtgttacgagagtcctgttctcctagctagaaattttgtggccncgatccctttttatgtttggaaatatttggagggtctcccttcgggcgcaaatttttctgtcctcgacanagtaaggngttggtnaaaaccgaggggggg

SEQ ID NO: 24198 - DNA, 927 bp, Triticum aestivum
  Clone ID: PAT_TA_24198
ctcgtgccgaattcggcacgagctggtgccgaactccgcacgcggaacacgacaccatccgaagcggtccatcacaatgtcggcatctttggaagcttcgaaacccacggctacaatcaagaccttcggaaagtcgacaagggaggttcctcaccacagtcagaaggcgaagcaatggtaccctgctgatgatgagcctcagctcaaaaagattcgaaaatctattcgagcatcaaccccgcgcccaagtctaacccctggcacaattctcattctcctcgccgggcgctttcgaggaaagcgcgtcattcttctcaagaacttaccacagggtgtcctgcttgtaactggtccgtttaaggtgaatggcgttcctcttcgacgagtcaacgcccgatacgtaatcgccacatcttacaagattaacctggcaggcgttgatcagaagaaaatcgacgaggtttccggcgataaatactttgctttggagaagggcgagaagaagaagggtgaagaggctttctttaagcaagggcgaaaaaccagaaaagaagaaaccatcaagccgccgcgctgctgcccaaaaggtctgtcggacaagacaccttattaggctactatcaacaaggcgcccttccttataggctacctaggaagtacctttagcctacgaaagggagatcgtccgcacgagatggcgtggtaattgggtaaggaactcggagtcgaataggaagcaaggaaataactagcgactttgttggcaagctacataggggtactgggatagtcagcctgtgcgtcttgtatccagtcttacagttaccaaagtcgtcaaaattcatgaataacggctccgtaggaaccagtcgcgtgaagtatatgtaataaataaccccgcgccgcttccggcacgagaaaaaaaaa

SEQ ID NO: 24199 - DNA, 717 bp, Triticum aestivum
  Clone ID: PAT_TA_24199
cgttctgcttcaaacacgcacacaagcaccccgagttgtcgtgatccgtcgacgtcgccgtgccgcaatgtcccggagctcatcttccgctcatcgtctctggacacccctgcccccgctgccattgatcctgtgcccgaggtgtgccgggatgaggactagatggtttgtctccgggatagatcggaatcccggcgtccgtttttacaagtgcccgaaccagggattttgaaactgacgcaggacggaggcccgtgcgacttttggttgtgggaggaccagtacgcgttcttcatcaccggcgttggcatcaaccttctcatcaaggcggccggaggtgggagcaacgtgatgtttggtatcagacgcgccatggaagatgtacatttttttagtcaatggaaaataacagtgtacataatgccatggcacgcgtactactgtaaccaaacaccgggtcatgattaagaaaatggaaaaaaaaaaaaaaggggcgctgtcctgtgcggactgcacggcgcagcttgagacgaaggccggcgtcccgttgctgcccagtaccgacggcaggaccatgcctccagaactgaatggcatgcacgaatccgccgggccactgcgggcgctggaatggacggagttgttcgagatgacggctggagtcgccaatcccgacgccacatccccgcctccagagctaaaggtcttgccggacgc

SEQ ID NO: 24200 - DNA, 616 bp, Triticum aestivum
  unsure (1)..(616): unsure at all n locations
  Clone ID: PAT_TA_24200
ctcgtgccgaattcggcacgagctcgtgccgaattcggcacgagtactcgcccccgtgtccgctcgagtccacctttatctcgcaagtcatcaacatccaaactcgacagaatccctggttagaaaaaatgtggttgctacattactttgtcctgcttgcttctgtttcaaaaccagctgctgcttctttccaaaaatgggacattgaaaaaggcgcagtctgttcgggaatcatatggactggggacgaattaaaagaagtccgattgagatattgccacaggccaccaagtccagccagtttaaaaaataccagccatcatcataggggacgcttcttttccaatgagatgaagtttatatacttccttccgcttcctcaacatgccttccttgaggaggacattgatagcgactattacattagcgtgggacgcggattgtaccttctacaacgtactaatattgaaggattcatttgcagtcaaacagtgtatatgaatgcatactgaaatgtcactgaaggacaccttctcgcgtcgagggccaccttccgttgcgttgagactaaaataccaatttantaaggaccagtnngcnggccaacacatgaata

SEQ ID NO: 24201 - DNA, 560 bp, Triticum aestivum
  unsure (1)..(560): unsure at all n locations
  Clone ID: PAT_TA_24201
ctcgtgccgaattcggcacgagcgaattcttcaccttccagtggtgccggtgtaatcgctcagtatgctctgcatatctgggatagccaagaagaatcgcatccgaatcgaagtcgaaagcaaacacatgtatatctccatttgacgacttctcaaccatgcagcactcatcattatcttctgagtcctcaaccccgatctaagcacatatcaactcgcctcgccgaccgacagaggcgtcaccctaactgcaaacaggagcttgcctcattcattaccggccatcactctctacatatttacgacgctatttatacccgcaaggaggaaatcaagtcgaaaaatacaaagttggggtcttggtttatgggggactgctgctctaatggggttatacatcttgaggaagaacaggcagctgagatgtggagcgagaggaggaaagaagactctgaagaccgtgttgggactgacattttcgaggagtttccaactttgggattttgtgtgggcgccaagaacaagganttcggctaatttaccaggagggcttcttttgt

SEQ ID NO: 24202 - DNA, 805 bp, Triticum aestivum
  unsure (1)..(805): unsure at all n locations
  Clone ID: PAT_TA_24202
ctcgtgccgaattcggcacgagtgaaaactcatacaatttcaagtttactccaatttatcccttcaattaacactcagaataaccatcatgtctgctccagctattaagtacaaggtcgcagatctatcccgtgccgccttcggccccagagaaatagaactcgccgagaatgaaatgccgggtctcatggccacccgggccaaatacgcaggtgaccaacctctgaagggtgcccgcattgctggctgtctgcatatgacaattcaaacagccgtgcttattgagactctcacatccctaggtgctgaggtgacctgggtcatcttgcaatatttttagcactcaggatcatgctgccgctgcaattgctgctgttggaatccctgtctttgcgtggaaaggtgaaaccgaagaagaatatcagtggtgcttggaacagcaattgttggcatttaaagatgggaacaccctcaacttaattctcgatgacggcggtgacttaacagctcttgttcacaagaagtacccagagatgctcaagggatgttttgggtgtatctgaagagaccactactgggtgttcaccatctttacaagatgttgaaaaacaaaactctccttgttcctgctgttaacgtcaatgactccgtcaccaagtccaagtttgacaacttattggggcgccgcccctcgctcgtcgatcccaaccattcgcgccaccgatggcgtgcccgctcggagtggttgctgttgtcgctggtttcggtgatgtaggaaaaggatgcgctatggctcctccaaggn

SEQ ID NO: 24203 - DNA, 888 bp, Triticum aestivum
  unsure (1)..(888): unsure at all n locations
  Clone ID: PAT_TA_24203
ctcgtgccgaattcggcacgtgaacaaatccatcgacagcgacaacatggttcgatacgccgccaccgaaatctcctcggcccgctccgccagagctcacggaaactacttacgagtctccttcaagaacacgcgagagacagctcaagccgtcaacggctggaagctacagcgcgccgtgaaattcctccaaaatgtgcaggagaaggttgaggccgtgccaatgagaagatacgccggtggcactggacgcgccgcacaaggcaaacaattcggcgtaacgcgtgcgcgatggcctgtcaagtcagctgccttcatcctcggtctcctcaagaacgctgaggccaatgccgacaccaaaggccttgacaccggcaacctcatcatcaagcacatccaagttaaccaggcccccaaacaacgacgacgaacataccgggctcacggtcgtatcaacccgtacatgtccaacccatgtcacattgagcttattttgaccgagggtgaggaagtcgtacagaagtctgaggcagtagttggacgtgaggcccatctcagctcgaggcagcgaggtgcccgtacccgtcgggccattactgctgcgtaaaatttttttgggggttacaagggagggtagaggcttttgtatgaaatttgaagcggtcaccattgtcaatgaaagacattcacgtgaggcggaaggagtggaatacgcaagataagctggctaatgtgactacggaatgcgaccttcgggttagtgatgatccttgactcccatcttgtattcgtacagaataagctagcaagacccatagcaagagacagctcataattaagcccaacgggccctgatacccctcaaaaaaaaaaaganaaagcaacncg

SEQ ID NO: 24204 - DNA, 692 bp, Triticum aestivum
  unsure (1)..(692): unsure at all n locations
  Clone ID: PAT_TA_24204
cgacgacatatgaacagtatgtctttgaatattcccaacgccccaaattcaaccctcgtctcgccggcatacgctcagtatgtcttcggtggtccccaccgccccctcctcggccctcttcctgcttcgataccccagctacgcttctgaggatggcgctgttttacggaatattgatgcctgtcgtgccatctcttctactgttcaaacctcctttggggccatatggacgaaacaaaatagtcataaaccatctacaaaaaatgattttaacatcaagatgctgccactatacttcngtgaactccgatgtgggtacaccccgcaagcaaaacttattgtcatgggcaagccaagcagcaagagcctgaaatgggagatgctacaaacctaagtaagtcatcctgggcaagcgaagctttggaagaaagcggagcatattattggaggatgggccttagaaccagcgatgttattccgggctatgaactaagcacaangagttgcgccctcgatgccaccaccggcggggcccggggtcccgtatacgttcgcaaacagactaagtannnatcaaaaatcncgcaacaaacaaanggtgcnaatatttggnanactggtganaacatgccacgtctccaaatcataattaagtgaaagtcngggtaaattaggngancttgcaacaattg

SEQ ID NO: 24205 - DNA, 765 bp, Triticum aestivum
  unsure (1)..(765): unsure at all n locations
  Clone ID: PAT_TA_24205
acttcacccctgccgctcccggcacgcgccaagatgggtcgagttcgcacgaagacggtgaagaaatctgcaaaggttatcattgaacggtattatccaaagttgacccttgacttcgagacaaataagagaatttgtgatgaaatcgcaattattgcttcgaaaaggctccgtaataagattgctggctacaccacacacttaatgaaacgtatccaacgcggacctgttcgaggaatctcgttcaaactccaagaagaggagcgagaaagaaaagatcaatacgtccctgaagtttctgctcttgacttcggccaatcggaagccggacaacttgaggttgacactgagacgaaggatcttcttaaaagcctaggatttgactctattcctgtctcagtcgtggctgttgctcaacaacaaaccatcgagcgaggacctcgtcgattcggtgaccgaccagcgagaccttaaagtgcatgcaatggaattgagttggagttcagacctggctagatttatccactatcatttgatatggacttgtgaaaactaggccaatgaaatatgattaatttaaaggtgtcgctgattctttgaaaagatgaggcttgattgccaacacttatgcctttatcaaaatgtgataacacacgttttagggcttccctaatacacctacacgcacaccaccccagatacatgaaactccctcactaggggcgcccaccccggccgctnccccaaacttaaatccccntgcag

SEQ ID NO: 24206 - DNA, 646 bp, Triticum aestivum
  unsure (1)..(646): unsure at all n locations
  Clone ID: PAT_TA_24206
ctcgtgccgcgtgccgcacgcggcgcgccgcaaccgccacgatgctgatccctaaggccgatagaaaaaaggttcacgagtacctgttccgcgaaggtgtcctggtcgcaaaaaaggatttcagcatcacgcacccagacatcgagaccaaaaacctttttgtagtcaaagcctgtcagtcattgacatcgcgcggatacgttaagacacaattttcatggcaatattactactacactttaacacctgaaggtcttgattatcttcgggaatggcttcacactcctgccgacattgtcccagcaactcacatcaagcaacagcgatcgcatgccccgcctcgtggaatgatgagtggcgaaggcgaacgtgagcgaaaacctttcgctgggcggggtcgtggcggtgatcgtggagaccgagaaggaggatatcgcaagcgtgatgctggagagggtaaaaaaaggaggtgcaccgggcgagtttgctccccaattccggggttttggtcnccgtgctggaaaagggggggcgctcctttacatcttttttgttcaattttgcagtcctcagtaatcaagtcctaccacggggccgntacaattcccnaaggggnctttaccgccaangcgnnttaaancgaagg

SEQ ID NO: 24207 - DNA, 310 bp, Triticum aestivum
  Clone ID: PAT_TA_24207
caggatggtcaggtacaagctcgggaagaagaggccggcggcggcggcggccaaggtcaatgccaagtgatacatccatgtacatacacatcttgcttgcaaccttgagcaaattacttgctttctggcgggatgagatccatcgatcgtttgtatgtacaaaacccgccgtgtttgcccgattctggctaagaaaaaaggattgttcatgtagcatatcaattgttccacaggcaagcatcttccgaacaaaggatgcatatatacacactgtagcaattcaactcttgtgcagaaatactttccgagc

SEQ ID NO: 24208 - DNA, 653 bp, Triticum aestivum
  unsure (1)..(653): unsure at all n locations
  Clone ID: PAT_TA_24208
ctcgtgccgaattcggcacgaggagactgggtgcagttcgcgcatcagacgacttgaactccgagtcgtcggggctagtgggagctatgcttctagctctccttggtctggtcacgccgtgtgggctcgggctgctcgaggtgctttgattcaacgtaccagtgcacagcgcgtaactggctctccgttgctgacatgtccggcaaaaagccctatccagtccacaactcccatcaagcgtcctccgaacccgcacgtccgcgctagatnaatccggacccactgtccctcctcactctccccggaatccaaggcggcgaccgcgtcctccggatgccacgaggataatggctacaaagctagtacaacctccgccaatcctgtatccgcaattaactttgtcccgttggggtgctggggcaaagatgtgatggcccataacctcctaaccgtgtttcaaatgggnatcgccagcgtcacacgtggngcggccccccaggtatataccgctanatctacnacctccatggtcaatncaaatttatccaaaaaggtaaacaaatgtgcaanngntattaatcaatgcaaacantgcggtannctccaaaacaactggactncaataatanctaattacttancttacggctaaa

SEQ ID NO: 24209 - DNA, 2396 bp, Triticum aestivum
  unsure (1)..(2396): unsure at all n locations
  Clone ID: PAT_TA_24209
caaggggtccgcacacacatccacgcggggacagcacgaccgacccgcacgcacacgcgcgcggccccggcgacgtcaccggagggagacggcgacgagcttcggtccccacgacctcctcgccggagcgccctaggcggcctccgccatggctcgccggtcgtcgtcctcctcctcgtccggggcgtggcggtacctcaaccccgcctactacctcaagcggcccaagcgcctcgcgctcctcttcttcgtcttcgtcgccgccaccttcgccttctgggaccgccaatcgctcgtcagcgagtacgagtctgagatttcccaattacaaaatgaaataaatcagttgcatggtcagttaaggaaggctggtgttcaactggaggaaaatccagcaactgaaattcccagaaaagatcttgtagagattgatcctattaataatgaaaggagggaaaaggttaaggatgctatgctccatgcctggaattcctatgtaaagtatgcatggggaatggatgagcttcagccgcaatcaaagaatggtgttaatagctttggtggtctcggggcaactcttgtggactcgctagatacactgtatataatgggcctaagagatgagtttcagaaggccagagactgggtggcagagtcattaagctttgacaaggattatgacgcaagcgtttttgaaacgaccataagggttgttgggaggtctcctcagtgcatatgatatgtcgggtgacaaagtatttctcgaaaaggcgaaggatattgctgatcgattgttacctgcctgggatacaacatctggtatcccttataattcaatcaacttagctcatggccgagctcataattttggatggaccaacggtgatagtatccttgcggattctggaacggagcaacttgaatttacacctttgtcccagaaaaccggaatcctaagtatcagctgaaggcagaaaatgtcatccgacagcttcagaagattatccaagtgatggcttacttcctatctacataaatcctcagtcagggcaagcatcatactcaacaataacattcggtgctatgggagatagcttctacgagtacttgctcaaggtctggattcaggggaataaaaccggagctgtaaaacattacagacaaatgtgggagacatcaatggaaggtttaataagcttgaccaggcaaactacaccctctaattacacatatatctgcgagaaaagtggtggctcgttatctcacaagatggatgaacttgcatgcttcgcccctggtatgctggcacttggagcctctggttatgggcctgaaaaagctaaacaaattatgaatctggcagaagagcttgctcggacctgttataacttctaccaaacaactcccacaaagttggctggagagaattattatttccacgctggacaggatatgaacgtgggcacgtcatggaatatcctgagacccgagactgtggaatcactcatgtacctggcgccttacggggaacaaaacataccaagattggggatgggacatattccaggcatttgagaagaactcccgcatagcatctggatatgtgggactaagagatgtgaatagtggtgaaaaggacgacaagatgcagaccttcttcctagcagagacgctcaagtacctctatctgctgttctcccctccgtcagtcgtatctttcgacgagtgggtcttcaacactgaagctcaccctttgagaatcgttccaacacatggtagcaacggccagtcaattgaaactgcaacaccagtggtccgaccgttcggtaggaagcaagggaaacaggggtaggcctgaacaacagagcagaggatttttgcatccgccgtgtgattgtgacctgccttgttgagaacgttatgttacgatgggaatttcttcctgcagcggcaagggttgcaaatcacggcactaggctatttaggcaacacaaattgtaggtagagcatgatggataatctggggcatgctgaaccttcagagtataaccgaagatcagcagccccatgaaagttttcatcttcaaacttgcctatgctccgtacgttgttgatttgcaacacatatgtaacttagtgtccataggttgttcctttcatggggctctcctggagttgtatccttattgttttgattatatgatatataaaaggggttgtgtttcctttcagtatatacattttgttaggacttttggaaacagtggccgcatttaagagaaaaaggtatgtgggcctgtatttgcagcaccaagaaaaaaaacaaaaaaggtgcggtccgcttctagaggcatnccaagacttcacgttacgccgtggcatgcgctacgtgcata

SEQ ID NO: 24210 - DNA, 791 bp, Triticum aestivum
  unsure (1)..(791): unsure at all n locations
  Clone ID: PAT_TA_24210
ctcgtgccgaattcggcacgaggaattgtgcggcactctcgtcataagaacatcagttctttcacaccaatcaagtttaaaagcacaaattatcacggttaatttctctgacttatcaactcgaatcattgcaatacttgaagagacttataaattgcttcacaatgaaaatagttcttcctcatctcgctattgcgctcttgagcgttgtagcgccagcacttgctgtgatgtatgactgttttgggaccattattgatggggatgtcgtgaagagagcagaggctagtcacgaatatgctagtacttcaaaagtagccttaattaaagaggattcgaaaattccatacacatactttgatatccataccactggtcaatattccgagagatatacaggttttgcctgctttgtggacacagctatgaccaaacccgatgtgcggaaacatcatgaagaaacttggtggccgtgtaatccctaactcaagttgaggagatgaagtacttgccaaagccgtaattgcggcggtgacaaaaaatgtgtgccgttagtaataggccgggtgggaccgacagcagcgccagtgagggaattatcggcaaggagattatgttccatagaggaccctcaatagctccattgatataaatttatatctatttatggtggccctattgtatctaaagctaactattgccatcctgccaannanaaacaangcngtncaaaactccgagggggggggcccgggtaccccaattcgcccctataagtgagtccgnattac

SEQ ID NO: 24211 - DNA, 641 bp, Triticum aestivum
  unsure (1)..(641): unsure at all n locations
  Clone ID: PAT_TA_24211
gntcggaattccaaccacaacgaccacgacggatcaatctcccctcgtacttcaagaataatggcatctggagtcccaaacatagtgatttcgaagcgaagaaagtttgtcgccgacggtgttttctatgccgagttaaatgagttctttcagcgtgaactcgccgaagagggttactcgggagtcgaggttcgagtaacgccaaccgtcacagacatcatcatccgggctactcatacccaagaagttcttggtgaacaaggacgccgaattcgcgagctcacatcccttattcaaaagcgctttaaattccccgaaaattcagtttctctctacgccgccaaggtgcaaaatcgtgggctttctgccggtggctcaatgtgagtcactaagatacaaaactgctaaatggggctccctgttcgggagaagcgtgttatggggggttcttcgattcattatgggaaaggggngcgggagcgattcgtgaccgggttgtccactgggcccgccccatgcttgaanttacgagggtttaagatcacccggtnacctgcgggggttcatngttangaccanacntctttanaaagggtctggataaggcaaanatcagtnggtcaaggaaatggcaaaaaatn

SEQ ID NO: 24212 - DNA, 553 bp, Triticum aestivum
  unsure (1)..(553): unsure at all n locations
  Clone ID: PAT_TA_24212
ctcgtgccnaattcggcacgccgacaaactcaccaacatacgccattgaccaacgatgcctacacacttaagcaagactcgcaagcatcgcggacatgtttcggctggtcacggaagagtaggaaaacatcgcaagcatcccggtggaagaggtcttgctggtggacaacatcatcaccgaacaaatatggacaagtaccatcctggatacttcggaaaggttggtatgcgatattttcacaagcaaggcaaccatttttgggaagcctgtgttgaatctcgaaaagctgtggtcctttgatccctgttgaaaagcgagacgcatatctctcatctacaaacccagatgtaatcccagtcatcgacttattaccacttggttattcaaagggcctcggaaaggggcgcatccctaaaagttccccttgccgtacgcccccgctgggttaataaaggaacccgaacgggaaatatctgaacctggggccgttntttggttcgtancctggaacaaagaatttgtgcaatcttgatacaaagtaaccacaaattn

SEQ ID NO: 24213 - DNA, 538 bp, Triticum aestivum
  unsure (1)..(538): unsure at all n locations
  Clone ID: PAT_TA_24213
ctcgtgccgaattcggcacgaggttaaccacatccctccgaacttcacgtttcagtctccgccaaactatcgcggttaaattgattgatcctgctgttctcaaaaaccaataaaatgaagcacctcgcagcataccttctccttactctcggtggaaactcgtctccatccgagagcgatatcaagaatgttctaggatctattggaattgaggctgacagtgaacgtctcactaagataatctcagaattgaaggacaaagatatcaacgaattgatcgctgaaggaagtgcaaagctcgcatccgtgccttcaggtggtgctggttccgctgtagctgccactggagcagtttctggtgacgcagctcctgaggctaaggaggaagaaaaagaagaaagagaaagaagagtctgacgaaagacatggggtttcgggctttttgattaaaaatgatctcctgaacggcgaagatatatttaaataaaacgtataccctcctgagaattctcaatttttcctcgcganaaaacgaaac

SEQ ID NO: 24214 - DNA, 385 bp, Triticum aestivum
  Clone ID: PAT_TA_24214
cattaagcagttctccgaaatttcatcaataaaccagcgaattttattatctggtccatcgggttctgagatttatcaggaaacattgataaaggcacttgccaaacattttggtgctagactacttgttgttgattcactcctgttgcctggggtgccttcaaaggacccagaaacccagaaagatgttggcaaggctgataagtcaggggacaaggcacgtggtgagaaattgacaattcttcataagcatcgctcttccttggcagacacaatgcacttcagaagaccagctgcaccaacttccagtgtgaatgctgatattgtgggtacatccactctacattctgcaactttgcccaaacaggagtcctcaacagctaca

SEQ ID NO: 24215 - DNA, 594 bp, Triticum aestivum
  unsure (1)..(594): unsure at all n locations
  Clone ID: PAT_TA_24215
ctcgtgccgaattcggcacgagcacgccacgtctcaagtatcttatcgtcaccccctcgacctcatcaaacctgcttccaacctatcgatcaaacttccttactcatttccaacaatacaatggcgtcccgtgtgttttcacctaagatggcatctattattgcccaaacttctgctaaatctgctcgacctgcgatgcaaattggcatcaaggccaaccagcgtgcgttttctattgcttcttcaagccttcgcacagcccctttccaagctatcaagcgtcagcaggcttctaaaataatcagtaatgcctctcttaaatttgctggtcgccaaaccactcgatcatttaactcaagaaatcgctactgccatggtacaagtctctcagaacctcggaatgggctctgctgctataggtcttggaggtgctggtattggcattggggctcgttttttctgctctcttaactgcagtgggctcgcaatcccaagcatgcgtgggcaactattctcctaagcccatttgggggcgcccccgccaggctggtgggttgtcnatctaagggtgcaagaatgtgnaatactgtaant

SEQ ID NO: 24216 - DNA, 525 bp, Triticum aestivum
  Clone ID: PAT_TA_24216
ctcgtgccgaattcggcacgagggaggaaagagtaactatatttatgttccaacaaaatcagaagattttgatgagccatggactgctttggacggcccgcttcccctgcccagccccaccctccggtcgtcctgctcctccgccccctccccccttgcaggcccactaaatagcctcttgggtgcttcccagtttggtttacggggttgacccagtgattggtcatcgttgcttgttgcagttgcaaggcttttcttagtctttcacaatgccagtcctgtcgattcctgcttttgtattattcaagttagccactaggttctgtaactcccatggcttcttgacttgtcaaatgtattgtgtacaagaatgttgatctatattgtctccaggatagtgatcgtcctccactgggtctatggggattaattgaattcttatgtagcagcttggttgacattaattctgtgactggacaagaaagcacattatgaatatgtcaacgctgtttcgaatccggtaac

SEQ ID NO: 24217 - DNA, 551 bp, Triticum aestivum
  unsure (1)..(551): unsure at all n locations
  Clone ID: PAT_TA_24217
ctcgtgccgaattcggcacgagctcacacaagcacaatgcccagtttgcacgacaccaccccggcgatggcgccgtcctacgacacgccggagggcgtggccatccgcggccgttacgacccggagttcgcggccatcctgacccgcgacgcgctggccttcgcggccggcctgcagcgcgagttccgcggcgccgtcaggtacgccatggagcgccggcgggaggcccagcggcgctacgacgccggcgagctgccacggttcgacccctccacgaggttcgtccgggagggagaatgggcgtgcgcgcccgtgcccccggccatcgcggaccggaccgtggagatnaccggccccgccgacccgaggaagatgtcatcaacgcgctcaactccggcgccaagtcttcatggtaagcccgcgtggccgtactacgtacaagtgcaacaacanggccaaangtacgncatgttacaaagtaaaaactgacgtgactggcaagtgactcangacccctggcgccactggganaactgatccgggaagttaac

SEQ ID NO: 24218 - DNA, 1065 bp, Triticum aestivum
  Clone ID: PAT_TA_24218
gaatgctgcacgacgtccaaccttcagaccagctctccgtcggacgagtttcttcgccgttacacaccaccactcctgctgctccggtcgagtttgatcgactgatggctgcggctgctcccacccaggctccggccatgaccctgccggccgccatggccgccaaggtggcgcccgcccccgcccgcgaccgcgagggtggtgccagctgaggaccgacgccgaccgggtcggcgtccaggtccaggtccaggccccgacgctcccaccgtcgctccgccgtcgaccgaccaagcgtcgctcgaccgcccgccgtcctccgccaaagatcctcctgcaagctcaaaatacacgagtggaccagccgtggggactctggccgaccgcagggcgcttggcatgctgctcgggcctggggctcatcacggacgtgaacatgatcatcaccgactattggatgcccggcatgaccgggtacgagctgctgaagcgcgtcaaggagtcgtcggagctccgggagatccccgtggtgatcatgtcgtcggagaacgtgcccaaccgcatcacccgctgcctcgaggagggcgccgtaggacttcctcctcaagcccgttccgcccctgccgacgtctcccgcctctagcaaccgcatccggtgatcagccgtccaagcctcagacaacggaggaggattaattcttaagtagagcaggatttttcaattcttttttcttcggtcttctttcccatggacatagatccgccgctcgctgccgcctcaaacaacagcttgactttttggggtcctaggagatgatgatgatttagattaggatgttagttcgttcgtccccttgtgtgctctgcttcttcagagatgccaagaagaacaaaccgaaacagagtattccttctaccaaaaggaaggatatcttctgaatgaatgttgttcagagaagtttcccctcttggctacatgtccgaaagctttgatgaaatggcatcggatcagagcaacatgttgacagtttcataatcagagttagtcttttggcatgaatcagc

SEQ ID NO: 24219 - DNA, 657 bp, Triticum aestivum
  unsure (1)..(657): unsure at all n locations
  Clone ID: PAT_TA_24219
cggcacgagcgcctgccaactgcagcaccgcgccatctggtcatacacccaaaatcagcgccattctcgccaaatagtatcatctagtcatcatgggaagaggaccaaaaaagcaccaaaagcgcctcagcgcaccctctcactggctgctagacaaactatctggcgcgtacgctccacggccctctgcaggtccccataaactacgtgattgtatgccactgatcgtatttatccgaaatcgtctcaagtatgccttaaacgcacgcgaaacgaaggcaattgtcatgcagcgcctaataaaggttgatggcaaagttcggacagattccacttacccagctgggtttatggacatcatcaagcatcgaaaaaactggagaacatttccgtcttgtctacgatacaaagggaagggtcactgtgcaacggattcaaggccgaggaggctgaatataaacccggcaaagtaaagagagtacaatttgggcaaacggggctatcccaatccgtggccacgcaccatgctaggacaatcccatatccacaaacgtcaagatgactccaaaagtaatccanattgcaanttgancgggttacccaangcncggnggcnanatgaattttggtacaccactnactcntaggggttaannt

SEQ ID NO: 24220 - DNA, 600 bp, Triticum aestivum
  Clone ID: PAT_TA_24220
ctcgtgccgaacgcccacctcgataaaacccataaagaaagaaaaatgggcgacgcacaaatcaaggcatcgtcatggagactggttgaagtcggtcgcgttgtcctaattagcagagggccttctgaaggcaggcttgcaacaatcgtagaaattattgatcacaagcgtgttcttatagatggcccatcgtcggatccgaacatctcagtccctcgccaagctgtatctctatcatatcttgttctcacaccattagtcctccaaagtttaccacgtggctcgcgatcaggtatcattaaggctgcatgggaaaaggctgggattgatgctcaatggaaggagagtgcatgggcaaaaaagagaactcagagggagaggagacgtgctttgacggactttgagagatttaaggttatgcggctgagaaagcaagctcggtttgaggttcgaaaagtcgttcgcaaagatcagggcaagcacgacatgatagatgtaaggtctagtgcaattaatagctttgacaaactaaatctcagtcgtccacgagagctctgatcctttttgaattcccaagcaatggcattggatgaagataaa

SEQ ID NO: 24221 - DNA, 806 bp, Triticum aestivum
  unsure (1)..(806): unsure at all n locations
  Clone ID: PAT_TA_24221
natatggtaccctttgaatccatttcaactaacactgtgcaatctaagctttagctcaatcttgtttactgaaatggtagtaagcgactatgttcgctgaaatattcatcatcttccgaaaagtaagaagttcctgtaaaatcaaaattattcccgtcttcaaggtgttggaatactggtgtaaaaaggtcttatagggcggaactttatgctttcgctcaagagatgtttttaactatagagtcgtattcgatatcttcgggttcatttagttggaaatcatgggtaaatccatcgagtgatttcttgagtgaatccttggaggacgcgtataccatttttggcttaacaccagagtcatctgggctccatgcaagaaatacaattttgtctctgtggccttctccggcagccaattggaagtggaaatcgtagacggcgtatcttgggcctttaaccatctggccatctttctgtacagaacgagcgctgaggagtttttcgcggaagtagtcccagttgtcatctttactggcctcctctactaagatggacttataatcgtcagacatcttgaaaattataaacttgtgctttttttggctctttagctccttatatttttccaagcagtcagggtccacggtaacacctgaaaaggacatgattttggtggtatctcggcgatgctaaagatcctcaatgactcgtgacctgttgagatcaagataactttgagtaacgtacagagctcttgaatccgaagggtaggtgaagttttgatctcgtgccgaattcggcacgag

SEQ ID NO: 24222 - DNA, 791 bp, Triticum aestivum
  Clone ID: PAT_TA_24222
ctcactcatcatcaagcgcacgcgcaaatcctcaccattagaaattaaaatctactggaagactgtcaaaatgtccaaaatcacagtcgctggagtgcgcaccaacgttcaacaactcctcgagtactcgcacgagacaaagaagcgaaacttcctcgagactgtcgagctacagatcggcctcaagaactatgaccctcagcgtgataagcgtttctcgggaaccattcggctgcccgtcgtgccccgcccgggaatgtcaatttgcatccttggtgaccaacacgacattgatcgtgccaagcacggtggcgttgacgccatgtcggcagatgacttgaaaaaactcaacaagaataagaagctcatcaaagaagcttgcacgggaaatatgatgcattcgttgcctctgacacactcatcaagcaaatccctccgtctcctaggtcccgggctatctaaagctggaaaattcccaactcctgtgtcccacaacgaagatctggccggcaagtttaacgaagtcaactccacctccaatttccagccttaaagggttccttgcgtgggtgtcgctggtggccatggaggactgtcagaggatcagccccctggtagcggcatcctgtctaccagcgacctcctctccctcctcttaaaaggctggcaaaatgtcggaagtttgaccattaaggcttcaatgtcgcccccaaaacgtttatattagttttagtataaatattatagatcaaaatctaaacctaaattatgcgtcgagatttctcgtcaaa

SEQ ID NO: 24223 - DNA, 484 bp, Triticum aestivum
  unsure (1)..(484): unsure at all n locations
  Clone ID: PAT_TA_24223
aaggacnntgccantgagacgcgtaaagatagtgacnccgncgcagggctngtgtggntaccgngcccccccctcgtgccgaattcggcacgagctcgtgccgaattccgcccgtgcacgcaactacaatacctcacaaaaccgcgccgtgtcacaactttacgttacagcatcatgcctcccaagataggagctaagcatactatccatgttccaccagctcgaccactttatagattcgcagcaaccggcctgggggcaaccatgtggttttttctaatgtatagagcgaaacaagacggacccgttctactcggatggaagcatccatgggatcactgaaggctaatgcaataagtctttggtgcttgcttagtgtgaaggtttatacaaagttaattcatacaacggcccagcgtattcatagttcattaatataagtgacacttttggtgcagaaaaaaaaaaaaaaanaaaacaaaca

SEQ ID NO: 24224 - DNA, 863 bp, Triticum aestivum
  Clone ID: PAT_TA_24224
ctcgtgccgaattcggcacgagggaagacaaccatttgtctaggctgtcatgcagatttttgtaaagactctcaccgggaagactatcacccttgaggtggagtcttccgataccattgataacgtcaagaccaaaatccaagacaaagaaggaataccccctgaccaacaacgtttgatcttcgcaggaaagcagcttgaagatggacgaacactcgcagactacaatattcaaaaagagtctaccttacatcttgttctacgtcttcgaggtggagcaaagaagcgcaagaagaaggtttacacaactcctaagaaaatcaagcacaagcgaaagaagacaaagttagctgtgctcaagtattacaaagtggatggcgacggaaaaattgagcgtcttcgcagagagtgtccatcaacagactgcggtgccggtgttttcatggctgctatgcaaggaccgtcaatactgtggacgatgccatctaacttacatatttgacgatgctgccaaataagtaaacttcagatcaaggcaagaaactgaacatccgggaacttcagaattgtctggaaatcgtaaagatgggtgtaaaaagtatttgcagattatcagatagttggctaccgatgtaatcttttgggtgtttttagcttctcccctaaatttccacaaccatttcgcacgcatgtacgaacatactttgacgcactataacttccggtaaattctccacagttatgccacaattaaatggttaaattttttagtggggtttaggatggagaaataatggccaattctaactgcaaaaaaaaaaaaaaaaaaaaaaaaaaaaaaaaaaaaaaaaaaaaaaaaaaaa

SEQ ID NO: 24225 - DNA, 818 bp, Triticum aestivum
  Clone ID: PAT_TA_24225
ccgcgcgtcccctgcgccgcctccagcgtgctcctggcgcagccgccgggggccgtgatagcgctggtacgcgtggcacgcggccagcgtgcgcctcgacgtcaccgacggcgaccgcctcgcctgcttcccggtcacccctggggctacggtgtacacgtcggaccagagctgctcgctccctgcgctgcccggccgccgcctcggctccctcttccgggtcggccccgccgccccccccgcgtcccaacacgatgataagccgcgagacggcggtcccgcgtagggccaggcacaggacgagaccagggaagctaggtccctggtggacaaaagcgcggcgcagcgagcggcgacgcgggacatgaaggctatgaagcaaatggctccgagcttggaaataagagtatatctaaacctgaaaacaagtatgtcatccttccctccactgtgggaaggacatgtaattgtaacatatgccgccattagtttcctggtgttgtaactgtggtctattcacatcccagtttgatctattcagttttctacaagcagtgcaacattgtattacaaagaggacacacaataggatgatatgcggccatcggaggagcattggggcggttggccgatgcggggaggaggggggaagccgccggatcttgcttgcctcccgcgaggcaggtggcgttggtgtatacacagatgcacatttttataattttcctctctaagtcaagagggaaaatgctcctcaaaattgaaagcacaaattgtttcttgcattgaattgaacatatgaaagccaaaggcagtgc

SEQ ID NO: 24226 - DNA, 688 bp, Triticum aestivum
  unsure (1)..(688): unsure at all n locations
  Clone ID: PAT_TA_24226
ctcgtgccctcgtccccacgtcggccctttgtcctagtcccgcttatccgctcttttctctcgtttgactagacgactcgctcctcttcactacttaatctacgaatcatgcttttttcacaaaccatcagcctaattttcttgctcgccccctctgttttggcagaaaaatatgacaaaatcacgcctgactttgttaaaactgtcacttctctcaaatttggcgttgactgtgggacacatgtttacaccgatctccagctgaaaaaactagcctttagctcgctgagaactgaaagattagtcaaatattgcaccctaaaatctgggtgtttcaaagaagctcgactaccgcaagaaatatatgagctatgtccaaaactcttacttccctatagaacatattacatacgcgtccgttcaactgggcggtattcctaaaaggaagatttggcaaagaacaacataattgtcgtagcgaacgatgggactatccaaggggttcctaaccactaaagacaaggctggggtaacggccaaacgtgagaaggcggacacagtgaacgcaagagcagactaccaangacgggaaaagataaatccaggtangctaaaccgcgacgggtcaatcgtaaancgagaatggaggntccgccgtcgtgaggctagcccaggcccggctcgngtt

SEQ ID NO: 24227 - DNA, 714 bp, Triticum aestivum
  unsure (1)..(714): unsure at all n locations
  Clone ID: PAT_TA_24227
gacctcgtccccaccgacacaagagaaatcagagtaagatggccgagtcagcagagaagacgcagaatcccatgaaggagcttcgtatccagaaactcgtcttaaacatttcggttggagaatctggtgacaaactcacacgagcagccaaggtactggaacaattaagtggacaaacgcccgtttacagcaaggctcgctataccgttcgcacattcggaatccgtcgaaatgaaaagatcgccgtccatgttacagttcgaggacccaaagccgaggagattctagaacgtggcctaaaggtcaaagagtatgagctacgcaaacgcaatttctctgagacaggaaactttggattcggaatcagcgaacatatcgatctcggaatcaagtatgaccccgcgatcggtatttacggaatggatttctacgcttgcatgactcggcctggagagcgcgttgccaagcgccgacgagctcaagactcacattggagcaaggcacaggattaaacgtgaagaatcaataaaatggttcaaaaatcggttcgagggaattgtaagatgaccgaaatagggaataaacaggtttaatatagatggagataactggttgggaactcaaactctacaaatttcattatcaaaaattatcttctgttcttaagaataataacgggcttanagaccgaccggcatgccggcttaacactaa

SEQ ID NO: 24228 - DNA, 635 bp, Triticum aestivum
  unsure (1)..(635): unsure at all n locations
  Clone ID: PAT_TA_24228
ctcgtgccgctcgcgccgcgtgcggcacctgacttcgaacagcatcaacttacagtcaccttcacccggtgtgactatcgactacaaaaaacaattgaaataagtagtagacaggatgcgcacttacgacgactctttctccggtcagaagatctaccctggaaagggtaaactctacgtccgcggcgacagcaagatattccgattccaaaacggcaaaactgaatctctatttctccagcgcaagaatccccgtcgtattgcttggacaattctcttccgaaggcaacacaagaaaggtatttctgaggaagttgccaagaaaagatctcgccgcaccataaaatctcagcgagctatcgttggcgcctctctagatgtaattaaggagaagcgaaaccaagagaccaagaggtccgaactgccgcacgcgcagctgccattaaggaaggtaaagataagagagctgctgctgctagcgccaagaaggcagagaaagccaagctggcaagntgcttcagctaaaggctccgcctgctacggtgccacagccgccagggggcccaagaaatccagcaaccacacgatagganttgaaaattnngcatcaaattgccacggaaanaatgtggaaa

SEQ ID NO: 24229 - DNA, 665 bp, Triticum aestivum
  unsure (1)..(665): unsure at all n locations
  Clone ID: PAT_TA_24229
ctcgtgccgctcgcgccgcgtgcggcgccagcactcgtttctccacacaatcaatctttaggggtggttaggagagataatctattaaccctcgtgtctgctttatttcacctttatctcgcaagtcatcaacatccaaactcaacagaatcgctggttagacaaaatgtggtggctacaatacttggtcctgcttacttctgtttcaaaacccgctgctgcttctttccaaaaatgggacattgaaaaaggcgcagcctgttcgcaaaccacatggacggcgagtggattaaaaagtgtccaattgagatattgcgacaggccaccaagtccagccagtttaaaaaataccaagccatcattacaggggactcttctattccgatgagaggacgttcatatactttcttccgcttcctctaacatcctcttctaacgaggggcatcgatagcgagtattacatggccgtggactcggattgtacctcctatntcggaaaattgaagaaccagaacaaggcaatcgtcatcanaatacatacggaactncactgaaggangngatctagcatanntactactttggaatagtagacggaatacaaatgtataggaccagtatctggcaacaatgtntaatactgngnaanacgataagggctttt

SEQ ID NO: 24230 - DNA, 642 bp, Triticum aestivum
  unsure (1)..(642): unsure at all n locations
  Clone ID: PAT_TA_24230
aaaagccttatgttctccctgtcccttttatgaatgttctgaatggaggatcgcatgcaggcggacgcttggcttttcaggagtttatgattgtcccctcgtcagcaccgtccttctccgaagctctacgtcagggagctgaggtataccaaatactaaagggtctcgctaaaaagaagtatggtcaatccgctggaaatgttggagatgagggtggtgtcgcaccagatatccagaccgccgaagaagcacttgaccttatcactgatgccattgaggctgcaggatacacaggtaaaatgtttatcgccatggatgttgcatcgagcgagttctacaaagaggatgccaagaaatacgatttagactttaaaaatcccgaaagtgacccaacaaaatggttaacttacgtcgagctcnccgataaatatcaaactctggggaaagacatacccaatcggcaagaacnaagattcatttgctgaggatgaccgggaacccggggcctctcttcagtctcactctgcctttcgccgtggccgtgctgctctggcatgctacaaatccttgagctattctgacaccgcgccaggggctatggccctgccgtccccctgcgcccgtcgggaaaccggggggant

SEQ ID NO: 24231 - DNA, 817 bp, Triticum aestivum
  unsure (1)..(817): unsure at all n locations
  Clone ID: PAT_TA_24231
ctacagcaattaaatccatattcaaagattcatcatgctttccctctacgatattagtgtacccgttttcattcgaaatcttgagatcctttccacactcttacacaaggcttccgcctgccccgatgtttcagacgaagtactggtcaagagcaagttgatttccgacatgggcgacttaattttccaaatccatgtgataacggacttggcttgtggtatggcaagcagtgcaggcaagatcgagctcacagaaatgccgagaactgagaccaacatgaatgaattacaagatcgtatccaggcaactatcaaggcgctgaaatccgtcaagcaagaggatttcgtcggcgaagaggaggctatttctttcacgaaagggtgatttgggtaattccatttgtcggaaaaacttacatccaggaatttcaaattccgaatcattacttccatttcgttactgcctacaacttactgcgcaaggagggcatagatatccggaaagaaggactacttgggcagctcataggatcctacctgtgcctggggctcggggcctccttggcctcgttcgtggttcccacctgtggctttcctcgctaatggcgggctacattctgggggactcggccctgggcggcactctgggtggtgggaaattctgggcctgccantgtatgggcaaagtttcatgtgggatgatanactattgcaatcnaatccccctacnaaaggantgcngcaacatgtggcaaaanggaaatnctttgtcaaaatcaaatcctgaagccttaaaaancccaagggngcccaaggg

SEQ ID NO: 24232 - DNA, 590 bp, Triticum aestivum
  unsure (1)..(590): unsure at all n locations
  Clone ID: PAT_TA_24232
ctcgtgccgaattcggcacgagatcggacgtcccgaatctacaataacattcctcacgtacaccattatgcatcttggcgccgttacacttgcctttctagctgcaattgcaagcatccatgccgccaaaaacgaggttgaaatacaaattgatcatgctgtagaatgcgaacgcagatctcaaaaaggtgacaaagtctacgtacactatcgtggcagcctcaaggacgggggaaaagaattcgataactcctatgaccgcggtaagcctttggactttgttgtaggcgaaggacatgttatccaanggatgggatcaaaatcttttaggaatgtgcatcggtgacaagaggactcttaccattcctcctgaattcggatatggcgaccccaaaatagggcccattccatgcttcggagcaactttaggattcacaaccggaattggncggtatacaaagggggtagaaagcaaccganggccaaagggctccaagntcctacttcaaagaattgtcgacaaaggttgtanagtcctggtaaaancggaaannaacnggaagccaaaaagntttncaggggcnaatttt

SEQ ID NO: 24233 - DNA, 678 bp, Triticum aestivum
  unsure (1)..(678): unsure at all n locations
  Clone ID: PAT_TA_24233
ggtcctcctctgctgccccaagaacgccgccggccgccggtctgccaccgctgccccaagaacgacgctgcctagaccgcatggccctggccatgggggatgccgccgccgcctggcctcatggctgcaggtcccatggttgttagatctaggccacacatgagagtcaccttggcagactggcgaccgcgtggtgccgagccggaaggaggcatagggcagcacgtcaccgcatcatgggtgcacaaacggcctgcaaggtgagtgcccaagacatactagccagtgctgtcaccggggacatgtacgcacgcngcaaaccaccgttacctcaggtccatccattcattgtgtggttttgagtaagtatgaaattccgtctctttccatagatacgaacacatgcttcgttctattttcaggatatttattcggcgttcgtggntaattcaaggaggctctgtttatcaggttatatncagcaacatcaagtgaacacaattctccccaatccttggtacaagcttaataatatgtgttccatccaatttgaacatcgatctttggccacnacantcatgaacgggccataatgtaccaatatgtcaattcccctcccatagnagntgnctcacactacactnaggcgtgngttaanttgantacttggtnatgtng

SEQ ID NO: 24234 - DNA, 590 bp, Triticum aestivum
  unsure (1)..(590): unsure at all n locations
  Clone ID: PAT_TA_24234
ttttttttttttgacggaaagaccttcatggctagctctatattaaactcaaataacactatcatcgtctgctaaaagtttaacaatataactcggaggtgcatccatccaaacagttggattgttcgcacggccccactctgctagcacgtgagccactgcattagattctctattgattacaatgctcaatagtagccttcccgcctgcccgggcggccgctcggcaatcatcaagcaacggagctgccaccatagagtaaccctcattgagacgtanagcttagaccacaatgatattgtccataatcacttatacgctgttgcatcccagggtttggagtagcctcaatccttcatgaagtgccgcagcttctgcaagacacaacatctgctacatgttcaatttgtgaggtagaaccagtaatgaagtaacctctgtgatctctaacaattgcttcgcatgacccggagtgggagccctcgatgaaagaggcgtccacattcagtagtagttgcagggtaagactgggggccatatgtcccccctgggaataggagttcccctcgtgccgaattcggcacgagct

SEQ ID NO: 24235 - DNA, 638 bp, Triticum aestivum
  unsure (1)..(638): unsure at all n locations
  Clone ID: PAT_TA_24235
cccgtcgactttaangacgccgtggcgctcgtgccgaattcggctcctggtccgccccgcagatcgctcagatatcgcacaagcatcatcacagctatctctccaagttaacgctattaacactggatttttgagcatttttcaaaaaaccaaacttcaaaatgaaattaatccacattgtttcatcggttgcacttttttgtcttccggcattagctgccaacgattgggattgcggagaagttgttatccacgcgagtccactggaggtgctgatgcaagacgtcgccgataaacgcgaaagaacggatgaaggctcgtttaccgatttcccaccagaccatttttttagagtcgagcgctatggtgatgatttaggtcttccacgggctcaattccaaattgaatttaacaacttgtatcaaatcaggtttgttgcaatgaaagttgataacgaatattttaaatgccatgagaaacagactaggaattagtttaactgctcttgtcggattacttttacaagcaagcacaaaaatgggaaacgggctctttgtaactatcaaatggttgtgtgatgcatagttttaccaatacaataactttgctctgagaaaaaaaaaaaaaaaaaaacaaat

SEQ ID NO: 24236 - DNA, 475 bp, Triticum aestivum
  unsure (1)..(475): unsure at all n locations
  Clone ID: PAT_TA_24236
ctcgtgccgaattcggctcgactgacgctgaagcatcacgaactaccgccgataactccggcggtcgccgttccccgatggacccctcttcgtcctccgtccccgcggctgcggctgcggagggggcgcctccggcgggggagaatctggccgtgttctggcacgagggcatgctggcccacgacgccggccgcggcgtgttcgactcgggccgcgacccgggcttcctcgacgtgcttcgaccaccacccgggagaacgccgaccgcgtccgcaacatggtctccatcctccgccgcgggcccatcggcgcccttcctctcttgggaatccgggaccccccgccacgccagcgagcctccgccctctctccccccataattgaggactccggacgcgcgcgcgggtggccccgatgggtcccaggcatttcttaaacccnggtnatgggtgctgcctcnggtgncggaaaacct

SEQ ID NO: 24237 - DNA, 483 bp, Triticum aestivum
  unsure (1)..(483): unsure at all n locations
  Clone ID: PAT_TA_24237
cacagtgcgatctctcacaacatggcgccaacgactgcgactctatcagcatctgttccacctccaacgcggaacactaaaaagtacgatcctaaaagaccccatatcacagaagaacccattactcgagacaattggtacaaacatgtcaattggctgaacgtcactttaatcgtcggacttcctctatatgggctattccgccgcagcctgngacaccattaaggttaaagacagccgtctngggccatagcatattattttatgacagggcttgggaattactgcagggataccaatcgtctttgggctcacacatcttatcccgccaagcctccctcctaaagatttttctcgctgccgtcggtggcggtgcggtgcaaggttcgatcagatggtgggctagagaccatcgcgctcancatcgctacaccgatncagataaaganccctactctgtacgaaaanggcttttatactctc

SEQ ID NO: 24238 - DNA, 499 bp, Triticum aestivum
  unsure (1)..(499): unsure at all n locations
  Clone ID: PAT_TA_24238
acggcatatggttctgttatggcggtggctttggttaccatgcctatggaaggcctcattggccgaggagagctcgggtaatttatactcaactcaagaaagggcagagatcgtggacgggagtcgagtcgatacagacttggaagttgcttgacgatgaaaacctttccaagatcgatgagcaggttctctggagagacagtgacgatgactcttaccagagtgtccacttgtaagctccggacactaaaagatctctttgtatgttgtaaacatgtttgataaattacaatacatcaaattggtaggtttgatcaaattagtcatggttggccatggaccaaattagtcatcacctgtatatgatactgctgtatcttgttcatatgcaaatcccttgcttgggttgttgaaaccagttctgaacatgatgtgaagaggtaatttgtccccttgatgtggcagttagcctgaaaaaaaaaaaaannnnnnnnnnnng

SEQ ID NO: 24239 - DNA, 642 bp, Triticum aestivum
  unsure (1)..(642): unsure at all n locations
  Clone ID: PAT_TA_24239
gagaacgccacgtggaatccttcagttatatcatttcaatcctctactcgccccgtattcggccccggctcagattttcccagtagaccttctgtcccgccaattgcgtcactatatttggaattcgatttcgcttagtgagcttaatacatcattatgtcgttattttctccatcaaactcacacaaaattttaagcgtcacgatcttgacaaagatcctcaactcctgtcatgcctactgatggaatttcacccatgttggggcaatctactccactgaagcttcgtaaatacgaaggtcgactgagtgatgacaacttccgaaaccatgtcatagctgccatcggcgagtcctccgggaccactttgttcctcttttatggattcctagcagctcatgattatcaacagcaaacctgacattctttcggacgctcctagtctactccagttaatattcgttgcttcagcctttggtgttagtggtgcggtcaacgtctggctattctaccgagtcagtgggagggcatctaaacctgcaatcactatcggtcttacactgataggggctcgtgccctggcgcctatgccgcttcattccccacggccggttcaacctgtctggggggcntaccaggtcc

SEQ ID NO: 24240 - DNA, 563 bp, Triticum aestivum
  Clone ID: PAT_TA_24240
caacaacctcaacaacaacagcaacgccggagccgtcccactaaagattacaataaaacacctgttaatcgacgagctacgatggcacctaccaaaaaggcaaagaagactgccgacagcattaacagtcgtctggcacttgttatgaaatcaggaaaagtcacacttggatacaaatcaactttaaaaactctccgttctggaaaggccaagctagttattatcgcgggcaacacccctccacttcgtaaatccgagcttgaatactactctatgctctccaaaactaatgtgcaccactttgctggtaacaacattgagttaggaaccgcttgtggaaagctattccgctgctcaacgatggcaattcttgatggtggggactccgatatactgtcaggtcaaaccgcataaagtgacaccaaggtattgtcgtttcatgggcagaaatgccaagggatcgtgtcaaattgatgaagcggagttgtggcccgataaatggattgtggaggtatgtatttaattttaaatttaaatcatcatctaaaaaaaaaaaaaaaaaa

SEQ ID NO: 24241 - DNA, 634 bp, Triticum aestivum
  unsure (1)..(634): unsure at all n locations
  Clone ID: PAT_TA_24241
gtcttatcggattcacaatcttatacaatcagagagcagttctctatatcacttgatcttcattcccattctcctactgatatctcgttcgcaacactcgagacagcacgatctctttctcttcacaaccttatctctcacgccatccacttgaaaaaattcatactaggctctcgcggagttaactgactttaaattcaagatgaaaacttttcaaattgctcattttgttgcagcacttagttttttgaagccgacagctgttgatggtcgtttttttagctgtggtattacaaatattgaagacgaaaatgttgctgacgttgccggaaatctctggacttataaactcggccaatttcagtcggacagtcaaggttcttttcctcaaaaagtcggcaattctgaatatggagaattacgggaatttccattgctttatggtggcaatcactgggatcatggatcttttatgtattatgtgatatcaaacaagagtgcagaggccctatacccctggtccacggggacgtatgggggtgtagaggccgacatgttgggcccttagaaggacggtaggttgttggcgtggtacaattagatcggcacggggccgtncnatcnctaaggagcc

SEQ ID NO: 24242 - DNA, 499 bp, Triticum aestivum
  unsure (1)..(499): unsure at all n locations
  Clone ID: PAT_TA_24242
tataaacaccgccatggttggatggtgcggtggtacatcgtcttggccggtctgccaagtagagtctggatagcttggacacatatcccacttgagacagtagatcgctggttcgaatccggcaaaacacaaccacatttctcgcggcgctggtatgcatggatgacgaaggcatgcttggataaccaaaggtttttaaattccctttggtgggtactaacggaggagggtcgactgtttgtgtaagcgaacatacctcatagtggtatttgcaaatgaaatccagagtatgagtgtctctaacgtcaaaagagtcatcccacatgtatacatagcgccggtcatgtgtcatagctagatagctgaatacacattaaatgatttaaaaaaaaaaaaaacaaactcgagggcgggccccggtanccaaattcgcccctatagtgaggtcgtattacngcgcgctcactgggncgtcgttttacaancgntcgngaactgg

SEQ ID NO: 24243 - DNA, 794 bp, Triticum aestivum
  unsure (1)..(794): unsure at all n locations
  Clone ID: PAT_TA_24243
tgaatatttctaaaacaacccaaaaacttggttctatcttgaagcaaagtcgtcagagcacatttcgatcatcgttctctggngcaggaaagatatcatctgctcatggngtacaacataccttgctctgcattaactcacctacgaacgccatcattagacgacaatatcacgaaaaagtacttgatcattattctcgacctcgaaatgttggnagcatgtccaaaaccgacgcagatgtcggcaccggactagtgggagcgcccgcatgcggcgatgttatgaaattacagataagggttgatcctgccacgaaaaagatttcagacgtcaaattcaaaacttttggntgtggatcaagctattgcttcctcatcataccttactgaattagtgagaggaatgacgcttgatgaggcaggtcgagttaggaatacagaaattgcaaaagaactatgtcctcctccagtcaaacttcattggtctatgttagcggaggatngctatcaagtcctgcaatctctaactactacactaagaatccaaatgcgtccccgactaatcttggtggaaccagctcgaaacttccacacatcgaaagagaaaaccgggtagatccangcactatagtaatgatttggntgcagtacaccttgttcagatatgagtttcatatcattagcattcaaactgcatgtantancttangagaagattgtggagtaacttaatttattagtggatcgantactattagatatctattttaagttcttactgtgggttctacaaga

SEQ ID NO: 24244 - DNA, 716 bp, Triticum aestivum
  unsure (1)..(716): unsure at all n locations
  Clone ID: PAT_TA_24244
ctcgtgccgaattcggcacgagctcgtgccgaattcggcacgaggacaatccggcaacaaatccagctcttcaaaatgccgttcaccaagctggtcaagaactcggcgtattatagtcggtatcaaacaaagtacaagcgccgtcgtcttggtaagaccgattactacgctcgtaaacgcctcattactcaagcgaagaacaaatacaatgctccaaaatacagactagtggttcgcttcaccaaccgtgatatagtcatgcaaatcgttacatctgaagataactggcgatagagtcttcagctcagcgtactcccatgagttgaaggcgttatgggaataaagcacggccttaccaactgggccgctgcctactgcactggactactgatcgcttagacgaactctaaaaaagcttaagccttgacaccgagtttgttggagtccgaagaagcagatggagagtacaaactcactgaagcttccagaagaaaataatcgacgacctttcaaagccaatttaaatgttgggccatccccactctccgctgccgcccgtcgtgttcggtggtgcgtcgggcgcagcagaccggcgcgctcggttatgccccacgccgggtgtcaggattccctcgcgcgggtccgcngacttattccgcgcccctcggatatggacttncntgcaganagntnaatccntcagtaatgagggatta

SEQ ID NO: 24245 - DNA, 481 bp, Triticum aestivum
  Clone ID: PAT_TA_24245
tatttttctgttatctggctcgttgctaacttgaatacttacatcaagaaatgcatcgttgtaactttagattatgtggagtgtgtagggtgataagcagtgttcccaatgtatttgtttgtcttgacattttaatagatatcaaagaggagcagaaaattcgtgacaagcttggggattacctatactaatatctgatgcatcaatacggagaccaatgagcgtacacgcatatcatctgcagttctgcatagcaatatgattagagggagtaccagcatgtcctgcatactggcacaaggcgttaacgccaaatctgtcagtgagtggttgagttttttttagcttgtaccacggcaagctaaaagaacaaagtaagaatagctgcttcttgaggaacatgatacgtaagctaaagcagttgatgtgtagcttttcccttgataagtgagattcaacgaactgctactatttatgtttt

SEQ ID NO: 24246 - DNA, 641 bp, Triticum aestivum
  unsure (1)..(641): unsure at all n locations
  Clone ID: PAT_TA_24246
ctcgtgccgaattcggcacgagccactgccggtcatgtaggttcttcctgtcacgtaaaagatttcaaattcaaattcccgattgagcttgactgggaggactttacgactcaccaacaaccatacaaaatcgaaggactgggtaatggctcaacctcactttagtcaaggacctcggccgcgacatctacattctcaacttttcgacacattccaaagacggcgcgaatgaagatgcctcacccagacaacgaacaatgtacgacaaaagctggggcatcgatgcctcggttttgagctctcgatttcggaatttcagccctctcagatgggggttgagcgcaatgcaggggagaatttgggaagagcgatctgtgaatttcaacaggctgttggcacagttgggtcnggtactggatgtgcttttagaagtggtaggtggatcccacacgcctgtttaaggggacaccgcgctcgtctgaaaagacacaggagcaatattgaggttccangaaggnttccccaataatggcctgggtatgggaatgctcctcccatcaccgngtancaacntgagnaacnttcggaancagcacaaanggtttctggaatggaaattgtncaancccaaggtncagcat

SEQ ID NO: 24247 - DNA, 1052 bp, Triticum aestivum
  unsure (1)..(1052): unsure at all n locations
  Clone ID: PAT_TA_24247
ctcgtgccgaattcggcacgagctaaacctaaacctaaacctaggtcacctgccgccgccggcccctgacttgccggctgggctcctcgcgttgccgcctctcccaccaccaacggcgcctcccaaagcaggagatccaccgtgaccgaagcaggtcaggcggtggccctggcgcacctagatcggccagcgccttccgacgtcgagctcctctgctcccagcgccagatccacctatggctccatctccacaaccacgcaccggcagccgccatggaaggtgctctatgtgcttgcttcctcccttcccggggacgccgctactctgatgccatgggacaaatgattacaaaaggttgatgcaaaccagctccaagaatgagctcaaggcatagaggaagaatgaggaggaggagatgagcacacttctgaaccactacctccatttctgtgcagttctagaaggagctcaaacctattcctcatgcctctgaatttcctttttcttgtactggataccctctcgtccttcctctccgtacctctagccggcctatcttcgcgctcgtgacctcgactcgattgtggtctcagcgagcacttcgttcgtgtctactcattccccaaacccgctgagtctcctatcactgcctccaccgcctcgctactcaagcctgtttgtgccatttcgttttgtaacttctggtttagtctgcttcaagtggagatcntcgtaaactttcagaaantcatagtcacgaaaattgtaagggattaaaaagggggtaatgggaaaaattgcatttcttcctaggccttaagnttggccctttccttnggcgcccctaactaatttaacattntttntcctaatttgggttnnggcaaatttaactaannggaatnggtccancttcttcctaatcctaaanattttncattaacttnnggttcnttaaattatttnctacnaaattcnacancgaanatttggttcggncggganntangtgcnncntttnaaacctgnttggggtttcntncgaaaaang

SEQ ID NO: 24248 - DNA, 700 bp, Triticum aestivum
  unsure (1)..(700): unsure at all n locations
  Clone ID: PAT_TA_24248
ttacgatccagtaacgctggagcgtgagagagcaccaaggcggataacttctagcaaagatgtactagatttttgtattcaatgggttcttgagaaccccggattatccaaattggtgaaacctcacgtggtgttagaacctagtaaagctaggttgataacgataactcccttcgcaagtgtcacgtatacaaggcgtgggtgcccatctattgagtccctgtcttccgtcagagatatcagactaaagtctgggtatgacgaaggacaaggcacttggtgggaaccttttccacaaagctgcatcctcaaggatacaagtttggggaaaaggtatggggnttccccgcccttgtcctactggatatgaggaaatgccacagttctccacctcgctccgctccgctcgccgatccgggagggaattctnggggatttaagtgacatcgaaggatccaactagcctaatgaaatnggnanaacctccanaatcttcaanatatgtggtccctnccatggggtcnccgtaaatagtggatctttagactcaaccgtatttatgggcgnntctcacaagcaatctaactcacaagcattcgaccaaggcggtaatgttancatgccgtgacatttgtggangggataaaccctcaacttcaggggccaacagnanggaagcgngactaaccnatcantnatg

SEQ ID NO: 24249 - DNA, 613 bp, Triticum aestivum
  unsure (1)..(613): unsure at all n locations
  Clone ID: PAT_TA_24249
ctcgtgccgaattcggcacganctcgtgccgaattcggcacgagctaatactcccttgactttgtcgatggggacgttggacatagaagtattatcaccatttattcgccataaacaccaagaaatcttttcattaatcatctatcgggtctcaagtcataagatcgagcagcttgccgagtcgagaccaaagtctatttgtgtgagcacgaaattctctaaatgaagtttctcaagcgctgcctccacggccgccctaagctggcctcctattactggtgcctactgcgcatggagcatcggatttcaaaatgtagtgggagaccaagaatctcngccatatccgcancttgntaggttggttcatcaccgtgacctcaataaagcgaaatctggcgatccaagtaggtcccgacggcaaagcatgcaangacatatcgatggggccctacgccccgccatgacggggagcacacttcacttantggtncngctcattcttcngatctatgagagtcnntngggttccgtttgacccgctggactgggacnagncctacagagggtactntngacactttgcaangttacangnggtnagaangganttggc

SEQ ID NO: 24250 - DNA, 557 bp, Triticum aestivum
  unsure (1)..(557): unsure at all n locations
  Clone ID: PAT_TA_24250
caggcaccgacggatttggagcagctctgatctttagcggccatggtcaagaaaggaatccagtatgtcgtggtggatgccttcacggcccagccgttcaagggcaacccggcggcggtgtgcttcctggaggacgacgcggccgcccccgcgggggacgggcggtggatgcagtccgtcgccgtcgagttcaacctctcccagacggccttcttctcccgtgactcgtcctgcgcagccgacgccaccacgccgcggttccacctccgctggttcacccccgtcaccgaggtcgcgctctgcggccacgcaacgctggccaccgcccacttcctcttcacgtctgtcctcgcggagcgccatggcgtggttgagttcgcgaccaagtccggggtcctgaccgccaagaaggttcctgcaccggaggccgaggaccaagggaagctgttcattgagctggacttcccatgagtgattatgtgggtttgcgattccgccgacgagctgccgtcaacccggagaagctcaaaggngcgccccgtcgtcaagtgttcaaa

SEQ ID NO: 24251 - DNA, 615 bp, Triticum aestivum
  unsure (1)..(615): unsure at all n locations
  Clone ID: PAT_TA_24251
cccgccccctcccgttctcgcctcgggacgacaaccacgccctaacgccgtcaacatgtcttcatctacgcaaattgtccaatgtttcgggaagaagaagactgctactgcagttgctcagtgcaaggccggcaagggtttaatcaaagttaatggaaagcctctggaacttgttcaacccgaaattctaagattcaaagtttacgagcccattttaatcgttggtctggacaaatttgctgacgtcgatatccgcgtccgcgttaccggtggtggtcatgtatcacaggtatatgcaatccgacaggctatcgcaaaatcaattgttgcctactaccagaagtttgtcgatgaacactccaaaaacgagttgaagaggtctcttgtacaatacgatagaaccttactagttgccgataacagacggtgcgagccaaagaaatttgggggacccggtgccaaagcaagggaccaaaaatcatatccttaaagaatggcgcaaaatggggggggctgggtcctgggctccgggggcctatggggagttgcctgttgcncaatgtttgggctggnagataaaaaggttcaatgatttttataaaagatancaacttc

SEQ ID NO: 24252 - DNA, 895 bp, Triticum aestivum
  unsure (1)..(895): unsure at all n locations
  Clone ID: PAT_TA_24252
gccggccgggtcgggctcttgactctttcttccctttcctctcgaaccatgcaaaagcgacacagggaaatcgcgtgtccattaggtccgcccacgcgtccgaacgaattggacatcgagaggaggacgtccccaccggaccaagagaggagaacggtcatcctcgacgacgccgccgccgccggcaaggagttcgatttgttgaggggagttttggatgggggaccatgtggtggtgaatgtggacggttttgcgaacaccaaggatgatggcgttgctgagaagccatctgaggctgtgtcggtggctgttgttgatatggcggaggatggtggcgaggatgagccactcatccaggctgcagagtgccgcatatgccaggaagaggacagtatcaagaatctcgagaagccgtgtacgtgcaacggcagtctgaagtatgctcatagagcgtgtgtgcaacgctggtgcaatgagaaaggagacattacatgtgaaatttgccatgagcaatataagcctgggtacacagcaccaccacgtgttcaaccagatgagaccagcatagatataagtggggattggaccattacaggagctcctctggatatgcgtgacccaagaattcttgctgtagcagctgcacagcgtcgtcttcttgaagcagagtatgacgaatatggtggtactgatgctaatggtgctgcattctgtcgttctgctgcactcattctaatggccctgttgcttctaaggcatgcattgtcgatctcggacaatgaaggagatgatgactcttctaccatgttctctctttttcttctncgagctgctggatttctgctgccatgctatataatggcatgggatcttcagcattttgcatcgccggcg

SEQ ID NO: 24253 - DNA, 1558 bp, Triticum aestivum
  unsure (1)..(1558): unsure at all n locations
  Clone ID: PAT_TA_24253
gtacgagcagctttcttcccttgactcgcgagacattacatgcgaaatttgccaagaccaagataagcaaacggccagtgcatcaccaccccttcccaaagccaaggaatgcgaaactcagaggacggggccgaccctggcaaaaggtcctccgggaccacgcgacccgcgccggcatcctctacgacgtggtcagggtcgtcgtggggagggagggatgggggactatgtggggactgaatgtggaaggactgggttgtgaccgtggatgataagccttctgaggagctttctgcggctgtggcggacattgttgatgatggggcggaggatggtggagacatcgaggagcatgatcgcgctgtttagccgcccatccagctggaagagtgccgcaataagaagtaatggcatcaatgttcagcatattgcagtcccggagtcagtgggaagagccggcgtaaataggcacgtgaaatgtgacatgaaacctgccatgagcaaaatgccgtcagcttaagtagaacctccccccagccacccaagccagagaacagcatgagccacacgtggagaaatagctgaattacccagagctcccagtggggattggacaatctacgcgtgctcctctgggtactgctggacacagtgattcttgttgtagcagctgaacaacgccatcttgttgaagcggagcacaacgaactacggtggtactgatgcgattgatgctgcattctggcgttgtgcctcactcagtctaatggctctatttcttcgaagacatgcattgtcgatctcggacaaagaaggagatgatgactcttctaccatgttctctctttttcttctccgagctgctggatttctgctgccatgctatataatggcatggatcttcagcattttgcatcgccggcgacaaagggaggaagcggcctcaattgccacggcagaggtagcattcatcctgcaatcagcccagggccgtgcccttcagtttaccatcgctccagactccccaaccaccccacagcatgagccacagcagcagcagcagcaacagcaatagctaaacgacccagtagttccacaagtactggcataatgcgtgcttgaagatgtaggtctgggtgcctattttgctgttggtgctggctcctcaggaatgctaggaagccttcctgtggccacgtaaaaacctcgtatggtgtcagagtcttatttgtctcgagcaatgtgactaaacctgtgtgtctgaatgtaatttaagcattgatttaatgtaaatttaacatctattacctttactattttggtgcaacccgagtcttgtgcaaaaaccgaaaacgttctccggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagngtaaagcctgggggggcctaatggagtgagctaactcacattaattngcg

SEQ ID NO: 24254 - DNA, 769 bp, Triticum aestivum
  unsure (1)..(769): unsure at all n locations
  Clone ID: PAT_TA_24254
tcccaaagaaggtttcgtacaaagagttgttgtgtttgtggatacatagcataccacagctcaatccatggcgaaatgctggctgatgctcctcttcttggtgtttctcctgccggcgacgagcgcgacgtcgtgccacgccgacgacctccgcgcactgcgggacttcgcccggaacctcaccggcggtggcgtcatcctccgcgcagcgtggtccggcacctggtgttgcagatgggaaggtgtgggctgcgacggcggaagtggacgcgtcacaacgctgcggcttcccggacgcggccttgcaggacccatcgctggagcatccttggcgggcttggcgcggctagaggagctcaaccttgccaacaacagactgatcggcacattcccatcgtggattggtgagcttgaacaccttcgttacttggatctctcagataattcattaattggcgaggtacccaaaagtttgatacggttcaaggacatcaccatcgctggccgctcactgggtaaggctttcaactaacatgccattatatgtgnaagagtaccagaagaacactccaacaacaacctcaaccaaatacaatatctgggaccacctactccgtcagggctgcgagctcctccggggtttctgcgtctgaccacgctaanacaatttccggananacnttctaccgtatgaaatacgtattgganacattctatcgganaantnctacngaaanatgcgntcgaacaaatagtnccgagntcaact

SEQ ID NO: 24255 - DNA, 517 bp, Triticum aestivum
  unsure (1)..(517): unsure at all n locations
  Clone ID: PAT_TA_24255
gcagcatcgaatcccaactaaatctattcacattcgtggtttttaattaacttccctacaaagatggcagacttccaagacattgcacgccagtttacaacgttctactatgatgctttcgacaaaaatagacaagatcttaagccactttatagagatgtctccatgttcacttttgaggactcatcaatattggggctcaaacgctatagtccgaaaaactaacctcacttccattcaaggcaagtcaaacatggaagtagctacgattggatgcacagccatctgggagaaaatggacagatcattattttggataaccgggaaaattactggtcgatgaggagcaaaaacctttgagctttagtcaagcattccaagctttaccgcgatggcgcaaggaagctacttattttcaacgacatcttcaagcttgtttaanggatagagcgtantacaaaggagaatccggtgtatttggattggtaaaattcgcgaaagncctcaactgaaagcn

SEQ ID NO: 24256 - DNA, 723 bp, Triticum aestivum
  Clone ID: PAT_TA_24256
ctcgtgccgaattcggcacccgacttagtgatcgctcccctcgaagtaatggcgatcaagcacaatcagcaaattcctcacaaccatttccgaaaggattggcagagacgtgttcgagttcactttgatcagcctggtcgcaaacttcgacgccgcaatgcccgtcaagcaaaggctgctgtagtcgcaccaaggcctatagacaagctaagacctatcgtcagatgcccaacaatcaaatacaaccgacgtgtgcgcgccggaagaggcttcagcatagctgaattgaaggaggctggaataccccgcaagctggcaccaactatcggcatctctgttgacccccgaagacaaaacttgtctcaagagtctctcgctatcaacgtagagagactaaagacctaccaatctcgaatgatactcttccctcgtaagactagtaaaccgaagaagggtgacgcaagccaagaggaaataaacaagcgcaaagaatactgtatcgaatttgaggactagcatcccaataaccacagtttctggaggagtaagcgagatcaaaaagagtgaaatgcctgagcctgtccaaggcggcgcgttcagaaaattacgggatgcacggtgtgatcccaggtgctcgccccaggggggcatgcccgcccgtggtatggcccaggacgcagctcccgctacgaagtagtgatctcgcgccgaattcggcacgag

SEQ ID NO: 24257 - DNA, 602 bp, Triticum aestivum
  unsure (1)..(602): unsure at all n locations
  Clone ID: PAT_TA_24257
ctcgtgccgaattcggccccgggccgcattcggcgcgagcttctaagtatcttgaaagattcttggaagtcaaatacgcacccaatatttagcaccattgctcatcacaatgtctgtgcctcgacaccgactactccaacttttgaaggtccaatgcagaatattcaacaccacgtacaatcctgatggactacgattgggaaataaagtcttacggcaacgattgaggggtccttcagtgatggcttactacccaaggaaggttgcaacacttcaggatatgaataggtgttttccagaatgggagacccctaacgaagaagaagaggaacggcttgaacacctgagaatcgccaaggctagaggaaaagctgcgcctaagaagaaaagaacttttgaagattcaaaaaaattttaaggggaaaaaaaaaagtaacctctatcctctattttacacgataggacatcctaataatgcttgccaactcaaccggaccgactgccctatccttgcctgtttacgtggtcttgaaccccaaaagnactgcacccnacttagggctaannatttgtaanatgtccaatttcagaaaaaaaaaaaa

SEQ ID NO: 24258 - DNA, 599 bp, Triticum aestivum
  unsure (1)..(599): unsure at all n locations
  Clone ID: PAT_TA_24258
ctcgtgccgaattcggcacgagaagctaccctcccctgtttcgccttctcttctcaccagcaccaccgcgcgcgcgtctgcttcccatcgcatgccaccccctgctctctgcgccacctccgccgcccgactgcgcctgctcctgccgtccgccccgtctgcgctcttcctccgcgcagccgctgcttctgccgccctcgcgccggcgaagcagaggttattgttctcgacgacggcgacgacagcaggcatggcggcggccgcgggagcgaaggcgtcgacgcagccggcggcggcgggcgggggcgtgtcggagcgcatcatgccgcatctcctcaacatatacggatcatgcgccacggcgcgggacttcgagatgtacgcgcccaatgccacattcgaggacccgctcatgcgcgcccacggcgtcaagcaggtcaaatcaagccttctacaaaatgccctaaagtattcggggagtccaaatattcggggacgtcacgaaaaagccggacggcgacccccaccgcgggtgaatccccaatcctgagccctcgacagattcactganncctcacagctcactcangaggaagtct

SEQ ID NO: 24259 - DNA, 810 bp, Triticum aestivum
  unsure (1)..(810): unsure at all n locations
  Clone ID: PAT_TA_24259
tttgattacagattattttaccaaccgcttaaaatgtttgaaattttaatacgctagtccctgttgagatatttattattcttctgcgcagcgctctagagcgggggccacaacttttggncaacagaataccatacaatagagataggtgagtactttggctattatctcactcataaatattaattccaagagtttncctgcaaagctcaaactggcggatttgccaatccaattcacctccctaatctataagacctggttgggttccaagtccacacanttccccagaaataccccctttgggatttgatatgatttttcacataaggcttgctgaataatagcgtttatgctcactctcattaatctaggcataatctgcgccgttcgaaaggaaacttggaatgattagaggcacaaatccaggtttatttattcagcagcccgcaacggcgcgagtgtaaatttgcagtttgctgtggcctacaactttcttgatctgacccttctcttctaaatctttaagacaccttcgggcgagggatccgttaatttttaagcgatcaactagcgtggcgacagttactagacgataagactggacatctttgtaaagtttatcagacgtggctttgtctagaatgacgacgtgttgagccttatccttgactttgcccttggaccacttcttcttttgcttcttagctccagtgttcgcgggagccattttgtgttaaggggtgtgtttatttcgaagtggtcaagctccgatgtcngctcgtggccgaattcgggacnaggcgctca

SEQ ID NO: 24260 - DNA, 268 bp, Triticum aestivum
  unsure (1)..(268): unsure at all n locations
  Clone ID: PAT_TA_24260
ctcanctcacttccatgttccatctcatctcgcccctccctttccactatctccagtaagtttcggcctcgctttccttcccgaccccgacccagctcgcaatcgcaagccacacgcatcggggtttccctcagcgcaagcgatctcacctccctgnacccgctccctcctcncgcgtcacggtgtcctcacaagctcaccccgccgggcgggcggccgcaagcggcgcgcccccggcccccccccatggcggnccgcggncagtgga

SEQ ID NO: 24261 - DNA, 401 bp, Triticum aestivum
  unsure (1)..(401): unsure at all n locations
  Clone ID: PAT_TA_24261
ttttttttttttttgatttgtaaatcttttgtttactattatattgagtgaaggatatttacattgattgagattaatccctaagttccgcaattttagcctttacgcgctcagccttctcctccttagtgagtttgcgtcctttaaatttcagggattctttcttgtattcctctttcgtcttagcggctgattctccctctaccttcttgtagggatcttcccgngatttgccgatgtgcttcctcatataattcttctagcccgtcaagcttcaatttcactgtcaatgtaaccttggaactgagatttgtatcgctcttcatcgccatcaggctaaggtctccaatgtnttcagcaacgtgggccgccgaaatatatntttttcgtaagggtctcgg

SEQ ID NO: 24262 - DNA, 569 bp, Triticum aestivum
  unsure (1)..(569): unsure at all n locations
  Clone ID: PAT_TA_24262
ccaaagcttcctttgcaacaagaccttcggccatcgcctcaatcatgtctgactctgcgggagaaatcgaggtcgaatcggacaacagccaacaaattctcccaaaggaagttacggctgaaatcggcagcattaaactattcaacaaatggagttatgaagatgtcgagattcgagacatatctttgaccgattacatacagatacgcgctccagtctacatatctcactctgccggtcgtttcgcacaaaaacgtttccgaaaagctcagtgccctatcatcgagcgtctcacaaactccttgatgatgaatggacgaaacattggaaagaagcttatggcccgtgagaattgtatctcatgcatttgagattatttacattatgaccgatcaaaaccctatccaagatttccgttgacgctatcgtaaattgcggacctcgagaagacacgtactccgtattgggtccgggcgggaccggccgccgccccggcgcgcgaccttgtccccccttccncgggggcccccaangcaatttgcnctattaacnattggtgntcgtgaatg

SEQ ID NO: 24263 - DNA, 537 bp, Triticum aestivum
  unsure (1)..(537): unsure at all n locations
  Clone ID: PAT_TA_24263
ctccatcttctcgtgccgaattcggcacgagattcagaaagcctcccatctagagttcacagaatccaagcaagcctcaaaaacttcatctacaaatcttctcccaacttccatatttaaattccatcatgaagggaggatgcggatgttccggtgctgccgtctgccagtgtggctcctcgtgcacctgctctaagtaaaggatagccagatgaatcttctctcagctggctctccgtcgcaccttatcgattgatcgtgttgctatggaagcgatgggataagcccttggctatgggggatctaccttacgaagcgttggtccggggtgggtggttaagggaaaacataggggatacttgcggtggttaattggagattatcgacttagaaaaaactgttcaagccacgaaaaaaaaaaaaaggagattgtggggggggtccggggccccgtatacgacactcccgggtactatccgagggcacgccgcgatgatgtangnactttaaaattcaattgatgttggaaaaaaaaaa

SEQ ID NO: 24264 - DNA, 437 bp, Triticum aestivum
  unsure (1)..(437): unsure at all n locations
  Clone ID: PAT_TA_24264
ctcgtgccgcgtgccgcacgcgccacccggaataatccgacgtcgtaatcacttcagtcaaattaaatcggcgtggataagcctaaactacacaatggcgacaattaagcagcgcctcgccctctccttcatcaactttctcactacaagtcttgccgatggcacactcagcgagggaagatagagaatcagttgaangtagcgcaaacatgtatttccgacatcttcaagagtagagtcaaccgaaagcgcacccaaagacccagagtccctactacaaatttatcctgtgtacggtaaacttaaagagcaaaccaccganataatgcttccagaggttccggaacctccaatcaccaactcagacccccgggtggtgactaaaaaaaagaacangganttgaattcccagggaatncatnaaggggcaacaaaga

SEQ ID NO: 24265 - DNA, 671 bp, Triticum aestivum
  unsure (1)..(671): unsure at all n locations
  Clone ID: PAT_TA_24265
ttatcatctcacttctgacttcccattcgcacaacatgcattccaatcgcttgatcagctgcctcggaatttggttaatatctatcatagctgtggtgcaatgttttactaactacaattgtggaaatggtgtggagataacagcaacggaggctctaagagtccacggccaggcgatgtcgtatttggctgatgttgctgcaaatatcaggcccgcaattaaagttccatacagagggactataaagaacctacctacacccacttatttttgggcacataaaatccttagcgaaccatcagggtgaggtggtaagtaaattactttatgttgacttcaatcaacccggcgaatccttgatgattataaacactgggctgggatgaaggagattgggcgaagattgacacctggtggccccggacgtaaacaattcnaagttcgcaagcattttcccgcccctctcacaacgcctttggattccaaacantgntcaactgtttcaggcgatntcaacaaantcataaccccgnaactaaatctncaantactgaggaagaatttacaggtacaatgggtgcatggtatccagtagacanntntacagggtnctttggacctaanacccggtacggtgttnagtgtacctnattggtcnaatgtcgtncat

SEQ ID NO: 24266 - DNA, 597 bp, Triticum aestivum
  Clone ID: PAT_TA_24266
ctcgtgccgcctccggcccccaaattcgagcgccacgatttgctcaacatgcctccaaagtccggaaaaaaagtggcagccgccccattcccccagtctaaggctggagctgggtccaagaagccggccaagaacccactcatcgagaaacgttctcgaaatttcggaatcgggcagaacattcaaccgcgacggaatctttctcgtatggtgaaatggcctgagtatgttcgtctacaacgtcaaaagaaaatacttcatttgcgcctaaaagttccacctgctatcgctcaattccaaaatgtcttagaccgtaatactgccacaaaagcattccatctccttaacaagtaccgaccaagagacaaaggtacaagaaaactaagcgcctccttcttgaagctgagggcagtgagacttggggaacaaaagaagacgtcaagcaaagaatgccttcacaccgtcaagtacgggctggaaccacgtccgttgggattaatccgaaaacaagaaagggaacacttgttctcaacccaaaccgtggccgccccattgtgttgggggtccccctccccccgctctctggcgaaaagatgg

SEQ ID NO: 24267 - DNA, 607 bp, Triticum aestivum
  unsure (1)..(607): unsure at all n locations
  Clone ID: PAT_TA_24267
gagaactagtctcgagggttttttttttttttttttttttttttttttnacaaaactaaatcagcgcggcttacccgctttagaccgtcgtgagacaggttagttttaccctactgatgattgtcaccgcaatggtaattcagcttagtacgagaggaaccgctgattcagataattggtttttgcggctgtctgacaaggcagtgccgcgaagctaccatctgctggataatggctgaacgcctctaagtcagaatccatgccagaacgcggcgatttcctcccacacatcgtagtcggatacgaataggcctatggccctgaatcttagctagttggcaatgggacagcgggagaagtccactgtctcagctgacgccttgcaattttaccatgcgtgggggataaaacctttgcatacgacaaaactatatcagccgggcttgtacttagtagatcgtacttacaagtctgctctactttggttatgaccgcccgatcttgctttagtaggggcgggcgcccggctccccgagctccccccggctaggccgcgctgatttagttttgtaaaaaaaaaaaaaaaaaaaaaaaaaaaaaaaaaaaa

SEQ ID NO: 24268 - DNA, 586 bp, Triticum aestivum
  unsure (1)..(586): unsure at all n locations
  Clone ID: PAT_TA_24268
ccacattattcttcttgctgagggtcgcctcgtgaacttaggatgcgcgaccggccattcttctttcgtcatgtcatgctctcccccaaaccacgttctagcacaaattcttctattcaaagccgaggaccccngtattcgggcaaaaaaatacgttgattccggcaggccccaaaagctggaagttggtgtattatgtccttcctaaggattnttggttgaaacttgtagcttttactttcacttagctcacgtcaacgctgagctttcaaagctcactcacgttcaagctgaatatcctcggccttgatatcggaaggtccatacaaaccaagacttgtaccgctactaggaataaaaattcggagaccacctaaaagatggtaatgggaaaattgggagcactgcgattttgcagggagctaatttggttaacggagttcgaggataacattagtgatggaagacacttaaaagaatttgaatttagaccaagtatacaccattgtatgtcggaaatttttgaaaagatgacatacgaaaattggctttcacaacccaactcgtnccgaattcggcacgagcn

SEQ ID NO: 24269 - DNA, 783 bp, Triticum aestivum
  unsure (1)..(783): unsure at all n locations
  Clone ID: PAT_TA_24269
gcggtggcggtggtgcaagaggacgcggcggtggtggtgcaagaggaggtgcaaaaacaattgtggaacctcatcgccacccaggtatcttcgtcgcgcgtggtaaagaagatatgttggtcactaagaacctctctcctggcgagtcagtctatggagaaaaacgtataagtgtcgaaaacagtggccctaccaacgaagatggtaccccttcaacaaccaaaacagaatatcgcgtttggaatccatttcgcagtaagcttgcagcaggtgttcttggcggccttgacgaaatatttattaaacctgggtgccaaagttctatatcttgggttctgcctccgggtacctcctgtatcccatgtagcggatattgttgggaaccacaggaaccgtttttgccgttgagttttcccaccgctcctggccgagacttaatcaacaatggctacccaccgaacgaatgttattccaattatcgaaagacgcacgtcatccgctcaagatatagaatgttggccccgatggttgacgttattcccgcaagttccagcccaacccccctatgntggtttaacccaatattcnaaattgggggggatgnancccattaagcaagtttcaannanggaaccaaggtttttccggngtaaaattttntgggaaaaactttaaagtanctgacctttaaaatatgntttttcgcnantcccaancaaattgngnttatgggtcnccttaacccaancnncaaatttngggaaaggtncccttttttggggg

SEQ ID NO: 24270 - DNA, 582 bp, Triticum aestivum
  unsure (1)..(582): unsure at all n locations
  Clone ID: PAT_TA_24270
gtcttcacggattgagacaacgagcctcgcgcgcccaatccgcctccgccacatccggagacggtctctatgagggcttagagtggcttgctcagtcattgagaaaggctggtcatcaataaacgcaacctctaatttcctttgatcaataacattgtcaatgtcatgactattgaatgtctatatctcaatctcgcgtatcgaacactgactatacagcccatgaaaaatcacaactagttcagcagatgaatttgatgaggcgtaagggtgggtattacaccggaactgaagcttcctccgcctgatgggtagttgcattgcatgtagctggattctcaccgtccgtgtcttaattttcattttatttgcgtgttttttccgactgttgggcttcctacatccgggctttattacaatattgtgtttcaaccgggtatagggggcgaagatggaggaatgataacggtantttcgtcgggaaatccacantcaanataattttctccgtttcaaaaaaaaaaaagggggggnccggtaccaattcgccctaaagtgagtccgtaatacgcgcgctcactg

SEQ ID NO: 24271 - DNA, 629 bp, Triticum aestivum
  unsure (1)..(629): unsure at all n locations
  Clone ID: PAT_TA_24271
ctcgtgccgaattcggnacgaggtggacgccaaccaaaacccaccccgcccggtcacgcaccataaatactcggttgcctgccatccgacgacggacgggacggacctccttgtttctttctgagtttctttcctcgccaccccggccgcgctgcccatccatccatcgccgcgcgatccgtccatgacctcgcctcccactgctcctcccgcatctcactaactcatcgccatcgccttcccttggctcctcgatcgcctgcgtgtgtatataggcggcctgccagtgcgtgccgcccaggagcagaccgccatggcggtggacctgcagcgcctgcgccacatgctgctcgccaccggcggcggccaccaccaagctcgccggccggccgggcgcccccaccgccgttatgactgggccttgctaagcggccggcgcgacgggccaacaacttgggtgccagccgtacgcgggacgtcttcacgccgccgcccccgcagtatgcccggcccggaccgagtccccggctggcgcggccttgcccgcaggcggtcgngccaagaatactccgaaaannggagccttnaaagggntcctcgtgtcggaattctgcggcaagnnaaanagg

SEQ ID NO: 24272 - DNA, 460 bp, Triticum aestivum
  Clone ID: PAT_TA_24272
tcacaaagcagcttcatgaggagtcttcctttatctctaacccaagtcctagtgttgtcgttcagactatgctcggcccagtcttcaaacaataccgcgtgcccgcgtgccgggttcggcacgtcgtcgcaatgactgaaactggtgatgtcaaacaatcaattccagttattgatcaagtcagatctctggggtcgtctctcaaaagcattcaaagctggaagtggatctgtcagggttcttgtaatttcggattctggccgtgagcttgccgttgatatgaaggttatccatagttcaagattgtaggttagactcgatagaacacgacttgcaagggagggacggtcttcaggcacagagtctagtgtactcaatgtgaaatgtagcaaaatttagttattgtgaaattggataatatagaacttttcagcaaaaaaaaaaaaaaaaaaaaaaaaaa

SEQ ID NO: 24273 - DNA, 542 bp, Triticum aestivum
  unsure (1)..(542): unsure at all n locations
  Clone ID: PAT_TA_24273
ctcgtgccgaattcggcacgagcataatttcgtcaattcgacagtttgaaaacatgccgagtcacaaatcctttcgtacaaagcaaaagctcgcacgagctcaaaagcaaaatagacccattccccaatggattcggctgaggactggcaacacaatcaggtacaattcgaaaaggagacattggcgtaagactcgcatcggtatctgaatgattttctctacgtatcttgactccgacgcccgacccttcatatcacaacaatcatcccgcaccaagcacaaattttatactcagctttcgctttgggagagggctccggatttctgttacggacaaaataaagttaagcgacaaacgcagcatatggttaaataaaaatttgaagcatatgactcggactcaattcaaatatttactaagtcactaaatatctcggcttaaaattccttatgcttttgatatgatgttcaagtgtaaagtgaaataatgggggagaattctatagaacctgccctaaacagactcttcctatcttcgana

SEQ ID NO: 24274 - DNA, 608 bp, Triticum aestivum
  unsure (1)..(608): unsure at all n locations
  Clone ID: PAT_TA_24274
cactcccccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcangttggcaacaggatcatcaagaagaggattcatgtgcgtgtggagcacgtgcagccatccaagtgcaacgaggagttcctccagaggaagctcaacaacgacaagctgaaggcggaggcaaggcgcgtggtgangtcatcagcacaagaggaagcagcaggcccaagccgggtcatggtggagggcacacatcgagacgtcacccatccgtacactctcaacatntcaaggtggtacaaancctgtgntcctgagaaaacttancatccttacacctgtccattttgacnatattctttccccgatna

SEQ ID NO: 24275 - DNA, 819 bp, Triticum aestivum
  unsure (1)..(819): unsure at all n locations
  Clone ID: PAT_TA_24275
gtttgttcttcttttcagtctaagataatctcagttgtaaaaatgccaggagttaatttggatccagccttttgtgatgacataagggtctgtggagaagatcctttaataccgccgcaacttttgctctcagaaataccacccacacacaaatcaatggatacagtcattcagggtcggagagaagcaatcgagatcataaatggcatgtctgatcgactcctggtagttgtcggcccttgctctctccacgaccctataaccgctctcgattattgtcgaaagctcaaaaaaatttctgatgagctttcggatgatctgagtatcatcatgcgagcatatcttgaaaaacctagaacaacggtaggatggaaaggtcttatcaatgacccaagacattaatgacactttcatgattaacaaaggcttgcgaattaagtcgtcaagctattttgtgatcttacaaccatgggaatgccaaattgcaacaagaaatgctagacactatatcgcctcaattcttagcagatctcatatccccaaggggctcgcgccgcgagacccacaccgtccccgctcctccgccggcttcctcccgtcggccttcccggtcgggggtctaacatgcgggtctgaatgggaagcttggagcngttgccaattgattgccattggcggcnagcgtccanctaangcaccnacntttatggggtggttnacaaagcaaangnccntgccgccnataaataaggaaaccgaattgggaaccaagcantgggatttgtgnttcctaccaaggggngggncaaaaaggnacan

SEQ ID NO: 24276 - DNA, 635 bp, Triticum aestivum
  unsure (1)..(635): unsure at all n locations
  Clone ID: PAT_TA_24276
ctcgtgccgaattcggcacggccacattagcaaagtccagtgtacgatgggtagggtaatccgcaatcaaagaaagggtcgcggctcgattttcaccgcaaacactagattgaacaaggctccagcgcagtttagaaccttggactatgccgaggctcatggatacttacgaggcgtagttaaggaaattattcatgacccaggtcgtggtgctcctcttgcccgtgttcaatttcgcgacccgtacagattcaaattgcacaccgaaaccttcatcgccaacgaaggaatgtacaccggtcaatttatatacgctggaaaaaacgctgctctcacaatcggaaatattctccccctgaaatctgttcccgagggaacagttcttacaaatgtcgaagaaaaggctggagaccgtggtgcgcttggtcgcacatctggtaactacgttactgtaattgggcataacccagacgaagggaaaactcgtggtaaaactaccttcaagcgccaaaaaaaatttccaagaataaggccccanggaaccgtgggggaccgtttaaccttnctaaggcncaaagcaacanaatttcctcaactaatctggccaaanccgggtggatatccatnacaccang

SEQ ID NO: 24277 - DNA, 580 bp, Triticum aestivum
  unsure (1)..(580): unsure at all n locations
  Clone ID: PAT_TA_24277
ctcgtgccgtgtgcgccacgtggtgaatttgaacaacaatatctccaaaacaagtcaaaccggcatcagaaacttgatctacaatgaagattaacagtcgcgcctttatcatctacctcatgagtcacataaaagtcattgatgccttgaactcatatctctgtcgggatggtttcactctaacccctcaaatgatctcagatgcattgcgtagagattgggatagtaaatacacgagaccttacttcggatatggtagagaacacaggcattttctaattgaacattgtaagggtggttgtaattttaagcagcctgtgttttacgcagtcgctgccgaccgacataggaggataataagagtttttatgacgtcatatacattttataacgattgtacgggggataattagttaagctcatagcacgatcatgagtcattgtttttgcaacccccctctccctccttcccacaactcacagttcaagccgcgggggcctcctcggtgccaccccctgggccagttcagcaattgcgtaattgcactataatgtcaagctcaatncancatngaaaaaa

SEQ ID NO: 24278 - DNA, 629 bp, Triticum aestivum
  unsure (1)..(629): unsure at all n locations
  Clone ID: PAT_TA_24278
cgctcccggcctctctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaagggaggccttcagcctcttcgacaaggacgggagatggttgcatcaccaccaaggagctgggaacagtcatgcgttccgctggggcaagaacccaacgggaggcttgagctccaaggacatgatcaatgaagtccgacgctgatggcaatggcaccattgactcccaagattcctcaacctggatggcccgcaaagatgaangacaccgactcaagaggaggactcaaggaggcttcaaggtgttccgacaaggaccaaaacgttcatctctgctgctgactccgccactcatgacgaactccgcgaagaactcacgacgagaggtggacgaatgttcgtntaaccgactcnacggtgatggcagttaactataagattgtaaggcatgatgcaatgacaccaacgtgtccaagaagngggatntcatnaataattaaatnanctattgttattcattacaccacnnn

SEQ ID NO: 24279 - DNA, 697 bp, Triticum aestivum
  Clone ID: PAT_TA_24279
ctcgtgccgaattcggcacgcgcgtgccctcgtcggcgcgtcttaagttgtacaggctggaaacttgaactgtattcgccgtcaatattactcaaaaaaatctactccttgcctaaccttacgacgaagctacctgttcaattttcgctcgaagttttcgaagatttctcaaaatgtcgtggcaagcatatgttgatgatagcatgatcggcagtggccatgctgataaaggtgccatattcggttttgatgacctcggcatgtgggctagctccactgggtttaacataacaccaagaagaaattaaagttattcatgacgcattaaattcaagccaatctaagaaaaattacaatctgaggggatatttattgctgggggtgaaatatgtgttttcaaaataaaggagttcgcagcctatatgctaggaagggaacagaaggtgttgttatcgtcaatacagctaagacaatcctaattgcccatcacaatgacacaatgattgctggaaattgttcaactgttattgaaggattggaagtttatcgtggtagctcaggttattaaaccttatggtccttaggttccatgtgccaggcgagtttcgcctggccggtgcgttccacgattgggttctccattcctggaccccgcggtatcgggcgcgtgtttcccttctctcagtgacgcttcgga

SEQ ID NO: 24280 - DNA, 699 bp, Triticum aestivum
  unsure (1)..(699): unsure at all n locations
  Clone ID: PAT_TA_24280
ctcgtgccgaattcggcacgagccgccctcccaccaacagcaatcatgagcgccctcaacaagatcgctgcaaatagcacctcgaggcagaatccatctgagctcgaaactagcattgctggtgctctctacgacctggaggtaaacaccgccgacttgaaagccgccctccggcctttgcaattcgtttctgcaaaagaaatcgaaatcaacaacggcaagaaggctattgtcatttttgtccccgtcccttctcttctaggatttcaccgcgtgcaacaacgtcttacgcgcgagcttgaaaaaaaaattctcggaacgtcacgttcttatactcgcatctcgtcgcattttgcctcgtcctaaaagatnaaatcgctcgagaacttcgctcacacaaaaaaagacccgattcaagaacctaacaagctggccatgacgctattttaaatgacctagtttacccagtttgaaatttgtcgggaaagcgtctacgttctaaagaagacgggagtaaatcatgaaggnaattctggatgagaaggaaaaggnggcgttgtnaccgattggtaatatccgaagntaaagaaactgacggcntggggcaattttgagttcccaaggaacccgatataagncaanaaaattgccnaaaaatnaatcgggctaaantcatggccaaaaaagtaanattactta

SEQ ID NO: 24281 - DNA, 532 bp, Triticum aestivum
  unsure (1)..(532): unsure at all n locations
  Clone ID: PAT_TA_24281
ctcgtgccgaatctcgtgccgaaggacgaccacaataatttacaacgtcacaatgccatccaacagattaacttaccgccgccgcaacccttacaacacacgatcgaataaggttcgcgtcaccaagacaccaggaggctctttaaggtatcttcacattaaaaaagccggaaccgcccctaaatgtggtgactgtggcacaaagcttccaggtattcctgcccttcgacctcgggaatatgctcaaatctctcgtcccaagaagaaggttcagcgtgcgtatggagggtcaagatgtgcaaactgcgttagggatcggattgtgagagcgtttttgattgaagaacaaaagattgtgaagaaggttctaaaggagtctcaacaaaaaaagtaactgaaaggctcttttggttgtcacgggtgttaataggcggcttggcaccgaaatcgataggacctgtctgtactttgagaaggtcactcggttagaaaaaccgagtcacaacttcaacttttngaccatataaggcca

SEQ ID NO: 24282 - DNA, 686 bp, Triticum aestivum
  unsure (1)..(686): unsure at all n locations
  Clone ID: PAT_TA_24282
cggcacgatcaacaagtgtcatcatccatctcataagataccggacaagaatctcgtaatctgaacagaatgtggctcatagattggttctgggacaccctcgcctcacttggtctactgaataagcacgccaagttattgtttctaggtcttgataatgctggaaagactacacttctacacatgctaaagaatgatagagttgcgattctccagcccactcttcatccaacttccgaagaactatcaattgggaatgtcaaatttatgacatttgatttgggaggccatcaacaagcgcgtcgtctctgggaaagattatttccccgaagtttctgggaattgtcttcttaagtaagatgctaaagatattgagcgcttgtctgaatctaaggctgagctagatgctcttctgagcaatgggaaggaactaagttaggncccatttgtggttttggggcaacaagttcgataaccaagatncaatcaatgaagatgactgagacacaattgggacttntcaaacactggtaaggtaaagtcctctcgaaggatcaggctatcgagattcagtgccatcnttttaaacaggctacgtaaggtttaatggtgganataagtgttaaaagtcagcaattnaaaanantccctgggtagggaanngttncatgaggtttcacggangt

SEQ ID NO: 24283 - DNA, 631 bp, Triticum aestivum
  Clone ID: PAT_TA_24283
ctcgtgccgaattcggcacgagctcgtgccgaattcgccccggccggacgggaagctgagaaaatacggatccaagaagaagacttcgcaaaagctcacgccaaagccatagaaaataacgacacacacgcctacgtccctcgatatttgccagtatgtctcacgaaaatgtctggaactcgcgtccccgcacctacggcaaaggctcccgctcctgccgcgtctgcacccacaaagccggcctcatccgtaaatacggcctcgacatctgcagacagtgcttccgagagaaagcctcagatatcggtttcgtcaagcaccgctagtaaacccaattaatacaagtaaatactagctacatttgttttctaaatttatggaaacgataaataagggtaaaatgaacaactacctctgaaagataccagatagcgatgacttttataaatagtctttccattcttacggaaaatcagtacaagttgaatgtctaaggaatgtaaattccaccttgtcagttttcttactttagtgacttgtttccttcaagtttattccaagtcaagattcgaatttcatcaaatgcaaaaaaaaaaaaaaaaaaaaaaaaaaagctcgagactattctctc

SEQ ID NO: 24284 - DNA, 653 bp, Triticum aestivum
  unsure (1)..(653): unsure at all n locations
  Clone ID: PAT_TA_24284
cccgttgttntggacaaatttncctganttcgatatccggggnccggggttacccggttgttggncatgtatcaccaggtatatgcantccggccaggctattcgcaaanncaantgttgccttactacccagagtttgtggntgaaccacttccaaaaacgagttgaagaggcccctgccgacttcggcgcgtggaaccttactagttgccgataacagacggtgcgagccaaagaaatttggaggacccggtgccagagcaaggtaccaaaaatcatatcgttaaagaatggagcaaatggaggggtttggttctgggctcgttggactattgggatcagctattgcacatgtttgggctgaagatagaaagtatcatgattttaatagagataccagctacccggctaggcaaattattctcaaacaccaagtcacttatactggacaagatcgccaggcacatggaggtggctcaattagacaaaacgtttgaagaactcttggtaacttttcaactgcgccctattttgataatatatcatatcatgttccgatatcctagacgagtaaatcagacgccctctaacagcggttctaaatactatcgtgaaattancatncttatgaaaccgtttnanaaanaaaaaag

SEQ ID NO: 24285 - DNA, 744 bp, Triticum aestivum
  Clone ID: PAT_TA_24285
ctcgacaaattcgacaatcaccatcacgaaggcattggaactcaagacgatccggcggaattgtctttaagtcggacaaaatgtcgacctttgagcctgttatcacgatcgatggcaaaggtcatctccttggtcgactagccagcacagtcgcaaagcagctactagagggacaaaagatcgtggtagtgcgctgcgaggcgctgaatatttccggggaatttttccgggccaaactaaagtaccatgcttacctccgaaagatgacccgatacaacccgactcgaggaggcccatttcacttccgagcgccgtcccgaattttttacaagactgttcgcggcatgattcctcataagactgctcgtggtgctgctgccatggaacggcttaaggtgttcgaaggagtacccccaccatacgacaaggtaaagcgagtcgtcgttccaacaagctctccgagttttgagattgaagcctggacgggaaatactgcactgtcggtagattaagtcatgaagttggtgggaaatatcaggatgtggtagcaagacttgaagagagaaggaaagtaaaaggagcaccaaaaggccatagcaacatcgccccaagaagacaacgttccgatccgctcaaaggtgcagcggttgacaagagcactctgcaacaactttctgagctaggttactagagactaagttacttactagttattgaaactactcgtgccgaattcggcacgag

SEQ ID NO: 24286 - DNA, 601 bp, Triticum aestivum
  unsure (1)..(601): unsure at all n locations
  Clone ID: PAT_TA_24286
ctcgtgccgaattcggcacgagctcgtgccgaattcggcacgagctcataaagatctatcgcttatcctgatttttggacatacaataaagtgaaatatcatttacctctctctctacagcccctcaacccaagcctcaaaataccaccaacgctgttgcatcatggctgcagctactaccaatgtctcttacactaccaatttgctcaaatacatgggcctgggaccaagaagggaagcgcaatggctgagtatatatggatttgacgctgttggcggtgtcccgttcaaagtcaaaagaccctttactagcataccaaccaaagtgggagaagtttacaagttagatgaccttccccgatgggcttctgtcggcaggctgctgtccgggccccngggctcccgccggtgtcccccctcgcctcctgctccttcccgcctgctgctgccggcccacattctccttccgccgcggcatcctgggcccccttggttcccaacggtatacctcgcgtgaacccaaataaggaaccataananaaaactggttggtaaaaaggataaacactagttnacaaggctanatgccccgtggtcctgc

SEQ ID NO: 24287 - DNA, 569 bp, Triticum aestivum
  unsure (1)..(569): unsure at all n locations
  Clone ID: PAT_TA_24287
ctcgtgccgaattcggcacgagacccaacaagctctgaatagttggtcatcgaatcccacgcggcacttcccttgatacaacaatatctgattggaaaattatccacagtcgtatttcactatggttcttgaggccgttatggttgtggtggataacagcgagagtagtcgaaatggcgattacaccccaacccgatttgaagctcaatccgacgctgtatccatgatattcaccgttatcactgaagcaaatcctgaatcgtcggtgggattaatgagcatgggtgggtaaggggccagaggtcctcgtaaccttaacaaccgattacggaaaaattttagaaggtttacatcgtacaaagagcaagattcggggtgaagggcatcttgctactgggaattcaagttgctggcctaacattaaagcaccgccaaaataatcccaacgtcaactatcatcgttttactgcaactccattccagaagatgagaaaaccttacaaacnggaaaaaaatgaagaaataagtacaacnatttgtacnttgggatnggtnacaaaccaagaatt

SEQ ID NO: 24288 - DNA, 793 bp, Triticum aestivum
  unsure (1)..(793): unsure at all n locations
  Clone ID: PAT_TA_24288
ttaaaatatacatcattcgacaactagacgacaaccgccacagcattcaagatgggagccttaaaatacgtcgaggaattgcaaaagaagaagcaatcagatgtcttgcgcttccttcttcgagtcaggtgctgggagcttcgacaattgaacgttgttcaccgcgcctctcgtccatctcgtcctgacaaggctcgtcgtctcggctacaaggccaaacaaggatatgtaatctaccgtgtgcgtgtccgaagaggtggtcgcaagcgcccagttccaaagggtgctacatacgggaaaccaaccaaccagggagttaatcaattaaaataccagcgatctctcaaatcaactgctgaagaacgggttggtcgccgctgcgcgaacttgcgagtcctaaactcctactggatcaaccaggactcgacctacaaatattacgaagtaattcttgttgatcctcagcacaaggcaattcgtcgtgatccccgtattaactggatcgtaaacccagtgcacaagcatcgtgaatgccgcggtctcactgcaaccggaaaaagatctcgtggattgggcaagggtcacggctacaacaagaccacagctggtcgcaggaagacctggaagaggcacaacaccctcaatctacaaagatacagatagaaatattaacattagctatcttatcactcataagaacattgaaagtgttcaatcctagaacaaatactcactggcaaatctgcaagcaaaaaaaaaaaaaaaaaaaaggggggggcccggtacccaantt

SEQ ID NO: 24289 - DNA, 568 bp, Triticum aestivum
  unsure (1)..(568): unsure at all n locations
  Clone ID: PAT_TA_24289
ctcgtgccgaattcggcacgagcccgggcagtactaagacagtgtcagcataccgtgatctacaaatcctctgattttcccagcgcagtcctcttctctacccgtctcttcaaacccaattcacagcattccctcgaccagatttagataaccgcagtcatggatatggaaaagctgaagaagatgcaacagtctgtaagaattggcggaaagggcacaccaagaagaaaggtcaaaaaagttcacaagagcgcgggtatggatgataaaaaacttcaaacagctctcaaaaaattgaacgtccaaccaattcaagcgattgaagaagttaacatgttcaaagctgacggaaatgtgatacactttgctgcgccaaaagttcatgcggcagttccgtctaatacttttgctatttacggcaatggcgaagacaaagaattgacggagcttgttcctgggaattctaaatcaagcttggggccagattcactaggcgccacggacggaatctggaatcncanatactgcttgtcaaaacatacggggntnaactaacngggaaatcccn

SEQ ID NO: 24290 - DNA, 570 bp, Triticum aestivum
  unsure (1)..(570): unsure at all n locations
  Clone ID: PAT_TA_24290
ctcgtgccgaattcggcacgagctcattctgtatctcccttcaatttgtcgattccctagaaatctagctagcctcattcggagaaaataaagcaacagctcaaataccatgaatttttttcacaaggccatcacggctgtaatattgcttctcacgactcccgcaatgtcaatgatgcctatgagggatgggagtaccgggtacccagtaccggtgcaggaccacagattatggttctcttgtagaggagtcaactacgaaaacgagtacctttttagggttttgaatcacgcttatggacttatgtctagttatgctacctatccggtacctacagagagggtaatttatgagagaaggggaccgtattatctattccctctccttcaaaataagcaaatatacgatttaggtactacttcgggccattatttgatatttaatatcgattaagagatttgggggggatttataatgatccagcacagctataatcctcaaaccaccgtgtgtgtatatccgaatggactaagttatttacctcgaaattggtagaacanttttgacag

SEQ ID NO: 24291 - DNA, 561 bp, Triticum aestivum
  unsure (1)..(561): unsure at all n locations
  Clone ID: PAT_TA_24291
ctcgtgccgaattcggcacgagggacacttaggcctccttcgttccaaccgtcacaggcacggcccaggacacttaggcctccatagattcaaatgtcacatagatagcttccatagcctcaactgtatctatggccccgtcaaactcctctacttcgtctactgtgtcgacagctacaccaacgcaggtcactttcgccaagcgggccgatgaggtaaactcttgtaaaagcgacctaaacgacataatattagactatctcacaatcgagggatatccatgtgccgcagagaaattctcaaaagaagctaatataaagcctcgtcaggtcgaggaagaaattaggtcacgacatgaaatccaaaatctaatccacagagggatgatacaagaggccatcgaagcattgaacaatacagatccagaggtcctcgacagaaatcctccactacacttcgaccttcttcgacttcaactaattgagttgatacgcgcacacaattctaatccaataggtgatataacaccaggctctccaantcgctgcaagaccaacttnn

SEQ ID NO: 24292 - DNA, 772 bp, Triticum aestivum
  unsure (1)..(772): unsure at all n locations
  Clone ID: PAT_TA_24292
ctcgtgccgaatgcggcgcgcgaaataccggctccatcattacgtgataaatattgaagatgtcttctcaaggcaatgaccaggagcaagatgtcctacccgaacagacagaggggtttagggttggggaaaagaagacaatgaatgaatatcagcaactcgatgccgaagatgaggctatgcagagatataaaaggtctctcggtataggaggagacggaaaatacctaactgatcccaatgatccccgacaatgtataatcttatccttaactatggagtctcaagaccgtccaccagtaactattgatctttctgaagaagattcgctatctactcttaaagataagccattcaaaattaaggaaggtgctagctactcaatgacggcccaaatttaaggttcaacacgaaatcttaagtggcctgcactatgttcagataataaagcgaaaaggaattagggtcaagaaaggaccaagagatgattggttcttatgcaccaaatactgaggcgaatccggtttacaccaagagatttgccgtaaatactgccccatcaggaattatggcccgaggaaactacactgtcattagtaacttcatagatgacgacaagaaagttcatttgatatttgaatggtcaattatgattggaaaagactggtagatgttagcaatgcctgtttgaaataccgcagaaattaccagatccgcccaaaaaaaaaaaaaaaaaaaaaaanacctcgactcgtgccgaattcggcacgag

SEQ ID NO: 24293 - DNA, 495 bp, Triticum aestivum
  Clone ID: PAT_TA_24293
tcgtgccgaattcggcacgagcaaactccaacatctcctttgtcaaccatccaacttggtagaagtgaactctcggcaacataacgattaaaaatggccagttcaagcttcccttctatcttcaatgcaacctcgcaagacattgagatgcttctcgcagctcaatgtcacctaggttcgaaaaatttacaagtccacatggacagctatctatggaaaacccgaccagatggaataaatattattaatattggaaaaacctgggaaaaagttgtcctcgcggctcgtattatcgcggccattgacaacccagccgatatctgtgtcatttctgctcgtccttatggtcaacgcgctgtactcaaattcgcagctcatactggtgctggttgctatcgctggacggtttacgcccggtaatttcacaaattacatcacacgattggttcaaaagagccacgcctaatcatcgtgactgatcctccgtactgacgc

SEQ ID NO: 24294 - DNA, 479 bp, Triticum aestivum
  unsure (1)..(479): unsure at all n locations
  Clone ID: PAT_TA_24294
ggatttttctaccgccgtctcgagcggcctcgagggctagccagagaaaggagagggaggatcttgccgtgccggaagccgccgccgcagggcgctggaaagcgccgtcacgggcttgagacgcccagacgcggccgcttcgggctgtgcaggaggccgcccggtcgctatgtcttgccgcgacgtgccgccggagagcgccgttggtggcggcaggactcaacgcggaggtgtgatccggtggcgcggcaggagacgaagccgctggagccggcgtcttggtccagcggggactgaaaccaaggcgatgtctcttgctgtggatgccttcgtccttcctccaagcgtatggcaagattctgttcatggtaaaagcaaatttgtgttagccatgnaagaaaattgggaaaagtaataacttgtttccctgtaccatatttgatgttagttcgccactccaanttgcgttggngctttga

SEQ ID NO: 24295 - DNA, 679 bp, Triticum aestivum
  unsure (1)..(679): unsure at all n locations
  Clone ID: PAT_TA_24295
ctcgtgccgaattcggcacgagctctacatcttacactcgtttgtctactagcattccataaagttgacattcttatccttacatcatgtcacttccagagccagttgtccaggaaatccagtacaagcctgtcccgcctcaacgcatgcgtatgacagatgccgactactacgcatttttccaaaaccaggtcatatttttaaccggtgctacgggcggactcggtggctgccttttatataaacttgcactcaagcttcaagaccaaaaagatatacgccctctgccgttctaagaccaaggctctccgatcaatggaaacgatactatgccccaccaagtacaaggcgatattgaacccggggcaaggtggatattaccgggagggggtgacaattacnaaaagccaaacctttgggnattgacccangctcaaagngccaggacactacaatttgtcataaaccaactgccgatatacattgccaacaagtgggtnaggtatccaaaaagatncaagctccactttnatntcaaagatggtcacatggcanactcaatcatcatcaacccctanagtatgtaatcttccancgatggccatcaagaaaaatntcccncggganccagagaatcaatcagcagtccanattcctgcaatnttncaaaantntgaaa

SEQ ID NO: 24296 - DNA, 540 bp, Triticum aestivum
  Clone ID: PAT_TA_24296
cactaaggacacccttgatagatatgttgataaagcgcgccgcggattgaattcaggtggaacccgtcttataccaacccaggcgttcccaatttactcgcccccaggacccatacctatataacttacatcccatcctgatagaggatgtctacagaactcaatttaacagagaggaacacgtcatatttgatagagaagggtttattatgggaggaatgacatacgaagcagttaacagcgtgccaaaatatgtggcctgtcgattttctagttcaactagattcatgtagtagaagcgccattcttccaacaatcatgcagtatggcccgaacatcttgaccgacagcattgtctcaaatcattgatgttggttttagggatacaaattcacgagtaggttggggacagccgagtatggcctttgaaaaacccagatttgcaagcacgtgggatatatggagataggagggtttgcactacgttatgagagtgtattattgggcactttttccaagctacagcgacatggatccctc

SEQ ID NO: 24297 - DNA, 369 bp, Triticum aestivum
  unsure (1)..(369): unsure at all n locations
  Clone ID: PAT_TA_24297
ctcgtgccgaggtcggccccggggagtggaggccagagagattcctggacccgaggttcgactctgcggacatgtacaaaaccatgtcattcggctccgggaagaggatctgcgccgggagcatgcaggcaacggtaatctcgtgcacagctatggcgcgcatggtgcaggaattctccttcaggctgaaggagggcgacgaggacaaagtggacacagtccagctcaccaagctacaagctccatccactctacgtgcatctctctccgagagggagcaagttgaatggcagcattgtttttgataataataataatgaaaagcattactccnagccggccaactttggtcccggtcttacgctaacc

SEQ ID NO: 24298 - DNA, 527 bp, Triticum aestivum
  Clone ID: PAT_TA_24298
aagccactagctcactactgagtcgatcaatctgttgtttcagaaagacgccatgaagtacttggggcaggtggtggtggcgctcctggccttctcgacggtggtgctgatggtggcgccggcgggcgcggaggcggcgacctgcaacgcgctgcagctgaccccgtgcgcgggggccatcatcgggagcgcggcgcccacggcgtcgtgctgcagcaagatgaaggagcagcagccgtgcatgtgccagtacgcgcgcgaccccaacctgaagcagtacgtcgactcccccaacggcaagaaggtcatggccgcctgcaaggtgcccgtgccatcatgctagatcgacgcatatatgatcgatccacacgagagagcccagcgcgcacgcgctcctctctggcctctcgctgcatgtttcatgtgtgttgatgtgtcagtgtttgcttgtttcccaacactgaatagctaccctgacgatgtacgtggaccgatgtgtatctgaatttacgcaataatgacgaagt

SEQ ID NO: 24299 - DNA, 569 bp, Triticum aestivum
  unsure (1)..(569): unsure at all n locations
  Clone ID: PAT_TA_24299
caanacactagctcactactcactaccagtcgatctacatttcatcgtcagagtttcagagatgccatgaagtacttggcccagctgctggtggcgctcctggccttctgggcggtggtgctgatgatggcaccggcgggcgcggaggccgcgacgtgcgacgcgctgcagctgagcccgtgcgcgggcgcgatcgtcgggaacgcggcgccgacggcggtgtgctgcagcaggatgaaggcgcagaggccgtgcatgtgccagtacgcgcgcgaccccaacctgaagcagtacgtcaacaccccccacggcaagaaggtcctggccgcctgcaaggtgcccgtgccatcctgctagatcgacgtctatgatcgagacgagaacgagagcccagccagtggcatctctctgcaccgctgcatgtgctgcatgtgttgatgtgtgagtgtttggttgtcgtgagtagcaaccccgatgtatctgtatctgaaattctgaataaatgcagtgcttgcgtgagctccactaggtaagagattggcgttgatgggagaaaaaaaaaaanaaaa

SEQ ID NO: 24300 - DNA, 592 bp, Triticum aestivum
  Clone ID: PAT_TA_24300
gtgcggcgctcgaggcggccggtcgggaacatccaagcatctttgcacaagccactagctcactactcactaccagtcgatctacatttcttcgtcagagtttcagagacgccatgaagtacatggggcagctggtggtggcgctcctggccttctcggcggtggtgctgatgatggcaccggcggacgcggaggccgcgacgtgcgacgcgctgcagctgagcccgtgcgcgggcgcgatcgtcgggaacgcggcgccgacggcggtgtgctgcagcaggatgaaggcgcagaggccgtgcatgtgccagtacgcgcgcgaccccaacctcaagcagtacgtcaactcccccaacggcaagaaggtcctggccgcctgcaaggtgcccgtgccatcctgctaaatcgacgtctatgaactatgataggagacgagatagcccagtcagtggcataatatctccctgcacgctgcaggtgttgatatgggagtgtttggttgccgtgtgcagttaccccgatgtatctgtatctgaaattctgaataaatgcagtaataattatgcaaaaaaaaaaaaaaaaaaggccccta

SEQ ID NO: 24301 - DNA, 1374 bp, Triticum aestivum
  unsure (1)..(1374): unsure at all n locations
  Clone ID: PAT_TA_24301
gccacagatgccgaagccactagctcactcctgcatacgccaatctctcagtagccactggctcactactagtcgatcaatctgttgttgcagcgagagacgccatgaagtacttggcccagctggtggtggcggtccgggcctactcggcggcggtccagatggtggcgccggcggcagcggagggggcgacctgcaatgcgctgccgcgggaccccgtgcgcggcggccatgatcggggaacgcgggcgcgcacggcgtcgtgctgaccagccggcctgaagcagcagcagccgtggcatgtgccacgtaacgcacgcgcaccccaccctgcacgcagtgacgcttccactccccccaaaacgggccacaaggtcatggccagcctggcaacggtgccccgtgccctcctgcctaagtccatattagctgattccgcacggatgaagagacccagctgcgcacgcgcgcctctgtgctctcctctgctctcccagcatgttccatgtgtgttgttgtacgctcgatcgtatgccgtgtggtgttgatcaccaatgtcgtttgtcgtcgccgttaccctctgccgatcggcgatctaagtggaccgatgtgtatctgaaattctgaatatatgcaataatgatgatgtgtccagctatatttaaattataaactaactccaaaatagagatgacaaagcgaaagcttcaggaagggtaccaagaattcgataacgcaaagaagcagaggactgtacagatggtggatccgcaagacatccggaagcaagggaaccgggcttggcagccgaatgccaagccgaggaacaacaacagcagcagcaacaccaacaacaaccggaattggtcgtcgaaatgagtttccaattccatcatccaccattagaaaaaataccttggtttcattcccgccctcggtcgttggcggcggcgtaagttgtttagcccagcccagcccagcccggtacataacatcagcaataaggcttccctgccgtccttgcgaaactgtgtcgtgtctgactttttttttgcccttgatgatggtggctggctcgccattatagtgtccgtcaaaacctgtaaagatgagacgtagtctgttgtggtactaaccgatggtgtttttgcttcctcggacggaacgcaagcggttcatcggagttgccggatggcatgatcgtgtcctctgcttgccttgtcgcagctgcaacggtcctgcttcgcctttcaagccgaagagggcttttggggttgcantgtcctgccctgaacatcttgtcctcccgcactgcaaatactcctacttggactactgcaaaattttcctgtgccgcaaaaaaaaaaaaaaaaa

SEQ ID NO: 24302 - DNA, 280 bp, Triticum aestivum
  Clone ID: PAT_TA_24302
ctcgtgccgaattcggcacgagaggaagatgagacaccgagacatggcaaacccgcgcttgatagcatggttcgcgtgtgaggaacgaacgttgcgttgacactatccgcagttgggtaaccactgcagagatggggtcctcagaagtgagagtaatagtcagagagtcttcactcagcagctacctctcaaacgtgacgtggcgcattctcattgcacgcgagctagggtacgtcgtatcacaagtctcaccaacctttttaaaaaaaaaaaaaaaaaa

SEQ ID NO: 24303 - DNA, 563 bp, Triticum aestivum
  Clone ID: PAT_TA_24303
ctgattctggaaaagttggcaagatcaaactggcatccgttcagttggcgaagaagtacatggagagggtcacctcggagctcgacgcgttgcagggcaccgagaaagagcccaacagggagttcctgcttctccagggcgtcagattcgccttccgagttcatcagtttgccggaggcttcgacgcggacagcatgaaagtctttgaggagctgagaagcaagatgagcagcacgcaggcacccgctccaccggcatctgacacatagtgcggagtcttcaggattgcgcgctcctccggtcaggttaattcggagggcacaattagttggctagttaaactgtacaaaagagaagtgtaaattccaatgttgtcttaatcaagttgtatatgtcaagtctacaggttcagatcatactataagcaaaacaggtttttggccttaatcaagtttgtttgtttggctgaaattctgtaaccgggcagtttgtaaaaagtgaaccacagtaatgagatactacctacctagttttggctaaaaaaaaaaaaaaaaaaaaaaaaa

SEQ ID NO: 24304 - DNA, 917 bp, Triticum aestivum
  Clone ID: PAT_TA_24304
ctgtttactcgtcaaggtccaaaaaaggggggccgtcgtttcaaaagagctccattctgcgttgattctggatgttccggcgatccttgttaatcatcggctctactggctcctttggcctaaagcccgtggtctgctctgagtttgatttggataggcagagcctaactgtgatcaagtggcctactggtatgattgctcccggcagctatgggatcatcaaaacagacaaaggcgcagctggcttgttcaggttttcattcccaaacatggaattgcgcgaaatgaaagtggattgcaagggctttacctcgtggttggatccaaaaataatcgatatgcataacgttcttgggatcccccctcagattggtaggagagtgtggcattgcaaattaaggggctatgaggaggacaacaatgtgatcgttttgtatgttgatgacagtgcctacatgcttgatcttaactcaatgaaatcaacaaaacttgatggaagccgttcgatgaatcactgtcaccctttcaccagtttctatccaccagacatggccatataagaaactatagaagcatggacacatatacagaagcattttccagaaacagccatacggcgacacggcgagtatatacataaataaataaagtacagcatgtaatgttgtgaggacaaaagtatatttgtaagatgtgcgatcgtttgtttcctgccttcatttccatgtttgtatatgggtgagcttaatgcagctgatgctgcacatatatgtaagtaaatattccgggaaaaacaaaatacaatacagcatgtagtatggacatatgattatatttgtaagatgtgggatcaagtcttgattctgtcatgtaatgtggacaaaattatgttgtaagatgtgagatcatttggtttc

SEQ ID NO: 24305 - DNA, 2199 bp, Triticum aestivum
  Clone ID: PAT_TA_24305
cccacgcgtccggccttggcggcgcggccgttcccaaatcgacgcgagcagaaatggccggccgccgccgcagccgctcccgaatccaaggcgacggggcggcccgtcctagtcgccgccgctcccgagtccacggcagcgagaacggcgacggggcgacccgtcccagtcgccgccgctcccgagtcatcagcagcgaggacggcgacggcgtgacccgtcctagtcgccgccgctcccgagtcgtcgccagcgaggacggcgacggggcgacccgtcccagccgccgccgctcccgagtcgtcggcagcgaggacggcgatggggcgacccgtcctagttgccgccgctcccgagtcgtcggcagcgaggacggcgacggcgtgacccgtcctagtcgccgccgctcccgagtcgtcggcagcgaggacggcgacggggcgacccgtcctagccgccgccgccgcgccagctcgccggaggtgccagacgaagctgacgctgataccctgttgggagtcgctgccgttggatatgatttggggagatcctgctcctgcttccaccggagcggccctccctcgtgctgccgccggcgcggccgctccctcctccgcgcaagcggaaccggcgcgtagccgccgcaacagagagcaaggcgccgggtacgcggttccgcgtcgccgccgccgccggagattatggcagcgaagcatcaattgtaacgggatttccacgtggttggagccaacgctggttgatatgcataacgttcttgggatcccccctcggagtaggaagaccgcgtggcatgaaagaatcctcggctaggacgaggagaacaatgtgatcattctgtatgttgatgacagtgcctacatgcttgatcttaagtcgatggaatccacaaaacttgatgaaatccgtttgatgaaatactgtcacccattcaccagtttctatccgccacacatggtcacctaagaagcattgatatatgcacacggacacagggatacagatacagagatcccagaaacaaccacacagggagacggcgaggatatacataaataaataaagttcaacatgtaatgttgtggggacaaaagtatatttgtaagatgtgcgatcaaagtactgcccatttgtgttttctgccttcatctccacgtttgtatatggatgagcttaatgcagctgatgctgcaagtacgtatatgtaagtagatatttcaggaaaaagaaaatacaatgcagcatgtaatatggacataattatatttgtgagatctgggatcaggtccagattctgtcatgtaatgtgatgttcctgcgaccctggttggaaatgtgctctactggatgctttcatgggataatgtttgtgctgccatgcttgagtttgatttggatacgcagagcctagctgtgatcaagggaccttctgatatgaattattccggcagccataggatcatcaaaatagagcaaggcacagttagctggctcaggtttaaattcccgatcctagaaatatggctggggcttcagttccggcccgggcttgccgcctgggggcagcataaggccgtggttttgcctcgcggtcgcggcatccctccgcgggtttgcatgacgtgcctgcggtccctcctcggctatgaggaagatagcaatgtgatcattctctatgttgatgacagtgcctacatgctagatcttaactcaatgaaatctacgaagcttgatgaaagccgtttgatgaattcctgtcaccctttcaccagtttctatccgccagacatggccatctaagaagcatagatatatgcacacggacacggggatacagatacatatatggagacatggaatacggcattttccagaaacagccatacggcgacacgggagtatatatatacataaataaataaagtacagcttgtaatgttgtgaggacagaagtatatttgtaagacgtacgatcaaagtactgcccatttgttttctgccttcatctccacatttctatatggctgagtgtaacgcagctgatgctgcaagtatatgtaagtagatatttcaggagaaagaaaatacaatgcagcatgtaatatggacataattatatttgtgggatctgggatcaagtcttgattctgtcatgtaatgtggacaaaattaaaaaaaaaa

SEQ ID NO: 24306 - DNA, 473 bp, Triticum aestivum
  unsure (1)..(473): unsure at all n locations
  Clone ID: PAT_TA_24306
taagtatttagtttaacgaagtttctgtgctccgcgttttcagtcccaggaaacagcttcaaaatggcaaaaagtaaaaacagtagtcagcataatcaaagcaaaaaagcacaccgaaacgggattaaaaaaccaaaaacctcgaggtatccatcactgaaaggcacagatcctaagttcaggagaaatcatcgacacgctttacatggaacaatgaaggccctgaaagaacaaaaggataaaaagggagaagacgcatgattatgaattttctatctgattaatgagtaaaagaatgcgtgctgggcgaagacactaatattaaaacctgtcccaatagacttggatgaaaactaggtcttgaacccaagcaaaaaaaaaaaaaccccacgggccgcccctataagttgaagtccgttatnacgacgncggctnnacctggggccggtcggttttacaancgttccttggat

SEQ ID NO: 24307 - DNA, 477 bp, Triticum aestivum
  unsure (1)..(477): unsure at all n locations
  Clone ID: PAT_TA_24307
cccaccccaccccccccccccgcatcaccaaaacgcccgcataaccaaaaagatacgcgcacgccacttgtacacctgctgcacccatggcgcctagagcggcggagaaggcgcctgtctccccgcccaccgggctcggcctcggcgtcggcggcggggtcggggtcgtcgccggcggcgcgcactacaggggcgtccggaagcgcccgtggggacgttacgccgcggagatccgtgacccggccaagaagagcagggtgtggctcggcacgtacgacacggcggaggaggccgcgcgcgcctacgacacccgccgcgcgtgagttccgcggcgccaaggcgaaaaccaacttcccgttcccttcgtcgtcgtcgtccgtcccctgtcccccgcgccccgggcggcggccgcccccccaagcgacggcaacttcggtgccccgccgggcgcccggggacccggcccgttcncccaac

SEQ ID NO: 24308 - DNA, 627 bp, Triticum aestivum
  unsure (1)..(627): unsure at all n locations
  Clone ID: PAT_TA_24308
ctcgtgccgcgtgccgcacgcgccaccacaaacaaagtaaccagcggttatagacatcatcaatcacattttttcgaagatggctgatgaatacgatcctatccaagccgctgagctaaagaagaagagagccttcaagaagttttcataccgcggaatagatctcgaacaactcctagacctctcctccgatcaactacgggatgttgttcatgcgcgtgcccgtcgtcgcttcaacaggggtctgaagcgcaaacctatgggtcttgtcaagaaacttcgtaaggctaagcatgaagccaagccaaatgaaaaacccagccttgtaaagacgcacttacgagatatgattgttgtccctgaaatgattggttctgtcattggagtttattctggtaaagagttcaatcaagtcgatatcaaaccagaaatggttggccactacctcggagaattctccatctcataccggcctgttaagcacggaagacctggtatcggagcaacacattcttcgcgttttatccctcttaagtagggtgtaaaagattgacgggcgtgcaggcggggtctgagccatgcgtttctcggtgacttcatttcacaacctccncnaaaaaaaaaaaa

SEQ ID NO: 24309 - DNA, 630 bp, Triticum aestivum
  unsure (1)..(630): unsure at all n locations
  Clone ID: PAT_TA_24309
ctcgtgccgaattcggcacgaggataccctcccgtccccgcccgcagccaccgcgccgccaggatccgatcggatcgctagggtttcgtctcctcctcaccctcgaccatggccgtcgccgccctcgtccgctcctccgcgcgccaccgccccgccgtcgccgccgccctcctgcgctccaccgccgcgnctcccccgcagctcccccgcccccaccaactccagcgccgccctcctctgtccgcgccgcttgctctccggtcccgcccgggcgcaaatcaacaccgagatctgccgggtggaaggcggccgtcgcggcgcgctacgactccgcaatcgaagagagtccatgagctctccgccaacgttaacaagctgggccaagcagttggtgcaacaggantacaacatcaaccctgacccggcggcgtcttgtcctccctgcacgccttcaacgccctctctcccgccgtccccctgggccgcgggcccgaagcgtccttgtcgatcccgcgcccgccgggcctgcgggggctgagcaanctnaaaagttanggtttaagncaagaatcaaantagganntanccaaaaagaggtgaaaaacaggggcactattaggaaaacncagg

SEQ ID NO: 24310 - DNA, 745 bp, Triticum aestivum
  Clone ID: PAT_TA_24310
acaacatcacgccagcttcgacaaacgcccaggtttacaatgaagtacattcattccgaagagaccttgaacattcctcaaggtgtcaaggtcctgatcaaatctcgcctggtgaccgttgaaggccctagaggcaaactaacgaaaaacctcaaccacctcgccgtaaacttctctagccccaaaaaagatatcattaagattgaattacaccacggagcgcggaagaatgttgcgaccctacgtaccgtccgaacattgataaacaacttaatcatcggcgtcactaagggatttaaatataagatgagatacgtgtatgcacatttcccaataaatgtcaacatagataagaataacgagacgggattgtatgaagttgagatacgcaactttattggagagaagattgttcgaagagtcgtaatgcaccctggtgtcgaagtagttacttccacaaaccaaaaagatgagctgcaaatcactggaaattccttggagaacgtatcccaaagtgctgccgatatccagcaggtctggtagagtaaggaacaaagatattcgaaagtttttggacggtctatatgtctcagagaagggaaacattgaggaagcagcataaggctcgagttcaaagggaaatttttttgggaccaaagcgaaactgtggatgctttgaatgtcagctagaaactggtccataatgaagataaaatcctttggaaaaaaaaaaaaaaaggggggg

SEQ ID NO: 24311 - DNA, 747 bp, Triticum aestivum
  unsure (1)..(747): unsure at all n locations
  Clone ID: PAT_TA_24311
nttacaatcatccatcaactttttcttcaccaaaaccatctccactccccatctacttctatcgttcttataattgaatataccatcacgncagcatgagtaatgattcangctccggtcaaacaggccgttatgggagtgccaccattcggcggcgatttcatgatgggtggtgtgtctgcaagcggtatcaaagactgccgcaagctcctatcgagcgagtaaagcgtattgatccaagagaccaggaagagatgttgaaatctggcccgcctacacaggaaatattgacggcatcttaganctgcttcaagcccgtgtcccccgattatgggggggcagccgctatcccgttgttacactgcctatgccactccccactgccctactccggctcgcgtctccccttcccgtgggccctccaacgctctgttcttccggtggatgccccgcgatcggccccctcgtcgatcgctgggagcttgggctcccgggcttctggcccgaaccaccttcgctccgttccgtcnactccctanacnatgcccgtanacgtctanccatgacacaaaagcgcaagtctggtggcnacgtcaatcaatggattggngacgtgttaanaagacatgataacgacgtatnctggatgtacgtggttcaagcccccgtccgggaaanggttaccgggccacttggatttcatcttaaacatntcttttggccccaaggaatnctgtnatcaaccgg

SEQ ID NO: 24312 - DNA, 731 bp, Triticum aestivum
  unsure (1)..(731): unsure at all n locations
  Clone ID: PAT_TA_24312
gtcggaggctgagaaatcatctgtgccaccggatccgctggccctgcggaggctcaaactgaagctcagggagacgctgattgctcacaagaacagagaagcaaacagagtgccccttggaaggttagaccagacgctgaattcagctcacaagaacagagagccgactagggtgcccctcctcggcaggttggacgagaactcggcgtctcacttgcagaagagggagcccaatagggtgcccctcggcaggctggacgacaactcggcgtcgaagatgcagcacagagagccgaattcggcgtcgaaaatgcagaacagggagccgtattcagcgtcgaaaatgcagaagagggagccgaattcagcgtcgaaaatgctgagcagagaacctatcaggatgcgcctcggaaggctggacgagaacgcgtgttgatttgacaccgggattatctaccttgggtgctctgctgttaaccaggagaaacagctcactgaactccaaagactcacaaggttgtgaaaccatggtttctccaaccacttatctaacttgtctgtgtgcgtcgagatttcgactgtattttttagtcgactctcggcgtagtcagctccctagttctactttggctgtcatttatttatgagtggtttgttgatgttctgaactttgtaccaatcagttgtgataatatatgtgtgtgatttgccctacaagagttgnaaaccag

SEQ ID NO: 24313 - DNA, 1320 bp, Triticum aestivum
  Clone ID: PAT_TA_24313
tcgcaatggccgccgttggtcttctcggcgtgtgtccagctccggcgcccggcggcccggcgaggacaggcgggggcttcaccggccgcgggtagctggggctggcgcgcccgcccgcgctcccttcggtccgttccgccgcccggaggagcggggaggggcggggcaagggcggcgaggcccccgcgcgccgcgatgggcggcggcgacctgtacgccctcgacttcgacggcgtcttctgcgacagctgcggggagagctccctctccgccgtcaaggccgccaaggtgaggtggccgtgggtgtttgagcaggtcgacgccgccttggaggagtggattgtggagcagatgcacacccttcgtccagtgatagaaacaggatatgagaacctgttgcttgtaaggttgcttgttgagatcaagataccctctgttcgaaaatcatcagttgcagatggccttagcatccaagatatattggagaactggtcaaaactgttgcccactctcatggatgagtggcaagaagatagggaatctcttgtagatctctttggccgtgtaagggatgactggcttgaaaatgatttgtctggctggataggtgctaacaggttttatcctgggacggctgatgcattaaagctttcaagctctgaactttacatagtcacaacaaaacagagtagatttactggagcgctactcaaagaattggctggagtagattttccctctgaaaggatatatggccttggcactggtccaaaggtaaaagttctccagcagttgcaggaaatgccacagcaccaaggtctaacacttcatttcatcgaggaccgactagcgactttgaagaacgtgatgaaagaaccagcgctggacaaatggaacctctacctggtgaaatggggatacaacacacagaaagagagggaagaagcaggggacataccaaggatccaactcattgatctcccagatttcagtaagcagctgaaataatcgactggcagtgacactcggacattgacgtgaccttcggtactttgtttttgttcgatgtacttgcaaacagcatgagatatacttgatgttttttccgattgtttgcatatttgtgaactggtttacttcctccgctctcctaggcactgtcgttccctcgatcgtgcacggccttacccctggagcagagttcctgtcaaacctggcgtatttattttttgcattattagtgtccaaatgtagaacaacagtatttgtggcctctcacacttcacctgaattatagagagtaatcaactccctcgtgcc

SEQ ID NO: 24314 - DNA, 819 bp, Triticum aestivum
  unsure (1)..(819): unsure at all n locations
  Clone ID: PAT_TA_24314
ttcaactcctgcgttgctgccgttcctccggatcattccctctcgcctggtgacatggcgccgaaacgctccgcgcgggaagccgcttctgcgctcggtacggccgcggtcaagccgacaaaggcatccagtggtgggcccaaaggtagtaaaatcactgcggagccaaccacgctgacgagcctccttggaaagctcgggcaagactaccaacgcgatacgcagcagcgaatcaagctaattgattgttttctcacctttctcctgctcgtcggcgccttgcagtttctctactgcgtcctgggccggtaactaccccttcaatgccttcctctccggcttttctgctacaagtcggtcagtttgtattgacaagttangtttgcgcatacaagaccaatccagaaaacaagggacgaagtttaagcgcatttccccagaaagggcattttgccgactacgtatttgggaagcttgattttacattttttttgcgtgaactttatcaactaaaaaactacatgtgggcacctaagcatccggggaatcttganacggatatataagggttagagaattgttagctaatgcacgagacctacatatgtcactcaaacatcaaaacattaattagtacgacataaatgacgcgcacataaaacatataagcaaatgatcaaaactatgcacggtacaaaanaagcactaaaaaaaatcnaggggggcccgtaccaatccccnaagganctataacgcntaacggcntctttanagtcnacngaaactgggttncactaaccntagaatcccttccagngg

SEQ ID NO: 24315 - DNA, 923 bp, Triticum aestivum
  unsure (1)..(923): unsure at all n locations
  Clone ID: PAT_TA_24315
accgtctgcacttccactctaatttctcgctattcatccgtctttgttccgccagcatcctttgactcgactggtccgaatctctgggcccaagctaaacggctctcttcgtcactgatcaacatcggctgtagattaaactcggttactccttcaaccgagtaaactttcattacccccccgtctggcatttatagggcagagccgatcatccactccgacccacaccccatctactcgcggncatttattcccgcatcctcctctattcttttacaacctatcttcgctctctttgcgccaccactgccattgttctccaacacgctcattaccctaaaacgtcccgacgctccttataaaaatgacactgttactccgactggtctcttcttctcgcggcgactgcgagcngccgtcgaacgcacattctctattcaactaactccttcacattaacggcccaacgatcnaggggcgatggggacctggtattcgcaatgcctaaaagacccaatcaactgccacttatccccccccaggcttgcaggaccctgctatggtatgcggatttngatgggacgaatggtgttcagcgtgtctgcaaaatcctcaaaggaacacctcggtttgagtatcacacttttccaaaccggagccaagaagnttcatcgaacttctcaaaaaagacctgcgctgttatacatgaaggcttccctcaactcctgaggtaatggtgaagngaagntggttaaggcctgggaacaaggtatgatcaagtccaaaatggtgccaaacaaatnatgacaacaatgggataagaacntgaacanctctgatctgctggngggaataccgtagaaggagctttacctcananctaaagtacactancccaatctagtnggtngccanantactgn

SEQ ID NO: 24316 - DNA, 787 bp, Triticum aestivum
  unsure (1)..(787): unsure at all n locations
  Clone ID: PAT_TA_24316
ctcgtgcctcgtgccgaattcggcacgagccacgccgacgcccaaataactgctaacgcgacaggaaacagaatttagagatggcttctcgtcctaccgtatctatcctttcggccgaggggaagccctgtggctcaactcatccactgccaaaagttttcaatgcaccgattcgtcctgatatcgttcaaacagtgcatactggaatggctaagaacaagagacagccttacgcagtaagtgagaaggcgggtcatcaaacatctgctgaatcttggggaaccggtcgtgcggtagcacgtattccccgtgtctccggtggaggaactcatcgtgctggtcaggctgcttttggaaacatgtgcagatcaggtcgcatgttcgctcctactaaagtatgggagaaaatggcatcagaaagattaacttgggtcaaaagcgatatgccactgtatctggccctcgctgcttcctctgttccggctctccttatggctcgaggtcatcaaatctccaccgttccgggagtgcccctcgtcatcaattccagtgtcttcgaaggtgctggtatcactcgcacagcagccgctatctcccttctaaaatctgttggtgcctcgtctgaactagaaaaagtagagggttcccgaaaactaagatccggtaaaggtaagcttcgtgggcgccgatatcgccagcgtcgtggccctctgggttgtgtatgatccgtccgttgatggtacaaagctcanccgagctttccgaaacaaanctggnggttganacc

SEQ ID NO: 24317 - DNA, 919 bp, Triticum aestivum
  unsure (1)..(919): unsure at all n locations
  Clone ID: PAT_TA_24317
gggctgcaggctcgngccgaattcggcacgaggcattattgaagctctgatatttttgtattcgatgcgtgcatcagttctttcttgaagagaaggttgggaatcatcagtctacatacatggctactcatactatggagacgctcgttggtgctacggataaagattctcttcagaagaacgtcattacggagagaaaaatcatttatgagccattgacagacctaaaaatgaataattcaatgtttgccaattcgacagtcaacgctctggttaacatagatcgaagtgacaataaacctgcgaatgaatatccaatgggttggtgaaccagatatagtacccacctctgagataggctgcacgaaaagagtaaaggggtctgtaattgcctttgataaaaaaggatttactacttgcagggtgaaaaatgagattcccccggtggatcatggcgtcacacaagctttggagtatcttaattcctcagtaattaaaaacaagatatatttcatctccaagtgtatcgactgagctaaaccatagcctagctactgcactcgaggatcttataactgggatacccatagtctatggggacgtcaaaagttttctccagacatcaaagaatacgctcgacaatctctgtgatgacctacccaatttccttggcgctgtggcccaacaattgtcgttccccgtgcgaaaatttcttcctgcggagctaataaaagtagcctcaactgtaccaaaattaaattctaaagatggcataaaattaaaaattatagataccctagcaaaaattttgaaatcaagtctctaacggaatgaggntttttttgccaagcaattttgatcaaaaaagtatcaatatgtttaacaagttaatggcctcctaattggtggttggtaacgg

SEQ ID NO: 24318 - DNA, 505 bp, Triticum aestivum
  Clone ID: PAT_TA_24318
tgcttgtgggtcctacttggactattgaattgctacagtcttggtttcctgctcgtgccgtgtccggcacgagtagatttgatttatttatttgataacctcaacacgctttggaacgacaggtgtaacctcaaatacaccacctagtagatttcgaataacttcaccttctcccttcttaccaaattccagaatttgcttcattttggagtcagcttcactaatcgcatcctcttcagctttcttattgttggaggcatgctcagattcaaatcttttaaattctaaatctttctttgctttgtaggcgtcaacttctttcttggcctcgtctcttgcttccttgacacgtttggttcgatattctcgtgctttctggactatcctctgtgcatccctctctgcgtccaatagggtttggatacccgcagaattctgggccgacattgttcgaggtgcgttgataaacaaataatctctcgtgccgaattcgggtggattttgt

SEQ ID NO: 24319 - DNA, 570 bp, Triticum aestivum
  unsure (1)..(570): unsure at all n locations
  Clone ID: PAT_TA_24319
ccgcccggtgggagggttacttcgcgcttgttgccggcgtggcttgctggggacgctcggcatccagatgatggtgccggcggcgcgcgcncccaaggtgtggggggtcccgcttcgtgccctggcttgccctcgctctccatcgccaccaacctgttcctcatgggctcgctcggctcggatgccttcgtccgcttcggcgcctgtaccgccatcatgctcatctactacgtcctcgtcggcctgcacgccacctacgacgtcgcccacgatgtgtgcagcgaagaccggccgcccggccacggcgacgccgctgatgatgctgctgatgagaaggcgacggcgaaaacggccgacgtcgagagggctagcgcgggagacggcggccgctaaagatgatccggagtcggccagacggtagtcagtagtcgctgcttgactatacgctgtctgaaaacttgtaattcgtaccatcaaatgaatctttatcttcacacgattgtaatctacacattcgcagtcttgatcttttgttttgtaatgtacatgtatgcctcgtgccgaattcgn

SEQ ID NO: 24320 - DNA, 960 bp, Triticum aestivum
  unsure (1)..(960): unsure at all n locations
  Clone ID: PAT_TA_24320
gcgttcggngccaagctggtttggtaaatggctctaagcttatgcaaccaatcaagnacaaatacccaagtatcacttatgcagatttattccagttggcaagtgctacagcaattgaggaagctggtggcccaaagattccaatgaaatatggacgggttgatgtcacaggacctgagcagtgtccacctgaggggaagcttcctgatgctggcccgagtgctcctgctgaccacttgaggctggtattctacagaatgggccttgatgacaaggaaatcgttgctttgtctggggcacatacacttggaaggtctaggcctgaacggagtggctgggggaaacctgaaacaaaatatactaaaaatggtcctggtgcacctggtggacaatcatggacagctgaatggctgaagtttgataacagttacttcaaggagataaaagagaaaagagatcaggatcttcttgtgttgcctacagatgctgcattatttgaggacccagcattcaaggtctatgcagagaaatatgcagcagacgaagaagcattctttaatgactatgcggaggctcatgctaaactgagcagcctgggtgcaaagtttgatcctgccgagggattctcattggatgattagcgccgcgcgttagccagagaacccttgaagcagccaaacacacttccaaaaggaccagaggacggcacaacttaatcaccatcgttcctctccagcttggtgtcaccatactacaggacgaggcattttcccaacttattatcatatagtacaagatagagattttccttcccaacttggtcaaattgttagatttggtggttgaggctgcaaaaataatacaggcgtgccaaacaaatctgagccattcgttcatgtgaacctgctccgatgacatattcgtttcattcaaaaatttatcacatgatgtttgcctgcc

SEQ ID NO: 24321 - DNA, 1677 bp, Triticum aestivum
  unsure (1)..(1677): unsure at all n locations
  Clone ID: PAT_TA_24321
ttgcggctatacccgcctacctatctaagcgtcaccacgtatctgcggcccgaaaaaaaaaaaaaaaaaagagccacagaacgaaacaacgactcaccggacgaccgcctccctctctcatcctgctcccaccccttgccctcccctcactccacagccccgccgcccaccgtcttctgtcaccaacccaccagcatggcggagcgtctcgccgcagccgccaccctccgcgccgacgctccgtccggcccctcgccggccggccgccgcgccaggccatccagctctgccttcttcccctcctcgtcctccccggctctccgcctcgtcagcctcctgggccgtgtcctctggcccctcccagaaggccatgtcggcggggagagggccatcggagaggtacgtgggggcggcgtcggttgcggaattgatgaaggccgcaagcgaggacatcagggagctgttcaaaacaacccacagccaccccatcctagttcgtttgggttgccaagattctggcatacatgacaaaaatagttaggactggccagaacgatgggggagctaagggacctataaagttttgatgttgaactaaagcatgaagtcaacgccggctttggtaaggtgatcttaaggcttgtgcaaccgatgcaaggacaaatcaccccagtataaacttatgcggatttattctagttggcaagtgctacggcaattgatcaggggctctggccccagaaatttcaatggaatatggaagggtcgaggggagaggctgggggaaatctgcaacaaaaggtactaatactggtgctggtccacctggtgcagctgaatggatggcggtagggctcaattttgtcaacaattaaaacaaggaaatagatgagtagtctggggtgtatcctcttgatgcggctatatttgaggacccaggctgggaggtacctgcaaagaaatatgcagaaaacgatgcagcagacgatgaagaatactcggaggcccatgcgaagctgaacagtcagggtgcaaagtttgggtgcagacgagggatttgcattggggatcttagcgtggcgcgtaaacaagagaacccttttaagaaccaaacacacttcgaaaaggcccaaagagacgccacaaattaatcaccattgttcatataccatttggagtcaccatactacctgacgaggcagtgtcccaactttttaccatatatgtacttctcataggttgtttattgccacgtgtgagacagagaacccttgaagcagccagacacaattgtaaaagtagcagacgacggccaaacttattcaaccttgttcctctcctgatccgtgtcactagactacaggacgagacattatcccaacttattatcatacagtacaagatagagattttccttcccaacttggtcaaattgttagatttggtggttgaggtcgcgagtgcaaaaataatacaggcgtgccaaacaaatctgagccattcgttcatgtgaatctgctccgatgagatactcccttcattcccacatgatgtttgcccgcctcaanggggggccgggtaccaaatcgcctatgtgagtctataccgcgctcactggcgtcgtttacacgtcggacnggaaaacccnggttaccacttaacgcntgacanatcccc

SEQ ID NO: 24322 - DNA, 926 bp, Triticum aestivum
  Clone ID: PAT_TA_24322
ctctaatcttctgtttttcgcctctctagcgatgggaaggctgtcctcacgccggatctgcggccaggtcgtaggaccggcaaggcaccagctctctaagaacctccctgttggtgtgcgcggattcggctcctttgacaggttgcccattggccaagtcaaagattggtcacttggcactgttatgtccctgggttccttgccagtctttgctggaggcatatggtatctcaaaactaatccagaggagccgggtgctcagaagcccaccgttgaggacccggaggagaaagccatgaagaagagattcgaggagtggatggttgtgcacaagcgcagatacaagaacgaggaggagaaggcacggcgctacgagctgttcaaggggtgtgtcaagagggtgaacgagctcaacgccgcgtcacggccgggtgaagcccggtacaaaccatcccgatatgctgactttaccaaggaagagaggagcaaaatacacggaatcgtggtcgaaccatctatgttcgacgagtggaacgaggagaagaggcgcaaaacacaagggggccatgacggcggcgccaacggggacgactgggaagaagagatgcgcctgatacaaaggtgtcttcgcactgcggcccttaatggcaaggcacaatgcaaagcacagcagtcgtcctaagtggtgaattagtacctatgttagcttccatcggtgtgttatatcgatatatataaatgcccctgtaattggtgagtttatgcatgccaatgtctgctgctacttatgcctggagccttgcagtgttgaactttaattagaacttcccctgtaccgctgtacgtactctatcttatcttagtataaaacataattatggagttgctgtacgtactctatcttatcttagtataaaacataatta

SEQ ID NO: 24323 - DNA, 1008 bp, Triticum aestivum
  unsure (1)..(1008): unsure at all n locations
  Clone ID: PAT_TA_24323
caggagcaatactttggtaatgttgcactaaagttcaatctcaaggcaggcggtataaatcacattttggagccaaccaagcttggcattgttagtgagggcaagacaatggttgtcggcgcgggccggactcggcccgcccccggatcaagggaaggcgcccctagtgttgcagggattgtggccagcgtggacaagtacttggggccaatggccttcacaatttagcattcaagccaaatccgaggacggaaatggtttctgacctagaatcgttgtttgtctctccgtctaaatatgtgggcaaaaaaagaaccaagaatcaacttccggaaaacatcctgatctaccgcgatggagttcctgaaggacagtaccgtcctgtattgacggaagaacttcctcaaatacgcaacgcatgccgcctgaaatatcctgcaaccgacaccaaacgagggctccccaggatcacaattgttgtctgtgggaaacgccaccacactcgattctaccctaaaaacagcggcgacgctgataaatcatcgaatttgatggctggaactgttgtcgatcgtggcgttacagagactcgaaactgggacttttacctacaagcccatgcatgtcttcagggaacagcccgtgcctgtcattactatgtgataatagacgaaattttccggtccaataaggttaagggtggtcacaaaaatcacgctgatgcccttgaggaattgacaaacaatatgagtcatctgtttggacgagcaacaaaagccgtcaagtctttgtcctcctgcttactatgctgatttactctgcacaagggtacgctgctacttatctgaagttttcgacccaagtgagggccaaagtgtgatgagtggcggnaccaaccaaacgatcgaggacattgntattccgccgagtatganggattccaagtactacatccaagctcaatgcatgagaatgngaatcaatnaaccaaaancttcggnggtaggt

SEQ ID NO: 24324 - DNA, 788 bp, Triticum aestivum
  Clone ID: PAT_TA_24324
ctcgtgccgaattcggcacgacatcaatctgaagaagtgacaagagagctaccttccatcaacaattgattctaactttcccgtcttgcaattgactacccttcaatagttcttgtctgctggtcccagctactccatatgttgtcagcaatggagtttgtcagacttgcttccgctttgagttctttgtttgtcgttgccaagtgcttgggcaatcgaagaaggtgcaacatgtgctaatgatagatggaccggtgatgacttgataaggatccgagatcaagaattgttcatggggaacgcatgaatacatgttaaatcatttgccgaatctcccgtttttcaagaaaggtgggggacaacagcccatgaacttcttcgtacgtcttcccgaaaaccggagctgaagggacatatcatcaaggtgagacttctacaactttacctctttttgcccgtaatcacacgttactaaggggcctcgcgcaataacttccatcagatatgcagcacggaaccgccactgctcccgtgacaggctcggacgcggtacttgctcggttcagatcaggggagcagaaatacaacaaaatcagataacaaactgcagaagaggatatcatgaacttcaatgctaaggggattggtagaaagtcgatgaaaataaaatgattgtattataattagcaaatctcaaaagtattgtaattaattcttttacagtacttttgagatttgctaattatcatacaatcatatttataactcatgactactacatcggccta

SEQ ID NO: 24325 - DNA, 631 bp, Triticum aestivum
  unsure (1)..(631): unsure at all n locations
  Clone ID: PAT_TA_24325
ctccgcccgagttcgccaccaagtaccagcaaaactcgtccactcaagttacctcgccgagatgggaaacggagccaaagcagcttccaaacgggatcgcaaggacaaagacgtcaaggtggccaaatcccaactgaaggttaacgaacaggcaagagatatccaagtgtaatatctgcaagtctacctttttgaaagacgactccgagcacccgctctctctgaacatgccacgaataaacacagtaagacattgggaatctgcttccccggattttccgccaagtgaaccaatgctgttgtctggggctgaatggactccgaggcgactgggaacgctggcgcgaaaggagatttaaaccagcagtcaacgggatgcttttgaaaaatgcatggcggtgaaagagacgctccaaggagctcctgggccgatgattaaattttcccttgtcacctttcatattgtgtttagcgtgaaactcggtgtattcatttaaccactgctcacctcctggtcatcacgcaacatccagctgctgagaagnctatctgatcatgttgccacgctataaactgataaactcctaagactcatctttatagnacacatcactcctacatganttaaagg

SEQ ID NO: 24326 - DNA, 673 bp, Triticum aestivum
  unsure (1)..(673): unsure at all n locations
  Clone ID: PAT_TA_24326
gnaaaaaggtaggaatcctcttgtgtcctggccgtcggccgtcgctgcgtcgttccagatttggggaaggaaatccggcaccgagattcgagtcgaaaggacatcatttgctagatggcacgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctttgcaggaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggcagaagaactctgcgctcgttttgtgtgttcgcctctctcaccctgtaagttttatggaagatatctagtaaactgtacttggcctgtttgactgtagccgcagtagcatatgcatgcgcatactgttggctgtt

SEQ ID NO: 24327 - DNA, 539 bp, Triticum aestivum
  unsure (1)..(539): unsure at all n locations
  Clone ID: PAT_TA_24327
ctcgtgccgaattcggcacgaggccagtagtcatatgcttgtctcaaagattaagccatgcatgtctaagtataagcatttataccgtgaaactgcgaatggctcattaaatcagttatcgtttatttgatagtaccttactacttggataaccgtggtaattctagagctaatacatgctaaaagccccgacttcggaaggggtgtatttattagataaaaaaccaatgcccttcggggctccttggtgactcataataacttaacgaatcgcatggccttgtgccggcgatggttcattcaaatttctgccctatcaactttcgatggtagtatatgggactaccatggggttcaacgggtaacggggaattagggttctattccggagagggaagcctgagaaacggctaccacatccaaggaaggcagcaagcgcgcaaattaccaatcccgacacggggaaggtactgacaataantactgntacanggctccttttgggtcctgtaattggnatgagtacaatttaaatnccn

SEQ ID NO: 24328 - DNA, 684 bp, Triticum aestivum
  unsure (1)..(684): unsure at all n locations
  Clone ID: PAT_TA_24328
ctcgtgccgaattcggcacgaggaacaaacatcaccttcaattcgcattcatcaagatgggtcacccagcaggtcttcgcgcgggcacgcgctatgctttcagccgaaatttccgggagaagggaatgatcaagttgtccacttatttgcgtcaatacaaggtcggagatatagttgatatcaaagcaaatggtgcagttcaaaagggtatgcctcacaaagtctaccatggaaagactggtgtaatctacaacgtcacaaaaaatgctgtcggtgttattatctacaaaaaagtcaagcacagatatattgaaaagcgtgtcaacctcagaattgagcacgtttcgctatcacgatcacgagaagagttcgtaaggcgtgtcaaggctaatgccgagttgaagaagaaatccaaggcagaaggaactcacgtgttcctaaagagacaaccgcttcaaccccgggaagcaagaaccatttcgatgaaaggacaatgtaccaagaaacagtcgttaccgattgcatattgagaccccacttatttggtcatcggtgcagttttcgtccggggcgggggttggcggggtgccctcctttttccgagtgggtcaatctagccacagccggcacccgggccgtcgcgagggccggccccggttacccaatttcccccctantagtgng

SEQ ID NO: 24329 - DNA, 462 bp, Triticum aestivum
  Clone ID: PAT_TA_24329
cttctccaatcgacacaccccgccgctccgacacgggcgcgtcgacgccggagctcccctgctcagcttcaccgtgctgctcccctgctctcccgcgcgtcctcctccgccgcctgggaggcctacgccaccgctccctcctgcctcgcgcagctcccctgcccccttgcctgcctcccaaatctcccctctttcacccccaaagtcgtttcttcttcctcccgctgcgtctcctgcttgcgcgcggcggcgacacctcctcctcgttgcccccgacgccagaggaggcacggggcaagcagcagtgtctcgcgctgcgcttgcgccacctcgggtgcgcgtgggactatgcaccggtcgccgcttcggccgtgcgccagtcccaaaggaggaaggaagggggttccgttcgccgccaagggtatgggtatctctcgagtcccgctcttaagcccctctcac

SEQ ID NO: 24330 - DNA, 779 bp, Triticum aestivum
  unsure (1)..(779): unsure at all n locations
  Clone ID: PAT_TA_24330
ctcgtgccgaattcggcacgagctcgtgccgaattcggcacgaggaaattatcaactatgtcgtcaaaaaccaagaagccttccggtaagacccaaaggtcagctatctccgacgttgttgctcgggaatacaccatacacctccataaacgacttcacggtgtaacatttaagaaaagagccccaaaagcaatcaaggaaataaaggcatttgcaacaaagtctatgggcacatccgacgttcgtctcgatccacaattaaacaagaaggtatgggaagctggtatcaagggtgtaccatatagattacgcgtccgaatctcacggaaacggaacgatgaagagggagcaaaagagaagctgtacagctacgttcaagccgtaaatgtgaaagacgcgaagggactacaaacagtattggtagaagcatagaaaaaatattagtatcaatgtgctacctgaaaaaaaaaaaatctcaaagtttacggttgactaaagctaacactgtgaagagactcctctaattttataggattgagagatgcaggttaaggaaaggtaatttcttatcatttggtagccactcattcctctcctatcagcgcccgcctgggacttttcgggatgttaagagatggaataaatattgcttccgatcttcaccttacctatttatttcanaaacaaagcttttgttactttataatcactcaaaactttacttcaacatgaagttatcatggntnaaaactatctccgaattacatcaattgaaatag

SEQ ID NO: 24331 - DNA, 539 bp, Triticum aestivum
  unsure (1)..(539): unsure at all n locations
  Clone ID: PAT_TA_24331
ctcgcatcaagattacttacacgattttattcaagttaacataggacccctgccgctgtcggctcgtcacaggattacgcaaattgttgaggttgtctccgagttcgaaaaaagagatcggatgaccaaacacctcgagaagattatggaagataaagacaataaaatattgatatttacagggacgaaaagggttgcagatgacataacacgtttccttcgccaagatggatggccagctctatccattcacggtgataaacaacaaaatgaacgagattgggtcttgaacgaattcaagactggaaagagtccaatcatggttgccacagatgtggcttctcgtggtatcgatgtccggaacattacccatgtactaaactatgactaccctaataactccgagggttatattcatcgggatcgggcgtacaaggcncgcaaggacaaaaagggacaagcggataactttctttaccactggcaactccaagcaaggcacgagatttcgttccggcctacngaggcaaacacanttc

SEQ ID NO: 24332 - DNA, 1163 bp, Triticum aestivum
  Clone ID: PAT_TA_24332
ttcaaaggaccggcagaaaaggatgatgtgttattgacatcaccaaaaaaaccttgcatagcagtacgaaaggacctaaatccgcctccactcctggtagaaatctatggatccagaccaggtgggcagccccgagatatgccagttcgtctcaacggtgggcaaccccgagatatgccagtgcgtctcaacggtgggcaaccccgagatatgccggttcgtctcaacagtgggcaaccccgagatatgccagttcgtctcagcggacctgaaacaattcttcgagctgtaaccagtggtgcaaatacacgttcggcgttgacagattcttccagtactgcgggtactagacctgttaagttgcaatctggagcaaagcacatactccagccatgtgctagtgctagcttggacccaggtggattcctggcctgcgcggtcggtcatacagcttgaagtggagaatgatgctcgcgcagtaggtgcgtcgaagaagaccgacctgtgctgaagctgcagagtttaaccgttcccagggttaatgagtcttttcgtcgtcatcagactagctaatcatgaagatacttcgtaccaagcccaacctgaaaccagataaatgatcttatgggacggagctggcatcttgcatcagtttctcccgtaatatcgctagcccttccctactgttgttgttgttgtaatatgctcctggctcctccatttaggttagattgtatttgtcctcaagcaatcggcagcatctctgccctttcatcttggttagatggtagtttcagctgggatagatggagttttccagcattggaagagaagttctgttattttcccaactgttcatgttacaaaccattatcgttagtttgttttcgatcgatcgattggcgagagccctgccttttcatcttggttagatggtagtttcagtgctgccataggtggaattttctagcattggaagggaaaatctgttgttttcctcgtgtgattttggctgtggtggtgatacgaagccccaagcttttccttgtgttgttgctgcattcctacgcatatgcttctgcagactaaattctcccaacaaactaatgaattctgtgaactgcaagctattcttctcagccaaagacagttgtttatacagt

SEQ ID NO: 24333 - DNA, 765 bp, Triticum aestivum
  Clone ID: PAT_TA_24333
cgtccgcccagcgtccgcccagcgtccgccccgcgtccgcagctagctgcaaccacaagtaggctgcaatggcgaggcatcgcctccttgccgtgctcctcatcgggatagttgcagcctctgccttcaaccaagcagctgccgctggccgaggccttgccgtcgtcgagaagttgcagagctagagccaaagccagaatccaaaccagagccaatgcccaaacctatgccacacacagagccagaaccatgcaaacctgaaccgacgcccaaacccaaaccaaagcccggacagaagcctgaaccagaacccaagcccaagacgatgccaaaaccgaagcccgagccctgctccaaaccaaagccggggcctaagcccgagccgatgccaaaacctgaaccaaagtcggagcccaagcctaaacctgaaccgaaaccaaagccgcctccaaagtgcaaaccaccaacaactcacaattgatgggatactatatacgagagttgatggaggagaccccgcacggagccacactatgctatttctagaataagtggtgtagtattccttgtattccatttctttctattttcccatgtgagcgtgatgagtactagtactgtgtaattactatttggttgttggtatatgttcatctactttgtatgtgacttgactcgcgttgttcttttgagtatctacgcatgattgtattcattcacatgaatgagctattttgtcagtggactgcagtctgctgttttcct

SEQ ID NO: 24334 - DNA, 883 bp, Triticum aestivum
  unsure (1)..(883): unsure at all n locations
  Clone ID: PAT_TA_24334
gcacgcagcaacacaaacccaaagcacagcaggtgcaacactagctgcaagcacaagaagtaggcagcactggcgaggcatcgcctcctcgacccttgctccccatcggcatacttctagccgccgccttcatccaagcagctgcggctgtccgaggccttgctgccgtcggacgaagcctgcacgacactagagccaaagcaaagaaaccaaaccaggaaccaatgaccaaaacctcaaagccacaaaaccccacgaagccaagaacctagcaaacctgcaacccggaaaccccaaacccaaaccaaaagcccgaaccaaaacccaggaacacgaaaccccgaaccaagaacccaagccccaagccaatgccaaaacccaaagcccaacccctgccccaaacccaaagccaggtcctaagccccgagccaatgccagaaaccccgaaacaaagccggacccccagcctaaacctggaaccgaaaccgaagccttctccttaagtgcaaaccaaccgacacgatcgcaattgaatgggtatactattatatatgacatgttaggaatggaggaagaccccatacgaagccaacactatgctatttcttatgaataagtggtgtattattccatgtattctatttatttctattgttccatgcatgtgtgatgagtattattactctgtattttcttttttgcttgttggtatatgttcatctactttgtatgtgactcgactagttgtacttatgagtatctacgcaagattatattcattcacatgaatgaactattttgtcagtgaaaaaaaatcaaaattgcaatcgtcactaaaaagcccctccctnccgtcaaacttgcccccccgnaanggacccct

SEQ ID NO: 24335 - DNA, 977 bp, Triticum aestivum
  Clone ID: PAT_TA_24335
tccgcggccgcgtgggttaccaactttttgtgaaaggtgtaaaattgccgaagactttttcggatcggaagagacaattccttaaatctaaggataacatatgctagggcagaatatcggaatccaagcatgtaccgccggtaccacaatgtgcacttccgttctccagatggccatggtgatgataatgagtatgacaatgggggactagtcattgacttgaaggagaaagttgtcggaatggtcaacctccctaagagatttgggtcttttataacgtcttccattttgctcaattgtttggattcatggaagaaatatcggtacatcgctcggccccatcttgggatgatgtttgaggccatcaagcatctagagcctgctcatgttgacatgttatggcatatgtataacattgatcatggtcttattgttcaagaggtgtcgaaaggatctaatgctgagatactcggaatccaaaaaggtgatgttattgaatctatcaatggaaaacctgtttctaccacaattgagttggaaaatacgctgatgatcacatgcaagggcccttcaggtgctgaagttcatatttctgttggggtgtttcacacactcaaaaaacaacgaagtactgtacagtggacagcagaattatcagaacttggagaagttcttacaagctaggtcctacagactcttgaaccggctgccagaagagggatgcgagaaaatgccagaaaagggatgtttctgtagagctgtgatggatatttacctgtgacaccatatgttgtagtagtactctagatatattagaaataacatctttagttgtagttagtgccaaagtagcagcccgttgtgagattctctcttctgctaaaagaaatgcagtacaccatattgaaacccctctttattgagcattccatgtgtcaaatagttaacctattttacatgcccccttgttcatgatc

SEQ ID NO: 24336 - DNA, 592 bp, Triticum aestivum
  unsure (1)..(592): unsure at all n locations
  Clone ID: PAT_TA_24336
ctcgtgccgaattcggcacgagctcgtgccgaattcggcacgagtgcccccagaacttcgccataatccagcctcacgacaaattctcatcaatcaatcatggctgttggaaagaacaagcgtctctcaaagggcaaaaaaggtctcaagaagaagacccaagaccctttcactcgaaaggactggtatcaagtcaaggctccctcgtcgtttcagatcagagatgtcggcaaaactcttgttaatcggacaaccggtcttaaacacgccaacgacgccctaaagggccggatattcgaggtttcacttgcagacctccagaaggatgaggatcatgcattccgcaaggtcaagttgagagtcgacgaagttcaaggaaagaactgcctaaccaacttccacggactggacttcacatccgacaagcttcggtcgttggtgcgaaagtggcaaacactgatcgaagcaaacctaaccgttaaaacaacgggacgactatcttatccgtctcttcgctatcgctttcaccaaagcggggggcgggacccaaatacaggaaaaaacccccctcggccccctcccttcgccggcn

SEQ ID NO: 24337 - DNA, 1220 bp, Triticum aestivum
  Clone ID: PAT_TA_24337
cacgcacacaggtcccggtccacactttcagccgctgtcacagccaaacagcgcacgcgcgaccaagaaccagcccaccgacgaccgcgcgcgcggccatccatccatccatggcgcagccgcacaggcgcgtgctccgcgtggctccgccgggctcagcaggagggagcggggacggggaggcgttccccacagtgcaggccgcggtggacgccgtgccgctgggcaacagggagcgcaccgtcatccgcctcgccccgggggtgtaccgggagcccgtctacgtccccaagaccaagaacttcatcaccctcgccggcgcgtccgccgaggccaccgtcatctcctgggacaacacagccacccgcatcaagcacgcccagacgtccagggtcattgggacagggacatttggctgtggaacagttattgtcgagggagaggatttcatcgcagagaatatcacgtttcagaactcagctccccagggatccgggcaagcagtcgcagtccgggtaacagcagataagtgtgccttctatggttgtcggttccttggttggcaggatacattatatttacattatggaaaacaatacctgagagactgttacattgagggtaactgtgacttcatctttggtaactctattgcccttctagaacattgccatatacattgcaaatcagcgggatttattactgcccatagtcggaaatcctcttcagagtcaactggctacgtgttcctaaggtgtattattacaggaaacggagaagctggatatatattcctgggtcggccatgggggccctttgggagggttgtctttgcgcacacttttatggatcgctgtgttaaggccactgggtggcataattgggacaaatctgagaatgaaagaaccgcttgcttctatgagtacaggtgctcagggcccggttcccggtcatcaagcagggtgtcttggtgtagagaattgcttgaccttgaagcagagcagttccttacacactccttcgttgatccagaccttgatagatcatggcttgtccagatgatggcgataaagataccagcttcagcgtagtctggtcccaggatcctagttcaaacctccttcgtaccctatctagtaaataaatttggggagtgtattataagtgtatcacatttattcacttttgtatccacgttctataaaaaaaaaaaaaaaaaa

SEQ ID NO: 24338 - DNA, 732 bp, Triticum aestivum
  Clone ID: PAT_TA_24338
ctcgtgccgaattcggcgcgtgctatacttgattttcatctattttcggattccagaatttcctagcttgagatttggaataaacacacccacagaacattctacaatgaagtttttcaccatcggtagcgtttccgcgctcttctgcatcttagggccagtgacagccatgtcaaataaaagtaaacaacagccattaccaagtgcccaagccgaaccaagaattcaccatgtcttgccaaaatggggaacagttacgaaaaatctcaactcgtcctagcagttcaaacagccaaacaagtcatgggtcccaataatacacacaatggttatcccttttagattaaattggcccccgtatgaaattcccggacaattgtggtattatcctgttgcagagggccaaggtatacaagatttcgttgtattcaacacatgacgatcagatagcgggcgtagttacccggcctgttctcaatcgccgggacatcttcagaccttgtgaaatcatttaaaactttgagttgatgaatgatgttgagctcctctacatacagcataattgggtagttgaaatgatgtgttggacactgagagccatctgaatagaatagaatcaaagtccctactgggtctatgactatgaggggctgagggtcaaattaaaaagtaaaataatgagatctctacccctgcaaaaaaaaaaaaaactcgtgccgaattcggcacgag

SEQ ID NO: 24339 - DNA, 513 bp, Triticum aestivum
  unsure (1)..(513): unsure at all n locations
  Clone ID: PAT_TA_24339
ctgtacaattacaaatatttcgacagacgcattttcgccgaagatacttacagaataaaagatgcctcgcgaaacctctgatatcaagcagttcatcgagatttgcagacgcaaggatgcttcctctgcacgcataaagcgaaacaagaaaagcgcccagactaaattcaaagttcgatgccaaagacatttatatactctagtcttgaaagactcggaaaaagttgaaaaattgaaacaatcattaccacctaatctcatcatcgctgatacaccaaaaaaaaacgcaaaggggaagcgaatagcttaaaataacttggataaaagaaggacacaaaactatctaaaatttgctagtcatcaatgaacctgtctcataaatcaatgttggatgatgagacagcgccctagacgttataaantaagcaacgaatacctgcaaagtattgacgccgggccaatataaaatatagtgtgaaacctaaaaaacttcttgcgaaaaaccgaacaatc

SEQ ID NO: 24340 - DNA, 571 bp, Triticum aestivum
  unsure (1)..(571): unsure at all n locations
  Clone ID: PAT_TA_24340
ctcgtgccgaattcgcctccacgttctttgccattcccctcctttcaagctagacttttacagttgcaattatttcatcgacgtcgacgacgatgactgactacaagataccaatttctgatagcgaatcccaccctctttatgtttccgagaaacaagagttgccagcgccagcgctagcacagcaatacaacgacccggcctcgagatgtcagagatatcgtgcaagaagatgtattctaaattttgtggcagtcatggcgctgctagtctggaccggttactattttttgagctcaatacagtgtatgagtagtacgattgggggaggtttcagctattctccagaaaatagcaagatcttaattcgcaccaggaaaattcaagcattccgaccccgggtcatgatcatggatattcctgagaaatacttgccggagataggcccagatcgaactcagcgtcgggctactcgtgatcggcgacattcacggcatgaaggaatcaatgcaaagatcttctccaagaaaccaaatttgatcatgagcaaggccacctggntctagccggg

SEQ ID NO: 24341 - DNA, 758 bp, Triticum aestivum
  Clone ID: PAT_TA_24341
ctcgtgccgaattcgcctcccgccttcgccaccaggctcataaaaaatggcgcccacccaaggcaagcagagttctcaggatttgctcgaggctcaagttgacctttggcaccattcattgggatttgtcaagtccatggcactcaaatgtgcaatggaactgcaaatccctaacaccatccaacaccatggtggggctatgactctttctgagctggccacaaagacagggatccatccgtctaagcttccccccttagggcgactcatgcgtgtactcaccgtatcaggcatctttgttgtccatgactcagcctcgggagacaacaaggaggctgtgtatggacttaccccaagcacgtgcctcctcgtcagcgatgaagttaaatcaaacctatttcccattctgtctttgttccttgattcaactgccattacaccctttttcggcatgcactcatggttcctagatgagcattccacgtccctgttcaaaaaggctcacggccttaacgtttgggagatgggaccagaacaatgcttgcaacgagcaaaataacgcgatgcaatatcctgagggagtgtgatcttgggtgggggagacactggtgtctatacttgtatcgctagaccctcgaacacatgctgaaccgagacctagccccctacccttaccatcatgttgctagagggatggggtatctgaagttgcgcatgatacatacttcctctgtcccatagtgtgagacgttctttga

SEQ ID NO: 24342 - DNA, 524 bp, Triticum aestivum
  unsure (1)..(524): unsure at all n locations
  Clone ID: PAT_TA_24342
aaaatctacaaatagtagataaaattttcccaatcctgttgccatagcgtatctcaagctatcttctcatcatcccagggtagaaactccgccaccaatgtcagactccgctcccaccaggcgaatctaatagcacaaccaccttatccgcctacgataacgaactccagaaaaatcatatttagtgagacatctttaaaatattttaagtgttccaggggttctttgctacccaaccgttgcatacttgtttcgattcactttttcacaagcctaccggtgacgagccttgaagatcgccactttatcatcataaaangaggatttcacgtagtccgtaatcgtaaattgggttccattctcttccgaacattcaaacgagtcaagtatctgagctatcgtattctgacatttcaagaatcaagtctcatctaagatggatancaaggagttgattccggccactggtgttgttaaaattatcgtcctccgtcatcatcaacatccttcatcaatccttcctc

SEQ ID NO: 24343 - DNA, 557 bp, Triticum aestivum
  unsure (1)..(557): unsure at all n locations
  Clone ID: PAT_TA_24343
agttcggctcgtgccctatgcgccacggctgctctccggccgctttctgttaaacattgtctcacagactcaatctatcactcaaaatggcaagcgcacgcatccaagaaattacggacgaagagccgcccaagaaagttacggcagaagatgaggcaacagaaagctctgactcagagcccgaggccggtgagggtggggtttccagtggaagcatggtagtccattcacgaaacgagaaaaaggctagaaaatcaatcgcaaaactaggactgattaaagttccggggataactcgtgttactctcagaagaccaaagaacatcctattcgttatcaaccaacccgaggtctacaagtcgccctccagcaacacttatatagtatttggagaggctaagattgaggacctcaactctcaggctcaagcgtccgcagcacaacagctagcagccaatgagggacatgaacactctggtcacgaacactccggtcccggtnactctcatgacaatggtaangggaaagtggctgaatctgacgattaaaaagacaat

SEQ ID NO: 24344 - DNA, 721 bp, Triticum aestivum
  unsure (1)..(721): unsure at all n locations
  Clone ID: PAT_TA_24344
gngagctgggagcaatgagcttggtggtctatccactcctgcggctcccgtgccgctgcgccctcgcggcggcgccgcgggccgccgcggcgtcggtggtgtcgctgtcggcatcggcctcggcctcggcggcggacggcggggacggggagctgacggcgcgggagaggcgggagaggcggagggaggcgagggagctcaaggcgcgggactggaaggaggaggtggaggagcggctcatccacgagccggcgcggcgtcggaagaagccgccgaagcggacgtggcgggaggagctcaacctcgacttcctcgccgagcacggcccgcagtggtggctcgtgcgcgtctccatggcccccggcaccgactacgtcgacctcatcaccaaggccgtcgcccgccgcttctccgaggtgtccttcaagatttacaacccagcaatccaagtgaagaagaggctgaaaagtggtttgatcagtaccaagtcaaagcctctgcatcctgggctggtctttctgtattgcacattaaacaaggagcttcatgattttatcagagacactgaaggttgttatggttttattggagccacaagaggatctattaaaaggcagattaagaagcctaaacctattccagttgaagatgtcgagtcgattattaacgaaaatcttgttcgaattatccatgctcttgcttatacagctctgttagatag

SEQ ID NO: 24345 - DNA, 1346 bp, Triticum aestivum
  Clone ID: PAT_TA_24345
ctctctactccagtactccggccatgtctctgcacatccaccagctctgcatctgctagcaaaaaaagtaagctccacaaaagaagagaaaacgaccactctgcattcctccgtcgaagctcgtcgccttggtggcaggaggtgacttattaactgcatctgcatcaccatggacttcgccgtggacgcggcgctgtgggtggttggcaaagcgctggcacccgtcacggacggcctgctggagtcatgtgcggccagcaccgagcttggccgcaacatcgacgccctcaagatgcaactcctctacgcacaagggatgctcgacaacgcgcagggtagggacatccgcagccctgcgctcaaggagcttctgcacaagctgcgggagctggcgtactgtgccgacgacgcgctcgatgagctcgactacttccgcatccaggacgcacttgacggcacataccatgccgccaatttggattcccagagctgcgttgacaggatcgccatcaatgctcaccacaccgccaaggctgcggccaataatctcaagtgctcatcatcctctacccgggctgatcccgacgatcaggaagatggtggcaaacgaggatgcctctctgtcgttggctcgtgtggggagcatgagatcagctcctcacgaccgccacccaccacccagggagtccaggaggttgatggcggatgcatgcctaatgtcgtctcttgtgctcgcaccgctgcacaaactatcggtaaacactttccgtgctactctttcccgtctgtctgcgatgatgatgcggacaccgtcatggtgaaatcctccaatatgacagggagtggacatcaatatgtgctacaaggagatcacgccatgcaaacacgaaaactgaagtttgatcgggtcgtaatttctacaaaaatactggaaataatagagcagttgaaacttctgtgtgctatggtctccaccattctcaatctagaactacttggctccacacgtatcccccctgcccaagacattactatgaaccgacccaaaaccaccccaaatattatagagcctgagttgtatgggaggaatgaccagaaaaaggaaatcattgatgacattacaaatggtaaatattgtaccaatgaacttaccgtagttccacttgttggtccaggaggtattgggaagacaacactcacgcaacacatatttgcagaactggagggttctttccaagtttcagtttggatatgtgtatctctagattttaatgcagataggttgacgcaagagattgtgaaaaagatccctgaagtgaatgatgaaaaggctaatgctaccaatc

SEQ ID NO: 24346 - DNA, 1138 bp, Triticum aestivum
  unsure (1)..(1138): unsure at all n locations
  Clone ID: PAT_TA_24346
ctcgtgccgaattcggcacgagtgaacgcacaaactcatcaagagaacggngcccatgcgcaaacacgcggcagaggccgcggatcacgagttagtggtcgttttaggcaaaggnctaatacgacgacgagacctcctgccgcatccggcgcccccgcgtcccgaatccggcccgaccgactcctagagccggaatgggtgaaagacaatgtcttaaaagacaaagtcttcgttctatggcttggttccggtcagaccggaacccagcagtggactttccaccatcctatcggtcacaccgatatggatgacacggagtgggtggcaacaccttcacgtgatatcgactatcttctgcaaagaagagagtcagagtctcttgcttcctggaagaggaaagcagagcttgccaaaaggcaaaaagtcctacggtcccgtacgggacgtggactcgacgcgtcaggccaagaggtctggacgttcgagaatgcaccggaaattcatccggtcattcatacttgcatcactgcggcaaaggccgctggtgctaaggagtctgcatggttagactatgcaagactcagctgtccgaactgcaagaacagcagttcaaggaggcctttgcgcaagcaagaaatccctgaaagcatgggttgaaggagaatcctcaaccaagctatgaaactatgggtgggtcctctaggggaccagccacagaaagctgttccctacttgaagggactcagcttatcagcggcacgtgacaaggtcacgatgactgctatcggatacgagtctgactcagattccgacgatgagcccgaacctattcaggttcgaggtggatcctagtgtcgtctcacgataactaggacgtaacaactagtggagttgttacagttctatataccaaagggtagatagatactggacagtatgctaagcgcaatataccgccgcgagaaggtactggacacgggtttaccgatcccaatacacgatctttactgactaggtcaagcatagattgtacgcagggctcctattggagcaaccttacgttaaaaaaaaaaaaaaaaaaaaaactccnaggggggggccggggnccccanttcgccctntaggggangtcggnntt

SEQ ID NO: 24347 - DNA, 513 bp, Triticum aestivum
  Clone ID: PAT_TA_24347
ctcaagatgaagttctcttgccttgcgattatcaccactgcctgtctatccgcagctcaacctcataaccaccgtcatcgtcacatggcccgtcatggctctcgcattgaggctagagacacagcgacatcagttcaagtcgaagcggcgatggttaccgtttacgaattaaatggacaaaagatttcttcaaacgacgtggactcgtgtctcaaggagaataaatgtgtggtccttggtgctgggtcgagctctaccgaaagtcaagaagatttgaatactttccctgcaccagaccaagataactcttcaccagaagactcaccatcaacagaagacaatgcatctccaagaagagccttccaacctagaacctccagtcccaatcccgtctactccagagccactaaaaccaagagcccccagtcccagtcccgtctactccaagagcctccaaaaccaagagccccctacaactgatcacaagaacgcaggctccatcaaggaaagccc

SEQ ID NO: 24348 - DNA, 780 bp, Triticum aestivum
  unsure (1)..(780): unsure at all n locations
  Clone ID: PAT_TA_24348
ctcgtgccgaattcggcacgagcatcatcgtacctccacgatggctgagcctctgaaaacaaacggcaatggggctgctgaagcgggctctgcgtttgcgtcggtgaaggtgccgccgtcgcccccgaggaggctgcagaggttcgactccctgcatatggaggccgggaagattcctggtggccatagctatgcagccaaggttggctgggcgacgacactgcacttggccttccagagcctaggtgtggtttatggggacatgggaacttcgcccctctatgtgttttccaagcacctttactggtgggatcaaggacacagatgacctccttggtgtcatgtccctgattatctacactgtgcttctccttccattgatgaaatattgtttcattgtcttgagagctaatgacaacggcgatggtggaacatttgcactttattccttgatatctcggtatgctaggattaagcttgataccgaaccaacaggctgaagatgcaacagtctcttactacaagttagagtctnccacaatcgtgtcaagcggctcattggttaaggaaaaatggaaacagcccgaatttaaggnatacttttctaggacaattntacaacatnatggtnttgggacgggggctactcnttgntttanggttagggngtncggaataagcattanaaagtcttactaaggacaaatgtggatngaaacggatttnnacnccttttttgtaacctttgnaaanaantgtaccatttgccanattttnttg

SEQ ID NO: 24349 - DNA, 979 bp, Triticum aestivum
  unsure (1)..(979): unsure at all n locations
  Clone ID: PAT_TA_24349
ggggnaaggatctttggggaatggtcgggcccctgnncccctttgttgtgttnctncgcctttaacagtgggacttgttacattttgtggnttnttgttgttggtntgctgggtgcnccttctggatgtcgttggtagtgtgattgtgcgcgatgntccnccncgtgganaatgttcctanatggccntaaattatnngcgtatggggtgtaacccggggtgttccccntttgtttaattcacggcgtgtcaggatgggctntattttagtnattttccaccccatcccnacttgtnccagcaccngggaaggtacataacaggagtgacaaggcagcatgtggatggttgaccgggttaaaccaaaacatatatgggagtataacgttgaacaccagtggagtgtataatccgtcggtataggagtgttcggtgttgaggaggggagcccatgactcgtgccggagtcggcgcgaggagaactactccctccgtcccaataatgtagttcccaacatctttttaaatgtcaaacttttgaaactttgacccaagtttataaagaaattacttatatctacaataccaaacataaatgatagtatgaagtaagtacatgttgtgatgaatctaatgatctttccagatgtaaatgtttttctccacatatacctggtcaaacttttctaaggtttgacttttcaaaacatccatatgcttatggacgtgagagagtccctaactagagagagagagatagagaaatagaaagagtgagtgaaaaaagtgtgtgtgcctgtgtgaaagagacatggacaacactcgataaaagtcgagaaaaaaagtgtgtgtcttatgcaaacatatcacagatgcagcttcgacaacggaagcagggtgaggagatagtgtgtggttgtttgcaaccgacagagcaagacccctagcacgtggccaagaggggtctgagaaacaaggg

SEQ ID NO: 24350 - DNA, 989 bp, Triticum aestivum
  unsure (1)..(989): unsure at all n locations
  Clone ID: PAT_TA_24350
aatcaatccaaagatccgtcggaaatatgagaccaacattgttacaaggacatgaaagagccctgactcaaattaaatacaatagagatggtgacataattttctctaccgcaaaagatcaacatatatgcgcatggttctcacacaacggtgaaagacttgggacttatcacggtcatcaaggtgcgatatggacagtagatgttgaccctacgagtactattatcgccagtggcgcggcagataacaccgttagactatgggatatcaagtccggcaaatgcttaaaggtctgggatttcaacacggctgtgaaacgggttgaatttaacgaggacggttcgcaactacttgcagtcaccgaacaacgtatgggattcctgggtactattgtagttttggacatcaaaatagacgtaaatgctgaacagtctgacgaagaaggtcatgacaataacttgcgaagaaagcaaagctacagtcgctggatggagttacttgtccaagtatataattgcgggacatgaagatgggagcgtatcccaataccatccaggggatggccgaagaatcttaaatgagaaggttcacgagacaatcatcacagatcttcagtggtcgacagacaggacgtatttcatcactgcgtccaaagataagacttccaagcttatcaatgtctcaaacctggaggttttaaaagtatacgttgcagacacgcctctaaatagcgcctcaatcacaccaaagaaggacttcgttattctcggaggaggacaaggccgcaatggatgtcaacactacttcgactccgtcaangggaaatttgaagccgaagantttancacaaaaatatttgaangaaagaaatccgggaagaantacnggggacaatttcgggtccacttaacantggtcccnggttgnttccnactgggnaaanggntacgccaagttggtggganaaaattgggtacctnncgggtaaa

SEQ ID NO: 24351 - DNA, 537 bp, Triticum aestivum
  Clone ID: PAT_TA_24351
gccatctccagcaagattctaccggaaaagtttgactctactaaacgtcaaaatggtcaagaaacgagcatcgaacggacgtaacaagaatgggcgtggtcatgtcaagccaatcagatgctcaaactgctcacgatgtacaccaaaggacaaggcaataaaaagattcactatccgtaacatggtcgagtctgctgccatacgcgacatttccgacgcttctgtatttcctgaatacacagttcccaagatgtacctcaagttgcagtactgtgtctcttgcgcaattcatggcaagattgtccgagtgcgatcccgacaaggccgccgtaatcgatctcctccaccaagagtgcgctacaataaggatggcaaaaaagttaatcctaaccaagctgctgcaaaaaccactcaggcataatcgtgatgaaggattagcctgttacctaattcatatccccaaatgtcaagatgtcctgttaggctcgactgaagtatttgtaattagattaaacaacatacctctatgacacaata

SEQ ID NO: 24352 - DNA, 520 bp, Triticum aestivum
  Clone ID: PAT_TA_24352
ctcgtgccgaattcggcacgaggcgaaacacattgtctgattcaaaggttgacgagaagattgacgccgcttgataaagaaaaactcaaggctgaaattgataagacagttgcatggttagatgattcacaagcagccaccaaagaagaatacgaagaacaccaaaaagaacttgaggcagttgctaacccaattatgatgaagttctacggtgctggtggagagggcgctgctggcggcttccctggtgctggtggattccctggtgctggagctgctcctggagccacccacgatgatggccctactgtcgaagaagtcgactgagtaaaataatgtcatgttacttgggatgtggttttcttaaaagtatttgcaaataatggtgtctagcgggtttggctatgataagaatgtatgaactttcatgctcgtttcgaatttaaagatagaattctctcagcagtgtctgttagttaaatgaatttaatcatgaaattctatccgtagtaatcaagaa

SEQ ID NO: 24353 - DNA, 663 bp, Triticum aestivum
  unsure (1)..(663): unsure at all n locations
  Clone ID: PAT_TA_24353
ctcgtgccgaattcggcacgagcccccgccggctgcggcccgtggcaacctcgctcgcatcaaggaattctctgaatcaagaggctctcagctgactagtccaaggctccggcatcgatcatgccgaccaacatgatctccaaggtgcttgagaaggctgtccttccactggatgttgcacctcctgtgaagaagggaccagcgtcccggaccgagcgtgcgtcgcaatccaaacatggagaggcttcaagaacggctactttattcccggggattaagcatgagacgttgaaagcacaacgagaagaatacccccgacccgacgcgcgccttggggctgcccggcccgcgacccgccccagcccatactctcattccgcatgggccgctagcccggcttacccgcccggggggcaccttccacagcctacgcgggccacgggnctgaggggcagcccgactgtgtcccaacgtggggctacaaaacgaggtcattccgacggaccatgcganncncggctgcaaatgatgtcgggcaaactgacacgcntgaagaccacttccgggtactganaagggtatatgggaaacggcctcgggtcacagattcgngaacagtacccgatnataatcggcncccgaagcntttncgcttcctcccac

SEQ ID NO: 24354 - DNA, 643 bp, Triticum aestivum
  Clone ID: PAT_TA_24354
cctctagtctcgaggccggttgttttgtcttctttctaggttttgacccggattcaacttgcttgccgctggtctcccccgcgagctgctagcacctcgccttgctggggctcgttcctcgtggccgatggtgcctcgctgatgggtttcgctcgcccacccccggttgccaacgctctgcatttctcgtgtagacttggatgaagggatattcatcgatttcctgaaccaagtaaggagtttcgactccaccttctggtgtcgcgctgattcgatgtgaccagtattcttccccattgggacctctgggatcatcagggctctgccctcctttttgcagaatattttaaacaattttcaatcatcctggcttgtaataaaatttcccacaccgcattgaaagtgtggaaccgcataaacagctggcactagtagtaaaagaccagccaatgcggccgggaatacggcgttgagaaacttcatttggacagtgtcgtctcacgaaactggactttggcctgcaaacaggaggtcgctcgatgttactgaggaggctcaatagataattgatgacaagatatccaggttttgtcaacggaaatatgttgatagtattcggtgccaacgtttctctgagtgaagc

SEQ ID NO: 24355 - DNA, 455 bp, Triticum aestivum
  Clone ID: PAT_TA_24355
tgaatatcaaattaaacctgcagttatggaaaacgataagggagaactcgtcgatctttacgtaccacgcaagtgcagtgcaacaaaccgaatcataaaggccaaagatcatgcttctgttcaaatatcggtcgctaaagttgatgaaaacggtcgcatcactggagaaagtcaggtctatgccctgtcaggtttcgtgcgcgccatgggtgaaagtgatgattcattaaatcgattagcacaacgtgacggtttacttaaaaatgtgtggagcgggagcagtcaacgataaaaaaatacaacttgagatgaatcataagaataaaaggagcaaatttaaatgatatgtaggctgggtatacgaatcatcttaatatgattcaattcatcgtttatagtttacaatcctagaattttagcactttatcctaaaaaaaaataaaaaaagggggggc

SEQ ID NO: 24356 - DNA, 729 bp, Triticum aestivum
  Clone ID: PAT_TA_24356
tccgcggtgggcatcaaggatccacttcttcaaatccaagcacggactggtgctggacaagcgtgccctcaccactgccattcaccaaggatgacatgatcaactcctacgccatgcacccggatggacacactatcttcatgtcttctagcagcaggcgctatctgcattgcaccttctcctttgacaccaggtaccaagagtggaggtgtcttggggaatggtcattgcctttccaaggacaaggctactttgacagtgagctggatgcatgggttggccttcacaaggatgggtacatttgttcctgccaagtcgcttcctgcaccgacaaaggtaccatgcaacctgactggaagatgggcaaggagaaacttttcctcaagcactcggatgccaccctcacatacatggggagcaccaggttttgccttgtagagagtttggtacgtgaagaactggagtttgatgacgcctttggtgactgtaatggcttcatgctctgcatcaccatttttggtgtcaagtacaaccgtgagggagagctgcaaaccaccatccgccgcaccaccaaatcctatcaagtgtctaagcatgtcttgtcattttctcctgtggcgttctggttttagctaggaattagctggcttggttgtatgcaatgcatctatgtccttctcatggatgtatattattatttgtagcaataaaaatcttccttctcatggc

SEQ ID NO: 24357 - DNA, 841 bp, Triticum aestivum
  unsure (1)..(841): unsure at all n locations
  Clone ID: PAT_TA_24357
ctcgtgccgaattcggcacgaggatttccagtcgttcaattctagtccangtaaattacaacgccaaacgcaagtcgtcagtcgccaaaatgggtatcgatcttaacgcccaccatgttcgaaatactcaccgaaaggctcccaagagtgacaatgtttacattaagttactggttaagctatatcgttttctagcacgacgaactgatgcttccttcaacaaagttgttcttcgtagactctttatgtctcgtattaacaggccccctgtgtctatttcccgaatcgtggccaatacctcagagcacacgaacaataaaacaatcgttgtcgttggtacggtgactgatgacaaccgtctattgactgtcccaaaacttagcgtggctgctctccgattcacctcgactgctcgcgcacgaatcctggctgcagggggcgaaaatacttacattgggattaagttagctctaaagagcgcctacangggaagcaacccacttctaataagggggccaaagaactcaagagaagcagtaaaacacttcggatttgggccacacaaacacaagaaaccatatgtcgaatccaagggtcgaaagttcgaaaaggctcgtggacgcagaaggtcgaggggattcaaggtctaagcgtggctttcaatctttctattttattaaaatttagagataacttattggctcccaatgaggaacctctaataaattactggtataaaggataaagtaggaatcattaataaacaaagtcattctccccaagaaaaaaaaaaaaaaaaaaaaaaaaaaaaaaaaaaaaaaaaaaaaaaaaaaaaaaaaaa

SEQ ID NO: 24358 - DNA, 725 bp, Triticum aestivum
  unsure (1)..(725): unsure at all n locations
  Clone ID: PAT_TA_24358
ctcgtgccgaattcggcgcggagcaagacgccatcatgcaaatctttgtcaagacgctgacgggtaaaaccatcaccctcgaggttgaatcttcagataccatcgaaaatgtcaagtccaaaattcaagacaaagaaggcattcctcccgaccagcagcgattgatattcgccggtaaacaactcgaagatggtcggactctactcgactataacatacaaaaggaatcaactctgcatcttgtgcttcgtctccgtggtggaatgattgagccctctctaagagccctcgcatcaaagtttaactgtgaaaagatgatctgccgcaaatgctatgccccgcctaccccctcgaggccacaaactgccggaaaaagaaatgtggacacaccacccaagctccgacccaagaacaaagataaagtcttggtcttcttgaatcaactattacttcgtttccactaagatcagttttcattagaacgggcacaccggtatgtccaatttaatttcaggaaagcggaacacctggaaactagcggatatcaacccagaggcaattagaatgctcttagcctatatggaaattacaaatcatgtatcagacgcgataaacgaataattattggcagatgtctagaaagaagactacatacattcgcactcgtgccgaattccgcccctgatttctctcaatcaanaacnaaaaaaaaaanaaaaaaaaaa

SEQ ID NO: 24359 - DNA, 589 bp, Triticum aestivum
  unsure (1)..(589): unsure at all n locations
  Clone ID: PAT_TA_24359
ctcgtgccgaattcggcacgagcctcgcgcccctctcgccccgtctccctccctccccctccctctctagagccgcaggaacatggtgcagcagcacagaatctacgtcgtgcagttcgacaagggggagcctgaccaggaggagctgtcatgcaaggcctcgccgcccaagggcggcggccgccggatcatgtactactaccatgactacggcaccggaggcgccgccggcaagaacggcaagccggccaagtccagggcgctcagcctgagcggcttcttcggcttgctcctcatctgccttttcggcctcgccacgctcctcgcggccccgggcgccttcttcagcttcgcgcgcaccggcggcgcggcggcggcggcggccacgcagcagcagcaagagcgggcggtgctccgggatcggcaacgacaccctgtgctgcgaccgctcgtcgaggcgcgcggacatgtgcttcgcgcgcggcgacctgcgcatgcactcggcgagcgcgtcgttccacgctcgtgtcctccgccggggggccgccggcggggatgtttaggtccanganatttcaccantccatcc

SEQ ID NO: 24360 - DNA, 644 bp, Triticum aestivum
  unsure (1)..(644): unsure at all n locations
  Clone ID: PAT_TA_24360
caggaattcggcccccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaagggcggaggccaaaggcgcgtggtgaggtcatcaagcaccaaagaggcaagccagcaggccccaagcctgggttcatggtggaagggcaccacctcngagacggtcacccccattccgtacgaacgttgtcaacgatctnaanggtngggtactaanaaccgcnttggtggtttncttgagcaanaagcnttgaanccaagttctttaanatcttattgccttggtn

SEQ ID NO: 24361 - DNA, 601 bp, Triticum aestivum
  unsure (1)..(601): unsure at all n locations
  Clone ID: PAT_TA_24361
cgcctgccagcacctaaactaaccaaatcatcgaaatgggtcgccttcacagcaacggaaaaggcatatcagcctcagccatcccatactcaagaaatcccccggcatggttaaaagcgacacccgaacaggtagttgaacaaatttgcaaacttgcaaagaagggtgctactccctctcagatcggtgtcgttcttagagactctcatggcgttgctcaagtaaaagttgtcactggaaacaagattcttagaattttaaaatctaatggacttgccccagaaattccagaagatctgtacatgttgatcaagaaggctgtcgctgtacggaaacatctcgaacgtaaccgaaaagacaaagacggaaaattccgcctcattctcattgagtcccggattcatcgtctatctcgctactacaaaactgttggtgtcctccctccaacctggaggtatgaaagtgccactgccaagtactttagtttcataggagatatttataaaataaccaatgttgcgcgggattccanggggtagattgggtagtgggaagttagtccaantattaaaggtcnaacctccanatnattnggacaatt

SEQ ID NO: 24362 - DNA, 699 bp, Triticum aestivum
  Clone ID: PAT_TA_24362
gatctctttacccttttccatagcatagtcatggcggcgacgggcaaaaccagcagcacggtggttgcgctgtccaccctggctctagcggcgagcctcctcctcctcgccgtctccacagaggcggcctgccccagcaaaaacaaaccaacgccaagcgcatcgacggcgacgagcgggagcggcggaggtaagtgctcggtggacgcactgaagctggggctgtgcgcggacgtgctcggcctaggcgacgggctgacgaacctgatggcgggctcctggtcgacggcgtcgtcggggaagaagccgtgctgcgagctcatcgacggcgtcgccgacctggacgccgccgtctgtctctgcaccgccatcaaggccaacgtgctgggcgtcgtcgacgtcggcctgcccctccagctcggcctcctcgtcaaccactgcggcaagaagctcccggctggcttccagtgccctaactgatcaaccgagtccgtacgcacgcacgcaggaatggcacgttgttaatttgcttgctagtagtggtacgtgctgagcgcgaattttaattaagtttgtctgtctactggtccgttaatgttaagtctactatctggtgtcgtgtggtgacgtaatgacatgttcggtgcttgctgcgctataccttcagttccaactttgctaaatggttatttccctgtg

SEQ ID NO: 24363 - DNA, 757 bp, Triticum aestivum
  Clone ID: PAT_TA_24363
ctcgtgccctcgtccccacgtcgccccgtccgccgcgctacgacaaaccgccaacttcttccccatgtctcatcgcaaattcgaagccccacgtcacggttctttggcatttctgcctcggaagcgagctgctcgtcacagaggaaaggtcaagtcttttccaaaagatgatcctaagaagcccgtgcatttaactgctactcttggttataaggctggcatgacaacaattgtcaagagacttagatcgaccaggagcaaaaacccacaaaaaggaagttgtcgaggctgtgactgttattgagacaccaccaagtgatcgttgttggtatcgttgggtatattgagactcctagaggactcagatccctcacaaccgtttggggctgaacatctgagcgacgaggtgaagcgccgattctacaaaaattggtacaagaagcaaaaagaaggcattcaccaaatacgctaaggaaacactcggaaaactccggaagctcaatcaaccgtgaattggagcgggtctcaaaatattgtactgtcgtacgtgttttggcacactcgcagatcagcaaaactccactcaaacaaaagaaagcccacttaatggaaatccaagtgaacggtggctcagttcctgataaggttacatttgcgaggaacttattcgagaaaccagtcgaggattggttcaatatttgagcaggacgagttaatagacgtcatagcagttaccaaaggtcacggtttctccggg

SEQ ID NO: 24364 - DNA, 644 bp, Triticum aestivum
  Clone ID: PAT_TA_24364
ataaaactcgcacaggcccttccgcctaggctaaagcgattcattgcgcgctatcaacctatctccatcactcttcctgccagtggtcaagtctccgcgatcaagcgacccaaccccttcaagtccacgcgcgatcccatcactaaacgatggcatgatcctgttttctccctccgccgtcaggctgacttggtaaaattagcccgaaatcacggagtagaatcactgcttcccccgtcccgcatgcggcccgaggaaagaatccggaagcgtctcagacatggaaggcaaatgaaaggaactggtgaaggtcaaactgtcaagggaaagcaatccgagaggacgatgaaagcccgtctcgagaagcgaagacaagccatgttagacatgccgcaagatgatacaaacatggaaagagagaggacacggtccgtggatggaagaaatggccaaagtgagaagggttaatggtggtacattgcggtaccacacaataattgatgggagggtacaaggccaataaacttggttaaatcgtcacaatttttttctctactcagcggcaggttacaagtggttccacagttgacagtaaatagatgtgtgtatttctgtaggtttaacaggtactatctaaatacaca

SEQ ID NO: 24365 - DNA, 567 bp, Triticum aestivum
  unsure (1)..(567): unsure at all n locations
  Clone ID: PAT_TA_24365
ctcgtgccgctcgggcccccggccgcccggggcgactcggggggcgacagatctcgtccgccgccaccccctccccttcgcatcttcccttgccgccgccggaggcagccgccggcaagcccgcacggtgtcgatgagggtggcggcgaggtcttcggccgcggttctttctcgggaacgggtctagggttccaggcggcggcctggtggtgagggcggcgccgtcccggcggtcggcggcgttcgctggagatgtgtccgcctcccctcggctgcgtgggtggcgaaggcggcggtggacctgggcgtcgggcgngcaggacccccgcgacctgctgcgccagatctgaagacggnaccccggtcgcttgcatcaancgtcctcctcctactgggtccggccgggattccggccggattcgggctgttggctgcgtggatttggtgttggggaaggcctgaatccggggtaaaccccttgggccggccggcggggggggcaaccccccttggtgggcccttccgggcgctgttccccttcttgaaaggnaactttaaggaaggntt

SEQ ID NO: 24366 - DNA, 542 bp, Triticum aestivum
  Clone ID: PAT_TA_24366
gttaattgtgagctttataatattagctgcaatgaaattcttaacaggcgtagccttggaattaatccaaattattgcgattttatcctctgtttctgaaggacgagattttcagtgcaagtcaaccacaatttccgatgaagaccttgaatctatccgtgtactcgcatgtaacagcttgcaaacaaccatggaaacgtcaaaaatcgacattaaatccaagggcaaggaaggacttagctacgattgggacctttccgagccgttggtgttggcacaaatgaaagatgaaagcatttcacaagtgcagctcaatagcaattgcgaaatcacatcaatcaagagtgtccaagtaaagagaatgatgacgaaatttgcacaaaagaaaagtctatcataaagcgtcaagatcaatatatggtttgcaatggtgttacattctgggaaggaaagagttgaaagtacaggctgcttcaggttgtgaaaatgggggcaatcgatgatagacacaaccgcttggaggtgttcctcacatccaacca

SEQ ID NO: 24367 - DNA, 1203 bp, Triticum aestivum
  Clone ID: PAT_TA_24367
cattcaaaagctcccgcttgttttcattgtgactggttctccatatgtaatttcaactcactccacacttcatgaaccataactgatgctaatatcaggtcgttgccgagaagaatgtgccattcctttcatctgtatttgtgctaatttactgcaaactgctaaatgttgaatagtgacttatatgcactgctgaaagtattatttggtcccttgagaacagagacatattccaagagattagcaaccatgagctttggtgtaataacaaaaacacaggtgtctggaaacttaagccactgggatagaaacagtaatttgctctgagatgttccatttttggtgtagcttctttagagctgcatagtagtactatgactcgatgacagcttcactagatctgtgaaacttgccactgtgtgccgcggcgccaattttgcatgcctctgagactgctatcttccgctgcagcgcactccccccccccaagacacaccacgcgcgagagagccatggccatgtcgctctccctcgcgcgcctggccctgccgccggtcctccaggccctccccggcaggaggcaggcccactccgccctcgccttcccggccaactcattcttcggcgcgccgctggccgtggccgccgccggcgccgccgcgctctccccggcggccccgctcccgcgccccctcgccgtcgtcgccgccgggaaggggtacaagatgaagacgcacaaggcatcggcgaagcggttcagggtgacgggcaccgggaagatcgtgcggcgctgcgccggggagcagcatctgctcagcaagaagaacgccaagcgccggacgagggtctccaagatggtccaagttaacaagagcgactacagcaacgtgatgggtgcgctgccctacctcaaagtgaacaagaaagcaggctgagatctaccgggtctggttaaaatgaccgccactgggtttctgttcacccacttgttacttcatgctgcattatctgtatgccttttttctcttaaatacataccaatgccatacttcacattctcagcaatcacaatcaaatttttgtgcatctttatctgtatgccttttttttctcttaaagacataccaatgccagacttcacattccaagcaaccataaactactattcaaaaaaaaaaaaaaaaaaaaaaaaaaccggcagcc

SEQ ID NO: 24368 - DNA, 909 bp, Triticum aestivum
  unsure (1)..(909): unsure at all n locations
  Clone ID: PAT_TA_24368
ctcgtgccgaattcggcacgaggtaattctagctttaaacagggcccgttgcctacatgagtcgagtatgcccgttctattctctcatagactcgtatcgtggacagtccgattttagttgtgagaggggtagctacaaaagttgatctcgcgaaaggttgattaaatgccgcagcaggatatgcccgataccgttgtcgaatatttagtgcaaatttaattgtttatgacttgatacatctacgcacactatttgcaaccctactaaacagatttcagcgatttgaagctatattgcgcattttataaccactgcgcgacgactgtttccctacgagttggnaccgaaatgatctaattcgagcccccccgtgctgttctcgctgcgacgcgtcgcggggacgctccgtgttctcttgtgtccgggggcgccaccaacctcggcatcggcccccgtttaaagcttgaccttcctgtccccatctacggattttttgcaacgcgcgatagcgcattgtctcaattcgcgagtcgccaaaggcgtgcttaactcagcaagatttaatccattaattctcaacagatcctgtacgaattctcgcatagattagaaatcgaaactaggaataaaatacgacaaagatggcgcgtgtttatgcagatgtgaaccaaacgatgcctcgtagttattgggactacgactcggtcaacattacgtggggagtcttaagaaaaccacgaggttgtacgaaaaattgggcgtggcaagtattcggaagtcttcgaaggtatcaacattgtcaattaccaaaaatgtgttatcaaagttctcaaaccaagtaaaaaagaagaagattaagcgcgaaatcaagattttacaagaacctatctgggagggccgaatattgt

SEQ ID NO: 24369 - DNA, 678 bp, Triticum aestivum
  Clone ID: PAT_TA_24369
caacaacgaaaaatggcgcctcgttgctactctaaaacaagtcgtgtacctcggagacctttcgagtcagctcgtctcgatgccgagctaaagcttgtgggagagtatgggctccgaaacaagcgcgaggtgtggcgtgtacagcttactctctctaaaattcgtcgtgccgctcgtcagctcctgaccctcgatgaaaaagatccaaagcgattgtttgagggaaatgcgcttattcgtcgacttgttcgcgtaggtgtgcttgatgaatctaggatgaagctcgattacgtcttggcattgaagaccgaggattttatggagcgacgtttgcagacatgtgtatacaagcttggtctcgcaaagtctatacatcacgcacgtgtacttatccgacaaagacacatccgggtaggcaagcaaattgtcaatgttccgtcctttgttgtcaggcttgactcccagaaacacatcgattttgcgctaagttcaccattcgggggtggtcgtcctggtcgtgtccgaaggaagaaggccgctgctgcatcaaagaaggacggcggtgacgcagaggaggaagatgaagaataaagaaatttaaaggccagaatttaaaaaaaatgtacaaacttacctcgcgacgcgttctctccccgtgccgtcctcggcgcgtcccaa

SEQ ID NO: 24370 - DNA, 828 bp, Triticum aestivum
  Clone ID: PAT_TA_24370
aagctttggcccaaatcaagcctcctggagtagaggttcactttattgttgctgcctgtgagaatatgattagtggcacaggaatgagacctggtgacattttgactgcctctaacgggaagacaattgaggtaaataacactgacgctgaagggaggcttacgcttgctgatgctttggtctatgcttgtaatcaaggtgttgacaagattattgatctggcaacactaactggtgcctgtgttgttgcacttgggcctagcattgctggaatcttcacaccaagtgatgaactagcccaggaagtcaccgctgcatctgagttatcgggggagaagttctggagattgcccatggaggaaagctactgggaacagatgaagtctggtgtggccgacatggtcaacaccggtggccgacagggcggctcaatcaccgctgccctgttccttaaacagtttgtcgacgagaaggttcagtggatgcacatcgacatggcggggccggtgtggaacgacaagaagcgtgccgccacaggattcggcgtgtccaccttggtggagtgggtcctcaagaactcatcatcatcctgaatgaacatcccccctgatttccattggttctgatactatgtcggaaggaagcaacccgagtggtgttcaacatcatctgtaccagggaaaatgaatggattttatttgcttttggctggcgtatggactatggaatggagcgatataataaggaagggtttcatggaggaaaataaaacagaatgtcgttgaacacttcccttgaaagattaaatggtgtttcatcgttttcaaa

SEQ ID NO: 24371 - DNA, 732 bp, Triticum aestivum
  Clone ID: PAT_TA_24371
cccacgcgtccggccgggcagtcggtggttctccgcctctctgggcagggcttcaagagggtggctctggttggcctcggccagagtgccccatccaccgccgcggcttgccggggtatcggtgagtccgttgcatcggttgccaagtctgctcaggctagcagcgttgctattgtccttgcatccccagctgggatccaggaagggttcaagctcaacgctgccgcggcaatcgcttctggaaccgtgcttggcttgcatgaggacagcagattcaaggctgagtcgaagaaggtgcatcttaaacaagtagatcttattggactgggttctggttcagagctggaccagaaacttaagtatgtgaatgatctttcctcgggcgtgattttcgggaaagagcttgtcaacgcacctgcaaatgtccttacccctgctgtacttgcggaggaggcatcaaagattgcttctgaatacagtgatgtattcactgccacaatattagatgtagagaaatgccaggagctaaagatgggctcctacttgggagttgctgcagcttttgcaaatccttctcacttcatccacttggtctacaaacccgttggcggcaatgtcaagagaaagctggctattgttgggaagggtctaacttttgacagtggaggctacaacattaagactggaccaggctgtcatattgaactgatgaagtttgacatgggaggttca

SEQ ID NO: 24372 - DNA, 2045 bp, Triticum aestivum
  Clone ID: PAT_TA_24372
gccccaggagccgccgcaccggggccgcctccgccctagcccctcgccccgcaccgcacgccttgcctccctcccaccctgcctgcggcgccggcgtccccgacttgctcctgggccgcgtgcagccccaacgccgccgcctcaatcgcgcctcgccccccgcccgccctgcgtgagcacagcagtttcgcggcggcggcgctcacggtcggcctcaccgaggccgatcccgtcgggctggcccctgattccgatctcgggctgaagctcatctaattctctgactgttcagcgggcctgcttcgccgcagagtgcttgcagaagcacctgcaaaaatctttacccctgcaatggcgacggcggagctatcaaggatctcgacgcagagctgtggtgtactgcctgctgcaagattcaaagcagagaactatttgagcgcgacgaggagcttggcgttgggcgttttccggcctcggccgaggaggacttcactgaggatggcgggcggtcggtggttcgccgcctctccgggcagagcttcgagagggggggggttgttggtctgggtcagagggccccatccaccgccgcggtttggctgggtatcggtgaatctgctgcatcggttgcaaagtcggctcaggatagcagcgttgctgttgttcttgcctccccccctgggttccacgaagggtgcatgctcaacgctgccgcaacaatcgcgtctggcaaacatgcttggcttagcataatgagatctggattcaaggcggagtcaaataaaggtgcatcttaagcaagtagatcttattggactgggttcaggcttacagttggtgaagaaacttatgtatgtgaacgttctttccttaagcaggattttggtgaaagagcttgtaaaggcacctgcgtatttgcacacgggcctagtattgctggaatcttcacacaaagtgatgtacgagtccaggaagtcgctcgctgcatctgagttatcgggggagaagttctggagattgcccatggaggaaagctactgggagcagatgaagtctggtgtggccgacatggtcaacaccggtggtcgacagggaggctccatcaccgctgccctgttccttaaacagtttgtcgacgagaaggttcagtggatgcacatcgacatggcggggccggtgtggaacgacaagaagcgtgccgccaccggattcggcgtgtccaccctggtggagtgggtgctcaagaactcatcatcctgaatggacatcccccctgatttccattggttctgataacaacgccagagaaggaagaaaaacagagtgctgttcattcatgattgtaccagggaaaatgaatggattttatttgcttttggctggcgtatggactatggaggggagcgatagaataaggaagggtttcattggaggaaaataaaacagaatcacaatgtcgttgaacacttcccttgtaatattaaatggtgtatgatcgttgagatactacacgaagaaaaagctactgggaccgagttatcgggtggtgtgttctggagtgttccaacggcggagagcgactgggaggatctgatgtccggtgccgctgatatggtcaacactggtggtcgacggggcggcttcatctccgttcccctggtaccgtggcagtgggccggcgagaagcgtcaaaggatgcacattgccatggccggccgcgtgtcgacctcgggggagtgggtccccaccaactcctcatcatcctgaatgaacatctcccccgatttccattggttctgatcctaagtcggcagcacgcaacccgagtggtgttctgattctacgtcggaagaagcaacccgtggggtgttcttcctcttcgctccagggagaacgattggatggtgcgaaataataactgacggatgcatggaggatagtaaaacagaatatcggtgagttccctgcccgtggaagattacagggtggtccttcatcatcaaaaaagtcaggattaaataaagtttcatcgttttcaaaaaaaa

SEQ ID NO: 24373 - DNA, 211 bp, Triticum aestivum
  unsure (1)..(211): unsure at all n locations
  Clone ID: PAT_TA_24373
gttcctcttagctcatggttttgattttaaccgaactgcaagttccagttctaagattgtgccaacttgttgaattgaactcaagaacttgtgtggaagttgatgattcgcaggcggtgcaatccttccagtaaaaaaaaaaaaaaaaaaaaaaaaaaaaaaaaaaaaaaaaaaaaaaaaaaaaaaaaaaaaaaaaaaanccaaggggggg

SEQ ID NO: 24374 - DNA, 522 bp, Triticum aestivum
  Clone ID: PAT_TA_24374
agcacgcaataatatattgagaactgtctcgttaaataaattaatgtacaatgcctcgctaatagcacgctatagtgcgctaatagcatattttcagggacacgctattttttgtactagtgcgctatttttttcattgctactataacatccgcatttgaccattagagctcgaatttaataaagttggtgtatcacgcggccaaccgcgccagggcctcgccggcatgctccccggtggactgccggagccggcggtagtcgtcgtagccgaatgtcctgaagaggcggtggctgccggcgccgacaaaggcgtccggcgcgcggaccacgtcgtctttgggcgccagcaagaagagcgcgatggagacgcgcggcacggccgccacgcactgcacgcggtgcctcacgttgtgcagcgccccgttgctccacgcctacgcgtggcgacgtcgccgaggttgacgatgaaggtgcctgggaccgggtccacgggcgcgaactcgccggtgtccgggtccg

SEQ ID NO: 24375 - DNA, 575 bp, Triticum aestivum
  unsure (1)..(575): unsure at all n locations
  Clone ID: PAT_TA_24375
ctgaacctatcatctatcatcatgaagtttttgaatactcttgcgacattggcgatcagcacaattgctgcagcgcactgtatgaagaaggatcaacaattatccacctctccaaactcagacccttttgacggtttattacccggatccaatctattgtacttttgttcagatgaggacaaggacagcagcatttccatatcaaatcttgacataaacccctttcttcctacttcttacaaccctatcgacataactatatctggaatactgcgccgacctcttgatcctgcctcatacgtcatcatccgaagatgtagtgtctggtgaacaacttaactctgaacagattttgatctgtcccttcctagagagctttgggcattcatgtccaattgggtattacaccattccaacctgaacctccatttcatgggccgaaaagtcctcccaagacgttgaaatccggaacacaatttacgttggaaactcctccgactccttcaaggaggatnaggataaatttggtataaattcaaccgttttacaaccggatttcccggatagccaanaat

SEQ ID NO: 24376 - DNA, 541 bp, Triticum aestivum
  unsure (1)..(541): unsure at all n locations
  Clone ID: PAT_TA_24376
ctcgtgccgaattcggcacgagcaatggcattcagaggacgcggccgtggtacaggcgcaaatttttcaggaggtggttcccgtggtggaggtgggtttggcgcccgcggtggccgtggtgggtttggccgagacaacggtccacccagcgaagttttagaaatgggttcatttctacacagctgtgagggagagatggtttgcgagtctattaataccaagataccatacttcaatgcacccatatttcttcaaaataagacttctattggtaaagtcgacgaaattctgggccccataaattcgctatatttcacaataaaacctaagtgaaggtattcagcccacatccttcaagtcaggcgacaaattttacataggcaacgataaattgcttccanttagaaaaatttcttcctaaacccaaaccacccccaggtgcaccgaaacccaaacganccccgggggggggcggccggcctgccccctccctaggaggacaggtcgggngaangggagctcctcnnggaanaggaggntt

SEQ ID NO: 24377 - DNA, 553 bp, Triticum aestivum
  unsure (1)..(553): unsure at all n locations
  Clone ID: PAT_TA_24377
cgagcgtgatggggtcttttcttcttccacgggaggcgctgtacgcggcggcggtcgcggccatggcgtggtgcgccgtgtgggtgctggagtgggcgtggtggaggccccggcggctgggccgggcgctgcggtcgcagggcctccgcggcacggcgtaccgccccgtggccggcgactcgccgctgatgcagcggctgaacagggaggccagggcccgggccatgccgctgggggtgggctgccacggcgtcgtgccgcgggcgatgccgctcttccaccgggccatgcacgagcacggtaagatgtcaatcacttggtttggacctgtacccagagtgaccattaccaagcctgaactgggtgcgagaggttctgtccaacaagttcgggcattttgagaagctcaagtttgggccgactccaggaggatgttgcaacaacggcgtgggtanncaacgaagggggaaaaaaattgggncaaaggncaaggaggnttnaacaaaccctggccttcaatcnggagaaagctcaaagcncaangttgccnggc

SEQ ID NO: 24378 - DNA, 533 bp, Triticum aestivum
  unsure (1)..(533): unsure at all n locations
  Clone ID: PAT_TA_24378
tctggctcgatatgactactcacaatgtagtcgttttcgggggagaccactgtggtcctgaggtggttgctgaagctcttaaggtacttagagttattgaaactagacgcccaagtgccggaaagttcaattttcaactccacttactcggcggctgttccattgatgcgacaggtgaaccattaacaagtgttgcgcttgatgcagccaaggccgccgatgctatccttctgggtgccattggcggacccgaatgggggacgggatctattcgcccagaacagggcattctcacattgcgcaaagagctcggcacctacgctaacttaagaccctgcaactttatctcccctgcactcgtcgatatctcgcctctccgtccagaaatttgtcgcggnacggatctccacatcgttcgcgagcttacaggcggtacctactttggcaagaaggaatgaagacaactggtgaatggtatcccatgggatacaagnaattttcacaacgtcanggaattaaacgaatttccaggt

SEQ ID NO: 24379 - DNA, 537 bp, Triticum aestivum
  unsure (1)..(537): unsure at all n locations
  Clone ID: PAT_TA_24379
ctcgtgccgctcgtgcccattgcggcgccaggcccaatctttcactattcactttccattatactaactccatcacttcgttaagcttcctcgcacgccagctttaggcagtgacaactatggagaacatcaaagaaacctcaattgaaccagctgcatctgagcttcaaaagctcaaggataaatatacagcggctgaacaggagcaagtctttaccttctatgacactctcgacgtaaccgaaaaagcgtccctgttttctcaagctctccaagtttgacccagattatattaatcaaatcaccaagcgggccctcgactcagttaaaacgactaatgacagagagaaactggaacctcttccatcttctgctaccgctagtattcttgattcagattccaaagatatagattaatggcatgagcaaggattaaacctaattgcagaagaataagggcggggtagtccttatggcangtgggcaaggcacacgactgggtagctcagagccaagggttgcttcaacattgggttg

SEQ ID NO: 24380 - DNA, 882 bp, Triticum aestivum
  unsure (1)..(882): unsure at all n locations
  Clone ID: PAT_TA_24380
ctagaggttttcatagggcaaagctggtcatcatcaacccggggctctacgtggacgtgttctggataccacagcaccggagcttcccaacatccttcatgctctttaccggtaataagcaagccttggacgatgatgaccatggccaacactttgtcgattcttgtgctgtcgacggtgcattgctggcggaccatcttctctcatcaagcgaggatgatgatgatgccgaggacctgagctgttgcttgatcatctattgttgctggattctttcaaccctcttggtttggaaatccttggctgtccagtagaacaaaatgcttgtagattttgtagggatggtgtgtattgcagtatttagcatttagcttaacaaaatgcttgtagattttgtagggatacttgatttgtgggatacttgatcttgcaactgtgacttgactaatagagtagaaaatatcttattaacgaggagagacaggcagcagcacgacgaggattaggggaagtagcagcagtagcatgactctgcatagaagtggtttcgaaaaagctcgaacagcaatgagcttgttttatttgctgataaggctatataatgtgatttctctatcactgagcgtaaaatcttgttttgcagtacactggaaactcaagatgtcagagcaatggttgcataaattaggacactataatgaatagtgtgattatgagtattgtatatagcgtatgttatgtaatgacttagttatgcttgaagagagtaatggagccgagtcattgtatatgctagtacatttgcttggtggtagagaatctcatgtaagacagaaaatnnnatgtatgttaatgctnnnnnacattccctctnanaannnn

SEQ ID NO: 24381 - DNA, 598 bp, Triticum aestivum
  Clone ID: PAT_TA_24381
tcgcgggccgtattcggctcgccattcactcctacactgccacgcagaaaacttgttgacggcccttcttgctaaagactggcgtggtggtcgtactgcagcccagaacattattcctagcagcacaggtgccgcaaaagctgttggcaaggttatccctgagcttaacgggaaattaacaggaatggcaatgcgtgtgcccactgctaatgtgtctgtcgttgacttgacatgtcgtatcgagaagagcgctacctatgatgaaattaaaaaggctgtgaagattgccgccggaaatgaactacaaggcatcctttcgtacaccgaagatgaaattgtctctacggatttaatcggcaacaaccactcatctatatttgacgccaaggccggaatatcactcaacgacaactttgttaagcttgttgcatggtacgataacgagtgggcttactctcgccgagtgttagatctaatcacctatatcgctaaaattgatgactccaattagattatatatttcggtttaaaataataccgtactaaattgcatacacttgaacaataaaaaaaaaaaaaaaaaaccaaaaaggggggg

SEQ ID NO: 24382 - DNA, 754 bp, Triticum aestivum
  unsure (1)..(754): unsure at all n locations
  Clone ID: PAT_TA_24382
ctcgtgccgaattcggcacgagccacaatcaaaactgacgcctatcgagctgacataaactactatcgatcaataaaccgaaatcatgggaaaagttcacggatccttggctcgtgccggaaaagtcaagtcgcagacaccaaaggttgagcctcaggagaaaaagaagaccccaaaaggccgtgccaagaagagaatcacttacactcgtcgtttcgttaacgtcactctaactggtggaaagagaaagatgaaccccaacccaacctcatagaaatgtcataaagggggagtggtacagaaatattacgctaccatatgtgtttactacactagatcctgaaatgccattttcctatcacttcaggctccttcaaatccggtctcccatctatcttttctgccaagcgaattagtgattacccactgtcacgtatataacgtgtcattaagcaatagtccctggaaaccccaagaaacggacgacttcaattaaacgacaaaaatgtagcaaggcattacattgaatgtctcctgagagttttagtcacgccttgtgctcggaataccaagtagccaacgtataacgccgcacttctcattccacacttactgccggacataccaacgcagaacggtaaatttcaggtatacatctttcaaataaaagaccaatttgaatcattcattttctcactgtaactgtaaatcactaccaagagtttcaaacccatgtcangtccaagactgctgt

SEQ ID NO: 24383 - DNA, 736 bp, Triticum aestivum
  unsure (1)..(736): unsure at all n locations
  Clone ID: PAT_TA_24383
aaaacatcgggataaagaacctacagaagttatactgcgcggcttcagatcttcacaacaatatgcggcgatacgagaatatgaacgaatagctggtagaatctgtgaagactatccccgagacccgcccgttgaccagagaagatacaaagctgacctgcgcgatcctgcttccctgcgtaaaaagccgttaactattgaagaaaagttgaaatctaacaaatttgccgggggagaacattggatcaaagttaccttcgaatgtgctgaattcgccgagactgcgattgaatgttcaccacaaaagatacttggccattgggtctttgcagaaatatatcgaggcgttccgccaaaccttgacgaaatgattcctgttgataattcaaaagctactgatccgaataaatacgagatgtctctcagactaggagcagcacctggattagatgtcgtatcaagtaacctgcatacgagcttaattgaaccatcccaagaactacgcaagcgattgaactccgaagatgaggacatctcccccttcgtccctcaagatgttgaatttatctgcaggtagtagcactgctaaggaaggttatccaacaagtaaaaaaagttagtccaccaagccggagaattctgccaacgaataccatcagcccggngaatggacacttctccctgctgaagaagcattattaccaacaatcatcctccatttcaagagatttttaag

SEQ ID NO: 24384 - DNA, 540 bp, Triticum aestivum
  unsure (1)..(540): unsure at all n locations
  Clone ID: PAT_TA_24384
ccggcaccatgttcggagtcgaagtttgaacaatncaatgctcgcagtcgattgcaagttaaatccacctttaacatttcccaaggccggaagatcaggtgtgctgaaatttccagaaaaatcaattgctccgccgacatatgtaagcgcgggccggcttcggctcgagctcgcgccgttgtcggcacgcggaactgctcccccgactgtcttaaggagcggcatggatacgttggcgagtttcccgttggcgacaaaagctaaacttccttgtccatcggccttcgagccgacagacgtgatgttgggagccgagacgctgggcatatagtttccgtaaaatcctaaggagccatcaacaatagcgagagatggtatactgactgttgaaacattgcganatgtcatgtntgcagctctaataangttaggaaagntgacatcgaggantgttgccattcgagttaatgttgagggaggatgttgacgttagaaacttgggtactgaaagttttganccgatggtggtaaccaanttgg

SEQ ID NO: 24385 - DNA, 590 bp, Triticum aestivum
  unsure (1)..(590): unsure at all n locations
  Clone ID: PAT_TA_24385
cttggcggtagtcttttcggcttgttctgtgatccccttctgctcagacctccccccccgattctatgctccgtaacactgtagcacgtgcagctgtagcaactcactatcaaatagctagccgtcgattacaaacattgtcacgaaacctgtccaccatgtcatcagaaatagaaacatctattgttaaaaagtgcgaatatctagtcattggtggtggaagtggtggtctagcctcagcaaggagagccagcagtttgtatggcgtgaagacgatacttgttgaaaagaagcggttaggaggaacttgcgtgaatgttggatgtgtgcctaaaaaggtaacatccaatgctgcatttattgctgaaactctacgagaagcaaaggcctacggattctctattagtactactcaacccttcgactgggggtactttaagcaaaaacggggtgcgtacatcaaacgattgaatgggtatatacgaaaggaacctagaaaaagantccatagaatacantcacggtgccccaaggtcaaaggacgattaanataagagttgaagtttgcaangntgatggtccaagcaagt

SEQ ID NO: 24386 - DNA, 561 bp, Triticum aestivum
  unsure (1)..(561): unsure at all n locations
  Clone ID: PAT_TA_24386
atctcaaacgatgtttatcagcagccctctgtctctcgcagctctcctctccggttcatatattgctcatgcctctatcataaatcagtttgatccgctgaagcatctatctggagttagtccaccatttgaccacgaagaagccagctctcctctagaccctgttccacctctaggctgcaatgtcactcgtgcagcatacctggtacgccatgctgcgattcattcgaatagttatgactacgtagcctttatcgaaccattcctcgaaaaacttagccgcacgaccgtcagatgggccgaaatccctagcttatcctttctaagctacctggagaaacccaattctaaagggagaagaaggaaaaattaagtcgatccgggtcaagctacaagccatggacatttgggtgtttganagttggacatagatactttaatttgagggacaccccaagaaaatatggggcagcatcttccgggatcgaacgatgaaaagcgctcaattccttcgcaaaaaggaattgctcctgagccgcaatcattaggattgcgcgtgng

SEQ ID NO: 24387 - DNA, 551 bp, Triticum aestivum
  unsure (1)..(551): unsure at all n locations
  Clone ID: PAT_TA_24387
ttttttttttttttttttttttttttgaatgcttcttgtgctttttgaaaagctgagaaattgtggtacatggaaagcctaaatgctgaaagtgaatgctgtgctcgacgcgaaaataccaaatcctctgctgcttggataaaaaacgccagtgatgagattgacaatgtgctgatccagcccaaactgaccgaatttcgttctgatgtacagcccacaggcgaaaccaaggaaaatctgcacccattgaaagtcatgatcgagagacgttcgctcgcccttcagtctgcacttcaatgtccgataagatctatgtggtctttttgacgagtttttatacttatcgaagtctttgacgattttcaaagaaatgttagcttaacctagtcgcgatacagaccttttgtgggaaattattttgaagtagaatcgtgtacaagatgtcaggaagctcgactgggaaatctgtcaagtattagtattcccgtcttgagaatctccccgcgccgtagccgcctcgtcctccgtanggatcccgccctccgcaaggg

SEQ ID NO: 24388 - DNA, 552 bp, Triticum aestivum
  unsure (1)..(552): unsure at all n locations
  Clone ID: PAT_TA_24388
ctcgtgccgaattcggcacgagcgaaactgatactctcaagattattttcacagccactagtgatggtatcgcaaagagaccccatcaagcattcctgctacttagggatcaagatacgggggttgaaaccgcatttgtctcttccttcaaagggaatggtcggggaaaagtagaattctcacaaaaagatatacccagtcccttactacaatcgtcgcaaccactgcgagctactttcctgctaggttcctttggagaatcacaagcctttaggaatcacgttttcaatctcatagtactcactgatcaaggttcctcaacaaaatacgagaagcctttgagatacggcaggcgagacgagattaaccatacttttagacctgacccaaagagcggccctatatttttatcaagcattcttcaccctcgcaatcgttgctactgtacacatactatttgccaagctggatttactttggtgctaacctatcacacttaccaagttcctaaagatcgcgcctttgtcacatactttantttatggtcgattt

SEQ ID NO: 24389 - DNA, 528 bp, Triticum aestivum
  unsure (1)..(528): unsure at all n locations
  Clone ID: PAT_TA_24389
ctcgtgccgaattcggcacgagacccaatcgagcccagttccctcattcttgtgccctaacgcccatcatatcgaatttctctatcccaccatgcccaaaagcaagcgtgccaaagttgtgaatctttccaaagtcggaaagaagggcaaagagctatcccaaaagcttttccgaaatgtacgcgaatgcctggatcagtacgcttactgctgggcctacagtgtcgaagccatgcgaaatacttacctaaaggatgtacgcaatgaactctctgatagccgattattttttggcaagacaaaagttatggctaaggctctaggcctcacgcctgaagaagcatatcagcgcaatactgaaaagctggccgtgcacctaaatggagacatgggacttttgttcacaaaccgagagccccaatctatcattgattactttgagaactcgcaaaaaccgattttgctcgtgcggggaacangaagcaacaagaggatttctccatancaagctgggaattgtcatggagt

SEQ ID NO: 24390 - DNA, 550 bp, Triticum aestivum
  Clone ID: PAT_TA_24390
ctcgtgccgaattcggcacgagctccaaaccaccaaatttgacggtatctcaagtatacaaggccaatttctcagacgtcgtcttaactctaattgtgcaaaatggttctcgccgtcgatcttctgaaccccacgcctgctgctgaagcacggaagcacaaactcaagaacttggttccggcgccgcggtctttctttatggatgtaaaatgtcctggctgcttcacaattactaccgtcttttcccatgcgcagacagttgtaatctgcgctggctgctcgaccgttctatgtcaaccaacgggaggaaaggctcgattgacagaaggttgctcatttagaagaaagtagtcaagataccacccatcgattttattcatgcaactataattgaggctatactggagctggagatggcaaaatgacgcgaaacttgtgggagggaatccacaaaaaacctttgcgaaattcagggatacgatcaacccgtgatgatataaaattcttaattcatttgaatgatttgacctcgtgccgaattcggcacgag

SEQ ID NO: 24391 - DNA, 770 bp, Triticum aestivum
  Clone ID: PAT_TA_24391
ctcgtgccgaattcggcacgagcgccattctcgctaccggccagctcaacaaagatgaatcctcaccaaaagagtaagatcgatgtgagcaaactatctcccgacgagcaacgtcttttccgcctctatggcaaaattccatccaaagccaaccacctggccaagatcatgaaagatcgaaaatacttcgactcgggagactatgctctctccaaagccggaaaggctgactctgttgacactggcagcgttgggtctcaacatcctgttccggaaaatattccgcatctctcctctcccagtatcgggagcgggggccagatcggcagctccagcatccaccacataacaggtacttcaggcctgcaatgcagtagtccgatcaaggagagcagcaacttaaaccgagaaatgaactttgatcaggcagaagacacggagactaaagaggcaactccagcaaaagatgaaaataccccactaccagttccatcagttgagagccttcctagccaaggctagtcgatagttagcaataagttggtatgcaagtggggttgctaaggaggtatcaagaatcttctagatgagtgtatgctcgggcgtttgggttgtgaacattcagatgtatatgtcataaataggctagtgaggaacgtcaagttcaagtgttacttcaaatatgttgcattatggagcatttgagacgtaaattgcaatatattttaaaaatgctttgcggcacgagctcgtgccgaattcggcaccag

SEQ ID NO: 24392 - DNA, 744 bp, Triticum aestivum
  unsure (1)..(744): unsure at all n locations
  Clone ID: PAT_TA_24392
ctcgtgccgaattcggcacgaggcaatatcacggacaactcaacttgcaggacaatttacctcacctactttaaaccacaacagattcaaaaccatggcttcgaaatattctgtacgcaagattggccaacctaacactctcgagcaccgcatctacattgagaaagacggaaacattgtttcccctttccacgatattccactatacgctaatccagagggaacaattcttaatatggtcgttgagataccacgatggaccaatgccaagttggagattagcaaagaacaaactatcaatcctataaagcaagacataaagaaaggcaagcttcgctatgttcgtaactgctttccccacaaagggtatctttggaattatggcgcctttccccagacatgggaagaccctaatgtgattcacccagagacgaaagctaagggtgataacgatcccttagatgtctgcgagattgggagaactagttgggtaccccgggcaagattaaacaagtcaaggtacttggagttatggctttgctcgatgaagaagaaacagactgggagggtatccgtcattgatggtaaccgtcccctagcagcaaagcttcacgatgtcgaggatgttgagagacatctccctggtcttttgagggcaaccaatgagtggttccgaatctataaaattccaagatggnaagcctgagaatcaatttgccttcaacggcgaatgtaaaaacaaaa

SEQ ID NO: 24393 - DNA, 687 bp, Triticum aestivum
  Clone ID: PAT_TA_24393
cgcccgccgtagtcggctcgaggataggcggcttcggagccccgtggcaccgttgcccatgggccatgccgttcacgggcgccccgtctgcctggacggtggccgtagcccggtagtgggtcgacgtgaaacgggggacggcccgcatcagcaaggccgagctcccgccaggccatcccgccgccggggctgctggttcgccaccgttagggcgggcggccgcccgggcagcgccgacagggaccacaacggctatgtcgacgacgccgagctcgagcacctcgtcgctttcgcgcgggaacacctcggcatgaacatctctgcccgttagctacctcggtagagcttcacctgctcagactaatgccgaatatggcaacatcgtgtctaggccgggtgtcgcctgcggggttcagcttctctgcccagcttcccccctcgcctgagcgttacgtggctctccaggagtgcccgagtagcgtgggttccgcgccgccggccgcggctgcgtctcctgttgcttacttttgtgtgtttctccaggtgaatttgtcaaggtttgttacgacgacgacgtctgctactatgtatgcagttgcttaattgtgagtgtgtctgctgtaagatttgaaagttgcatgaagtgctcaatatatacaagttgtacctgcccgggcggccgctcga

SEQ ID NO: 24394 - DNA, 701 bp, Triticum aestivum
  Clone ID: PAT_TA_24394
ctcgtgcccttggcggcacgagcttttacaatcagaaagtagttctttacatcacttgatctccatttctactctccaatcgatatctcgttcgtaacactcgagacggcacaatctcttcagcatcacaacctaaactctcacgccatccacctgcacaaattctcacgaggctctcgcagagttaacagacttcaaattcaagatgaaattttttcaacttgcttctattattgcaggacttagttttttgcagccgacagttgcggatcaatatatcagctgtggtatgggatcaattagtcgtaatagtattctttcggttgccaaagatatgtggaacatgtcactcgggagttgtccgtcgtatcacgaaacttttcctgcagaataccgccaaagttccgaaggaatgacacggagatttccaataatttacaacagccaagaaatggacctctgggggttattattacattgttgaatcaagccaaaatagaaaatttattaagactccattactatggtataaccacggaggaatgctatgtaaccggcgtctaaagacctgaggctgtttagcaaagtattattagatattggttcgatctttatttgatccgattatcctgatctgctgcgctttgggctcacgtagatgtttataaagttcatttaaatagaaggaaacttgcaaatac

SEQ ID NO: 24395 - DNA, 532 bp, Triticum aestivum
  Clone ID: PAT_TA_24395
cccgcgccgacgccggcacccgctgctccccgccctcctccccccctcccctcctcccccccctgccgcccccctcgccgcccgcccccccgcccgccccccgccccccccgcccgcccccccgcccgccccctcccgcgcctcctgcccccccctttccatgccgcccttcgccaccccgccacgggtgtccgccggtggccacggggcggcggacgtcgttgtctgcgcccgggccggttctccccctccgggcggcccgccgggtgagctgatgccccccgtcttgcccgcctgcctttcccggtcctggcgcttcttcctgggggcgggccccgcctcatctgtcctcgtgcctttgcttgcgcaggttctcgtccctcgggacgtgccccgggtcagccccgtcggcgtgtacgctcgcggagcgtcgcttccgccccgtccgtggcgcctggtcatgcccgctccacatgtgcgcccgtcgcccgatccttcctcctccaactaagggctgcaatatgattgttgc

SEQ ID NO: 24396 - DNA, 864 bp, Triticum aestivum
  Clone ID: PAT_TA_24396
cggccgcgtgggggacgaacggtcacaacccacactcccacaggccacagcactccaagcaggcggccatggagttgctccttctcccttcccgtgccaccgtctcctgccggctccagccaaccgctccactccgccgcgccagcgcggccaccttccggccgtcggccagctccggcaatgtcgaggccaccaccgacgccacggcgacaacgtcggtagccaagaccggccaagaatggcgcgcgggcggccggcagggccaatcaccgttcgggctcggcctggacctgtccgaggagatgaggcgcgggatgatgtggcggatgctggccttccccgcggcggcggtggcggcagaggccgcgctcctgtgggcgctcgacagcggcgtcgacgcgcccgcgtgggccagcaaggcggggtcggccgtgctgttcgctgcggggctgctcgggtcccagtacgggttcttctcctcgaggtgggacgcggcggagacggggtcggtggtggggtgggagctcgccgcccggcactggaacgcgctatatggccaggggttcgtccatggaagaggaagatgaggaggacgacgaggagtgggagtgggtgtacgaggaagacgaggatgaaactgacgattagttgggttagatacagtctgtgatagcaaggtaattggttggattaaaccttgtaaaaatgcatgtgacagtgcttggtttggttaaaccatgcagtaaatagactggttacatgtaggcctagaactaccacttcgttcttttcctgtcattctgatcgactcctgtgaatatagtcaccaacttttctttttcttacaacgttcacaattgacat

SEQ ID NO: 24397 - DNA, 534 bp, Triticum aestivum
  Clone ID: PAT_TA_24397
cacccttccgtccgcccccgcgtccgcccacgagtccgcggacgtgtgggcggagattagcggcggcgatggcactcccggcgtcgagctccggcctcttccgcttcatctccccgcgcagccgcctccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacatcacttttgtccgggatggttcctgactgaagagaacttggataactcagcaaataatacgagaccccctcgtgtttccttgtttgttttttattattcagatgtatgtaggcaatccccacgagggagacagggaacagagaaaccgcttggttcacctgtgtttatataatactcctgtattatccaacatgcatgttttaaaacctgtggcaaatatatcttgctgattaatattggactatgatgtc

SEQ ID NO: 24398 - DNA, 573 bp, Triticum aestivum
  Clone ID: PAT_TA_24398
atcttctcatcctctcctccccaactcgtgccgaatgcggctcgcctcctgattcaagttcatctagatacttgaattcctacaccaacccatcaaataaatatcccggcatccagtacgactgctctcgctgcaatcaactaaacacctaatcaagtaataacaacaactcgcacagaatatgaccaagttatttgtcggaggcctctcatggtcaactgaagaagattccctaagaaacaagtttgaggaatttggtgcagtagaggaagcagttgttgtacgagacagagaaaccggccgaagccgtggatttggttttgtgcgctacacatccgatcaggatgccgagacagctatcactgccatgaacaatattgagttcaacggacgtactattcgcgtagacaaagcaacagaacgcggatcaggtggccgccaaaaacggtggtggtggttacggtggcggtggcggcggtggaggtggtggttaccgtaacagtggaaacgacggttacggtggcggcggtggatacaacggtggaggaggtgatggcaattacaacggaggtt

SEQ ID NO: 24399 - DNA, 1443 bp, Triticum aestivum
  Clone ID: PAT_TA_24399
ccccgcgtccgccaaattccaccaacctcgagcctccgcccctatatatcgcccccggcgccaattcggcgatccaccagccacctctgactctgagcgcatccaacaaaggagtcgcgtcacagtctacgctagcggccacgaatcgaggcggcggcgcgctgcgagagagagagagcggagaggatcaggctggtggtggggaaagcgtagcggcggcgcatggagagctcgacctcgaggacgagcctgaattgcatcagcctggtggaccccgacatccagagatcggtcgcgctcctcaagcaggcatgcttggattcaggcttcttctatgtgctggatcatgggataagccaggaattcatggacgaggtttttgccgaaagcaagaagttctttgaacttccgaacagtgagaaaatgaagcttctccgaaatgagaagaatcgagggtatacacctatgctagatgagattcttgatccagaaaaccaagtgaatggtgaccacaaggaagggtattatattggtgttgaggtacctgcagatgacccacagtcaaataggccattttatggtccaaaccagtggccttccgaagaaatattgcccaaatggagggaggtgatggagcaatatcacagggaagcattgagagtggccaaatcagttgcaaggatcattgctcttgctttgaacctagacgaggacttctttgatagacctgaaatgcttggcgattcgatagccacattaaggctcttgcactatgaaggtggacaaaaaacaggtcaagtgtcaaatccttctaagggagtttatggagctggtgcacattcggattatggcctgatcactctcttagcaactgatgatgtagttggtctccaaatttgcaaggacaggaatgctcagcctcaagtatgggaatatgtagctcctgtgaaaggcggctttattgtcaatcttggtgatatgctcgaacgctggagtaactccattttcaggtcaactttacatcgagtggtccttgatgggcaggagcgttactccattgccttcttcgtggaaccaagccacgactgcgtagtcgagtgcctgccaacctgcaaatccgagacgaatccgccaaagttccccccaatcacttgctcggtgtacctatcccagcgctacaaggacacacacgcagatctgagcacttacagcgacggcaaagcctgaaagaagaagctctggtttttgccctgttccttttttttgccttcccatctatctagtatgacgtgtaatgttgcgagtggcaataagaatgcccttagcaaggaggatggtaatgttgtactgctaatgtgctaatatcagtgtaaccatagctgtggagatgtcactcattgttcatgtagacatgaacaacatgaacaatggttgccttttttc

SEQ ID NO: 24400 - DNA, 1728 bp, Triticum aestivum
  Clone ID: PAT_TA_24400
cacaattgtaggtccactttacatcgagtggtccttgatggacaagagcgttactctgtaagtttgttctcttgtgtaaatatgtgaaaatcatctatatccgtgtgtgtgacaaacgctgtaccagtgaaagcaagtactagttgacctactgtgtcatctttgttcatgcaattaataacataaagctccttttaaaaaaaattatatatgctccaagacaaacccagaattataccataaaaaggttgattttaatcgtgctgtttctttctttcttgtaacagcacagtctacgctagcggccgcgccccggcgccgcggcccgccgcgcgcatcagcggaccacgcagccgcaggcgagcgggctggtggtggggaaaccgcagcgccgccgggagggctcgcctcgaggccgagcctgacttgcatcagcctggcggaccccgacacccagagatcggtcgcgctcctcaagcaggcatgcttggattcaggcttcttctatgtgctggatcatgggataagccaggaattcatggatgaggtttttgccgaaagcaagaagttctttgaacttccaaacagtgagagaatgaagcttctccgaaatgagaagaatcgagggtgtacacctatgctagatgagattcttgatccagaaaaccaagtgaatggtgactacaaggaagggtattatattggtgttgaggtacctgcagaggacccacagtcaaatagaccatttgatggtccaatccactggcctcctgaagccgtattgcccaaatggagcgaggtggtggagcaatatcacagggaagcattgagagtagccaatttagtcgcaagggtcgttgctcttgcatcaatcctagacgggaacatcgagggtggccccgacatgcttgaggatccgttcgcctgctttaaacccagacgaggacttctttgataggcctgatcaagggcgattcgactgccgcattttggcagctggtctatgttcggggtatggcctcagcactcgcttagcaactgatgatggagttggtcgccgaagtgcaacgacagaatgctcggcctcaagtacggaatatgtcgcccggtgtagttggtctccaaatttgcaaggacaggaatgctcagcctcaagtatgggaatatgtagctcctgtgaaaggcggctttattgtcaatcttggtgatatgctcgaacgctggagtaactccattttcaggtcaactttacatcgagtggtccttgatgggcaggagcgttactccattgcctttttcgtggaaccaagccacgactgcgtagtcgagtgcctgccaacctgcaaatccgagacgaatccgccaaagttccccccaatcacttgctcggcgtacctatctcagcgctacaaggacacgcacgcagatctgagcacttacagcgacggcaaagcctgaaagaagcagctctggtttttgccctgtccccctttttttgccttcacatctatagtatgacgtgtaatgttgcaagtggcaataagaatgcccttaggacggaggatggcaatgttgtactgctaatgtgctaatatcagtgtaaccatagctgtggagatgtcatcattgttcctgtggagatgaacaataattgccttctttctgaatgtgtacaagttccgaagtttattgctcaaaaaaaaaaaaaaaaaaaaaaaaaaaaaaaaa

SEQ ID NO: 24401 - DNA, 507 bp, Triticum aestivum
  unsure (1)..(507): unsure at all n locations
  Clone ID: PAT_TA_24401
cggctcgcgggagacggcctgttacgaatcaaggcctctccaactccaaacaacatggcttcacaggcgagagcgatgcatacgaaagatctgcctggactgataaattctggggccgcgaagaaagggaaacatgtgcctgtgcagcaagaggcatcttctactgcatctaaagctaaagcgccaagtactgccccaccgccaacgcttaacagcaaaaatggaaagccagccaacccaggcggcaaggctccaaagcggtgaataccggattcacacatacattttaaaactctcatgtggattgatgaagaagaataatgatctggacatcatttggcgtgctttgtctatgaaataatacatataccaaagactctaatagtatgtaagaagttaagaggtggaaaagaaatatggatcgatctattgcatggtttgtagtttggacgtcccttggtgggttttgtcactgtcctaagttcaagtattggnantggtattgan

SEQ ID NO: 24402 - DNA, 1123 bp, Triticum aestivum
  Clone ID: PAT_TA_24402
gcatcggcccgcttgctcttgctcggcatcctcggccggtcttgctctcggacagggtttcgccgcgtacacctagccatggccgcctcgctgccacgcctctccctcccgccgacggccgctctccctgccgtcgcctcctctcgctaccgccccgacctcgcccccgtccccagccgccgccgccgcctcggcctccgtctccaccgctcgccgctggcacctgcagctgccgcgagctcgccgtccattccgtcttcttcaccggaaccagggtcgggtatcggtgatgccctcggtggcgtcgccatcttctccgcggccaccggcgagcccgtcctgatcagggatctgtgggaccagaacgagggaatggctgtggtcgcgttgctaaggcatttcggatgtccttgctgctgggagttggccttgacgttgaaagacgcgaaagaaagatttgattctgctggcgtcaaactaattgctgttggtgttggcactcctgataaagcccgtatacttgctgagcgtttgccctttccattggattacctctacgcagatcctgagcgcaaggcttatgatctcttgggcctatattttggtgttggtcgcacattcttcaacccacccagtgtgaaagtattttctcggtttgattccctcaaggaggcaacaaagaactatacaatcgaagccaccccagatgacaggccaagtgtcctgcaacagggtggaatgttacgtgttcaaagggaaagaactgttatatgcaagggaaggatgagggcacaggtgatcatgcaccattagatgatgtcctgaacatctgctgtaaagttccagtagcctgatgttgaatcctacaaactggtgcttctcgtagagacatttcataagcttggcatcagatgactttcgagatactggatcctgatgtaagggtagcgtcccccccatgtgcatgtattaagatttttggcaaactttctaacaccttgttaattataggagcttagacagggttggtttattggtagatatatgtaactgatcacgaacactgcacagtgcgctaaaatatagcgatacgttatcttcaaaaaaaaaaaaaaaaaactcg

SEQ ID NO: 24403 - DNA, 739 bp, Triticum aestivum
  unsure (1)..(739): unsure at all n locations
  Clone ID: PAT_TA_24403
ctcgtgcccgattcggcaccagagcagcaaaccacgccgccgccgctaatcggtgcccaccctcacgcttctgcttcgtttctctcatcacacgtgtctgtgattctagtttccttgcttagccgcaaactagtaccacgttcagacagggcggcggcctcctggtcccatggcagcctccccttggatcggaaacctgcaccaaatcctaaccaccaaggctgcccgtcggcctccgggacctggcaaagaagcatgggcccggccatgtaccttcggctggggtcatgatcgacaccgatggctgatctcctcgccggcggccgcgccaggtcaagtgctgccggggcacaaaagatccttacattcacgtcgcggccgagcgtgcggccctccgggctctccccctgtgctgaacgcggcatcctcttcacgccatacggcacgtactgccggtcgcgccgctagaggtgcacggtgggagctcctaatgcgagcggaaggtgaggcagttttcgccggtaagggacagcgagaccatgtgccttgttaggaacgtgggcgacgccagcagaggtggcaagccgttcaatatcagcaggctgctcgtgtcgtgctcaaattcgataaccgggaggacggtgttcggggagatgtgcagccccgagctccaaaaggagtttatgtccgcgttggacaaggcgcggaaccttgccgcggngctctgcatcggggatct

SEQ ID NO: 24404 - DNA, 581 bp, Triticum aestivum
  unsure (1)..(581): unsure at all n locations
  Clone ID: PAT_TA_24404
gctgccactnctttgattcggaggttggcnccactctttaggactctaaagtcttatgccaatgatgtcgccagtttttcgcccttggggcccaacccgatggaggcagatggcacagtccaagagtgcaagtatatgcctggttcatttagggatccttggtctgtcgaggaagaggatgctccttgggctatatgcgcgatggagggtcactcattgttgatcgaagacgatgacgttcgggctgctgaactgatgcaagcctacaagatgggtggcgtttcgtgcttcaggtggcatagcagaatgtcgactgtcactcttagatccgatctcagcgtattaaataaacctggtggtcgtgatgttgttgtcattgcagattctactttccgttcaggttatactttacctgtcggcactatcatagattctggctttgttagaagatgtgtcgttgacgagcgaggtagggctatcatacgatccagagatatcttcgagattgaggcgattcagaccagaagtcgcggaggtagaattgcctcgcgccgttctcgccacgggcgtcccaacaagga

SEQ ID NO: 24405 - DNA, 726 bp, Triticum aestivum
  unsure (1)..(726): unsure at all n locations
  Clone ID: PAT_TA_24405
ctcgtgccgaattcggcaccaagcacattgactgcgcatacgtttacgaaaatggctgatacgcgctttaagttgaataccggcgcaaagataccagcgttaggcttaggaacctggaggtcaggtccangattggttcaaaaagctgttacacacgccttatcacatagggtatagacacattgactgcgcatacgtttacgaaaatgagtctgaggttggcgaagctttaggtgaggctttttcaaagggattgaagcgtgaggacgttttcattaccaccacgctttggtctacatatcanttctcgagcggggggaccgcgtgctaagagtctcaaaagccttggattggaatatgttgatctttatttgatgcattggccttttgctatgaatcctcatggtaaccacgatctatctccgcgagcgccagatggaacacgcgaaatagtcagggattggtcacatgtaaaaacatggaaaagtatggagaacctcttggctacaggtaaagtcaaggcgatcggagtttccaactgttctgttccttatttagaggaattaattgcggaagcaaaagtcattcctgctgtcaaccaaatagaaaatcatccatcgcttccacaacaagagattgttgattattgccattcgaagggtattcatattacggcctatagtccttttggaagtgcangatgcccaatgttcactgaaccaacaa

SEQ ID NO: 24406 - DNA, 1997 bp, Triticum aestivum
  unsure (1)..(1997): unsure at all n locations
  Clone ID: PAT_TA_24406
ccctgctggggccgcttcggccaggtctccgacgcggtcagcctgcgcgcccgctacaccggccgcccgcgccggtactgtgaattggtgatatcagattaatatacaggttagttaattgtttctagctaaccagaggtgtggtttacggacacccaaccaacatgctagaggagcgggatacaaacattttgtgaaggtttcagattttagtttaattttctacgtgtattaggtcttttggttttccaatgagatgtgcagtggtgattgcggcacacacttaaaaggtgttccaacataagattgaatgctgtcatacgtgctaccaacttggataccgaggtacgaccacaacacacagaggcccaggcgctttggctccatcacctatgattcagaagatgcagtggatcatgcgctgcacaagaacttccacgagcttaatggcaagatggttgaagtcaagagagctgtcccaaaggagcagtcgcctggacctgtcgcacgctcacctgctggagggcagaaccttgctatcagcagggttcacaacttcttgaatggcttcaaccagggatatagcccaaacccgataggaggttacggcatgagagtggatggaaggtttgggctgctttcaggtgcacgaaatgggttttcttcatttggccccagttatggaatgggcatgaatgttgaaactgggatgaatgcgaattttggtgcaaactctagtttcctcaataactcaaatgggcggcaaatgggttcatactacaatggtggttcaaacagactaggcagccctattgggtatgttggtctgaatgacgattcaggatcaatattgagttcaatgggaaggaatgtttggggtaatggaaatgtcaactaccagaacagccctacaaacatgagttcttttgtaccatctggaagtgggagtcaagttggtattactggcgacggtataaattggggaggtcctacttctgcccacgggatgggaagcatttcaagccttgggtctaacattggccgtggggctggagataactttggcttgccgtctggtggctatggaaggagcaacccaactggcaccattggtgaacctttttctgcctcacccaacgcatatgaaatgaccaacatagatacatatggccacaactctatttatggtgactcaacctggtggttcacgtcccctggggttgatactcctcctttggatactgctcttggaatcttcgatctgagatcgcaattcagaacatgccagcacagttacatggggcaactatactgttaataataatcagacaagcagaggtatcacttcctaggcgagaatattattatagtcatatatatgacttgggataggcaagacacccattatatcaggtattcaggtgcagtactgtgaattggtgatatcagattaatatacaggttagttaattgtttctagctaaccagaggtgtggtttacggacaccaaccaacatgctagaggagcgggatacaaacattttgtgaaggtttcagattttagtttaattttctacgtgtattaggtcttttggttttccaatgagatgtgcagtggtgattgcggcacacacttagaaggtgttccaacataagctggaattctgtcatacggacgacaaacttgtataccagggatgctgtattatcttgcccatttatggcaacattagcttgcgtgtttttcctcttttccttttttaaccatttcatttgttactagaggatttggtcggctttatactagtaaaaactatttgggggtgccaatgccatcctggtccccattaataaagtcacccaaagtacatactaaaaagaggcgggccccgtgccgcattacccccaagcgtctcttatcgcccgcccccgttcgccgccctttanaccccccagcgggacaagcccccgcctccatccacccgctgcaannatcc

SEQ ID NO: 24407 - DNA, 542 bp, Triticum aestivum
  Clone ID: PAT_TA_24407
ctcgtgccgaattcggcacgagtcaaggcgccaccaaataatagcatctcaattaacgttgaggagggccactggatcacatcgaaacttagcgcctcttcttctactacaaccaagctaatagaaaaattcttagcagacgccttcagtacctcttccgatggcagctggagtacatcatattcaacgacttttagtttcgaagtaccagcaggaaagtatggggcaatcgtcagtaaccctttgaccacagtacatgagggccatgtggacgtgggctgcataggtcaggctgagcggacggaatttgtgagccacacttatcagagtagagattatttcaacttgaaatgggtagagggcgttattggactttgtgtgggtgatacgcttcctctggctcgatgctacggcccaggcagcctgggaggagttgaaaagcgggtaaagatgagtccaagatgaatttgtgaacactcgggctagcccaattgcctttccccaaagctacaagataagagtaaagtttttaatacgatctt

SEQ ID NO: 24408 - DNA, 554 bp, Triticum aestivum
  unsure (1)..(554): unsure at all n locations
  Clone ID: PAT_TA_24408
ccggcggatnttgaatntccagacgttggttcccnagcgcccacttgnggttagggtnntcctgcggatgatacccaccacccattgttggttacgaatttcccgattatccatccccaactggaggttatgaatctcctagttacccagcccccaccagccccggggaatacccaagtccaactgggggatacatccccccccccgccccgggcaaccggccactgggaacttaacgggctcgcgcccacttccgcacgacaaaaccttggtctcggcctaccacgtttgcttcagtactcgcacaatgctttcttgcgctactagaaccggccgtttcatacgctttttctttcgtcttctctcgctcacgactaactcctttccgacattaaaatagcgtgtgttgtcgaaggacttcatttagagataacttattacgccaaattagaaaggctttcacgggaattattattttgaaggggctatgaatctttaattaaatgtattcatgagtcataacatgtatgaaattaaacgtcttttgaatgaaa

SEQ ID NO: 24409 - DNA, 548 bp, Triticum aestivum
  unsure (1)..(548): unsure at all n locations
  Clone ID: PAT_TA_24409
ctcgtgccgaattcggcacgagattgtttttatcatacttctcacaacaagcctccctcgggttttttgatcaggctgtcgtcaaattttcattatacagcttcaatctagcaatagtccttcgtttacgctacacccgctcgtctgacctcgatccatacgagcatatcacaactcagacatttgaaagtaccgattattacctgacatctctatcgttaactctaccgcctttacaatggctgatacaacttttgatgagattaacctctccatcctcggagtcgcttccgagtatcctccttttgtacacgacgcatctgtgttacagaaaatgtgcgaacgtcactatcccaagaatgcagccatggacaaagtttgtatgatcaaccgttacactgggtatagaatcgcgctctgccatcgggaccggnccgactatcctctggcaaaacatggatcgtgctcccaacatcactgaaactggtgcgaagtttcccgaaanggacggtgtgggggtggccctggctgcatcctagaaaagcact

SEQ ID NO: 24410 - DNA, 576 bp, Triticum aestivum
  Clone ID: PAT_TA_24410
tggcggaggaacagcgagtatcggccgaaagcgagcacggcgcaagctgctgttcgccgtccccatcattccgatcgtcttgttcatcgtcgggtcatgcgcgctcttcttgttcacggccgacctcccgcgcatccgcatcgagtacgcctgcctcgatggcgcccgcgacgctcggcccacgaattcgaaggagccgccggaggccgtgatggtgcaggctgttcgcggcgaggaggagcaaccgctgcgccagctgaccgaccggccgtactcgctgggcccgaacgtgtccgactacgacgcccgcagagcggcctggctggccgcgcaccctgggttcccggccatggtcgcgccggggcggccccgggtgctcatggtcaccgggtcgtcgccgcgccggtgcacggaggcggagggcgaccacgtgctcctccgcgcgttcaagaacaaggcggactactgccgcgtgcacgggctggacatcttctacagcaacgcagtgctggacggcgagatgacggggttctggacgaagctgccgctgctgcgcgcgctgatggtggcgcaccc

SEQ ID NO: 24411 - DNA, 550 bp, Triticum aestivum
  Clone ID: PAT_TA_24411
ctcgtgccgaattcggcacgaggtcactgtctacctacatctatattctcctctttatattcctctgcgcgtgtcagctctcttcaaacaaaaaatgcgatcctacctcatatttccggcctgggccatgctggccgcagctcacttcaccctcgagtaccctgaatcgcgtggctttgacgaagataccctggacaaattcccatgtggtggccagaacgatatttcggagatccgaactccctatccgctctctaacggtgtcattgccctcaaaatgggccatatcaagtctagagtccaggtcaccattgccctcgactcggatcctaccacagcttttaacacccgtcttgcgtcccacatttcaggagacaggcctcggaaagttctgcatgacgggaaattttctattcccacatctctcaatgttcaaggaggggggatggcgtcgcgccctgtccccacgtccgcgacgatcgcgggggctgattcaacggcgccggtttcgtgtctaacgccccgccgcctgtcccgtcaacgatgactg

SEQ ID NO: 24412 - DNA, 652 bp, Triticum aestivum
  unsure (1)..(652): unsure at all n locations
  Clone ID: PAT_TA_24412
ctcgtgccgaattcggcacgagctcgtgccgaattcggcacgaggttgacaatagctaccttaataatccaacctcccgccagtcatacagatagccactcgtccggcaatctctacacttgttaaaaattcaaactaacatattgccattatggaatcgaaagtttctgtcaagtttgtgaaggtcattcgggtcttaggccggaccggatctcgcggtggagttactcaagtgcgggttgaatttatggacgacacttctcgcagtataatccggaatgtaaaaggcccagtccgcgaggatgatatactctgcttacttgagtctgaacgtgaagctcgaagactaagataattttttatcaagtactgtttatcggctgtctggaggaaatcaattcggaagagaaagcgaatccttagcatgcactgtatatttttcacaccttacatgacatgtttcgctaaagtttatggtcgtatacaaagttgaaaattaagagcttgatatctcatttgacaaacttttccaaaaaagggttgggattttgaaatttgaaggcccgatgctaaggctactcctggtaactggctatacccaataaattttatccctaggcatgtggngaaaaactgggaagaaaaaccagnn

SEQ ID NO: 24413 - DNA, 613 bp, Triticum aestivum
  unsure (1)..(613): unsure at all n locations
  Clone ID: PAT_TA_24413
caattagtacgccttctagacgagatagccaaacctcagttcccctcacgatctggtattcagtgattgttaaacacaacacctgaaaattggcgttgttaaggtcaagtctggcattatggaaggtccatctacaaatttgatcgaatttatcgacttgagtcagaaaagttttgccattgcggctggatcgattttgtttaacccaacattctggaatatcgttgcgcgaaaagaatatcatgataaagtccctaactaaacttgtctggtggcaatgcacgcctcgngctggttataatactcgcagttaccatcccttgctgcggggggtgccgagattttctctatgagcgcgccctccgtgatcagcctaccatgccactcttgttgacaaccccctttcagcttctaagcccttgttttagttatttcaggcaatatcctagtcatatcctcaatgtgggccctcggaataactggtacataccttggtgattatttcggaattctaatggacgaaatggtgacgggcttcccgtttaatgttaccgacgcaccatgtattacggnagcacaatgagtttcccaaggacagcactaatccttggaa

SEQ ID NO: 24414 - DNA, 565 bp, Triticum aestivum
  unsure (1)..(565): unsure at all n locations
  Clone ID: PAT_TA_24414
ctcgtgccgaattcngcacgagcaagaaagctccatcgacgaaccaatcgccccactgctagacatggatcccgccgccggcgagaagccgcacgccgtgtgcctgccgttcccggtgcaggggcacatcacgccgatgatgaagctggccaaggtgctcccgctgcaggggcttccacgtcaccttcgtcagcaccgagtacaaccaccgacgcctcatccgctcccgcgggccgagcgccgccgcgggcctccccggcttcgtcttcgccaccatccccgacggccttccctcgtcggacgccgacgtcacgcaggacccgccgtcgctctgctactccatcatgaccacctgcctcccccanttcaaagaatctaatccgcttggcctcaaacggcaacacgttccggggcgccgccggtcaacgttgcatcgtggcgggacgggctcaagaagctttcgccgtggacgccgcgaaggggaactcggngttgccgttgcgctctgntctggaacggcaancgccttggnggntaaatgggctaacgggaacttccgnccccc

SEQ ID NO: 24415 - DNA, 847 bp, Triticum aestivum
  unsure (1)..(847): unsure at all n locations
  Clone ID: PAT_TA_24415
ccacctctctgcgattccagtacaccttgtctgtagacattcaactagacaccaaaatggcacgccgtccagcaagatgttatcgttactgcaaaaataagccataccctaagtcaagattcaaccgaggtgtacctgacccaaagatacgaattttcgacctgggtcgcaagcgtgccaatgtcgacgagtttcctctgtgtatccatctggtctctaacgagtatgaacaactaagttctgaggctttggaagctgctcgaatttgcgccaacaagtacttggtcaagattgcaggaaaagaaggtttccatctacgagtgcgagcacatccttaccatgtcgttcgaatcaacaaaatgttgtcatgcgctggtgccgatagattacagaccggaatgcgtggagcatggggaaagcctaacggaactgttgctcgtgtaaatattgggcaaatcattctcaagtgtccgaactcgggattcccatcgtgcaactgctctcgaggctctccggcgctcacagtacaaagttccctggacgccaaaagattatcgtatccaagaattggggatttacacctctccgtcgtgaagagtacatggaaaagaaagcgtctggaaaagtattggttgacggggcatatgttcaatttttgagcaatcacgggaaactagccgacaatgtccgaagattcccagccgcatttgagggataagcggaactattagaattgtagaaaataccaagccaatgccttaaaatgtagtttattcctgttggaggatactctgatacaagcaacagtttgaagtaaaaaaaaaaaaaaaannanaaaaaaaaaaaa

SEQ ID NO: 24416 - DNA, 836 bp, Triticum aestivum
  unsure (1)..(836): unsure at all n locations
  Clone ID: PAT_TA_24416
tagcatggcatgcgtctggtacatacgataaggaaaccggtacaggaggatccaatggcgctactatgaggttctctcccgagaaagatcatggtgcaaacgctggtctagaagcagcgcggaattttctcgagccggtaaaagaaaaatttccatggattagttattccgacctatggattcttgcaggggttgttgcgattcaagagatgcaaggtcccatcataccatggcgacccggtcgaagcgacaaagatctaagtgcatgcacgcctgacggtcgtctgcccgtgccgactccggcacgggaacatctccgtgatatatttgggcgtatgggcttcaacgaccaagagattgtccgctttgagtggtgcacatgcgctaggtcggtgccataccactcgctctgggcttcgacggtccatggacattttcccccgactgttcttaccaacganatactaccgccttctgcttaatgagaagtggtcatggagaaaatgggatggcccaaaacaactggaaagacaaaacaacaaaaacgttgatgatgcttcctactggctattcattaattggcgacaaagacttcaagtcatgggtcaaaaagtatgctgatgacaatcaattgttctttcaagacttttcaaatgttattttaaaacttttccgaattaaggagtcccaatccctgangggtcaaagcgttttcaattcaaaaccaactcaaaatcctangncttgggcctcccggtaantgttataaacactggtattaacaatttcaattncgggggaaaaaattccattccattangggaaccaaaatctnt

SEQ ID NO: 24417 - DNA, 559 bp, Triticum aestivum
  unsure (1)..(559): unsure at all n locations
  Clone ID: PAT_TA_24417
ctcttccgcaagcgatgggaagcgcaccttgccgtccgccggaggcaggacgagatcttgctcccgctgatcgaagcaaggcgctcagtttccgtgccccgcggcgccgatgaccctccgtgctacgccgactcgctcctagcgctgcgcgtggccgacgaaggcggccgcccgctcacggactctgagctcgtcagtctctgctccgagttcttgagcggtggcacggacagcacggtgacctcgctggaatggatcatgggggagctggtgaaccatccggacatgcaggccaaggtctacgaaagaggtcaggagcaagccggagctcagcgaaggcgacctgcatggggatgccgttacctgaaagggccgtcgtcctcgaggggctgcggttccacccgccggctcaattcctcctccctcacggcgttcaagagcgacacggaaatcggcggctacagggtccccaagggcgcggaggcaaacctcctcgccgcccgggcccggcgcacgtgtgggcggggcgcncaattcgacggancggttctgacggggg

SEQ ID NO: 24418 - DNA, 843 bp, Triticum aestivum
  unsure (1)..(843): unsure at all n locations
  Clone ID: PAT_TA_24418
aaatagtttggaagtttacaatgttgtcgtatcaaaanaaaacatgacaacgcttctattttcatccgcataaaattataattcgntcctctctctgatgcaccccggacantaatgagttttgttaactancccttacngatancgaatcanttaanagctttccgtaggaatgattcctacncangtncatggattctgngacttggtcngcgacanatanngataagtcatcgatctctnatgaactanattccancccttctatctcgncaactatcactngacgctntgcannccctcgtgccgtctcccgcccccgcgctgggccgcccgatgtgcctggtcgtttcgaccacattgcaatctccccacctccgctatatatctatcatcgaagattcaaagcaaaacatgacaacgcttctattttcatccgcataaaattataattcgttcctctctctgatgcaccccggacattaatgagttttgttaactaccccttactgataacgaatcatttaaaagctttccgtaggaatgattcctacccaagtactggatattgggacttggctgcgacactagtgaaagtaccgatgctgttgactacatttctaaccccaaaaacgccattgatgaaattttttacgcttaatttttcggaaattcaatgagcgttacgactggtgcgttgagcttttgacggcctttcaattcttcaatctccaagatgaaaaggaatccaacaaagcaagccanccagctgttcgacgaagtttccttgcggctagcgcaagagccccagtggcaacaatatcatcaacaatcaatactngg

SEQ ID NO: 24419 - DNA, 506 bp, Triticum aestivum
  Clone ID: PAT_TA_24419
cgtccgtaccccgagcccgactggacgcgcagctctctcccaaccgaggcggcgcgacctcctcccgccgccccgccccgccccgccggacccctcgccgcccgacgctccgtccgttccatccggatccgcctatctcgtcccgccgcctcccagatccgccggccgcctcccctccgatcttgttttgttgcagcctctgtattgctgcaatctgacaaagtggagggcctagaaggtgaagcttcttttatgtctgaacaagcatcggtttatttgggatcagttggattgctgggagagtattctcgttcaacgagaaaaaggcacaagtttgtgctcccctgcatgcatcaagagcctattaggatctctggttctgagaattcacttgccaccgccagtgctcaaagccagctcagttttcttcaaggaccagcagctactctcacttctggaattttctacatctgatagtatctgctgcagaaatcttgagtcaagat

SEQ ID NO: 24420 - DNA, 427 bp, Triticum aestivum
  Clone ID: PAT_TA_24420
cggaccccacgcgtccgcccacgcgtccgtgaggaggaaaccattgtgcagtggtacaatgaagctgttgctgccggcaaggactctcaggtcgtgaagaatgccaagcccgtcgtggagtggctcgagagcgccgagtccgacgaggagtgagacgctgtactgcttgctccctttcggcatttcctttttaccaccactactgcttaagtgtcttttgaagtttgtttgaagtgttcctcgtcgttgtggatcagtatttggagtttgagtcagttgagtgtgttgcgtctgatgtatttcaaagcacagtggatcagtatttggggtttgagtcagttgagtgtgttgcgtctgatgtatttcaaagcaccgtgtgatggtagactcgttatattatgaaatgatgtggttttttgtctgttat

SEQ ID NO: 24421 - DNA, 2408 bp, Triticum aestivum
  unsure (1)..(2408): unsure at all n locations
  Clone ID: PAT_TA_24421
ccgccggcagccccgccgccgcccgcaccctccgatccgatttcggttcgattgcggtttcgtaccccgcccgccgacgaggcagcagcatctgttgtgccgcacgctcacaaagtggagggccccgatggacctccgtttatccccccccacgccccgcagcctccggtcgatttcggttcgattgcggtttcgtccccccgcccgccgacgaggtagcagcatctgttttgctgcaatctgacaaagtggaggggatacatgctgaaccttcttttactgtctgaacaagcatcggtctatttgggatcagttggattgctgggagagtactcctcaggtgcaacgagaaaaaggcataagtttgtgctcccctgcatgcatcaagagcccattaggttctctggttctgagagttcacttgccactgcctgtgcactgtcacgacaagtggtagctcccgcctgcagctactatttcttctgaattttgccacatctgatagcatcctgctgcagaaagattttctcaagatggcgctgcaaaacattggtgcttcaaacaaaggatgatgccttctacaggtacaagttggccacaatgattgaccaaaattgaaggccgtagtaatggcatcaagaccaatattgtgaacatggttgatatagcaaaagcaacttgccaggcctgcttcctacacaaccaagtactttggatgtgagcttggggcacaatcaaagtttgatgagaagacgggaatctccttggtcaatggagcccatgacacttcgaagctggctggtctgcttgagaacttcatcaagaagtatgtccagtgttatggctgtggcaaccctgagacggaggtcctcatctccaagaaagagatgataactctgaaatgtgctgcctgtggcttcctctcggatgttgacatgagggacaagctcactacattcatcctgaagaacccaccagaggcaaagaaaggaggcaaggacaagaaagctatgcggagggctgagaaggagcgtctgaaagaaggtgaagcagctgatgaggagatgaagaaactcaagaaggaatgggaaggaagaaaggtgcttcgtccaaggagaggtactgcaaaaggtgttgccacaaagaagaaggggtgctgggggctctgaatgaggaacatgtctcatcaaccaagagatgctgactttgcagctgctgcagacgatgatgatgatgacgatgatgatgtacagtgggcgactgacacgtcagcagaggctgcgagaaagcgcatggaggaacagctgagtgcagcaactgctgaaatggttatgcttgccactgaagagactgaaaggaagaagaaacaggcccagcacaaggatgatggcggtgccaatggcacagcaaaggctgaagagacctccaacggtaaccaggagtggggccaagaaccaccactccctatgatgcactggttgaagagatcaaggccagcctagccaatgctgccaccgcagctcagctcaaggggttgctgtcctcctcgcccctgcccctgaaggatgtgatggatgccctcttcgaggcgctcttccatggtgctgccaaggggtttgcgaaggatgtggtgaagaacaggaagtaccttgctgctgctgtgcctgatgaagccgcccagatgctcctgctccagtctatcgaggcgttctgtggcaagtgcagcgccgaggccctgaaggagctgcctgtcgtcctgaaggccctctacgacggagacgtcctcgaggaagagactattgtgcagtggtacaatgaggctgttgctgccggcaaggactcccaggtcgtgaagaatgccaagcccgtcgtggagtggctccagagcgctgagtctgacgaggagtgagaccctgtactgcttgctcccattccgcacttactttttaccaccgctacttgcttaagtgtctttttaagtttgtttgaagtgtccttcatcgtcgtggatcgttttttggagtttgagtcagttgagtctgtatttcaaagcaccgtgtgatgaacaatttgcgttgaagactcgttatatatgaactgctgtcatttgtagtctgttatatatgctgccttgggtagcgctgtcacttgattgtcctttaaatggtgtccgtcattgtcgtgggactgtatttgaaacggactaatgttttagtcactcctgtacaacccccgtgacgcatccggaccgcctcccggcacctcccccttccccctccgggcgcactagcccgctgcccccccccccgcgcccggcccggccgtcgcgcagcctgccggcccaagggcacgttgtaagcgtgaggtgcctgctacgcctcgcgtgaagggccctnaaatgcaacaag

SEQ ID NO: 24422 - DNA, 534 bp, Triticum aestivum
  Clone ID: PAT_TA_24422
aaggccaacaaccgcttcatcggctgcatgcaggggtttgaccactggtacgccagcaaacggcccaacccccacgtggtcaccggggccattgtcggggggcccaactgccccgacgagttcagggacgaccgcgccaaatacgtgcagacccaggggtgcacaaacaacacggggcccatggttgccgtttttgccaggctgcccaacctgtcggcggcggaggaggaggaggggtgccgcccaggggcggcgctggggctctcggcgaagtgtagataaaggtggcattggcttgggtgggaaattcttttttctttctcgtatacgggacttacttccatataagatctttttttgaagtgttcatatgagagaggtttatttagtgaaaggaaagaacaaaggagagtagtgaatgaacaatgaggagaccgatcacgatggtgaagattagatacttgtattctgaagttaattaggtgcctcagaaagcaaatttaaagagctttaaactttactgaaaaaaaaaaa

SEQ ID NO: 24423 - DNA, 730 bp, Triticum aestivum
  unsure (1)..(730): unsure at all n locations
  Clone ID: PAT_TA_24423
ctcgtgccctcgtgccgaattcggcacgggctcctctcttagtgattaaaacaccctccattcaaataataacaaaagataattcgagactaaccctctaaaatattgacactgaaacaactatacctgaagattttcgcgcccacacattggaataaaattagtaacaactttcgatggcttccctggcagttctcggtgtcggtgtcgcaaccgcagcgtttcttgggcgtgccgggctattagccttcaggcgatcacggggtgaagcagttggcgcttttggaaaagcgtactataagggtggttttgagcccaagatgaatcttcgagaagcggccctaatcctccagcttaatgaaagaaacctgacgaaagaagccatccgtaaaaaccatcgaatgctaatgatgttaaatcacccaagaccgaggcggtagtccctacttggccacgaaggtcaacgaagctaaagaattcttaaataagaacaagccgtcgctaagggtgctgacaactttggagatagaaattctgacgtgccactaccaatggtgtttaacaaagcttctacttggatnaaagcttgcntaatgaaagaaaaatcngttgctactgncctccggntncacctgtccaataattttccaatccatcccgnacggctcaagggcaaagaccnaaagtagtaaaagacaaaagcaactcctttggacaaagcnagnacant

SEQ ID NO: 24424 - DNA, 676 bp, Triticum aestivum
  Clone ID: PAT_TA_24424
ctcgtgccgaattcggcacgagaaaagataagaggcttctgccatttatcaaccggacaagaggccgtagcagtcggaatcaaacacgccttgagtaatgaggacgacattattacagcttaccgatgtcacggatttgctctcatgcgcggacccggccccaagtccgctcgtggagaacttctaggaagacgtgatggaattgcgtacggaaagggtggatctatgcacatgttcgcaaaaggtttttatggcggcaacggtattgttggcgctcaggtgcctgtcggagcagggctagcattcgcgcacaagtacaacgacaagaaaaattgtacagtagcgctatatggtgacggtgctagtaatcaaggccaagtatttgaggcgttcaatatggcaaagctctggaaccttcctgtgttatttggatgcgagaacaataaatatggcatgggaacttccattaatcgatcctccgccactacagacttctataagcgtggacaatatatcccaggtctgaaggttaacggtatggatgtacttgccgtcaaagctgctgtcgcatacgggaaggcatgggccgcagcaggaaatgggccacttgtctacgaatacgtcacttaccgttacggaggccactcaatgtcaggttcaggaaccacctatcgaa

SEQ ID NO: 24425 - DNA, 535 bp, Triticum aestivum
  unsure (1)..(535): unsure at all n locations
  Clone ID: PAT_TA_24425
gggctgcangctcntgccctcgtgccgaattcggcacgaagcttaccagcattcaatagattctcgcccatcatttctttcctacgacgttttttcacgaagactgctgtgagtcctacggcgatgtcaaccgcaaaggcaaaagttgaacagatcattaacgatcacgctgttgctgttttcagcaaaagctattgtccacattgtgaccatacaaagaacctattagaaagtatgggtgcgaaatataccgccattgagctcgatcaaattgatgatgggtccaccattcaggcagccttaaaagagattaacggtcaatcaacagtaccaaatatttacattaataaggtccacattggtggcaattcagatctccaatctaagaaatccacgctaccaagtttacttaaagatgcaggagcattgtagcttgaagaacaaagatttgaacactgaaataaatgttgagagcatagatgcaatagatactttatgaatgcctttaaatcaaagccaaacattaattaacagg

SEQ ID NO: 24426 - DNA, 431 bp, Triticum aestivum
  Clone ID: PAT_TA_24426
tcccgctccaccagtccacaccgcagcagcacgagtgagctcgagaccgagaggggaagagaggaggaagcgatacagtactacaggcaaccatggaggtggtgaccggcagcaacggcgggaggctgaacccgtgggcggagcccttcgtgccggggagctggtgccgccccgcccccgcgccacaacgatggggaggagaggaagggagaagccgccgtcaagaagagcgggggcgaggtggcgccctgggggatcgagaagtggtggcgggcgcacgtcgcctcgccgccggaggtcccgaagtacgcggagaaggcgcctgctaaggtcctgggcggcggcaggttcagcccccgcaccatccagcagcctcgctaaggggcctaccggcctcatcgcgttccgcatcgatccatcgatcttggcat

SEQ ID NO: 24427 - DNA, 620 bp, Triticum aestivum
  unsure (1)..(620): unsure at all n locations
  Clone ID: PAT_TA_24427
cggncgcgtgggtcccaccccactccaccagtccacaccgcgacagctggctccgcgactacggcgacctggggctcctcgacgccgacgaaggcccggacgacagcgacgccttcttccctccgccgtgccacgcagatggagaggagaggaagggagaggccgccgtcaagaagagcggaggcgaggtggcgccctgggggatcgagaagtggtggcgggcgcacgtcgcctcgccgccggaggtcccgaagtacgcggagaaggcgcctgctaaggtcctgggcggcggcaggttcagcccccgcaccatccagcagcctcgctaagggaccggccagcctcatcgcgttccgcatcgatccatcgatcttggcataaatgaatggaaaagggatagaaaaaatagttgtttgcgagctcttgtgctcttaattagctttgcttatgctaaatttcgtcgtgtctcgttttcgttctagtttccagctcaagatcgaagggaggttcaattcgctgcgctgtgtatgtacagacgtctgtaaatgatgtactagtgtgtaataagatgcagtgatgcaatgactccattcggtgcaaatggttttccagttttcgtt

SEQ ID NO: 24428 - DNA, 690 bp, Triticum aestivum
  Clone ID: PAT_TA_24428
caattagccttgcgtaatcatgttgtgtcgtcgtagtttgagttttcagccaaagatcgagcggaggtcaattgcgctgcgtatgtgttcagttgtctgtaaatggtgtagtgtgtaataagatgcagtgatacaatggctattccgtgcaaatggttttccggttttcgttgccaaaaaaaaaaaaaaaaaaataggggccctttttttttttttttagaacaaaatacatcttattatagctccagatttattcaattcacaggacagcagaaggttattgcttttttttcccaacatgtactgggtgaagaaatgatgaacaactttccaacataaactgggtgaaaaatgatgaacaactaacaaaaataatttaataagcactctattctttgtctacaaaagctgactctgcaagatcaattgcccgagctagggcagccgccttattctcacattctttttgctcatcgtctgggatactatcagcaacaatgcccgcaccagcctgaaggtgagcaacccactctcggcgcctatctgagcttttgtatgagtacatcgtattgtggcttggagctgttgagaatacaatggtgcggagagcaagagcaataagcatgtcaccatcaaatgatatccctcctaagccaccactgtatggtcctcgtcttgggacttccaact

SEQ ID NO: 24429 - DNA, 1023 bp, Triticum aestivum
  unsure (1)..(1023): unsure at all n locations
  Clone ID: PAT_TA_24429
gccggaccccgctccattcccattcctatcccatcccactccggtgagctcgaaaccgagaggggaagaggaggaaacgatacagacctcaagccaccaatggaggtggtaactgcaagcaagggcgggaggctgaacccgtgggcggagcccttgttcccggggagctggtgccgcccggccccggtgcaggcggcggggggggaggtcgaggacttctcccccgagtggtgggccctctgtcgcccccccccgccccttccgcggcagctggcgccgccagcgcggcgacctggggctcctggccgccgacgaaggcccatcacgacagcgacgccctcttccttccgccgcgcgacaacgatggggaggagaggagaggaaacgcggccgcccagacgagcagaggggaggtggcgcccatgggggcatcgagaacgtggtggcgggcagcacgtcgcctcgccggccggaggtcccgaagtatgcggagaaggcgcctgccaaggtcctgggcggcggcaggttcagcccccgcacaatccagcagcctcgttaaggggccccacgacccacgtcattcgacgagtcgacccatcaatctttggcagtaagtaaaagaaaaatactgacacaatacagcagtcccgctaagttatcgtccaacctcacctcgtttcgcatcgatttatctatctttgcatgtattagtggaaaagtgatagataagatagttgtttgccagctcttctgtgcgtaattagctttgctaatgcgtaattacgtcggtttctcggttttcagttctagtttccagctcaagatcttagggaggttcaattcgctgcgctgtgtatgtacctacgccggtagccgctgtactagtgtgtaataagatgcagtgatgcaatgactccattcggtgcaaaaaaaaaacaaaatatccgaacccggtcccccggancccctgatctaaacgggggttcnancggggaantttttcanctgggganncatgaagcc

SEQ ID NO: 24430 - DNA, 558 bp, Triticum aestivum
  Clone ID: PAT_TA_24430
ggacgaaccggttgcgcttcggcctgtgcggcccgcacatgggcgatggtgcttgctccggctcggtgctcggcccaagcactgggtaaccgtcaacgagccaaacagactctcgatcggcggctacgacaacggctcccaacctccgcgccgctgctcctatccgttcggcgcggactgcgccgaggggaattcttcgaccgagccgtacatagcagctcaccatctcctgctcgcacacgcttcggcagtgtccctgtacagagagaagtacaaggcagctcagggaggccagatagggatcactctgctgggctggtggcatgagcctgcttctgacacaccccaggatgcagctgctgccgtgaggatgaatgacttccacataggatggcaggttcatgcatccgttggtgtacggagactaccctccggtgatgaggagcagggtgggccgtcgattgccggctctaccggcgccggagtcggccaaggtgcgtggatcgttcgacttcatcggcttcaaccactatcttatcatgcgtgcgcgatcgatcg

SEQ ID NO: 24431 - DNA, 782 bp, Triticum aestivum
  Clone ID: PAT_TA_24431
tggttcatgcatccgttggtatatggagactaccctccggtgatgaggagcagggtaggccgtcctggtggcatgagcctgctaccgacacacccccaggatgcagctgctgccgtgaggatgaatgacttccacataggatggttcatgcatccgttggtatatggagactaccctccggtgatgaggagcagggtaggccgtcgattgccggctctaccggccccggagccggccaagggcgaggttgagaccgccccgtggtccctgaggaagctgctggagcacctgaaactcaactacgggaaccccactgtgtggatccacgaaaatggatacgcagacggccccggcacccggagcaaggccgaggaggaggaggacgacgacgaggacagagcagagttcctgcaagattacatggaaaccttgtacctttccatacggaacgggtcgaacgcgcggggatacttcgtgtggtcgttcctggacgtcttcgagttcctcttcggctaccggctgaggtttggcctgtgcggcgtcgacatgggcgacgcggcgaggaggaggtacaagaggagctcggctcgctggtactccggcttcctcgcgggcggcgagctccggccggctgcttggccccagaagtcctacgtccaatgagaaaacaagagacgctcacatgtgttttccgagatgttaataagcaagacctctttttattcatcaaaggacgaaaatacctgtaccgggttcacgtgcgcgcgcgcacacacacacac

SEQ ID NO: 24432 - DNA, 638 bp, Triticum aestivum
  Clone ID: PAT_TA_24432
ctcgtgccgcgtgccgcacgcgccacgacgacaatacgactaacaatccactccaacgactaagccgccatgaagttcctaaaggttagccgtgttgcaatcatcacacgaggaagatacgcgggaaaaaaggtcgtgatagtccaacctcaagacaacggaaacaagtcacacccatatcctcatgctctggtcgtcggtattgagcggtatccctcacaagtcactcgccgcatgtcgaaggcacgccagactaagcgcagcaaggtaaaacctttcatcaaggttattaactacaaccatttaatgcctactcgctacaccctcgaactcgagggacttaaaaacttgatcagtgccgacacgttcaaggaggtgtcgcaacgtgaggaagctaagaaaaccgcaaagaaggccttggaggatcgttacctgactggaaagaaccgatgggtcttcacccctctacatttctgaattacacataacatagcgaggtgcaaaagaatgaagatctgttgttgtatcacaaaggctaatcgcatgtgggattctcaaagctatttagctacaggccggaagtcctccccaatggccccaatcagtatcacatatcacactgatgatgatacgcctat

SEQ ID NO: 24433 - DNA, 539 bp, Triticum aestivum
  Clone ID: PAT_TA_24433
cccgttcagacgactttcaaatttcgcacttcaagtcaaaaataacctcatcttcaatactatcaactacttcacactcttcaatatggtatcaccaagcacttgctgtggaaaggacggccagagatgcgtctgcgcctctatggcaaaatgttcatgcggcgagaaatcagcacttcattgcaactgctcaaaatctgcggtcgaaaatgcgatcactggaccacgctgttcttgccgggctcgtcctgcacgggcatgtacctgtgatcgtgccgctgtagaaaatgcttcccctactgggacctttatgttactggcggatcaagacctggccgactcctgctccgtgtgaagagagcttgtgatgggagggaatttacccaaatgagaccgatttcaccacgctatagatagtgactaaattttatatatgaggggaaacgcaaagtaaaaaaggggtctggagttaggtacgaggggtgagaagaatcgacccggagtttattttaaagcttggagcggttaaaggtaccatg

SEQ ID NO: 24434 - DNA, 516 bp, Triticum aestivum
  unsure (1)..(516): unsure at all n locations
  Clone ID: PAT_TA_24434
cctcccttccacatttctcacaatcaactcatctctcacctcaataaaattaccctaattaccaaatatggctccgatcaaagttggcattaatggtttcggtcgtataggccgcattgtcttccgaaacgctgctcaaagctgtgacatcgaagttgttgctgtcaatgaccccttcattgaaccagaatatgccgcgtacatgctgaagtatgattcaactcatggtcagtttaatggagacatacaagccgtcgaggacggactagttgtcaactccaagaacgtcaagttctacaacaaaaggaaccctgaagagataccatgggccgacacaggagctcagtatatcgtagagtcaactgggtgtctttacaacaaccgaaaaggctaaggcgacacttgaaaaggaggtgctaaaaagggttgtcatttcggctccctctgctgacgcaacccatgtttggcctggggggcagccacaagtcgtacacaactgatcttgangtgattcaa

SEQ ID NO: 24435 - DNA, 531 bp, Triticum aestivum
  Clone ID: PAT_TA_24435
gccggccgggtcgcgggcaataactctaatctctacccctcctccgcgatccccttccccctcctccccgtcttcccccctcagatctccggcgaccccccggcgaatcggcgccatgtcagggcagagccagcgcctgaacgtggtgccgacggtgacgatgctgggggtggtgaaggcgcggctgatcggcgcgacgcggggccacgcgctgctcaagaagaagtcggacgcgctcacggtgcagttccgcgccgtcctcaagaagatcgtcgccaccaaggagtccatgggcgaggccatgcgcgcctcctccttctcgctcgccgaggccaagtacgtggccggcgacggcgtgcgccacgtcgtgctccagtccgtccgctccgcctcgctccgcgtccgctcccaccaggagaacgtcgccggggtcaagctgcccaagttcacccacttcgtcgaccccgccggcgcctcctccggcggtccctgcggggcctacaacagactaaccggtctcttccgccatgg

SEQ ID NO: 24436 - DNA, 1540 bp, Triticum aestivum
  unsure (1)..(1540): unsure at all n locations
  Clone ID: PAT_TA_24436
gccggccggcgcgcgatcccctccctcctagtccgacctccaacccgtattcccgatcccatccctcccaccgcccccccgcccagctccggggacctcccgcgggatccccttcttcttcctcctccccgtctgcccccgctcagatctccgaccgccgccccgccccacccgccccgccgagatgtcggggcagagccagcgcctgaacgtggtgccgacggtgacgatgctgggggtggtgaaggcgcggctgatcggcgcgacgcggggccacgcgctgctcaagaagaagtcggacgcgctcacggtgcagttccgcgccatcctcaagaagatcgtggccaccaaggagtccatgggcgaggccatgcgagcctcctccttctcgctctgccgaggccaagtacgtggccggcgacggcgtgcgccacgtcgtgctccagtcggtccgctccgcctcgcttccgcgtccgctcccaccagggagaacggcgccggggtcaagctgcccaagtgcacccacttcttcgcccccgccggcgcctcctccggcgggccctccggcgcctcccccagcctcaccggcctcgcccgcggggggcagccggtcccggcctcctgcgccacccacgtcaaggccatcaaggccctcatccggcgcgcctcgctccacgcctacttcctcaccctcgacgaggccatcaagaccaccaaccgccgcgtcaacgccctcgagaacgtcgtcaagcccaggctcgagaacaccatcacctacatcaagggcgagctcgacgagctcgagcgcgaggacttcttccggctcaagaagatccagggatacaagaggagggaggtcgagcgccagatggccgcggccaagctcttcgccgaggagcagctcgccgaggatctcgccctcaagaggggcgtctccatcgggggcgccaccaacatactcgtcggcggcggagacaaggacgaagacatcatcttctgatccccacccctgctatccaattgttcaatcgtggtggaaacaataagttctggtgctggagccccagaatgacatctgtttatagagtggcggaggtttttgtttcaggctgtgtgcagcctgaattatggccatccaagacccaaaataatctctctctgtgtacttttgggaaccaaacattgctggtgaaactagtggctatgtgcagtagtaaaaattcttttgtaccgtattactgtatttcatttccctgcacgctcgttttagttgcatatttattcagacattgtgtatctggatttcggcatgcttcgctgtgaacctgctctgctgcagacttgtatccttctttttggccgtgtattctggggcatctactctattcttttctcaacttttccttggaggaaatagatgatgtgtgataacatggcaccaaagataaatattaaatctgaacttatgtgaagtgtaaaataagatttagntgttgtgaaccttgaaataaatacccctcccgtttctaaaaaaaaaaaa

SEQ ID NO: 24437 - DNA, 924 bp, Triticum aestivum
  Clone ID: PAT_TA_24437
atcaaaggcgcttcccgatgagcctgtgagccggctcaatgaggagcctacccgaatgagcacactcatcgacctaacctgcgacagcgacggcaagatcgacaagttcataggaaacgccgagacgctcccgcttcacccactagaccctgagcgcggtggctgctactacctcgccgtgctgctttccggcgcataccaggaagccctttctaacaagcacaacctgttcggcggcccgagcatagtgcgggtcgagaaaagcaccgccgctgccaccggcttccaaattgccacagccgacctgggcccgacgacggaggagctcatcagcaccatgaggtacaatgtcaggcaggacatcgtgggcgtcatccagaggcgggccatagagataggggtgtggggaatggtgggggaggcagtgcacactgggcttaccaccatgccgtacctcatcatggaagatcacgctgcctcttcatggaagcaccaaggaggactagatggaaaagacgagtccatcgtcaagatggtgtttcggcaagtttcccgtctcctctgcttgcccttcatgtggtccatcccatcaaaacgaatcggatcagcagcctgatttcgatcgtttcccctcaaaaaataaagagtaatgctaccccccccaacacttacgtgagctttttacgtaaaggctaatatggatgtgttttattggatcgagattagattagtttgagatggaaagttacgtagatgtatcattattcaaaaataaaccgccccctaaattattgttctagcattataatagtatttgttatttactcatatattgtaagagaatctttctatatacctatatatatatatctaaaaagaaaaaaaaataaaaaaaaataaaaataaataaagaaaaagaggggc

SEQ ID NO: 24438 - DNA, 540 bp, Triticum aestivum
  unsure (1)..(540): unsure at all n locations
  Clone ID: PAT_TA_24438
ccttcggaatcgcacctacactatcacgcctttcatcctctaccgcctatctttcatcagccactatgcgtgaaattgtccacttacagaccggtcaatgcggaaaccaaatcggtgccgcgttctggcaaacaatttctggtgaacatggactcgatggttcaggagtctataatggtacatcagatttacaacttgagaggatgaacgtatactttaatgaggcttctggcaacaagtatgttcctcgtgctgttctcgtcgatttagagccaggtaccatggatgctgtacgagctggtccttttggccagctattcagaccagacaactttgttttcggacaatctggagcaggaaataattgggcaaaaggtcactatactgagggagcggagcttgtcgaccaaagtactagatgtggtgcgaagagaagcaaaagggatgtgactgtcttcaagggattccaaataacacattctcttgggggtgggacaaggtgcccntatgggtacnttantaaattcaaaatccngggag

SEQ ID NO: 24439 - DNA, 467 bp, Triticum aestivum
  unsure (1)..(467): unsure at all n locations
  Clone ID: PAT_TA_24439
gaattggtaccgggcccccccttttttgcaggaggagcgtagtttgcttgaatgccttggatgtgttattttctgcacnaatctgtgcggttgcatcgcttgatgctgcttacggttttcgctagcggttcaaaggcgggctggggaatcgcagtagcgtgatgattgaatgatgatatattgcttcctggtctcgacactaacactagatttgcttgtatatcacatataggtaatggtgtgatttgattagtaatctggtcttttgtactactactttgtgcatagcgagcgcagcccagtcctctttgtgtaggatgcaaacatagtcccactgtgttagcagttgataagtgtatttacccccagatgcaaactcgtatgtggacttaaataacatagaattaaatgggttcttacattatttccctaaaaaaaaaaaaaaaaaaaaaaaaaaaaaaaaaaaa

SEQ ID NO: 24440 - DNA, 1091 bp, Triticum aestivum
  unsure (1)..(1091): unsure at all n locations
  Clone ID: PAT_TA_24440
gagacctacctcaccgccgccgccgtcgcctgctctccccgctcgcgccgcccgccctagaaaagcccgcgactttctcgccgccgccaccccccgccgccgcagggatggccgaggacacggagacgaggcccgcgtcggcgggcgcggaggagagggaggagggggagatcgcggacgacggagacggctcctccgccgcggcggcggggcgcatcaccgcccacccgctcgagaacgcctggaccttctggttcgacaacccgcagggcaagtccaggcaggtggcctgggggagcaccatccaccccatccacaccttctccaccgtcgaggacttctggggcctttacaacaatatacataaccctagcaagttgaatgtgggagccgacttccactgcttcaagaataagattgagcctaaatgggaagatcccatttgtgccaatggcggtaaatggaccatcagttgtggcagagggaaatctgacacattctggttgcatactttgctggcaatgattggtgaacaattcgactttggtgacgaaatttgtggagctgtcgttagtgtgcgtcagaaacaggaaagagtagctatctggactaaaaatgctgccaatgaagctgctcagataagcattggcaagcagtggaaggagtttctggactacaaggactccattgggttcattgttcatgaggatgcaaagaggtctgacaaaggccccaagaaccgctacaccgtttgatcccgtgactcgttgatcctgagagcttccacagcaggcctgcctactcttggacgcaagaaggtttctcctgggatagcttagcttgtagcgggcggatgctattttccgatattatgtgtttgctgtgaattgcttggaagacataatctaacatcgttgcgtttgtcgtcgttgtactccataagacacattttaatttatgaagagttattttatgagaagcgatgacgaatgcgattactcgtttgagctgaaagtgtttacactactgctttgtccatcttgagcctgtgctgggatgccaataattgcattcaaacttgaagnangnta

SEQ ID NO: 24441 - DNA, 1317 bp, Triticum aestivum
  Clone ID: PAT_TA_24441
agaggaccttgctgtcctcgacggccgtggactgggaggcggaggcctacccggagatacggacgactacctccgatctacccattctttgcaaatattttcccgctcctgcgctatctactttacggctcctgtttgaaatattagcacagaatacttatatttctgaaatagatgtggacaagcgttgctcgataacagtactagaaggagagaaagcaagatcatactaattataaggaggtaagctctggtaaatttgtataattttctttagggggaggcgctttcattatttgaaacatacaatgagccatgggttacaaacaccatatacttttgggtagggcctggtgagcaactgtggcctgatcaaaagatgaaactgaagcttaaggctgtatacatgtatgctgctggattttacacatattccatctttgcccttctgttctgggaaacaagacgcaaggattttggagtctcgatgtctcaccatgtggcaactgttgttctgattgttatgtcctacatttgcagattatctcgtgctggctcggtcattttagccgtccatgatgcgagtgatatattcctagagatcggaaagatggccaagtacagtagctgtgaggggctagctgttgtagcatttctacttttcgtggcttcttggatccttcttcggctaataattttccctttctggatcctgagaagcacaagctatgaagtagctgtgatccttgacaaggagaaaaaagaattttacagctccgtatactactatcttttcaacagtctcctgttctcacttctagtccttcacatatattggtgggtactgatttaccggatgctagtgaaacaaatccaatccagaggacgtgttggtgacgatgttcgatccgattctgagggagaagaagaccacgaagactaatctgtaggttgttggatgcttaactgaagaattatataatgtgttccctacaggatgatacgtccatcaccctaggcactgatttcactagaccggatcaatcttcgtgtcaaacatggcagccacaatttgcaggagttggtactacagctacttgtgctatcatatacaaagttggtgtatatttgccctggatccgtatttgtataaaagagagcacaataagtttgttcaatctaggaaggattagttgattcatgatgcattgacgtcgttgtgtaatatgctgtggcaactcagtttaccacttggtgtatcttgcattgtaatgggtaatctggataagaagttccaaagaaatcttcaacattctt

SEQ ID NO: 24442 - DNA, 504 bp, Triticum aestivum
  Clone ID: PAT_TA_24442
cccgcgccccaccccgcccgcgccccgcgtctcccccccccccgccccgccccgcccggcccccccgccccacccgctcacctccaaagtccccaatcctgccgctcacgccccacgaacccatcaaaccctagctagcgtcatcacccccctcgagatggacggccgggacgccacggcggacctgcaggagtgggagctcctcctcgcctccccgaccgccaccgcggcgccgggcccttacgccgccggcgaggaggcggtggaggacgacgccgccggggccatcaacgtagcgactacttcgacctcggctccgacgcccaagtgacgccaggaggggcgtccctgtcggggggggccgagggaggagggtaaggcagccgaggggacggacgaggaggccggcgaggcgagctgggtggagccgcaaccgggcgccctcgcctttcccgccccgcgaacgcgcccgcgctctggtcccgactcgtcgtcggacggggg

SEQ ID NO: 24443 - DNA, 561 bp, Triticum aestivum
  unsure (1)..(561): unsure at all n locations
  Clone ID: PAT_TA_24443
ctcgtgccgaattcggcacgagcttcccccgtcccccctccccgcctcgcctcctgcccccatccatccacccgcgcgatcctcctcccgatcgccgccatgagcagccgcgccggagaccgcgccctccccgcctcctcccccaccgaacccgatccggaggcgccgtccgcggtgagcggcggcgacttcccggccgacctcctgcgggcggtcctgcaccggctcccgcccgcggacgtcgcgcgggcggcctgcgtctgccgcctctggcgcgcggtcgcctccgaccgcgccgtgctcgaggccgccttccgcgcgccctgcggggtgcgccgcgtcctcggcgacccggccaccagggccttctggcgcgccgcctccctcgcccgcttcgcgctctcgcacgccgtccgtcgcggggacaccgtccccggcgtcgcgctcaagtaccccgtccaggtgaccgatatcaaacggttcaacaatatgatgacgggcccggggtcnatcaagganangttctatcaataattaccaaaaatttgtgggtanactgca

SEQ ID NO: 24444 - DNA, 358 bp, Triticum aestivum
  Clone ID: PAT_TA_24444
ctgttgcgaaactctcacaggattctgctattagggcggtgaaggaaagtctgaaagtattgttctcccgccgtgcccggagcctggacaaatactccattgcagtaattaccaaagccggcgttgaactaaaagaaaatgaacaagctggagaatcaaagctggaagttcgccgaacaaattcggggatacggaacacagaaaaattaaggaataactgtttgatactaatagaataatttacatgtcgaaggacattgaagttgtatcaacactctagtgtattcaactatcaatccttttcctttacatcaataaataaaagattctgggaaagcttgtgatcacccgggaaaaa

SEQ ID NO: 24445 - DNA, 1295 bp, Triticum aestivum
  Clone ID: PAT_TA_24445
gcggccggttgcgctcgcgcacgaccgcaccctccccttcgtccctgcccctagcgcgaggactcacacgccctgctcttccccgccccttccagtcgaacccggtcgccgaagtgcacgaggaggcgctcgagctagtcgtgctcgcgggcgagccggccttaggcgacggtcggaggcggatgcggaggcgtgggactcaccggcggcgacgccctgccctgcctggcctctcccgcggtgagacacgccgtcccgcgtcacccgcgcccagctcgagtacgaaggcgtggagcaagatggcggggccgccgtggccgtgacggcgggttgtggtggtcgatctcggcgaggcggcgacgactgcggctccatggcgagcgcgagtagggagcggcgcaggttggtgcgccacggagtacgttgcaggacgagggcgtacgggcctggccttcctcccggaccctctgctagtgccttttcgctcgttcaccaatctccatcctcaccatggtcctctgtactcaacaagggtgaactctacaagttctagtaggctcctcggtgactcctcacaggagagcttttggcctgatctgatggagctgagaggtcaaaggaagaagtcaaacctgaagaagtgcagggaggaaattacagctgcgtgtgtccggctggttcaggggatgtgcagggcggccgtagccatgcgggtgtcgaggcaggcgatctcgcggatggatgccatgctgcgagggtaggttcctgggcgcccgctacgttgatgacggattccacgctgcgagcggcgacaatcggcgatggcgatcgtgcagggaggcgacggtgttggtgggcggcatctggtgcggtggtgactcaaggcagacaaacgtcgaggtcaaaggaaaaggtcaaaccttgagaaatgcagggaggaaattacagctgcgtgtgtccggctggttcacgggatgtgcaggacggccgtagccatgcgggtgttgagccaggcgatctcgcgaatgcagggcatgctgggattgtaggttggaatactcctctggtggtggagtacggtcagtcattagaaattgctaaatacacaccatcccactattagataaatgatggctgttagattgaaatttgtgggactaatcgtgtggttctgactgggttgtgcggtgtttggggccgctaatagtggggtgcgtgtaagaaatgttttgttccaattgttcaagtgtaggggaggaaaaggaaaaaaaaaaaaaaaaaaaatgtgtttcctt

SEQ ID NO: 24446 - DNA, 512 bp, Triticum aestivum
  unsure (1)..(512): unsure at all n locations
  Clone ID: PAT_TA_24446
cgcccaacgcaaccattatcagatatagagacaaaatttttattgagtgagcggaaaatgtcgttactactcgcgcgtcatgcactcaggcactccgctaaaataagagggcttgtcgcaaaatctaaggctagatgggaatcaacggcttcgaaagcaaatacgtcaacaacctcacaggctaccgagggtctaagccgtgtcgcctcagctgcaggcccagttctcaatggtgcagtaaatggtctcactgaagccttaataaaagttggaggtcgaaccggacgagttgttgcctttattcaacgaacaaatcccaccaacgctctactatgcgcgcgttggcctcgagctctccaaattgggtcttccatgggcaagaagatgagccctccgcccatgagcaccttttcaagtctaactatcaaganaactccgttcaaaaaccttaggtatccaangtagcctgctgggtgcctcttcgtctctaaacctcaaggtttactcaaacc

SEQ ID NO: 24447 - DNA, 512 bp, Triticum aestivum
  unsure (1)..(512): unsure at all n locations
  Clone ID: PAT_TA_24447
ctcgtgccgaattcggcacgaaggttgtctgttaatctcaaatatagatataaagcccgggccgcgccccgcacgagctcgggccgttgtccgcccgcgcacgaatccccagatacgccagctatcccaatatgcgcacttctactttactgagctgcctcatcacctggctcgtttctgttgtgtctatggtgaaatgtcacgacaactataaatgtgaccatggggccatcatttcggcagagcatatcacacacactctcacgccaccagggataaaaaccaacaatctgggttcagtagtaattgatgacgagagaagacccgtttactggcgggaaatctcagtcgcgcctgagtatctcgccataaatggtgcgacgctcagctatcgagcggtattttatgatgcaggaatatttctcgatatcctataagtcgaacatgctgaaataaggagggaagataanttcgtgtgaaagctggtanagaagtaaatcgctggttccggg

SEQ ID NO: 24448 - DNA, 429 bp, Triticum aestivum
  Clone ID: PAT_TA_24448
cgggtcgacgcgggccaccacaaggggacctggctaccattactactgcagttcccgcgtggttggaagatgtccaaggcggttaccaagaagatgcagaagctcaacgcctactgaccaaactcaccacttcgccggagggttttgatgggtttgtgctccaggacggcatcatccgccacaggggacgagtgtggctgggagcaaatgtggctttgcaaagacaggtccttgaagcgttgcacacaggcgctatcggtgggcactctggtttcaatgccacgtaccggcgtgtgcgacatctcttcacttggccgagcctgaaacatcacgtgaagttattcctcgaagcgtgccagacttgcaagcaagccaagccagaaaggattcgttacccgggattgatcgagcctcttcctgtaccttgtc

SEQ ID NO: 24449 - DNA, 451 bp, Triticum aestivum
  Clone ID: PAT_TA_24449
gtgatccgcacactaaagtttaagcagcactcttcagctttgagagcctgtattcgtcacttcttgttgtcatggaccaatctttactctctgaatggaagaatgccgttggcaactcatttgtcccgttcattgggaaagaaaatcattttactgttggattttccctcctagttgctggaataattttaagtggtctttttggtcttaatagatcaagctttgaacataccattgataatgtattccaagcttctttgggcgatttcctttggctcaatttatatgatgtggcgcaagtcggggtttaatgtttaacgtaaattcctttaaaaagtcgccgagagtcctcttccccctactgttgtttacctgccagtttcaggtcgccccggtccttgaattacagcgtggtcctttcacataacaaacaatttttcttgtcacgcaa

SEQ ID NO: 24450 - DNA, 820 bp, Triticum aestivum
  unsure (1)..(820): unsure at all n locations
  Clone ID: PAT_TA_24450
aaagttcctacgacaaagatttgtgtattagaaggatactattggacactaaagtttcaccagaaaaatgtgcgccttaatttataccctctttctcgtcatcaaaattaaacaagatcaataccagacttccggacgagagatgacctgacatctccattgacaaaacaattatctagtcaagccagtaatctgaccaccagggaatcacttcatctactttggtttaggttgaaccgcttccttgcttactgttgctttttgcggccttacacttttagatcttccaagacaaggtgtcaacgatttttgtgagccctaaccaatgttcgttgcgaggtcttcgatttggccaagtcagtttctttttcttcgacgtctttcatggagctaaatactacactangcaccctttattccgataacagaacttccgagtgggtcattcagtattttctcccttgagcaaccttcatatttctcaagatgttccatacatttgatagcaagacgaacggntctcgtacggtccatgggagatggaaccccgccttgctgtacatgacctggaatactctcacgtgactcgaaatgagtttccgcttcatcgcgaattatgtctgcaatcaagcttagcattggaaacaagggctaacccttttcgttggaccaaaatcaatttccctgaacgagaatgtccccaaacctgtccggataacgnccctaaaggaccttaacgtccggtggcaanatatcanagacttaaggccntcctccgggagtatnanaaagccgaggaaccnaccggcaaggacaagaa

SEQ ID NO: 24451 - DNA, 563 bp, Triticum aestivum
  unsure (1)..(563): unsure at all n locations
  Clone ID: PAT_TA_24451
tttttttttctgatgcagaactattttattacaacaccctcagccttggcagtttttatcctcttttgtatagctatagtgccatgaagtgttgcaaatttcaaatttcaaatcccaactaaacttctcgttcntccagcacttgcatttagagcttgttacagctttaaggccctgttnttgagctatcccatgccaattaactatgcgttgaatggatttgcttcccatttctaacaagtacccagaggttaagatttccttcactatcaattggtgacataattttcatcttcattgtgatgccactcatgatgaacacgaatgggaatcaggaatgggtgtcctaatttttgagctagtcttgctactcgatcatttggagatctgtgttcttctccactctttattttatttctgatgggctgctctgatgtcatccattgggtttgggaacatttctgaaccagattccatccttgggatcagcatggcagcaagaaattgatgtcgcctcgcgccggctgcggcacgagcccgggccggatgcggcgcctgcaaat

SEQ ID NO: 24452 - DNA, 702 bp, Triticum aestivum
  Clone ID: PAT_TA_24452
tttttttacaggaaatccgttacattaactatgtcctctgcagctactgagtgatctacttcccaacctcagcataattaaccgagtgatgcaagtgatttgagttgtgagaagcgaacctaggttggatcacgttattaacatcattccgactcagcctgtccaaagtcgtgctccatttccgttgccagcagggagactctctctagtcaagcaagtaaatttgaaaataattcctgatcccctgatctgcatggtacattgcagaatagctcaagtcgtgatttcgcacatcgtgtacaatccttctggcctaggctcggtgggatggttgtttctgtaatatatcgacctctttatcatagcattcgcttgattatttacgttagtgacaagtatgtaagaattaagaaaatagccgtcgtaaatatcctgtctctgcgttaatcttataagctcgaaaaaacgattgacaccatcataactgccttggaaggcaaccgttctattatcttcttggtcagacaatcggctgtggtaaacattaatcatcttccagcccaaataattaactggaccggataattcggatttttctgcttgattgtattcattgtaatagattttgcgaccgtcgcaattaaatcctttatgtccctcccatatatggcccgtaatgaaggcagcgaatgttgaaacgaa

SEQ ID NO: 24453 - DNA, 985 bp, Triticum aestivum
  unsure (1)..(985): unsure at all n locations
  Clone ID: PAT_TA_24453
aaacctgacatctcctaagctatnncttaattgaaagaagagcgatcaggaaactgctcgataagattactggtactgatgcaaaaaaggagcaggttcttaagtttctcctacatcttgttacaaagtatggaaagaacgtcaaaccagacactggtgagcggaatgaaaatttacaatctgaaagcaagtctttgagtccaagcttaagtcttgcaagcgatgccagtactcctgaaaagtgcgacaagccaacatacttccagggatatgagtatcagagtagcatgtctggagaaaccacaccacctacagagttctgttgcccaatatcaacaaagctaatgcatgatcctgtgataataacatctggacagacttacgaaagagaatatattgagaaatggttcagtgagggatacaacacttgtcccaagacacaaaaaaagctagaaaactttgcgatgattccaaatacttgcatgagggatctcatttgcaactggtgcagagagcatggtttcacaatctcagattttcttccaagcaaagattcctacagttatttgccagagcaattgcatggtcactctatgtcaagtttgcacaatgtttcagtacctctaattgctgggaatgccaggaattttgtgattgaccacagcagttcatctgtcgcgttttctgatgccagttatgtctcagattcctcccatgtgaaagatatggaggagccgaaggatagtttttctcagttctcttggagtgcagactatcagaagcatctgtcattccacaacttcaaccagggcatgttcctgaggttcttctgcgagctgtccaagctcccattagaaatacaaggaagctccattaaagatctgaagaacattcttcacgatgacgatgatgtttcctgggctattggcgtccatggatttgtagaagcattcctccgattcttgagaaatgacgacagcagcta

SEQ ID NO: 24454 - DNA, 583 bp, Triticum aestivum
  unsure (1)..(583): unsure at all n locations
  Clone ID: PAT_TA_24454
ggatatttggacctagtaaattttttctagcttatttagttgtgcccatcttcattatctctacccaattatctatcatgcccaatccatcacctcaatcaaatcaacaattacttaggaaagcacaatgcctgacaggcctggataatcagctcggtgaagatacggccctacttggttcagaaggcccggatacacagcctgtagttgccgatgttacagtgccaagatctgtagacgaggaaattactaaagaagagaggaagaacagaatatctggagtctggggagcgttacatgggaagacgagcaagcaacaaatcatttcgccatggttcattcttatcaccatttttactgccattcaaatgacacgggattaattattttgttgcgactatacgctctcagtacgaaattcattttaggctcctacgaaggaagcaagttacaaccagcaaattccttcgacgcaagcaactcccaactcggtgggaatccttgctaatnccctttatnggnatagtacttgccaattacaangtacaacggttggcccttacngcattaattcaatgggaag

SEQ ID NO: 24455 - DNA, 499 bp, Triticum aestivum
  Clone ID: PAT_TA_24455
gtcgttgtcattgtctactttgatcttaactatctacctactttatatcatcggtatcgagacgtcaggtggtgactattagtaatcgtgtcgtgtggatacggtctatttatcggccccgcgcatctcgcgcgctctatgggacgcatcgggtaccgggccccccctcgagtccacaggctgaaaattcatcctgaaatttagttggcagctcggtggtctatatacatattacgacctagttttgtgctgctgggtcgaaacgcgtcatcacagtgcctgttaaagaaacccgtttcgttcaagtgttgaccctcaagtgtgaatcaattacgaaggccccattattaagttaacttatcggcctaacaatctgtgatctggaattggtgtagaagaaggtggaaaaataccaccagaggattgggggggttcacaaagaaaaaaaaaaaaaaaaaaaactcgagactagttctcctcgtgccgaattcggcacgag

SEQ ID NO: 24456 - DNA, 518 bp, Triticum aestivum
  Clone ID: PAT_TA_24456
gttaaagcaaagacatgtgtatagtatgatgatgatctagttgatcgttggatgcaaatcaaacggttcaggtgaaaagcgactgaaacgggaaaaaagaatcaggaacctgagccatagatgctccctacagtcacagagattcatcttgtttatcaagaaaggacgtgctgtctgcacgtcgatacccaaaccaatcgaggtatctagttgatcacaatggcatggcggccctgaactctgggtgcaggaggcggccgatctcctcgtcgtcggcgtccagcggccgtccggtgtcgttcctgacgcgccgcacggcagtggtgcccagcgactggtgctggaacccgtagaggccgagtatctggtcatcggcgaagttgagcgcgcgctccatgccctcacggcacaccacggcatcataggtcgcgcctggctccccgcacggcttgcacccgacgaagtgcgtcaccagcggccaccggtggtcgccgagccccggccgccccgtgctccgc

SEQ ID NO: 24457 - DNA, 658 bp, Triticum aestivum
  unsure (1)..(658): unsure at all n locations
  Clone ID: PAT_TA_24457
ctcgtgccgggtgccgcacgcggccccgcatcaccaagtcccttaacaccggccgaagcaaaaccacgaaattccttcgacgtgaccatcatgcctcctaagaaagccgcgagacctgcgcaggagaacatttctctcggtccccaattgcgtgaaggggaatcaaacgtattcgctactgctcgtatctttgccagtttcaatgacacctttgttcacattaccgatttgtccggccgggaaaccatcactcgcgttactggaggcatgaaagtcaaggctgaccgcgatgaatcctcgccatacgctgccatgttggcagcccaggatgtagccacaagatgcaaggaattaggcattaatgctctccacatcaagatccgcgcgacgggaggcaatggaaccaagaccccctgggcccaggcgctcagtcggctctacgtggcccttgctcgatcaaggtatgaagattggaaggatagaagatgtgacgcccaccccgtcagactcgacccgtcgtaaaagggggtncgccgtggtcgtcgtctatgattttactgcgttgcgtatgggaatgggttagcttgggccagctgggagatgtacgcgagaatantntcatatnttaacgtagtttcatgcncaaatcccattcgaa

SEQ ID NO: 24458 - DNA, 526 bp, Triticum aestivum
  unsure (1)..(526): unsure at all n locations
  Clone ID: PAT_TA_24458
ctcgtgccgaattcggcacgagggacgacgacgaggatgatgaggacgacgatgatgaggatgacgatgatgccttcgaagaagatgatgaggacgaagatgatgagactcgtgccgaattcggcacgagggagcaccgccggttgatgctgctgacgctccagcagcaaggggggcaaggggtcccgcgcgtacacccgggggggagacttgagtggctctgatgacgctgcaagcaacagccgccggcggcactgtcactcctgccgcaagtgtggcaaacagcagtgcaggagtggcactacctatatacgtatataaattatggtgcgtactaatatatgtttgctgtctgcatgcatgcagcctcacccgtggatgccacgggtgtcgatttaaataaataatcctcctaactgtctgtaactaaatccaaagtaattttgtaactcccccatgtttgggaccatgcgccccgctcccacccctattggggcccctataccgcttnaaccttaantttcaa

SEQ ID NO: 24459 - DNA, 595 bp, Triticum aestivum
  unsure (1)..(595): unsure at all n locations
  Clone ID: PAT_TA_24459
ccacaatggncaccgaattaactgtccaatctgagcgcgccttccagaaacaacctcatattttcctaaattctaaagttaaaactaagtcgactaaggtagggaagggtggccgaagatggtacaaagatgttggtctaggattcagaacgccgaagacagcaattgaggggaattatatcgacaanaaatgcccattcacaggtttagtatcaatccgagggcgaattctgaccggaactgtcgtatcaacgaaaatgcatcgtactctcattattcgcagagaatacctccattttattcccaaatacgcgcgatacgaaaagagacacaagaacctcgccgcacatgtttctccggctttccgtgtcgaagaagggcgatcaaagttacgggtngggacagtggtcgccctctcaagcaaggactngtaagattcaatggtccccgtggtgcttccccgggctgggaaggcagtcaagcaatttaacaaattttgggcgaatattcccaaagccacgtccttatagattggtaatatagaaaactgaaataaagatcgggtctacaacaaaaaaaaaaaaaaaanaaaaaa

SEQ ID NO: 24460 - DNA, 620 bp, Triticum aestivum
  unsure (1)..(620): unsure at all n locations
  Clone ID: PAT_TA_24460
gccaaacagtggcatcagctcgcaacccctttcagctgcttatcctgattcccatcactttaaaatttcaacagacacacaaagttcgtacggcgccaaaatccaccaataaatctcctcatctctgctttgaagacgccatcatcaccctaaaatgccaacttcagaacacgacgagtcggccgcacctgagacctcagaaaatagtgatcatgttaaacatttgaatattaaagtaactgacaataacaatgaggttttcttcaagatcaaaagtacaactcccttgaagaaactaatggatgcattttgcgaaagacagggcaagtcccctgcttcagtaaggtttctccatgaaggaagtcgtgttcaaccaacaagattgcccaagaatcaataaatattgaagacggagatacgttagaaagtacatcagganacaaatccggtggcgcatcctcatccgactgngggtatgagttgcatgggtatcactcccgagtgctcgacaaagatggggtgttcaagagaaaatggatattncaataatgngcgaatcanatcgcanaatggctttnanaagtgctgttgggancgcagcatctcaagtcacttcntnn

SEQ ID NO: 24461 - DNA, 540 bp, Triticum aestivum
  unsure (1)..(540): unsure at all n locations
  Clone ID: PAT_TA_24461
gagaaaacactgatttttctacaaaagagtaacattttgtgaattgaattgaacttaaatagtcttcatagtaaattcatctgcctgttatacatcttcaggggttagctcaaggaaaaaagcctcgaatatctttgcgccgatcaattactccactcattttaaatgttaatgacacttgattcgtggaagtatcacgctttatattgacaagctgttgctttacttacaaaatattaagtcgcttgtatcatgcttccgagcggcgttgaacgatacacaattcaacccangagctcgatatttaatctcggtatgtttcgattaaaacacttgtacctaagctttgtggcccaagatcagcttttgatgccttttatcggagaagtatcgggacactttgacacatcngggtttcttttgttcctttttttggtaatgggtgcacatggttcgatggctttcacttggactgggaagtaagaagttacattttacctccncgaaaacaagggngatatgaccaatggggaacgcaat

SEQ ID NO: 24462 - DNA, 560 bp, Triticum aestivum
  Clone ID: PAT_TA_24462
ctcgtgccgaattcggcacgaggtcgatgcaacaattaatacctcgccaaccatcgtgatcatttcatactaaaagaattaagatgggaaaaggaaagccccgtggattattagcggctcgaaagctccaaacccatcgccgggatcaacgatgggccgatctctcgtacaagaagcgcgcgcttggaacggcgttcaaatcatcgccattcggaggatcatctcacgctaagggcattgtgcttgaaaaggtcggagtcgaggccaagcagccaaactcggccattcgcaagtgtgttcgggtccaattgatcaagaacggaaagaaagtgacggctttcgtgcctaacgacggttgtctcaactttgttgatgaaaacgacgaggtactactggcaggatttggacgaaagggaaagggcaagggagatattcctggagtgcggttcaaggtagtgaaggtatcaagtgtgggactatctgctctatgggaaagagaaagaagggaaaagcctagattataagcgagcaaaaaatctaaatttaagttacgaaatcaa

SEQ ID NO: 24463 - DNA, 571 bp, Triticum aestivum
  unsure (1)..(571): unsure at all n locations
  Clone ID: PAT_TA_24463
ttcatgaatatctcacattggcgaagaccgacacaaaatcgatttagttggttcttggagaaagttgctcttcaatcccaactgcagtattgcaccattcaatcttattcccattgtggaaggggacgggttaataatttatgccctaccntcgttgttgccgacaaatcaaaagatgccgtcatcattgacccccccagcccaattgaagtagcgccaattctcaaagaaaggatacaaagtattcagatatgcctcaagtctatcattaatacacacaggtaggagtgtcacctcatgcagatcatgctggcggtaatcggcgtatgctaggttaccctgagttcaagggtgtaactatcatcggaggtaagaaatgcgaaggagtgcaatggacacccgacgatcgagaagtattcaaggttggaaaaatatcagtgacagctctgtatactccatgccatacacaagatagtatctgctggtttatggaagatgaagggcaacgtgctgtcttctcaggagacactttatttcatggcggctgcgcgcgtgcngaattcggcacgag

SEQ ID NO: 24464 - DNA, 575 bp, Triticum aestivum
  Clone ID: PAT_TA_24464
gggctgcaggctcgtgccgaattcggcacgagattctgcgctgcaggaagcgtagccttccgcaaatgataattgggctttagagcgtctattccccactatattagggactcttgaaacattaacggattcgagcgtggtaatgaagttcacttgcatgatgaactcccttgaattgaggttttgttaaaagtcaaaagttttttttttgccatcctcaaaaaattgtttatgcagatatcttgttgggtcctcttgcgtcctttggttcaccagtctggaacccattcttaaacttgcgagcgacacacttaaggtatcgcatacgtccagtgccagtagtcttcctccgtttggccttctcgccccagttgtatttacgtatctttgctgatgggtatccacaagaagagcaggtatgcttttggatatgaagggaccgtcgtccacaacgtctgcacaaggtgtgtgtcttgttgtggcgctttccgaagctggaggttcccttcgtcattttcgattaggaactcgataccgtcaatgtcgaatttgtcgcgggccgtgttcggcacgag

SEQ ID NO: 24465 - DNA, 579 bp, Triticum aestivum
  unsure (1)..(579): unsure at all n locations
  Clone ID: PAT_TA_24465
ctcgtgccgaattcggcacgagccgaggcgactcgggggaaaccctaaatcgccggcgccgcacccctccttcccccctccccttccccttcgccgccgccagaggtgtgcgccggcatgcgctcgacaccgatgaaggtggcggcaggggatccggcggctccacatagcgtggagggctcggcatccggggcggcggccccgggcggagagcgccgggtggcccgggcggagacgcgcctggggcccgggcggcgggccaccacggccggagctggtgaggcgcctccctcaatctcgcgggggacgaggaggtgtcggtccacggtcgctggtgtgcggcctcccctgcgcggttgccgtcgccaagatgcatctcatcctctccgccccgatctgctccttccatcgccggattccggtcctcccgggcgtcggaacgcggatctcgtccagaagggttggttccgggggaaaacccctggccgggcgccanctcccttacnagcccggggcccttccgcctccagctcccttccctcgtcccctcttcgtccnggattctttccccctcctttg

SEQ ID NO: 24466 - DNA, 607 bp, Triticum aestivum
  unsure (1)..(607): unsure at all n locations
  Clone ID: PAT_TA_24466
ctggtgccgaattcggcacctcccgccgcgttcgccaccacctcgcgccgtgtgcggcacgcggaactatgaaggtgtaacacaagcttttgcaggtttcccgtattactccaaactagccatcacgtgtgatacatttacatttcgaaggtaattatatcatggcggtttggaattttagttgggcgttggcacgatgagttttactcccttactgatgttcttggctagctcttcaagagcaacggcgagaagtttttgttcctcgggcgatatctttccgatatcacgctcgtgcccaattccgctcgggcccgtgtcgactgcgcctccagggggggctccgcctcgctccctcgccagtgcacgctccacgtttccggcgctcacctatttctttttgtccttgggcaagccttcaacagactatcggcaaatcgagcaccagncattgccatcgaaagcgtgggcggatccactccattccttgctttgaccaactcatcaccccgtactggacacgtctaagtaaatcggatttcctaacangatctggatgagacattgagagaatagagggactatcgtagcgcaagaatgccaacaa

SEQ ID NO: 24467 - DNA, 943 bp, Triticum aestivum
  unsure (1)..(943): unsure at all n locations
  Clone ID: PAT_TA_24467
tcatgaagttctctgtctctcccgtcgttcaagagatctgtcgaagtaaagaacgcgcaagatctaccaaaacttgtcgaaggtctaaagcgtctctcaaaatctgatccatgtgtattgacattcatctctgattctggacaacatattgtcgctggtgcaggcgagttacatctggaaatctgtctgaaagacctcgaagacgaccacgctggcgtaccgttgcgaatctcagacccagttgtttccttccgtgagaccgtccgatcaacatcccgtatgactgcactatcgaaatctccaaacaagcataaccggctgtacatggtagctgagccactagctgaggaggtgtcccttgccattgaagctggtaagataacccctcgcgatgatgtcaagacccgtgcccgccttttggcgggatgactttggatgggatgttacagacgctcgcaagatttgggtgcttccggaccggataccaacggtccaaatttgttggttgatcagacaaaggctgtacaatacctaaacgaaattaaggattcagttgcatcaggatttcaatgggctatgaaagaaggaccagtcacagaagagccaatgcgatcttgtagattcaacattatggatgttacacttcacgccgacgcaattcatcgtggtggcggacagatcatcccaactgctcgtcgtgtactatatgcatctgttctattgggcagaaccggcgctgcaagaaccaagtcttcttggccgaaattcaggttcccgaaaatgctctgggaagtgtgtacagcacgctcaatatcaagaacgagggcaaggtggttcctgaagagcaacgcccgggggaacccccctaattaaaggntaaaggccaaccttccgggccttgggaacccttggggtcaacggggtnccttcctgcgaacactgg

SEQ ID NO: 24468 - DNA, 663 bp, Triticum aestivum
  unsure (1)..(663): unsure at all n locations
  Clone ID: PAT_TA_24468
ctcgtgccgaattcggcacgagctcgtgccgaattcggcacgagctctattaacactttccgctcgacccatcctttctatctgcaaaatctcccaacactatctttcttcgcttcacttctaccatcgaccaagctcctctttttacctccacaactaatctacgctgaacgctacggcgaaatttcccattcactatatcatcacaacgacagcttaacctagatagtcatcatggaagaagaagttgcagccctcgttatagacaatgggtcgggaatgtgtaaagctggtttcgctggcgatgatgctccgcgagctgttttcccatctatcgtcggtcgacctcgtcaccatggcatcatgattggaatgggccagaaagactcatacgttggagatgaagcacaatctaaacgtggtattctgactcttagatttcccatcgggcatggtgttgtcaccaactgggatgatatgggggaaaatatgggnaccacacattctacnaacgaattacgtgttgctccagagggaacatccaggtcttctcacagnaagccctatcancccaagtcgancaagagagangntgactcanattggtttcganacnttcaaggncccagccntctaagnntccaatcanggnagtnctttcct

SEQ ID NO: 24469 - DNA, 660 bp, Triticum aestivum
  unsure (1)..(660): unsure at all n locations
  Clone ID: PAT_TA_24469
cttgtagcntggagaggagttttgttgggatgctattaagtgcaaggaccggcagaaggcagatggaaacccatgttgcctgtgctgtgaaggcaccaaggaacttgagaggcgacttttttatcttcgtcaaagcgagagtctttcccgtcggcaagtatacgctgaaaaaggtagctacccaatctcgtggcccagattgtgacggccatacttaatgctacctgcctccaattcaatgcgctaaaactgagcgtcaccggcctcatttcgttcacaaaattgccagaaatacgtgcacgaagcataggaaggcagagcgagagcgcggtgacagaaagataggttatagagccagaagcatcataaaatttttcggactttgcaagaattgatgggattgctacggtagcttgaagtgcgtatgcggcccctacagctgggacgagtgtccggagaaaaggatttttgtagttggtangccttaaaggaaagaactaangaatggtcattttaactgtcgggaaggtctgatcctccgtgccgaattcngngaacgagggggggcccggtaaccnaattcgccctantngngcgtcngnattactcgcgntcnactggcctccgttttaaaaggncncaccggggaaaccctggngg

SEQ ID NO: 24470 - DNA, 881 bp, Triticum aestivum
  unsure (1)..(881): unsure at all n locations
  Clone ID: PAT_TA_24470
ctcgagttcccgagcaagagaaggagcaattgaaggtggatcacgataatgagacaccggcgcaagcttttgctcgacggcatgaagaattagctgagcaagagtctaaaaatcatgagattttcttgagtcaagaaagaacaaaaaaaaaccgggcaccaaagcaagaatcggtgaaatttgagccgaaatcaagaccctccaatcatcgtttccctagccgagatatctgggaggatacgcccgatagtttgctccttcagacaacagtcgcaggaccacaggttgagaaggatatttccaacgcacttgaagaacagcaaaatccagaactcactganaatactgaagcctaccgactgccacagttcagagacgaaaatattgatctcgctaaatcttcacaaacggtcaagccttcagtaccatttagatctacggtgccaaacctacaagatagacaggagcagtcacaggcagctattcttgggaagagtctccagaagccaacatctgggccggtccgtctccactagctatagccccaaaaccaaagccacaagtaccagagcgtcctactaaacctatctctcagggctcttcggaaagtatcccatcatccattattanttcggatagctgcctcgaaagccaaaaaccggctgctacctgcaccaatcangggggggggggaaanttgcanngacttcaaggtgggcctcatgtttacactttacacaaaaggggggggggggggttgggnaaccccaangnttcccaaaaaaagggatggaaaattatttncatgnaacaaccccggggggggtgnggganaaattaaacaancnacttttcccgattntnaaccataaagggncatg

SEQ ID NO: 24471 - DNA, 612 bp, Triticum aestivum
  unsure (1)..(612): unsure at all n locations
  Clone ID: PAT_TA_24471
ctcgtgcngaattcggcgtgtcattcattgctcacactctcgctatctcagcctccaactctaataccactcttttgttagtatttcttctaaagggtcctcttcttgttctgtacttttgtcaacatgcgatccattctctttctggccgctggcctaatctcatgcgtctctgcatccccaggcgctcaagccgacccaccccagagacgatggtgaggtttctgccaaccgggaacatcctaccatccaattagactacgcacctgtcatcggttcatcgcggcacggtatcgacaagcttccgtggaattcctttcgctcagccacctgtcgggccaactccgcctccagcgcccgcagcccattacacagaacttgggcaactggttgacgccaacggcatcttacctgccagttgccctcaacaagtcaactccaacaaaccaaatgttagctggntcctcaaggacctcctccaacgacattactcaacagtgggggncggtcaaaaggtccgtaattattatgaggggggtcccggccgggtgaantgtncaaaanncgcaatgnngctactnccggncaaagtnccnggtggggtctcggggn

SEQ ID NO: 24472 - DNA, 579 bp, Triticum aestivum
  unsure (1)..(579): unsure at all n locations
  Clone ID: PAT_TA_24472
ctcgtgccgaattcggcacgagctcgtgccgaattcggcacgagctccgccaaacgccaaaatgtccacaacgaatacatctgtcccaactgtggatcaaatcctcgtaccagagacacttctcaagaagcgtaagagtcaagagaaggctagggaggaacgtgccgctgagatcgagaccaaaaagaaggcacaaaaagaaaagcgaggcgttatattcaagcgtgcagagaaatatgtaaaagaatatcgggatatggagcgggaaaagatcagactatcccggctctcgaaacaagatggaacttacttcatccctgctgaggagaaactcgtctttgtagtgcgcataaaaggtattaacaaaattgctccaaagccacggaagattctccaacttctacgtctcctccaaataaacaacggcgtattcgtacgaatgactaaagctactctcgaaatgttaaaagttgtcgaaccatggatagcctacggatatccaaacctcaagancattagagagctaatatacaagcgcggatacgggaaagttgacaagcaacgcattgctctcactgg

SEQ ID NO: 24473 - DNA, 522 bp, Triticum aestivum
  unsure (1)..(522): unsure at all n locations
  Clone ID: PAT_TA_24473
ctgactcgcccgtcatcgataatggcaaatttaagttcaacattttgcctgggcagagggtttctctagatcttcatgctatctatcgagatcctaaaattttctccgatcctcaagaggtaaacctcaatcgtccgcttgaatcatactttgaccatggatttggaccacaacagtacgttggtcacgaccttaaccttgtcgcaagggtggcgatgacagctatgtttaagacgatctttagcctaaaaggcttacagcggttacgcgggggtggggtcgctcgcagtcgctccccgggggcgagagtcaaggtatgttaaagaaagcccagatatcaccagtccgatttgcctatatgaccccggatcaaagtagcttctgtcccttcccaaccaccatgaaaattcaatggaatattgaatagtcacttggtctaggtaataaagatttcatgtggccgaangggaagaagctaaaattaatgtttacgtacgtggaataagaggcatagtaatccgg

SEQ ID NO: 24474 - DNA, 389 bp, Triticum aestivum
  unsure (1)..(389): unsure at all n locations
  Clone ID: PAT_TA_24474
gcgcgcgtaatacngactccacttatngggcgganttgggtcccgccccccccctggtgtcttgtcttttgctttttccgaatcgcttcacaggtacgactaatagtgtgctagttattgtcctgtagcaaatggatgttattctgtgccccaaagttctacaatttcgactctttactctagatgagtttggccatgagtagaagattctagaaacttgcatcaagaatgtaaatcagtcatagtggagcatgtgaggagatgatgtcacgcaaggatgaatattccaaatgtttgaaagaaagtataaattcatgaagtttttnccaatcaagggcttctgttcagattagatactgatcaacgatgtctnccataaaaaaaaaaaa

SEQ ID NO: 24475 - DNA, 409 bp, Triticum aestivum
  Clone ID: PAT_TA_24475
ctcgtgcccccccccgcgcgcccgactcgccacgtcgcacgacttgtacgcaatggcagccgaacgcaaagagcgcagcggaatcgctgtaggcctcaacaaaggacacaaaactgaggcacgagtccccaagcctcgagttagtagaaccaagggtcacttgagcaagcggactgcatttgtgcgtgaaattgtcaaagaagtatcgggacttgccccatatgaacgaagggtaatcgaattacttcgcaacagcaaagacaaacgtgcccgcaagttggctaagaagaggctcgggacatttggccgcgcaaaggcaaaggtagacgagcttcagcgtgtaatcgccgagtcacgaagagccggtcactagagatataaaaatattgaatgaaaaattaaactataa

SEQ ID NO: 24476 - DNA, 600 bp, Triticum aestivum
  unsure (1)..(600): unsure at all n locations
  Clone ID: PAT_TA_24476
ctcgtgccgaattcggcacgagtaagtgcatcaacctaatgagagatggagggcctattctttaacgttaataatggctatattgaggggtgttgttaggggctaccgtaatgggtctcctaacgggtcagaactataccaaatttaacacaatgtgaaacgattgacgacctaaagctccagctgggaccaagtttatggggactttcttgcatcacttccgccaaatccttcaacttcgtcactcgccgccaaagcttctgataaactaaatatctgaattccgatacgtacgagcgaatgcaagtgggggtcattancaaaagtttatgggattacattgacaatatgggatacatngattagaataatggtcgcactatttaattactgggtacaacctacaccgaaaaggaggacactccgggaagctnactaagaaagatgtcatcccccttaggaatattttngaaacccggcccctgcttcgtaccgccaacaataaccagggactccncaacaagtgtactcctngaaactccancttgcgccgnacttcaanggnaacttnaggcatcaagancttggtgagccaaaann

SEQ ID NO: 24477 - DNA, 481 bp, Triticum aestivum
  unsure (1)..(481): unsure at all n locations
  Clone ID: PAT_TA_24477
ntcgtgccgaattcggcacgagctatcttcatcactttgccgtaacgatttgttcgagtcttgaagaacctaagtaagccaaaatgtcttacaacaagattgataaagagggttacggcgaggctccaaaaacacacaaaattcgtatcaccctttcatcccggaaagttcaatcgctagaaaaagtctgtcaagaattaattgatcgtgcaaagactaagggccttcgggttaaaggcccagtgcgtctcccgaccaagacactgaaagtaactacccgtaagacaccctggggtgaaggttctaagacttgggacacatttgtgatgagaatacacaaagcgtttgatcgatctcaatgccccaactgaggggtgtgaaacaaatcattattaacatcgagggctggtggttgaagtcgagggttactatagctgcctaaaccagaataaantccggtcaaccccccgaaaaaaaaaaa

SEQ ID NO: 24478 - DNA, 608 bp, Triticum aestivum
  unsure (1)..(608): unsure at all n locations
  Clone ID: PAT_TA_24478
ctcgtgccgaattcggctcgggatccaacgactccctccgcaaaacaacttatatgaaatggccgaactaacgctgaaacgtgtgcaagaactcgctgaaggccaagattgactttgaagggcaaaagctcaatgagtcgttagctacgagcctacttgttgtcgctggagttgtatcttttctatatggttacttccgtcaaggatatcatacaaacccctctacattgggttaaggaggaactgcgctcacgtttttcttgggcgttccaccatggccattctatcgatctcatccggttaaatggctaccagtcgagggttctgataagcatgtgagagactttctcccaagatgggtatggttatcaatttcaaaataagttcaacggaagggtataattccatgttgatattgaatattccacccaaaggtggcgtatttcatgtccaccgctgcacctcctgcctttggagtggtctgttggtgggtggggcgaactcgattgggtcgttgtggaagatatgtataacgcatatgatgtcgaataaaactcctgtaaatatatttaatgcactccaccttggattcactctacangngaaac

SEQ ID NO: 24479 - DNA, 591 bp, Triticum aestivum
  unsure (1)..(591): unsure at all n locations
  Clone ID: PAT_TA_24479
ttcaactacttcttcccatatttcggttcgtttcctcacgacatctcacttctccgattcgtttcactgggtgttcattccactggcgtctgcaatctcgagtggctcttttcttctattcctccttagtctccttcgtgattcctttatttcattcgcactctttcccatctctgcacatctcgtcgcccactgacgctgcttaaattttcaacaagtcacgacattgttgcgcgctgtctctccattcgcctagcatttcctcacgctttttgcctgaggaacagtaatcgcgctctaatacaatcatcgttatcatcgtaaacgcattcgcaataaatttctcatcgacgtctgccagtaatcgaggacataatttaatacttcaagccatatacgccaaggtacggtgaatatagaaggcgggtcacgtcgctcgagtcccggatatcactagcgaggataaacaactttttgagaagcttccaacggatataactgggatttaaataagcattcccggcaattcgtggtattaaggcaatcncaatggatccaaagagaatggcaaaaagngggtatcgcgcttgn

SEQ ID NO: 24480 - DNA, 500 bp, Triticum aestivum
  unsure (1)..(500): unsure at all n locations
  Clone ID: PAT_TA_24480
gggatnccgaattttgccaaggagtttttcggaattgggctttgtgcgcgcccaaggcttcgcttgcgagagtgcagcttgacactataaaaacaagcccacgatggaaggtgttgtgatccgcctcctggtgatgttctcctggtatagtttgagtagcctgggcacctactccacttgggaaggagacatctcagattacatttcgcgcggagaaaagttgatggatgacggaggcatgtctggataactcagggtttttgagacgttcccctgggtgggtattcacggatgagggttgacttggggtgaagaaaaagccaccataacttcgcagtggtacttgcaaatgaaatccgaggcatgagtgctcttcctgtaaattgagtcatctattctatacttttctttgatattgtgtcatagctagatagctgcatacgcaattaaaatctggatgcaaaaaaaaaaaaaaaaaaaacgcaagagggggcccggta

SEQ ID NO: 24481 - DNA, 600 bp, Triticum aestivum
  Clone ID: PAT_TA_24481
gcccttccccccagcagcaatgtaaaatagcggtttctcaaatcctcaacacccagaggagtgcaggcgagaaacaaatatcactccacaggagcacctgaatggagcaacaacaagctcaccgtcacctacaccagcgacagcccaagtccccatggcgactccaaatattgggccatatcaatctagagaatgaggaggggggaatccagaacctcagccgctctccagcacaagcaaacaacagcaatctaccaccgtggatgctctccaccatcagcaacagatgaaggctggcgacagcctcatatgactccacctgaaggcgagaatggcgtattgtttccacgtttcggttccatttttttcctgtactataagatacagcgtcttgtttccacgttccggttccatttttttctcctatcgatgagcacgatcttgtggttggagttaagtgtgtaagctttaatggacttgcggtatgtttttacttgttgtgacggtttttgtattccatccgttgtaaaaaagcaaaagggcgctgccttctctttacattgttattaaaaaaaagagtagggcactaaacttttcgcc

SEQ ID NO: 24482 - DNA, 1060 bp, Triticum aestivum
  Clone ID: PAT_TA_24482
ccacgcggcacgagcactcgcttaccctagcttcaacgccagcgcgcagctccccttccctctgttcgccgatgcggctcactccccacacgagcactcgcttaccctagcttcaacgccagcgcgctcctccgcttccctttgttcgacgatggcgtccacaccgccgccggtaatcggcaaggcgggaaacctcactgtcttcatcacgcccccggccacgccgccgccagtggataccccgacctctcgttcggccgagtcgccaggatctgagttttccacccccaattccactccccgttcggtggcgtctcctgcgtccccgccgccagagcatatagccacatcgcctccgccggccaagatggtctcgccgcctccgccggtcaagacggtctccccgccactgccgccagccaagctgttccaggcctcgccagtgcaggtgcctccgccgcagttcgagaaggcagaggctaggacggatggatcggcgttcggattcttctgggacgcggttttgcgcgtgcaagaagcgcacgcaagcttggatgagtacatttcgaattggatcgggctggatcaatccaagtaccagtgggcgctcaacgacaattacgagagcaccggaaaggagatggattcgggcaaggctgccaagacaacggagcttagtggtaagatacagaaagtgtagtgatatatatttacgcgcttgtcggtagccaagctgctatgtgtaaagttggatttggaagtgcatggaagcatgaaggtcgttgcctcttttgctacaactagcaggatcaatctgcccgtgtcaaggtatcaagtcagtcgaattaacgagtgtaagcaatttatttgcttcctaaattgtagtcctataatccttttctgtttgtatcggcaatggcaagcattgatctgttagaatgtttgcttgtgcagttcatagggtgtcaattttaatctgcattatccatgtcacatttgaccgacatttgtgttgtatccgtgcaaaaaaaaggttatctatcaaaaaaaaaaaaaaaaa

SEQ ID NO: 24483 - DNA, 518 bp, Triticum aestivum
  unsure (1)..(518): unsure at all n locations
  Clone ID: PAT_TA_24483
cctcacgcagctatggcggccggcagcgtcggcgtctccaagagcaatgacggaggcggcggcggaagggtcaccatgttcgtggtgctgtcgtgcatcaccgccggcatgggtggcgccatcttcggctacgacatcgggatcgctggcggggtgtcttccatggagccgttcctccgcaagttcttcccggaggtgtaccggcggatgaagggcgactcccatgtcaagcaactactgcaagttcgacagccaagctgctcaccgccttcacctcctcggctctacgtcgccggcctgctcaccaccttcctggcctccggcggtcaacggcccgtcctgggccgccgcccgtccatgctcctttggcggtgccgctttcctcgccggcgncggcggtcggaggggcgcccctgaacgcctacatggccatcctgggggcgcgtgctcctccggggtcgggctgggcttcccgaaccaaggccgtggcgctccacctgtctgagatggcgccnccg

SEQ ID NO: 24484 - DNA, 843 bp, Triticum aestivum
  Clone ID: PAT_TA_24484
ctcgtgccgagctcgcactcagtccagtcagtcattcattcagtcttttcctcacttttttgacggtctcctcgaacactaaattcaactattcgtctctttttagtaacctctcggaataatcaccactcaccgctaccatgcattcctctgttctaaccttcattactcttcttatcaccagctctgtctcggctttttcgattcccagcttctctaacgtggagcggagacatgagacacaaagcgtggtcccatttgccatttatattcagcaaagtcttggggaaccagaggtaccaatcactagccaacgccatagatttcagtgtgaaaaaaagtcatacagcggagtcaaggttcaggatgcgttgcaaagaggctgcagagtgttcaaggagaataaacaacgcaggagtttcccccagcaagttcactgccttcaaataccaaggcatgactacccttaacgagtgggcctttgcaatggacccacagttaccaaatatttttcccgggcaaaagacgagttatctttgacaatgaatgtaaattagctggattagtggttcgtgaaaaggatggtacctacaaaccctgcacacctataaacgcatgagctgcgacaacggcttccatgaaagagtaggtaactagcgttaaccttcggatacaagtaagtacgccttgggaaggaatagaaggtcaaggggtgtcggaacgagatgcaaaaagaagttctatttgagagattcccgggctgaagtatctcagttcagagtatgccacgttagctagctccaattagtaaatcaggatctgctcaagctgaaatccctcaaa

SEQ ID NO: 24485 - DNA, 644 bp, Triticum aestivum
  Clone ID: PAT_TA_24485
gccgccgccacctctccctctctcctccggctctggatttagattcgccacccaccggcgccctcacatctcgccgcccatatcccccaagccaccatcctcccaccctctctgtctccccctccctcccctcctctcctcagagaggagagggagatcgaccaaccatggcggcggccatggtggcagccagatctgggatggtcgcaggcacctctccctcctcacaaaggctacgggatttaccggtatgggacaggagcactgtttcctcccgttgcttctgctcggccgcgcgtgaggagatcccatggacgccaatgtcaagctccgctgctctgacccccatccaggtctgcccccttctctgttcccctcttcgatctgcccttcttccaattccttctccgaggcatgcattttctcttggttttcttcctcacacaggcacctgcaccagcaactctatgcagggagaggagtgagggcgctgcagggagaaaaatgaagaacgggatgcacctgaggagagaggggatggtgagaggagaaggaaggtgctacaagtgccaggagaaggggtcggatgcaactgaaaccctggctgtgagagtctctgtatagaccaagcacctacgggtgaa

SEQ ID NO: 24486 - DNA, 599 bp, Triticum aestivum
  unsure (1)..(599): unsure at all n locations
  Clone ID: PAT_TA_24486
tcgcggccgcgtcgacctcgtggaaccactccaccaccaccaggtccgtccgctccgctccgctggcgacggagattcgcgcctcggttgctcctcctcttcctcctcgcccccttccgcccgcgcaagcttcagccgagttcccagccccagccgcctccgatctctcatcatcgctcccagaccccgccgccggcggatctgctccggcgatgggggagcagccgcagcagcaggagccgctcctcgaggtagaacaatgtgtcacgtccataccggaagatcatgaagccacttgctggggctgcggtcttcggcttgttttttcaagttattcacctgtctataagtgtggctggtgtggagcagtcacccaaggcaaccaaacttcaagaaaacctgacagcgtatgcttttctcactggaggcgtttccgggatgggttctttgtgattgtgctcgtcctcttcctcctcgcccccttccgcggccgcgtccggcgcccgggttcccttccgcgcccacgcggccgtcttctggggnatctttcactgnacagtcaacagtctcttaaccaaaatttacaaattgaagttagn

SEQ ID NO: 24487 - DNA, 436 bp, Triticum aestivum
  unsure (1)..(436): unsure at all n locations
  Clone ID: PAT_TA_24487
tttttttttttgaattacagaaaacttatttctagagagctattttgttttcaagacgtcgtattactttatagctcgacaccgcgaaaccgagtctttcccatcatcaccattgatatctctcctgagtattgtaatatcactctagcctaactcagccttcccacatctttctgccaggttgacaatattattgagggttaaaaattagnacatgtatcccacatatttgtcgctgtgggcagcctctagcagttgaatgggttgtccagggtttaantcgcaagtttgatttttttatatcgggacggacctttgttgtggatcggaaatcgagataagtcaatttttaatatgcgatcttaatcctggccgagacatgtccgtcctcgcatattgataatggaaagtcggcaaatttacaaaaagggggggg

SEQ ID NO: 24488 - DNA, 703 bp, Triticum aestivum
  Clone ID: PAT_TA_24488
gccggccgggctgcgaacaatcctcccaccttcaatctcattcccccccccccccccacacacacaccacagcacctctccccgccgaagcgtccgcatccgcatccatggccccgaaggcagccgagaagaagccggtggagaagaccccggcgggcaagaagcccaaggcggagaagaaggtgccggcgtccaaggagggcggggacaagaagggcaagaagaaggccaagaagagcgtggagacctacaagatctacatcttcaaggtgctgaagcaggtgcacccggacatcggcatctcctccaaggccatgtccatcatgaactccttcatcaacgacatcttcgagaagctggccggcgagtccgccaagctggcgcgctacaacaagaagcccaccatcacgtcccgggagatccagacctccgtccgcctcgtcctccccggcgagctcgccaagcacgccgtctccgagggcaccaaggccgtcaccaagttcacctccgcctgattccgccgtccacgtgtcttctttgatgtatccatcgatcgatgttgttgctctgtagtagttagctgctcgtgctctgtcgtgttgtaacttgtgctggttgtgtgggatcacatttcatgatccggagaaatagtaacagtgcttatttcagttcttgccaaaaaaaaaaaaaaaaaaggccccta

SEQ ID NO: 24489 - DNA, 685 bp, Triticum aestivum
  Clone ID: PAT_TA_24489
cggccgctcgagccggccgggtccgggacattccccccaccttcgagcgaagccgcgcacagcacaccagagcacctctccccgttgcagcagcagcagcagcatccatggcgcccaaggctgccgagaagaagccggtggagaagacccccgcgggcaagaagcccaaggcggagaagaaggtgccggcgtccaaggagggcggcgagaagaaggggaagaagaagtccaagaagagcgtagagacgtacaagatctacatcttcaaggtgctgaagcaggtgcacccggacatcgggatctcctccaaggccatgtccatcatgaactccttcatcaacgacatcttcgagaagctcgccggcgagtccgccaagctggcgcggtacaacaagaagcccaccatcacatcccgggagatccagacctccgtccgcctcgtcctccccggcgagctcgccaagcacgccgtctccgagggcaccaaggctgtcaccaagttcacctccgcctaatttggcacgtcgtccgtgtgtcttctctggtggatggatcgatgtcaccctgtagtttcctgttcggactctgtcctcttgtaacttgtgctggttgtgtgggatcatatttcatgatccggagaaatagtaatttcagttcttgataaaaaaaaaaaaaaaggccccta

SEQ ID NO: 24490 - DNA, 908 bp, Triticum aestivum
  Clone ID: PAT_TA_24490
cccggcgggagcccgagaccgacccgcccccacaccctcatccacacgcacccccccccagcacacccacccccactccccgccccccgcttcccgcagcaccgagcccaactccatgggcggcccaggggggaccgaaaaggaaggcggtgaagaagaccccgggggggaaggaagcccaaggcggagaagaaggtgccggcgtccaaggagggcggcgagaagaagaggaagaagaaggccaccaagaacatagtgacgaagaagaagatccacgtccacgcggtgatggagctggccccccaggacatgcccatctctcccccaatcatctaccacatatactctctcatagccggcatgtccgcgaagctggcgcgggcgatccggcaagccggccgcactacacaagaaagccacccatccctccccgcggatccccccccccggcccgccccgtcctccccggcgagctggcccaaccgccccccccagcgagaaccacgccgcgtcatcacgttcacctccgcctgcttcgttcgcggtcccgcgtgtgtttctttggtggtttggttggctgtcgttctgtcgttttctggtcttactttctcgttcttttagtttgtgttgtatgttgtgttgtgtgtgaggcatctcacttcatcttcagaaaaaatagtaacagcttatatcacagttttgccaaaaaaaaaaaaatgctactttgtcttggttcgatctgtggtgcaagctcgcttttctctgtaaatctctgtggacgacgactgtgaacctgccgaggtgttttcccggttcaattctgaaaaaaaaaaaaaaaaaaaaacccgatgggggggcccgtccccaatttcccctataggaagttgtattataattcactggccccg

SEQ ID NO: 24491 - DNA, 717 bp, Triticum aestivum
  unsure (1)..(717): unsure at all n locations
  Clone ID: PAT_TA_24491
cctaattgtaaaaatcatacgaattttcaccaatatcaccttgatactcatcaacangatccatcagccgtgngaaaacaagggccaaatctcaccaagcgaatatccacttcacccgggaggtcaaagccataaaattgtgtgtcgttgaaaagtatcaaacatctcacaagtcacttgtggcaataagtccaagtttcgttgccgggaaaagaanatcctcgnaaaatganagtttcttgttacaagccttctaccgtccgcattaagttgcctttttctcctaggtgcctgctgcgcccttggagagaatgtttttttattgtccaagatattggattgtatgtcggtagaagtagctgccagtttcgcaagtcaagctgttccggatcaaatatatcagagcgaccctgtatcccgaggtgatgtagtacttgaggcatatcattttagcaggacaaatgcgaataacgaacctggttactacttaatccaagttgttaatgaacatcgagtgcttgtactgtggaaatatctccaaaaaaaatggagcccatgtcctctacttataaacgaaccttgattatgtggcataaatggtccgcaatgaggcagtatttggtgttggaaattcgcgcagaacacttgatgaaatagattcatgacatttttccaaagaaatttctagataacaatactctcatccactgctcaaaa

SEQ ID NO: 24492 - DNA, 979 bp, Triticum aestivum
  Clone ID: PAT_TA_24492
accggtccggaatttcccggtcgacccacgcgtccggattctcttagagaagtaattggtgcagtccttaagcagttgggatcatcatataacacgattgacatggaaacagaagtcaatggtggtagggaagcagtcctaagcagctttacacagctacaaaagcaggtccagctatttgacagcatgaactatctgaaatcatttggagttggggatgtttgggtcacagtgggttggagcagcgatgtcatccctgctgcaaagcgaatgtccaatgtcgctgttgttgttcccaagtcaggcagtagcctctgggctgatttatgggccgtaccttgtgcgacaaggtttcagactgatcgaatcgggggcagaactagaggcccatctccactcatccaccagtggttcgacttctgtctgcagagtgccagaagcttgccctttcgccaggaaattatcccaggagcatcgccgctgttccttgagaacccagctccagaggttctgcaagatcgaaacaagaagaagccaaagctggagagtaaccttctcaggggagtgcctccccctgaaatcctggaaaaatgtgagttcttagaacctctatcggacaaagcggtgggtgactaccagtggttgatgtcgagagtgcacagaccacgcggcggtctgcttggcaccatgctgcaaaagatatcaaccatgctagacttaaaatcgagattttagagcacacacctatcgatacgaagtttatcagtcatcagtattttttcgagctgaccagtgaccactaacaaaccaatagttcaaaccatgcataggatccactttttacagtcccacttctaaaaacctctctttggagatttaatgtaatactgactctgagattcggacgaaaaatgctgcggatcatctctgaaactttcttggttggtaaaggaacaaggtaccacttgttgagcccccc

SEQ ID NO: 24493 - DNA, 789 bp, Triticum aestivum
  unsure (1)..(789): unsure at all n locations
  Clone ID: PAT_TA_24493
ttggacccccggagaagggacttgcagttnttncagcacttgnggaanngtcggcnttcacgtgtgnggaggactcccatgtccaggacgnccttggaggatgaggatcgccgcgagcttggtgcccttcatggtcgcttgatgaacttttcgtcccgtgccctctccgcccccgggcgccccgcgccgccccaggaattattcacgatggcacaccactcaagtcaagtttctgctgatttaatctgggagatcgttcgtccccaaaactcgttcctagttaagcgcgcatccagtggaggtattcagttttctcgtgatcctctcaatttaaagaacgttcattctcggaaatacgcaggatttgtcaatgacaaggctgtcgggattttaccggctgaaggagacaaagggggcgtaactttagtcaccaaaaagcccaaacactcgcagaaaccagcgagtgccttatcaaagacaacttttgggggccataaatctacaagaaagacatacaaaggtgttgtgaataccaccgtcaaattcggctacagatctgacctcaaagttgaggctattgctcgcgcatctgctctacgccaagctcagaaacctaagaaaaatgctccaaaggcaaaagctacgtggcgcaaagggctttggaagcaaagttattggttaaaagacgagtaaccaccggagtaaataataactgccttacaaaggttaaaaaattctataataaacccctnacactggnngcaaattttggacccttcncccaccccc

SEQ ID NO: 24494 - DNA, 2379 bp, Triticum aestivum
  unsure (1)..(2379): unsure at all n locations
  Clone ID: PAT_TA_24494
aattcggcacgaggncttctctctcctgactgcccagctaccgccgcccccctccctcccctctgtcctcgagcttcgccttggatcgcagcgcagcgcagcgcagctggactcctcccctcggccgcgtcccccctcgtcctgcgcgcgcgtgagcgaacatctcaaatggacttttttactgagtatggtgagggaaacagatacaagatagaagaggttataggaaaagggagttacggcgtggtctgctctgctttggatactcacaccggtgagaaagttgctatcaagaagataaacgacatctttgaacatgtgtctgatgcgacacggatactccgcgagatcaagttgcttaggctcctaagacatcccgatatcgtggaaataaaacatattctacttcctccgtcgaggagagagttcaaggatatatacgttgttttcgaactcatggagtctgatttgcaccaagttataaaggcgaatgatgacttgactccagaacattatcagtttttcttgtatcagttgctccgaggattgaaatacatacatacagcaaatgtatttcatcgagatctcaaaccaaagaatatcttggctaatgctgattgtaagctcaaaatatgtgacttcggtcttgcaagggtagctataagtgatactccaaccgcaatattttggacggattatatcgcaacaaggtggtaccgagcacctgagctatgtggatcttttttctccaagtacacaccagcaatagatatatggagtattggatgtatatttgcggaacttctaactggcaaacctctttttcctgggaaaaatgtggtgcgtcaacttgatataatcacagatctcctgggaacgcctgctccagaaacaattgctacgattccaaatgagaaggccaggcgctacttgagcagtatgaggcggaaaaagcctgtaccgttcacgcataagtttccaaatgcagatccacttgcattaaatttgttagagagaatgctagcatttgatccaaaagacaggccaagtgctgaagaggctcttgctgatctttatttcaagaacattgctagtgtggatagggagccttctgcacagcccattactaagctcgagtttgagtttgagagacgaagaattacgaaggacgacataagggaactcatatacagagaaattctggaatatcatccaaacatgctgagggaattccttgagggggcagagccaactaatttcatgtacccaagtgcagtagatcatttcaaaaagcaattcacattccttgaagagcattatgcaaagggatcaacagcagcaccgcctgagaggcaacataattcattaccaaggccgagtgttatctattcggataaccggccacagggttcagatagccgaccacagggtgctgccaacattacggatgatctttccaggtgtataatcagagataatgcacaaaagccacgcagagatcctgcttcagttggtgcaaacagagttcctcaaggtgctgctgtcgcaaggcctggtaaagtggttggttcggcacttcgttatggtaactgttcaacatctggtactgagcaatatgaacagcgaagggtcatcacaagccaaggaattgttccaaacggtgttccttcaggcagctcataccctagaagaaataacacctgcaagagtgaaacaggtgaagctgaaaggatcgacgtgagccaagctgggccaccaaagccatataccggaaataaactacctgcaaccgtggatggccgcaacgggcactggtagactgctgtggcaatgccagaaaatccttgtcactggatcaggaagggtttactcattccaaggacacaccttcaaacatgccattctgtacagagttatattatctgtcacgcttacatctcccggagacgataaaactgtatgcgaagtctttgcggcaggctagtctcctgttaagctcaactctggtctggttacctgcaattgggtagatccagttcaactgttcaacaagtataaccaaaaaactggaaactttgagcggcattcgcgacaaaggactgttactgacctgactgatggtgttcctcaattcgtttctccaagctggtggccctgagggaggttcagagagcccactgtacactatctaatgttgtaacacggagttaattaattgactttaaagtatgttcttgttgcttgtagtcttgtcatccagctgtagtattgaactattgaacactgctatttctgataacacattatttggaccctgctcgctattgagtgccgaatttataatgatgtatgcagtaatcaagtagcccgnagtaaaaa

SEQ ID NO: 24495 - DNA, 614 bp, Triticum aestivum
  unsure (1)..(614): unsure at all n locations
  Clone ID: PAT_TA_24495
ctcgtgccgaattcggcacgagccgcatcctcttcactcttgccatcataaatactgtcttcgaaaagtaacgaaaaaagtccacaatcaaggctcatttaatcttgcgatccttctccgccgagaccaggtcttcatatcagcagctagctgtttagagttctaattttgattccaaacgtacgacactttcgaaatgaagtttctcagctctgctacaaccgcagcgatggccggtctcttacttctggtatctgccgcgaacggagaaggattttacgagtgttataataaagaaaaattttacctttcagaagtaatcgtaaaagcaagtatatgctactgttgggaaatcaggaaccatagaacctcatgttcctttgagtgcgactcgtatttcacatgaattcgaagttaagaaagaagggaaagattaagaatgggaattagttcaatattgcgaggtatccaaaaaataccacttggttaaattgggtggggcaaactggggaacaagtcaattccaccaaagagtacaaggccccganattcctgtcaagttttnaatggaaanaaatttttgatgggaaggtgagangggngnttcttccaan

SEQ ID NO: 24496 - DNA, 616 bp, Triticum aestivum
  unsure (1)..(616): unsure at all n locations
  Clone ID: PAT_TA_24496
ccccggccgtcgtccgcaccaccgccgcccctcctccccccgcccccgccccctccgctcccccgccgcccatcccccccccgcccccgccctcccccacctccctccccgcggcccctcgccgccccccccgtgccccccgggccgccccggcgcgccgcgccgcgccccgcctcctgccccggccccggctgcccgcccggccgggcgccctcccccgccccggcgccggcctcctcccccgccttcacgcccgccccgccccggggccccgccgcccccccggcgcctcggccgccccggccctgcactccgcccgcctcctgcgcgtcctgcccccgccggcggcagtctgcccggggcaaggccggtcggtgcgtgcgggtggggcgggtggcgtggcgaaggctccgtctcgtcccggcggctggaatccgggagcagcccctggcgggtcgtccccatgtggcggtcggcctggggcgttcttggggccgtgcccgttattggcgcccccaatgtgggagatgcgtcaaaattacttnnnggtgtatcattgcacacaatcgccgatatgcgtgatgcagcagaatccatttacaaatttggtccannn

SEQ ID NO: 24497 - DNA, 2068 bp, Triticum aestivum
  unsure (1)..(2068): unsure at all n locations
  Clone ID: PAT_TA_24497
gcaagagcagttccagtctgactccagttcaaggaatctttgttgaagaggatgtcggcaagcaaaggcgcaagtactggaaaagtaacaacaaaggatacggggctacacaaactggtattcaaggttttgcttgacggtactgaagtaacctactttgttgatgggaagaaaataatcgatggatacatcaaggatcaaagaatctactgtaaccattgcaacaaagtggtcagcccctcagcgttcgaagctcatgctggtgagggatcaagacgcaaaccgtatgacaacatctatacgtcaaatggggtatccctgcatgagttgtcgatgagtatatcaaaagacatgcaattgtcggagcgtgaaaccgatgatctgtgcagagaatgtggtctaggaggggatattttcccttgcaaaatgtgtccaaggtcatttcacccagcttgcgttgggctgcctggagttccctcggaggagtggttttgtgataactgcaccatcctcgttcagaaagaaaagctttagcagcaaataagaatgccaaggctgctgggaggcaggccggagtcgattctattgagcagattttgaagagggctattagaatcgtcccaatctgtgatgaccttggaggatgcgccttatgcaagaaaaaggattttaacaattcagtatttgatgagcgcactgtgatactctgtgatcaatgcgagaaagaataccatgtaggatgtttgaggagtgaatggcaggtcgacctgaaggaattaccagaaggggagtggttctgttgtgatagttgctctgagatacgctcctctttggacaagatgatttctgaaggagctcagcctttgtcggagtcagaccttgatatcataagaaaaaagcacgagtcaaaaggtttgatcatggacaccaatacagagatcagatggcaattggttgctgggtagaagtgccactgaagatggcaactcattgctttcttctgctgtcccagttattcatcaatcttttgatccaatcatcgaagcccatactggtagggatctaattcctgagatggtccacgggaggagacctaaggaaggaatgccaaggccaagattacagtgggatgtactgtgcggtcctaactgtaggttctactgtcgtgtcggcagcacttttgcctgtcatgggaggtgacgtggccgaactgccactggttgctacaagtatggtccctcgggcgcggggctccttccaagtgttgttctcatgcatcgaaaggctgctagtttcgctgaaggtgaagcacttcatgcttccggccgcccatgaagccgaagccatctggatgaagaagtttggcttctctaaaatccctcaggatcagatggaagcttatcttgtcgggcccctcctcaccgtattccatggaaccttgaacctgtacaaggccgttccattgcctgaatcttagcatggatgccgaagccgccctttgcttaaaatggagatatgctcatcggacatgtttgtcatttgaggctctgctggtaactgtacataataagatgatgaagcatggcgaaaaagatgatgatataattacttcaaatctaaaagagggggagcatacaagaaagatagcagaaacaaccggaaatgtttgatcctgtggtgaagatagatatggagaagctggaacaggggaagcggttgttctcttccggattttattttccgttttgtacttttagtagggcgttcagctgagccgccatgtcgaggagcaagcgctgtcgtttttcgacgtacatgcctggccgtctcaggaactgcggaatgggattttgtggcgataggtgtgatgttgtcttgttgggctgcgggtggttgaaattttgatcccttcattggtggggtggcgcgtttgtaagtaagagttggtctggttgtcgaattttgatgagaaatgaggagagatgtgggggttggataaattggttggttggttggttgtaccttacctgatggattatcaccttgagaattttaccttcnactcatg

SEQ ID NO: 24498 - DNA, 1140 bp, Triticum aestivum
  Clone ID: PAT_TA_24498
cccgccgcgcgcgccggccgcgcctcggtgccgaaatccgaaccccgccgccgccgccgccgccgcctccgccctcctcctccgtcagcctcgccgcggagcagcgcgtcgttggcggcggaggccgtgtaaacccataaagttctgttttaagcgcacattgaattttatggacatatctgaggagcaacaacaagattttggtgtgctactaaagcagggggctgaaggaagggtatttgtttctacatttgttggacgaaaatgcgtaatcaaagagcgcttttcaaagaagtatcgacacccattgctggactcaaagctgactctaaaacgcttaaatgctgaagctagatgcatgacaaaagcaagacggcttggtgttcctacaccagttctgtatgctgtggaccctcttccacatacattaacctttgagtttgtggatggcttgtgcgtcaaagatattcttcttggatttgggtcaaatgggataaatgaagaacgtcttaatgatattgccacacagataggtaatgcagttggcaaactacacgatggaggtcttgttcatggtgatttgacaacttcaaatatgatgatcaagaacagcaccaatcaactggttcttattgattttggtctgagctttacatcaactattcccgaggacaaggcagtggacctatatgttcttgagagagccttgatttccatgcattcttcatgtggggatgtgatggagaagatccttgcagcgtaccgaaaagcttcaaggcagtggtgtgccactacgaacaagctagctcaagtcaggcagcggggcagaaaacgaacaatggttgggtaaaacttgacccggagttgctgaatgcgacgaattgaacctgcattaccatccattgtgtgtgttagtttgcatgtagcggttcagcggaattggctcttgcagaattgaaatggatgtcaacgtgtcaagtgaatcatttgtaacactgcttgttgtacttccgttaggaatcatatatctcccaactctttaacttgtgagttttggatgatcgttgtgcatcttagtgaacctatacatttactttgttgcggtgcatctggtgaaatgtgaattgatgtaatttattg

SEQ ID NO: 24499 - DNA, 567 bp, Triticum aestivum
  unsure (1)..(567): unsure at all n locations
  Clone ID: PAT_TA_24499
gtgccgaatttcggnacgagcttttccttaccantatcatcacaacaataaatcaacgtccgcgggtaacatcgcccttctgggtttgatatttcacaaacgaaggccaaataattagatctcctattttgaatcacgcagtcacaaaaatttcacgatggggatacgaagattctgtttatctcgcaaagcttgctgagcaagccgagcgatatgaggaaatggtagagaacatgaagcaggtagcttccgaaggaccaagagctttcagtcgaagaaaggaacctactctctgtggcatacaaaaacgttatcggtgcccgtcgtgcnttcatggagaattgtcacatctattggacagaaaagagggatcctaagggaaactcctcctcaagggtggtctggattaaagattaccgtcaggagatcgagggaaaacttgccaagatttgcgaggatattctccaagttctcaacaaacatctgattccatctgcaaaaagtgggngaatccaanggtttttatcacaaaatgaagggagantnncaacggtatccttgcaaaaa

SEQ ID NO: 24500 - DNA, 536 bp, Triticum aestivum
  unsure (1)..(536): unsure at all n locations
  Clone ID: PAT_TA_24500
gaatggnagggggtangtatngggctttgtgtttggaggggtcgatgtccgcgagtgttcccggtcaactggccccgtattaggtgggccacgcggccccgctcgcgcgtggggttgttacgactcctggtcccctgccgtgttatttaccagtcgatttactncaagtgaanccccataccccacccntacccatccacaccataacatcatgaaggagatacacaaactactgaaaagccatcacggtttaatattcttgacttgcttgcttatttggcttggtcttcttggggagaagattttggtgaatattaggtaagacacctccttgagcaattgttacgtgtccaagtagcttgttcagttcttcatcgttcctaatagcgagctgaagatgacgtggtattattcttggccttcctgttgtccgcgggcgcgcgccgccttccccacgcgagaatttccggcancnagatantccnagaactgctggcaaagttanancgggagnaacaagctccgactccgtgccc

SEQ ID NO: 24501 - DNA, 551 bp, Triticum aestivum
  unsure (1)..(551): unsure at all n locations
  Clone ID: PAT_TA_24501
ctcgtgccgaattcggcacgagacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaagcgagatgaagcagcgtcatccgtgcctatgcgtgtgtgtgtgggcaacaatgcttataccagtatgtcgtctcttcgtcgctgtgttttctctctccagaaaaaggtgggggtgcttgttgtcanctatccggg

SEQ ID NO: 24502 - DNA, 581 bp, Triticum aestivum
  Clone ID: PAT_TA_24502
cggccgcgtgggtgcccactcccatgtctgagaaagcccaagtgactctctcaatgatgccgaaacatcttccgaaggcacctctgcagcagctgccgctataaggaacgaggcaaatagccatcccaatcatcccaggttatttatccgggaccgaacgactgattggtattataaccccgacgaggaagagaaccacactgacgaggaagagagctagctgtcagggaactgttatatcatgacattccactcgactaccaatgcaagaggggatcttctattgactgcaagcacgtgattggaatgctgtggcggatcacgttctcctttcgactttcaggcgggagcacgcgtgtggaggctcaaataaaggtgtccaagaagaagtggtgttggttgctttgctgcatggtactatttggttttcagtgaatcttgtatccagtttatttgcgttgattactattgttaagaatcaattaagttaccgttgttgtgtatgtactcaagcactttgtgtgtaccaacttaattttgatgtaccatgcattcagttaagctgagacagattggttgaa

SEQ ID NO: 24503 - DNA, 625 bp, Triticum aestivum
  unsure (1)..(625): unsure at all n locations
  Clone ID: PAT_TA_24503
cgccgttgctgcctttctgttagactctgctacatctgaaagatatggttatatgtgtcgtcctgatacgcaacaatttattatgtttgatcaggaatcagcccagcaaactttaacggaatattgcccctcgtgccggagtccgcccgacagagaattgaatgacaacactagaaacaatcgcagtcctgcctactttgaccaagttgtcaagctcggatattccgaatattcaatagtggtgagggttccaggcccacacggtctcggaacaggattcatcatcacggacaggaattgtgcctttcgtactatgctctacatgtttacaagaggcctacgaagatgttattatggagctcttgataattttctttaccaagatggtaaaggaaccggaatacgctcctgtggagattgataatccacacaacgaacccgggtgcaaggttccttatggtgtgggtcacactcctagctccaagtttgatgaagaaagatgataaaattgggatgatgcagtttgcccacactgagagggtagatataaattttcgggattgcacatatattcaatggctcaaatatgcccgtgtcctcagtaaagatagcagctntcgttaan

SEQ ID NO: 24504 - DNA, 605 bp, Triticum aestivum
  unsure (1)..(605): unsure at all n locations
  Clone ID: PAT_TA_24504
ctcctatgcaaacagngataagaattttcagncatattcatatcgtgctggctaaaaaancctgaccgataggtaantgacgttcanacaacctcgtgccgtctgccccgcttcgcttttacttattatacatcgatatgcgaatccaaattagcaggtccccagggagcttcaatagcttctctctcagataaatcaactgttggcaatctgattgaaatcatcaccgaccaaacgacaaatcaatgatttcgaggtcagatttggataccctcttaggacccttgatttattgcaatttgacagttctctccctttacttcaattaagtgtcgagctagatggagagcaagctaattatcaagcactcgagnaatcaacaaggagtgatgagaacatccacaggccgattattccaacccccagggaatcaactgctccantcgaacaaggccgaaaagatcactaactctacacaatcaactgtatcaaaattccaagggnaaaagtagataaatttacgtccatcaggcaaaagggaattgagggcgattctcccagaaaatccctatacctgaaagangggctacattggttctccgtat

SEQ ID NO: 24505 - DNA, 656 bp, Triticum aestivum
  unsure (1)..(656): unsure at all n locations
  Clone ID: PAT_TA_24505
ctcgtgccgaattcggcacgagctcgtgccgaattcggcacgaggttacaaccaacaccctcactatttacatcaaagtccatcacttcgttccacaacaaccgaattctatagatacacacaggctgtgattatggctctcaaaagaattttaaaagaacttcaagacctgggcaaagaccccccctcatcgtgctccgctggtccctccggggaagatatgttccgatggactgccacaattatgggtccctcagaatcaccatactctggaggcgtcttctttttatccattcatttcccaactgattacccattcaagccgccaaaggttaactttacaacacgtatttaccatcccaacataaattccaatggctctatctgtctagatattttacgtgaccagtggtctccggcattgactatctccaaagtacttttatctatctgttccatgctgaccgacccgaatcctgatgatcctcctgtacctgaaatccgcccatgtctacaagccggatagaagtcggttatgaagtctacagcgcgggagtggactcnggaatatgctgtctaaaaaanttatnaacccaattgggggcaaatccaantttcnanccccgggtggcctttgggttaaaaaagtaagggaa

SEQ ID NO: 24506 - DNA, 582 bp, Triticum aestivum
  Clone ID: PAT_TA_24506
tttttttttaaccaaaaatgacgatttactatctaaggaataaatatagtagatatccctcccccgcatttccaaccatcaaatttacattatccttgttcagatctactgttggtaagattgccctatgtcttattgcactcttgtcaacatacagcttcccttctccatatctttttttggatccgacaactaagaaatccagatccttattttttaatccagcaatgtacttggtagacactcagattttattgattttgtgtgaatatttatgcggtaataatctcccaccctggcgcttttgtctatctttactcaggtatttattccccgtagacctgacatcttcttctttgaaattttgttctccctcacacacaaacgtaagggagtcgacaaaggctgggagccaagaagactcaaaaagacaatcattgacggagaataaacaaatttcatttcgtgactttttcctggggggtgtagtatttgtcactttcgagcgagagaaggtggcttctatgcccaggagttttgcttcgatggcgagcagcttggccggagatgaatgagcacagg

SEQ ID NO: 24507 - DNA, 628 bp, Triticum aestivum
  unsure (1)..(628): unsure at all n locations
  Clone ID: PAT_TA_24507
ctcgtgccgaattcggcacgaggccccgcgagtaaaggattcaatcccctccccaccctccacctcgccgccgccgccgccgccccctccgtctccgctcgagcttgtcagtccgcctcgtcctcctccttcggttctgcccgcccgtcgaccagattgattctctcttcttcttcgtcgtcgtcttcttggtctgccgctgccgcttggaatcccaaggccttggttgatcaatcctgtgaccctggaagaagatcgaagggcgtcgcgtggtgacatgatgtggtgcaggtgatggtgagcgtgcggcagagccccatggtgcggtcggaggaggacctgggcccgccgtggctgcggccgctgctgggcacgagcttcttcgtgccatgcccggcgcacccggacctgagcaagaacgagtgcaacttcttctgcctcggctgcaaccacgccgccggcgcgctctgctcctactgcgtcccgcgcaacgcgaccaacacgtcgtccagatacggcgttcgtcgtacacaacgtgatccgggtcggagtgggaactgtcantncncagtgagactacgtgtnaacangcaagatctgtcctaacggcggcgaagcaagccggaag

SEQ ID NO: 24508 - DNA, 1170 bp, Triticum aestivum
  unsure (1)..(1170): unsure at all n locations
  Clone ID: PAT_TA_24508
ccccgcgtccggnaaggattgccaacagagctgttggagaacacgtatcctctatctacnncatttctgaacagttngaaaaacatttcaatgttgtaaattttgtcgtcctaaatgaatatgtagaaatgaacctggccagcagtagaagtcactgcgtgtacattttctccgtgcagcatggatccactgcagatgataaggtaagggccgggaagattgttcttgttgacttggctggttcagagaaagttgagaaaactggtgctgaagggcgagttcttgatgaggcgaaaacaatcaacaagtcgctctcagctcttggaaatgttattaatgccctaactactgctaaaccgaatcatgtcccttaccgtgactcgaagcttacacgcatacttcaagatgcactgggtggcagctcataaagactctacccaaactgattcccaatgaagtggacagcgtcaagaagcccacctgctattctcatgatcaagatgatccgcgtggcagagcaccaagcaaggctggtagcagccagtctgaggtgtccgatccgagccttgattcttatgatcatgatgatttgcgtgacaggatactgagcaagctaaggttgagtctgaaggaggaggacgtggatctgctggaggagctgtttgtgcaggaaggtatcatcttcgaccccaacgcagcggtgccggacatcgacctggcgttccaagacgtcgcgagccggcagattgtgtcgctcgtgcaaacagtggaggagctcacagaaactgtgcaagagctcactgacgagaacgagaaattgaggcatcagctcgagttcgcgcaggagatcgccgcccgcgcccagtgcgccaccgcggaccggagccgtggtgccctgtttggtttcgtgcccgcggccgtcctccgcccctttggattcgttccagactgatggctcgaacagacagccggcgtcacgtagattccgcaaatattttgctgccagaaacatcacagcaacgttaatcctgagtgccttgaggatcatgtagtgacaccttatgacagattcttcctttttttgacaagagtatggcagattcttgtggaaatcaattttggctctaaggagcacacgctcctgcgtgtcaaaaatggattttaccaatg

SEQ ID NO: 24509 - DNA, 617 bp, Triticum aestivum
  unsure (1)..(617): unsure at all n locations
  Clone ID: PAT_TA_24509
ggtggttgtgtggctggaggtggagggcgaccagggcgacccggcggtcagcgccatcgtggtacagtgcatcatcttgccgctcctcggcggcgcgcgggaccaggcggtggtggacgagaacgtggccaagctcaagaaggtgctggaggtctacgaggcgcggctgtcggcgtcgaggagccgggccggcgacgacatcagcctcgccgacctcagccacttccccttcacgcgctacttgatggagacggagtacgcgccgctggtggcggagctcccccacgtgaacgcgtggtgggaggggctcaaggccaggccggccgcgaggaaggtgacggagctcatgccgccggaccttgggcttggaaagaaggcagaggagtgatgactgcctggcaattacaccggactgccgcccacgttcaccagaatcgagcaagtcactgtcgactgtcgagtctcctgtccggttttgcgttgtaccggcagatatgttctgtgccagtggctcgtgttttgagtctcacgcttgaataaaatgcaagatacccatcggttccaaaaacaaaaagccacagcnnnnnnnnnnnnnnnnnnnnnnnnnnnnnnnnnnn

SEQ ID NO: 24510 - DNA, 657 bp, Triticum aestivum
  Clone ID: PAT_TA_24510
cgcgggcaatcgcgaggcacgtgcttcgcaagtacaagccggagttgctggtaggcgacggctcgccggagtcggcgtccacggtcgacatgtggctggaggtggaggcccaccagcaccaccccgtgttggtcgccatcacgatgcagtgcctcgtcgccccgctcctcggcaacgcgccggaccaggccgtcctcgacgagaacctcgggaagctggggaaggtgctggaggtgtacgaggcacggctgtcggcatccaagtacctcgccggggaatcggtcagcatcgccgacctcagccacttcccgatgatgcgctacttcatggagaccgagtacgcggcgctggtagaggagagcccccatgtcaaggcgtggtgggaggagctcaaggcgaggccggcggccagaagggtgacggagttcatgccgcctgactttgggcttggaaaaaaggcagagaagtgatgggtgatgacaacaacaccggcaaactggcctgccgcctgcggctgcgggcgatggtcaccgacatacgttttgtggcctgatacagagtgaattgcataaaaccatcccattttgagctttttgtgcaaaaaaaaaaaaaaaaaaaaaaaaaaaaaggggggagaaggggggaagaggaaggaag

SEQ ID NO: 24511 - DNA, 887 bp, Triticum aestivum
  Clone ID: PAT_TA_24511
aacttaaagaagcggacgcgagctatctcgatagtcgatggcgccagcgctgaaggtgtacgggtgggcggtctcgccgttcgtggcacgccccctgctgtgcctggaggaggcaggcgtcgactacgagctcatccccatgaaacgcgaggccggtgaccaccttctgccggacttcctcgccaagaaccccttcggccaggtccccgttctcgaggacggcgacctcaccctcttcgagtcgcgcgcaattgcgaggcacgtgcttcgcaagtacaagccggagctgctggtgggcgacggctcgccggagtcggcggcgatggtggacgtgtggctggaggtggaggcccaccagcaccaccccgtggcgggcgccatctcgatccagtgcctcctcgtcccgctactcggcggcacgcgcgaccaggccatcgtcgacgagaacgttgtcaagctgaggaaggtgctggaggtgtacgaggcgcggttgtcggcgtccaagtatctcgccggggagtcggtcagcctcgccgacctcagccacttcccgctcatgcactacttcatggagacggagtacgcgtcgctggtggaggagcgcccgcatgtcaaggcgtggtgggaggagctcaaggccaggccggcggcgaggaaggtcaaggagttcatgtcaccggactttgggctggggaacaaggcagagcagtgattgcaacgtcggcgtatatgttgtgtgtgttttcagattgtttatccggtgtgaatgaaataaaaagtggtccgggtcagtacaatttctttcaaataccatgttcgaaccattcaaaaattgtgtttcaacctagtttttttctcaataatctgagcaagtatattatttgttg

SEQ ID NO: 24512 - DNA, 930 bp, Triticum aestivum
  Clone ID: PAT_TA_24512
gccggccggtccggaaagagcacacacgcacccgtcgatctccaagaagcggaagcgggagcgagcagagcaaaggtgcgatggcggcgccggcggtgaaggtgcacgggtgggcgatgtcgccgttcgtggcgcgcgcgttgctgtgcctggaggaggccggcgtggagtacgagctcgtccccatgagccgcgaggccggcgaccaccgccagccggacttcctcgccaggaaccccttcggccaggtccccgttctcgaggacggcgacctcaccatcttcgaatcgcgcgccgtcgcgaggcacgtgctgcgcaagcacaagccggagctgctgggctccggctcgccggagtcggcggcgaaggtggacgtgtggctggaggtggaggcccaccagcaccagaccccggcgggcaccatcgtgatgcagtgcatcctcaccccgttcctcggctgcgagcgcgaccaggccgccatcgacgagaacgcggcaaagctgacgaagctgttcgacgtgtacgaggcgcggctgtcggcgtcgaggtacctcgccggggagtcggtcagcctcgccgacctcagccacttcccgctcatgcgctacttcatggacaccgagtacgcgtcgctggtggtggagcgcccgcacgtgaaggtgtggtgggaggagctcaaggccagcccggcggcgaagagggtgacggagttcatgccgccaaacttcgggttcggaaagaaggcacaggagtgaagacaagaacgagcaccgaccgaacatgttgtgtggtctgtgcgaccatggctcaatgttttgggctgtttgtgtttcacgcatgaatgaataaaacaaaatgcttttgggtttcaaaaaaaaaaaaaaaaattgcaacgctggcgtttattatggtgtgtacacctatggcgcg

SEQ ID NO: 24513 - DNA, 1044 bp, Triticum aestivum
  unsure (1)..(1044): unsure at all n locations
  Clone ID: PAT_TA_24513
ggatgcggcccgagcgcacacacgcgtccatctccaagaagcgaaagccagcagagcagagcacgcaacacgcgtccatctccaagaagcggaagctagtggagcagagcaaaccaagcaaggtgggatggcgccggcggtgaaggtgtacgggtgggccgtgtcgccgttcgtggcgcgcccgctgctgtgcctggaggaggccggcgtcgagtacgagctcgtccccatgagccgcgcggccggcgaccaccgccagccggacttcctcgcccggaaccccttcggccaggtccccgtcctcgaggacggcgacctcaccctcttcgagtcgcgcgcgatcgcgaggcacgtgctccggaagcacaagccggagctgctgggctgcggctcgccggaggcggaggcgatggtggacgtgtggctggaggtggaggcccaccagtaccaaccccgcggccagcgccatcgtggtgcagtgcatcatcttgccgctacctgggcggcgcgcgggaccaggcggtggtggacgagaacgtagccaagctcaagaaggtgctggaggtgtacgaggcacggctgtcggcgtccaggtacctcgccggggacgacatcagcctcgccgacctcagccacttcccgttcacgcgctacttcatggagacggagtacgcgccgctggtggcggagctcccccacgtgaacgcgtggtgggaggggctcaaggccaggccggccgcgaggaaggtgacggagctcatgccgccggatccttgggcttggaaagaaagcagagtagtgatgactgccgccaacgttcaccaggatcgagcaagtcactgtcgagtctccggttttgcgttgtacggcaccggggcaccggcctatatcttctgtaccagtggctcgtgttttgatgttttagtctcacgcttgaataaaatgcaagatatacccatcggttctacaagaaaaaaaaaaaaaaaaaaaaaaanaaaaaaaaacncaagggggggcccggtacccaattcccccnaaattgnt

SEQ ID NO: 24514 - DNA, 292 bp, Triticum aestivum
  Clone ID: PAT_TA_24514
caggaaggcttaggtattgcaaaattctctctactgagatgatcttgttctccaaattgcacatgcttgttacaagcgttacttgcattatgttcagattaagcccatatgtgactacaaggccagcaattcctggacgtcggatggaatttcagttgcaaactcagatcgtttctcccaccattttgttcagtacaaaatgtgtttgaaaccttttactattttttttggttaataccggtgtaaattccccctatcttcaaatgaaatatagcttccaggctgttatttc

SEQ ID NO: 24515 - DNA, 534 bp, Triticum aestivum
  unsure (1)..(534): unsure at all n locations
  Clone ID: PAT_TA_24515
ctcgtgccgaattcggcacgaggtgtgaatcagcaaggaccaccttgcaaggctaaatactcctgggtgaccgatagcgaagtagtaccgtgagggaaacgcgtgccgaaccccgcgcgccctcctccgcccgagctctcgctcgccgcctcccgcgccttccgcttgccaccgccgccgccacaacagccatgtcgtcgtccgacaccgccgggagcgtcgccgaccgtccgatctctcctgataccacacgcatcgggtgggtggggacgggcgtcatgggccaagtccatgggcgcaccacctcctcgccgccggctacgcgctcaccgtaaaccgccccacgcccgccttcggcccccgcccgcgtcccgggcgccccccgcctcgtggtctagcccgcgccccccccgcggccgtcgctgacgtcatcttcctcaatggtcggcttccctccgnacgtccgcttccacgtcnctcgaacccctncacgnggcgntctcggccnggcctccgccccaagcgggngttctc

SEQ ID NO: 24516 - DNA, 606 bp, Triticum aestivum
  Clone ID: PAT_TA_24516
ggcccagcacccctcgtctcgtctccagatccaaatcctccaaatcgagatcacccacccaccggcgatccatccatggagctggaggcgccgtcgccggcgaggtacctgctgggcgcggcgatcatgatggccggcgtcgtgctcccgctcgcctacatgatcttccgcagcaagcgctcctcctcctccgccgcggcctccgtctcctccatcgcctccgccgccccctcctcctccttctccaagcagacgtaggaacaagggcctcttctgatggcccgcgcgctcgcgttccgtctggcgctgttctagctgctagcgctacctccatccattctaggagtacaagaaaagagaggagatcccacctgtatccgcggtcggtctctgatgcggtagcacaagtagtaaattcagttgtgtgaatctgtatccgtagtgtgtcttgtctctaatcagttaagcaattttttggtgatgaattggaatgaaatgaaagagggaacaaactggtgtgtgctgctgctcagtcccatgagtttattcttcttgtttttgtcaatgcctgtagtacaactttgactgaaaaaaaaaaaaaaaaaa

SEQ ID NO: 24517 - DNA, 980 bp, Triticum aestivum
  Clone ID: PAT_TA_24517
ggggttttatgtttgcgctagctctgctgatgatgacaatttaccctatcatgatagctcctctgttcaacaaattcactcctcttcccgaaggctcgctcagggagaaaatagagaagttagcagattccctcaagtttcctctgaaaaagctttttgtggtggatgggtctactcgatcaagccacagtaatgcttacatgtatgggtttttcaagaataagcgcattgttctctatgacacattgatacaacagtgtagtaatgataatgagatcgtttctgttcttgcgcacgagcttgggcactggaaactcaatcacactgcatattcctttgtagctgtgcaggtgcttacatttatgcaattcggaggatacactcttgtaaggaattccaaagatctctttgaaagttttggttttgaggatcagccggtaatcattggactgatcatttttatgcacactattatacccgtccaacaccttctgagtttttgcctcaacctcgtcagcagagcatttgaatttcaggctgatgcttttgccaagaaccttgggtatgctcctgagctcaggggagcccttgttaaactacaggaagagaacttatctgcaatgaacacagatccgtggtattcagcataccactactcccatccaccccttgttgaaagactgtctgctcttgaagacctggacagcaagaaagagaactaatggaagatgatctcatacttgatgcgcatatgccaactgtcatggcatagcttcaatctcaatgtaatatggatatttagagggattatttatatgcatacagggatccgtatgaaaacgtgcacctctagattcagatatgtattgttcgtcgattgacttactgtcttattgacctatacacacaggattgttggtcctttaacattgacaaatagaagttgatcaaaaacgaaaagttcaaaaaaaaaaaaaaaa

SEQ ID NO: 24518 - DNA, 793 bp, Triticum aestivum
  unsure (1)..(793): unsure at all n locations
  Clone ID: PAT_TA_24518
gtctcattcagttccatgtgcttattagcatgacaaccatgtgatggctcgctgggcacagatactctacatacataggtttctcaacacactaggttgcacacatatagcgctcgtacacaaaccgctagagcaccgtttgccagcctcctggcttacatatactatatatagttttattccctaacagaagtatatctgtaatgtttaggacgtacaggacggatgagttattcaatataaggaatccatctgatctgatgatcacggctcatccgacgagtgtacataccgttctggggtgtgcttgggatccgttcatgttgaacctccgctgattgggctgggctggtcatttatccaatactgtaacgggcgggtgctgggcggcgtcattgcacttttttttcaacggcgtcattgcacttgccgtcatgatgagcanattacttgatattggtgtgncttcctgctcgaatccccatgcatatgcatatggggggacaaccacggnagcataaccttacatcnccgccacaatacaacgtcgtcctacctcgtgccatnccntaccatgtctcccctcctgagttncccatgtggtgctggtacctcataagcggtacaactcggnggnaacacccgcgctacntcgggtntgcgcgnggcccntagcttctanccanacgcgcgctctctcccnancatcagacacaacacnataatgganaatagtttnacgcaagncaaattcactccnatcatannggngttcccncgnccaccttcntnn

SEQ ID NO: 24519 - DNA, 536 bp, Triticum aestivum
  unsure (1)..(536): unsure at all n locations
  Clone ID: PAT_TA_24519
gtcgtggccgaattcggnctgagacgtccatcgagtcaagatattttatagagatgggtatctttgaaagtttgagcgatctgttagaagcagctataccatggactgaggctcacgccgaggcgccacctgtagaggcagaagagcaggaagtcaatcaaactgaaaccaaagcggctgagccgcaggaaacatccgaagagcaagaacagccaacagagcaagctgaagatgcggaagaggtagaagaggaagaggaagagactgttgatcccaaagaagtactagaagaggaatgcaagaattctgcttcttgctctccagcgaaacatcattttgaagactgtgtagagcgtgttactggcgctcaggaaggaactgcagatgaggattgcgttgaggaattctttcatcttatacattgtgcatcttcatgtgcagcccctaagctctggtcgaccctcaaatagaatgaataatggctactttatttcatgaaaccccgggaagggtagaacgtggtccttgggcataat

SEQ ID NO: 24520 - DNA, 720 bp, Triticum aestivum
  unsure (1)..(720): unsure at all n locations
  Clone ID: PAT_TA_24520
gctccttcttgcgtttgcttgtatatatcacacaccaacacccttcagaggctgcgaggtcggaagaaagaggagccacctttgactcctctctctagtggtttttgtggggatttcgggtggtacgagaggattaattagtggatttgtattcttggagaggctgctagttcttggagagtttttccttttcttgtcctgagagagattcatgcccaggagttcaccctgaggagctggtattgttctgtcttctgtctgagggttagcgtgagaggatccacctttgagttgaccggccagaatccttgaaagaaatttcgttggtttttgcgtggatcgggccttagggtcgttgatgtttgcgcacttctactagtttggaagggcggctggggcaccttgtgtggagagaattttagtgcttcgctgaaacagcgcgggttcaaattagcccccttcgttccttgattcctttgggggggatccgattcgcttccctccatggagctgcctgcagtcaatcctaattttcgatggatcgggtagttacccctctgtaaaagaaacacacgtttgactnaacatctggaattggacggaaggttgattgaagggaacatgggccccttaggaaacccatnaaatctcgtccaattcttggancccggcttctggagatggccgttccacnaaanttttnaanggacatttnaangn

SEQ ID NO: 24521 - DNA, 407 bp, Triticum aestivum
  Clone ID: PAT_TA_24521
cctacgtcagcaggctcgagcggccgcccgggcaggtacatgccgttctggccgaccatgtagcgagctagcacgtcatcatccatgatgatcactacccaccctcggtccatgtctcgaattggtttggcacgcagagcttcagaggataagaccgtagcgtgctggtgcctgatagtatctcattgtttaggcggaagcgtcatgatccactcggctcggccccgcccacgccagatagtaggaaatgtcaggtgcttgactaggacagttcccgagaccgtgtccgggcaattaagattgttatagactacaggaagcatgatgtgtaattattgaattttgtatctgattatattgatgaaagtagaggagattgaccggccaaaaaaaaaaaaaaaaaaaaa

SEQ ID NO: 24522 - DNA, 501 bp, Triticum aestivum
  Clone ID: PAT_TA_24522
ttttttttttttttagcccaccggatatattaaggtttaacctatttagtatggcagctcaaagttccaacggggtgcgtctttttgtccctggaattcagagaattagatttatattctcagctatgaagcaaattattttagacttcctgtgccttggttcctcccacaacctcaggaaccttgttaggatcgaagccattagattcctttaactcctctatgaatttgatgtacttttcttccgcttccttctgactgtattgcgacacttctctccaggccttccgttttgccttgccctttaaatcaaaggtaccaggggctggtgctttctcaatgtcttcacccgaagccaccttaaataaaccgtacatgtagagcagtttatcgttactgaggggaatggtcaattgcttggattctttcgcagctttctcaaacggggtcagttcggtttcaaccatgctgggcaactgctcgtgccgaattcggcacgag

SEQ ID NO: 24523 - DNA, 698 bp, Triticum aestivum
  Clone ID: PAT_TA_24523
gcggggactgctctctggttcagctgatcgaccatccccatggcgaccgcgagaatagccgccgggacctgttccgccatcgccggacatcgcctccggcctgctgcggtatcgccgcttgtgtcgaacttgtctcactcacaccatcacagaagaaaccagcctcttggccttgcctcggcccgtgctgccgagcatggtctcaccggagcacaccgccccgagttcttcccccatgaccattgccgtgctcctccctattcgatgagcgcgaggaggacgcggacgatggcaacttccgctttagcgaagaagagtttggtaggagaaaatgcaggcctgcgaaacaaggaacgggaggctagaataaggaagcagcttcagaatcctgaattgacaccatctccgttacgacacagcaatgggttgctatggtggcccttgccgggaatttccctagtgctccacaacttcccccggtggccttgaatgggataattgcaaaggccaacaaggattatgggtcccggggcggcagcgaacgtgacttggcccccgacaactctactctcttatccacattggcgtgtgttattgcactcaagaaatggaatgttggcccggaacacatcaggagaggactgcattttattggaaaaaaattctccttctctatggatgagcagattgctactcct

SEQ ID NO: 24524 - DNA, 701 bp, Triticum aestivum
  unsure (1)..(701): unsure at all n locations
  Clone ID: PAT_TA_24524
cccacgcacacgagctagacgctcccttcctctctcgttgcctccagtagcttcccgttgcctccaccttccaattggcattgattcaaggtggaagacgtagctctgatgggagggcaggagctgcaatggcggagatggggagagattttttgcgccagatgcggagatgcggagtgttggctgaggagctgctgcgtccacgagctggaaccggcatggcagcatggtggaaccggcaaggaggcgtgctgccacggtggtcgcgcgatgcaggaaccggcatggcaacatgctggaactggcaagaaggcgtgctgccacggtgggcgtgcgatgctggaaccaataggccgatttgctggaaccggcgcccgatttgttgcgtacgctggagcacgccggtgccgctgcaacctactacaatggcggacatgacgaaagctggaaccagcaggccgatttgctggaaccggctgtcagttttgttgcatacgacggagcacgcgtgcacgacggaagctggaaccaacgaccgtcatgttgcgacggcgcggcgacgatccaccattgctggaaccatcaatttctttgctggaagcagcgatttattttgctactacccggtgacgatgattcatgactttgctggaaacggcaagtatttttgctggaagcatggtattttgcttaaaanaaaa

SEQ ID NO: 24525 - DNA, 522 bp, Triticum aestivum
  unsure (1)..(522): unsure at all n locations
  Clone ID: PAT_TA_24525
ctgagccgccagactgcaccattggccgtcgccaccgcccaccagtgtgtctaatttggtgacatcgcaaagcacagcaggtcaaatttgtgcagttttgaacctgtcattctgaactggagtcctgagtgctggaacctgaagcccttcttcgcacttcaaatacggagtcctatagtcttgttcgagcaaactgaacttggtgtcgaaactcgaaacccgaagctttnctcagtatacagtttgatttctgttgtgcattttctgggatatggagtcgtgtaactcgagctatctgatccaagagaagagacactcaagctggtccaactctgttaatcatttcaagtcctcgttcctgcgcattggagaggtaaaactgttgggccgaaaatttgcttgacaagccaacctactattgcagccattcaggccaccacaagatcgcnatgcatatcaaggtccctctgtaagcaatataagacgttttttgcnagttcaagttgggtaaaaagggggggc

SEQ ID NO: 24526 - DNA, 635 bp, Triticum aestivum
  unsure (1)..(635): unsure at all n locations
  Clone ID: PAT_TA_24526
gtattttttgctggnaccatatcaatgtcttttgctgaatcatagcatttttgctacaaccacattattgtttgctggagccatattaattatttgctggaactatgtgtttttggtttcaaactagcgtattctttgttttttgtgctgcaatcgatgagtggcaacggcgagcgacgagcattggggaaccaacggagcttcgaggtcgccggggcatgaatcgatggtgctcgttgtgtttttgtttccttgtgcgtactgggaagaaggacgggaagggaaaggaagaggacgtgagatctgacggttcgtgactttcagatcgatgactagtagcggaccggccgaaagattgggccggtgcgccggcgcctagccttggcctttttgttttgttttctctttttcttctttgattttgttttattttccacttttctacttttaactttatgtttgttcactaatttgtttttcttcttcctagtttatgttttttatttcacctttttttactgtgttatttatgtattttatattttttgtaatgttcaaaatatcggccgatttgtcgctctaacaagcgattgatcgagaacatagcgacttgggcccatgtatttcctaagact

SEQ ID NO: 24527 - DNA, 432 bp, Triticum aestivum
  Clone ID: PAT_TA_24527
agtttttttttttttttttttttagctgtgccctcgttactctctttcatgtcttctagcctgaactggttcctggctctgacttgctggctcctttcctgcggcttcctcttgcccatcttaggtttcgactatcttcacacacttagtctacccgagtcactggatagcaaggaaccgtgtgacctcttgacgaagcttccgcctttgtaattattttatgcatgttaaatgttgcttcaaacacaacatcccaaccttcataaggtggatttcgagctactaattcgatctgtattttcccaaatctctcatcagagttgaagctcgcgccgctttcgccacgtggtatcaagctattgtattctccattgatcattgattctaattttataccagggattacttcgcccatacaattgtaaggggggg

SEQ ID NO: 24528 - DNA, 547 bp, Triticum aestivum
  unsure (1)..(547): unsure at all n locations
  Clone ID: PAT_TA_24528
ctcgtgccgaattcggcacgagctagccgtaccaatgcttaatttgatctatcctgacgttgaagatgcacattgttatgggaacattatactccgggggctctactcgctaggtctacatcctagggaaaggatcccgctctttacgggcgttaaggatgcagatcttacgtgtatcagtatttaatcgggtaatctcgaaccctatcggtacatcagctggtgttgataagcttgctgaaataccagatatcttaatttgcacttggaccgagcggttgtcgaggttggtggcgtaacgcctttcgctcaagagggaaatccaaggccgcgtgtcttcaaactgcctaaatataacgccttgattaatcgttgtggtctcgcaaggaaagggagctgaaggatatggcccagcgcctacgagaacgggttcaagaattttgcctacaaaaancgggtatggatcaaagtgcagaaagcccgtangatttcngttctcaacggtggcacccggagtaccaccgggaangtctaaaanaatgggang

SEQ ID NO: 24529 - DNA, 627 bp, Triticum aestivum
  Clone ID: PAT_TA_24529
tttttttttcggcccccctcgtgtggttttgttgtctgtttttgcatataaccttttttgttttagtacaatctgttttgaaatgtataaagatctgcattttcttttaaactccttaaagtggtaaactagtgatttactcatcatcatcatcatcctcagcatcattgtgtacgttgaagaatcggagctcatagacaccttttgaggtggagacaacacgaagccaatcgcgaagttgctgtttcttgaggaatttcttggtaaggtatttgaggtaacgaccagaaaactgagtatgagcaattacttcaattttcccatctcctatctgggaaatctggaccgtatctccgagatttccgacgagaccatcgaccttaattttatcttgaaggaacttttcgaatgcagaaatatcgaaaattttgtcgcttgctggctgagaagcattgatgatgaacttatgcgtaaccttagcctgcttcacctttgatgatttagtttgaggcattgtgaaaatgggtctttggtcgcaaagaagttaaatcctacgccagattattgataattgagtagttggttggtattatcgactcgtgccgaattcggcacgagcggcacgag

SEQ ID NO: 24530 - DNA, 597 bp, Triticum aestivum
  Clone ID: PAT_TA_24530
ggcacatccggccagggccgcgaccgtgggagcgtcgtcgtctccgctgtgggagccacgccgaaggcgccgctgcctccggggccggagggccagccgagtgccgttgcctcgggcgccgctggatcggatgcaagccgagggcgcggcgtcgcctcagtcttccgcgccgcgccgcggttgggtgccgccttcgcgggcgccgaggctgtcgtttgcggcatgcgtagtgggagagcatctcgccatgcacgtgtgcgccgggcatctccgcggtcacgctttaggcggcctcgcgcctctgcacgcgccgccacatcatggctggtgcgccgcgccgcgttgccgtttcgtcgaggtccgcgcagcgcctccgcgttgagaggtcaaggccacgcagtcgtgccccgcgttaggcgccggcccgcaccttgacgcatcgctggacagccgtgtgtgtacaaggtggacggacgcgggccgccgctggctatgctggcctccaggtgtagcccgagtcgctgtcggcccagggcattctacggccccgcccgggcattggcgaagggagcgctggccgggccttttgtcgccttt

SEQ ID NO: 24531 - DNA, 1046 bp, Triticum aestivum
  unsure (1)..(1046): unsure at all n locations
  Clone ID: PAT_TA_24531
gtaattattgcactgcacggctggctctctgtctcgctgtctgcctcttcgagctagctaccactctcgcagcatagcttttctccgcgcacacgatggggaggggaataattaagcgaggcaggcatggcggcgagtgagccgagtagtgctatcgacatggcggagctggacccggtgctgcacggggtgggcttcgagatgcaggaggtgtcgccgtcgctgctctccggccggctcccggtcacggagcgctgctgccagccgttcaaggtgctgcacggcggcgtgtcggcgctggtggcggagggcctggccagcatgggcgcgcacatggcgtccggctaccgccgcgtcgccggcgtgcacctcgccatcaaccacttccgcagcgccgccctcggcgacgtcgtcctcgcgcgcgccgtccccgtccacctcgggcgctccacccaggtgtgggaggtgaagctgtggaagatggacccgtcggaggaggggaagaagggcccgcagatctccgagtccagggtcacgctgctctgcaacctgcccgtgccggacaacctgcaccacgccggcgacgccctcaagaagtacgctgccgcagcaacgacccccacccccaccagcaaactgtaactagtactagtatcatccttctccgtgtatatttactactccatataattttccacttcttgtttggtcgcctatcgagcgattaaaaatccaagagcaaacaaaccctatcagttactcctttttcttttagattatacattaacttatctgttactccttttactttggcattatcctatcagttactttcaccagtactcttttgtaaactaatataagagtgtttaaatcattattttaatattttaaaaaaaaaattaaattagtttacggngcgantacaatgtatctgntctatgcaagtatgcattgcgtgttgttctgtcctctcaaggtatcaatcaagcagnccctgaatgttcttcagtgggtntagttcgtcaanaagannaggngaaggg

SEQ ID NO: 24532 - DNA, 764 bp, Triticum aestivum
  unsure (1)..(764): unsure at all n locations
  Clone ID: PAT_TA_24532
gcgggggagctagtggcgaccactcatggaaggagccatctccagcgggccaaatccgaggattgccgtcgtcaccggcggcaacaaggggatcggcttcgaggtgtgccggcaactggccagccatggagtcgcggtcgttctgacggcccgggacgagccgaggggcgcggaggcagtcgagaagctcagagcgctggggctcgcccaagtcatcttccatcagctggatgtcacggacacttccagcattgctacactgttcgttttcctgaagacccgctttggcaaactagacattctggtgaacaatgccgcaatcggtggggttgagtacctccaagaactccatgccaacgaggaaaagtttgccggcatggatttcgaccagatgcttgaatggatggtgaagaacgtccgtgaacccgtcgacagtgcaaagaaaggcgtgcagacgaactactacggcacgaagcatgtaaccgaggccgtgctgcctttgctgcaatcttcctccgagggaagaattgtgaacgtctcctccctatttgggctgctaaggcttatcagcaacgaggaggtgaggcaggagctcaatgacatcgacaacctgacagaggaaaggctggacgagctgctggacaggttcctcagggacttcgaggccgacgcgctggaggcgcgcggatggccatggggtgctctgcgtacaaggtggcaaggncgccatgaacgcctaccnaaggttgctgtccaaggaagna

SEQ ID NO: 24533 - DNA, 520 bp, Triticum aestivum
  unsure (1)..(520): unsure at all n locations
  Clone ID: PAT_TA_24533
ctaatctcaactatctcccagaaaccatcttcttacattcctacactattacattcgttctcgaaccttataacaatgcgtatctctatcattgcaattgcctctctatgcgcctctgcggctgcattccccgagtttaacaaacggactgaaacaccctccaacactacttccgtcatggcaacatctgccactatgccacatggtactggtctcgaaacttcatccccatcatcaactgggtatcttcaataacggaacatcaactacgagcgaggcttcgtctgcaactacatccagcacccataaaactaccgcatcacctatctcctcaaccaagctcttctactgccggtggccgccccaaccggtatctggggccaacgaatacgccaaggggagccgtcgctggtgcaagttgggaatcaatggggtttggctctagcggctctaagggggggaaaggaatatattggtattttcaccccttangtgtcggtggnatcaaggatggtcaagg

SEQ ID NO: 24534 - DNA, 752 bp, Triticum aestivum
  unsure (1)..(752): unsure at all n locations
  Clone ID: PAT_TA_24534
cggccgctcgaggcggcaggccggggccggccaaaaaaaagatcaccaaccagcaatccaattccccaccaccagtcccctcgcaccctccggcgaaccaccgcacctctccccggcgaagcaacagcgtccgatggctcccaaggcggagaagaagccggctgccgccgagaagaccccggcggcggagaagaccacggcggggaagaagcccaaggccgagaagcggccgcccaagtccaaggagggcggcgccgacaagaagaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtcggccaagctagcccgctacaacaagaagcccaccatcacgtcccgggagatccagacctccgtccgcctcgtcctccccggggagctcgccaagcacgccgtctccgagggcaccaaggccgtcaccaagttcacctcctcttagatacgccgttccctgtcttcttggtcggtcgatgcttctctctgtaatggttagctgttcgggctatgtccctgtgtaacttgtgctggtgttgtggcatcacactgtttcagtatctcgtgaaatagtaacgatggttatttattctgtctatcaagaaaaaaaaaaaaaaaaaaggcccctannnngc

SEQ ID NO: 24535 - DNA, 755 bp, Triticum aestivum
  Clone ID: PAT_TA_24535
gctccgccgtgccaccgcacctctccccaactaccagcaatccaattccccaccagccccctcgcaccctccggcgaaccaccgcacctctccccggcgaagcagcagcgtccgatggcccccaaggcggagaagaagccggcggccgcggagaagacccctgcggcggagaagaccacggcggggaagaagcccaaggccgagaagcggccgccgaagtccaaggagggcggcgccgacaagaagaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctggcccgctacaacaagaagcccaccatcacgtccagggagatccagacctccgtccgcctcgtcctccccggcgagctcgccaagcacgccgtctccgagggcaccaaggccgtcaccaagttcacctcctcttagataatctgttctcgtatcttcttggtcgttcgatggtactctgtaatactactcgttagctgttcggaccatgtcgctgtgtagcctctgcttgttgtgtggcagcacactgtttcattatcttgtgaaatagaaatggtgcttatttattctatcaaaaaaaaaaaaaaaaaaaaaataaaaaaaaaaaaaaaaaaaaacctgtttctgag

SEQ ID NO: 24536 - DNA, 646 bp, Triticum aestivum
  Clone ID: PAT_TA_24536
aagaagagaaagagagaatggtgacgaggcaccatcaagggaggaatctttggaaacattggaaatatgcaaaacctttatgaaactgtgaagaaggcccaaatggttgtccaagtggaggctgtgcgggtgcaaaaggagcttgcagcgactgagattgagggttattgtgaaggcgaactaatcaaggttacactatctgggaaccaacaacctataaatgttgaaataacggaagctgcaatggagttgggcgctgaaaaagtctccgagctggtcaatgaagcctacaaggatggctgatctagcgcagagcataggaatgcctgcagggctcggcgacggtctcaagtgataaaaggcctggtacttgaatgctttccaataatgaaagaagcgtctctcaattttgtattctagctgtgtcgagtcatggttaaacccctctgcagcatcggttagctgtgcacgagctgtaactgtggacacctgtttccttgctcatttgcacatcatagttacagcattagttctaatgtgttgttttacaccaaacagatgttgcttttgtgctagtagaccggcagcctggagaacatttgtaaactaataactgcagagtgaaatatgtttatgttgcgaatag

SEQ ID NO: 24537 - DNA, 1004 bp, Triticum aestivum
  Clone ID: PAT_TA_24537
cgtagtccgccatcttatctgcgtccctcccctggagcgagcgagccctcgtctcactccccgcgatggcttcctccactgctctctccccggtggccttcaagtcctccttctccccgctcccctccagaccagctcgtactagtataaatgtacaaggcgcattctgtttgccatgttccacttggaaaagagctaataatagatcgttccgggtatacagtttatttggaggaaagaaggagaaagatgagaatggtgatgaggcaccatcaaagggaggaatctttggaaacattggaaatatgcaaaacctttatgaaactgtgaagaaggcccaaatggttgtccaagtggaggctgtgcgggtgcaaaaggagcttgcagcgactgagattgagggttattgtgaaggcgaactaatcaaggttacactatctgggaaccaacaacctataaatgttgaaataacggaagctgcaatggagttgggcgctgaaaaagtctccgagctggtcaatgaagcctacaaggatgcacaccagaggagcgttcaggcaatgaaggaaaggatggctgatctagcgcagagcataggaatgcctgcagggctcggtagacggtctcaagtgataaaaggcctggtacttgaatgctttccaataatgaaagaagcgtctctcaattttgtattctagctgtgtcgagtcatggttaaacccctccgcagcatcggttagctgtgcatgaactgtaactgtggacacctgtttccttgctcatttgcacatcatagttacagcattagttctaatgtgttgttttacaccaaacagatgttgctgttgtgctagtagaccggcagcctggagaacatttgtaatctaataactgcagagtgaaatttgtttacgttgcgaatagagtacgctttggttttgggtatcgacattgtccctaaaacacggcttaaaccaatgggcaaaaaacccgaggcacctcgg

SEQ ID NO: 24538 - DNA, 577 bp, Triticum aestivum
  unsure (1)..(577): unsure at all n locations
  Clone ID: PAT_TA_24538
gaattaccgcgcgtgccgagcccggcacgaggttgacagctttgaacatctgcctactagcacatttcacttcgctagtctcagcaactgcgcttacatacatgctaggtgcgaatgagagagcatgtttttacgccaatgtagaaaagaagggtttaaaggtcgcattctatttcgctgtacaatccggagactcattcgagattgattatgaagttgtagggccggatagaaaagagattcttgatgggattaaggagcgacaaggagactttgtctttacagcgaacgccgccggtcctcacgaattttgtttcaagcaacaaagtcagcgcctctacgcaaaaactgtttgacttcgaaattactgttgaaaacgaacacacaagcatcaattcctttcaaacaagacaaatcaccggnacaggcatctaacctgganggaatccatatttaagctnctccggggcaaactttcaaactaattaactaagnaaaccaaaaagtattttccgggctcgtgaagaacccgcaactttagtactgtaagaagtaccgaacgaagaatatttanctt

SEQ ID NO: 24539 - DNA, 345 bp, Triticum aestivum
  Clone ID: PAT_TA_24539
ctcgtgccgaattcggcacgaggtagccacgcaaccaactgaagctagcaaaccatgcccatggaactggccgtgatccacctcgcgcgcccagccctcacaccgtcgccttcgctgcggccgcgtggacggcgcatgctgcgcctacgcgtgaggtgccgcatcgacggggatgaggggggtggagcccgggggagcgaggaggacgcgcccgagtcgctgtttgcaaaggagctgaggcggcggggtatggcggcggggtccgtcccttccggggagaagtcgggggcagccgcggaggcggaggaaggcggcccctgggggaaggcggggaggaaacacggg

SEQ ID NO: 24540 - DNA, 769 bp, Triticum aestivum
  Clone ID: PAT_TA_24540
gatcacttagaaaatctagtcatctcatcttctgcagcggagctcaccaccactactattgctagctagatcgagatggcccgtgctgcagttgctcggctcgtgctggtcgccctggtggcgacaatgctcctcatagccactgacgcggccatctcatgcggtcaggtcaactccgccttgagcccctgcatctcctatgcacgaggcaatggtgccaacccgtctgcggcctgctgcagcggcgtcaggagacttgcgggcgcagtgcggagcaccactgacaagaaaacgacctgcaactgcatcaagagcgctgctggtgggctcaacgctggcaaggccgccgacatcccctccaagtgcagcatcagcatcccatacgccatcagcccttcccttgaatgctctactattcgctaatcaaccactgccccccatggctgccgcatatcgcgccatccgacgtttctgagtatgcttaagtcccaaatacatatgaataaacgttttgacctgatctccatgtgagggagaaaggagtgcgtacgctgagccagctctgaatggccggcccctgtcgtactattgttgctttttactttcactcccattgaggagacacgagactttattgtaccttgtaccatgtacacttctagtatgtggattgtactcataattatttctccccaggtactttactccacataacaacggtgagagacgatgaaaataaagtgaatgcataggacctcttacgggtttt

SEQ ID NO: 24541 - DNA, 553 bp, Triticum aestivum
  unsure (1)..(553): unsure at all n locations
  Clone ID: PAT_TA_24541
caggctttttgttcaatctagagggttggttcttgtttgcgtgttttttgttctcgccgtttctccttcttcttttgttcccgagacaacagtggctgaagtggccttcccgtcccgataagtggtaatgcttgccgcgggctctataaaatctcaaggtctagaacctggcattacagataccgatccaaggcaaactgaaacagaaaattcaaagttagtcgtggcttacactgacggtagctccaggggaaatgggacttcgaacgcaaaggcagggataggcgtttacttcggcaagaatgacccaaggaatatctctgaaccacttcttgggaagcctcaaaccaatcaacgaagcccgagctcaatgctatttggcgcgccattcaaatctgccctgaaaagtaaaaacctnccgactctttacaagacagtaanttactcaatcaaatngcttaactaccgggtacaaaggctggctaangaacanatggcgtantgcaagtggctcacccgtcntgaancgggatcttattcaggctgtccgcac

SEQ ID NO: 24542 - DNA, 388 bp, Triticum aestivum
  Clone ID: PAT_TA_24542
cccacgcgtccgtcccagtcttgcaatagcccttctgcatctccaacttgctactgctcctctgaacctcttctcctcctagtcttgcttctatcttgccgcttccctgtagcagttcctttccttcacccgctgctctctttgtgtgtgtgtgtgtgtgcgtgtgtgtgtgtgttcgtgtgtgtgagattgtgtgtgtttgtacttcataagtattgatagtgtgtgatgaagagatatgttaattccagggacatgtagttgttcttataattttgttgatcagtgagaattggtactgatgcttatgaccttctatttctatgtatgagatctagccaaacctgtcattttatatattgtaattgctgaatagtgttcagttttc

SEQ ID NO: 24543 - DNA, 824 bp, Triticum aestivum
  unsure (1)..(824): unsure at all n locations
  Clone ID: PAT_TA_24543
aacagcaatacgtttcataccaaccatcactactaaaaaacatccacaatttactaaaatttcaatatgactggtcgtggaaaaggtggaaagggtcttggtaagggcggagccaagcgccatcgcaagattcttcgagacaacatccaaggtatcacaaaacctgctattcgccgtctcgctcgtcgtggtggagtgaaacgtatctcagctatgatatatgaagaaacgcgtggtgttctgaagactttcctagaaggcgtcatccgagatgctgtaacgtacactgagcacgcaaaaaggaaaactgtcacatctctcgatgttgtttatgcattgaaaagacaaggtcgcacactatatggtttcggaggctaaactccaattaacaccacctgttaattccatacaactgatcacgaaaatacttcaaagaggatgccaagtaatttttcaggcgtcacggaacagaccgatcccgtccttccagtcataaatttacaacaaatgctctcggttacaatgctgcgttaattcatttttcttgtaaacgttcgctagatatcacatattgaggaggaaagactagcctaacgatctagacagtttatctgaaacacaagacagcagaggctaatagactttatggatatactgcgcaaggcgttcgacggtgaacattgataagggtcgtgaccaaaggactggacacgccatgtaattgaactgaattgttcaaattagtttagacgcgaattgatgcangtagaatttaaatcaaataatgcaaaagnaaaanaaaaaaccnagggggggccggtacc

SEQ ID NO: 24544 - DNA, 552 bp, Triticum aestivum
  Clone ID: PAT_TA_24544
ctcgtgccgaattcggcacgagctcgtgccgctcgcgccgcgtgccgctcccgatcccacccagtcaacatcataagcgctcaaagccagcatgtccgacatagactttactcctaaatttgcgcccttctttggaatggcggggattacatttgccatgacctttggatgtatcggcgcagcgtacggaacagcaaagtcaggcataggaatttcgggcgttggaaccttccggccagaccttatcatgaagtcactcattccagtcgtcatgtctggtatcattgcagtctactctctaagttgtagcagttctcatagcaggagatatgggtccaccacccggccaaaactatagtctttttaacggatttatgcatccttgcgtgtggtctatctgtcgggctaactggattagctgctgggatatgcaattgggtattgttggggacatgggtgtacgatcatacatgctccagtcccgaatattcgtgggcatggtattaatacttatctttggcgaagttttgggtctctacggacttattgtcg

SEQ ID NO: 24545 - DNA, 1213 bp, Triticum aestivum
  unsure (1)..(1213): unsure at all n locations
  Clone ID: PAT_TA_24545
gnctagttctagnacgcgagcggccgccttcttggcgacccactctttggccgtccccgtgaccgaaatcccatggagaccgccgttcttgcgccacagcaggtcaacccggctcaagcggcggtgccgcagaccaggaacgcggcggccatggccgccatgcggaagctcggcgccacctcggcgaggaggaagacgctctgcgacatcaccaacctgagacggccgctggaggcggcggccgatgaggggcatcaggacgggtcgaggtgcgcggacggcgtggatgcagtcgcgcggttggtcaaggagaactcggatcttgtgaagctcctggaggagagagacaagttcatagagctgagcggggctgagctccagaatctgcggctggcaaactggcagcttgcgcaggctaattcccagatgttagcagagctaaatcttggcaaaaataggctgaaatcgctacaacatgagcttacctgctccagagctgccctcaaagtaaaatcatcggaacttgaggaggcaacagaaagcgctgaagagcagcagactccagcaacagaagagcgcgaacgagacggcacggcacttggctgccgacagagctgcagcagctgcacagctcaaggatggaaacgcggagcccgcttcggatgcgtcgcgcgccgccattgccaangaagtctacctgcaacgccagccggaagaggctgctgaatcccatgtctgggccctgcggtggcgccgacgaagctggtggcggcgtccaaggagagggagagcgcacagagacgcaagtccatgagaacgccgcagccgagtgggcgcagggaagacttgttcgagatagaggacgttcagctcaccgccggcagtggagatgacaggaaggagacgtcgtgggagctggattcgtcagtgcaattcccacgcaggtcgtcgctggggaggccgctccggcgggccacagagaaggtcacctcctacaaggagatgcctgtcaacattaagcttaggaggccctaagcagtagcacaagttggttgcagttttttgcatccagttagattatgtatgatgagttccctttttctgtgctgccttcggcggccgccggcgcgcagccagcgtgtgtttggtgtgaaaaatctggattgtagtgtgaaagaatggtgttggcaaaccagattcactaatttgttct

SEQ ID NO: 24546 - DNA, 637 bp, Triticum aestivum
  unsure (1)..(637): unsure at all n locations
  Clone ID: PAT_TA_24546
ttatactataatcatagtatgagcagttttttggaattgtcaatatactcgaaaagtataaatagatccaaagcaaagagtttttccaacttttctgttatgttttcatctaggtttttttttagttgatcgttatagattaattctccgtgcttcatttagtgttcaagaccaaaaatgcatccatcccgcactaagtcataaaattctctaaaaatatagagaaagtttcaaaaacaaagaaaaaaagtggaatcaatttangtagaaaagtactccatcaaggttcganaccaaacgaccttacgtccttagcacgggggttctctccccctactttagttagccctttaccccttttgccccggggtcgggtcccggaccatggcattactctaccactgagttaaaagggctttttatttaattcaaaaattagccacttggatttcccattatgggtccactgcataatgtacatattatatatataatatatagagatagagagagagacattatgtngaggattgtatatgtatatatccgatattttggagagctcaaaataaaattaataaaaaaaaaaactcnagggggggggcccgggacccaattccgccccanaggggggtcg

SEQ ID NO: 24547 - DNA, 459 bp, Triticum aestivum
  unsure (1)..(459): unsure at all n locations
  Clone ID: PAT_TA_24547
gattacagtcactcttcaaggagaaatctcaaaccaccccaatcctcatcaacggctaaaaccatgactgttgaaaaaaccatcataaaagctgggcacggtgtttcccctaagcctggtgataccgtcacaatggagtatacaggctttcttaaagatactggatgtccaagacaacaagggtaaacaatttgacagttcagtcggacgcggtgatttcgaggtagtgattggtcgaaaatgtgtgataaaaggctgggatgaagctatccccacgatgaaagttggcgaaaaggccacactagatatcaagcaagcgattaatgcatacgggaaaaaatggctttggaaatatcattcccgtcaaatgctaagtcctaatcttccgatgtcgagctcaagaanagtttaattaggaaacattatattccctgaatatcatccctggaaaatttacaa

SEQ ID NO: 24548 - DNA, 528 bp, Triticum aestivum
  Clone ID: PAT_TA_24548
tttagtgccaaatttggctgaagaaaaaatacttcaaaatgccctgtagtatttacacagccatccatcgatacatacaacatagcagtttacaaaacctccctgaaatgattatttacaacatgaattgacaaaatacaacacatagcaaggttaggaccatcaaaatccaatttacttcaacaacgtatataaaaatttcttattcaatttcttgcaatcgacactcttcatggcaactatcatctaatatatcccaggttggccctctgtggctccgtgcattttttaattggttgtagagaaacccttagtatgctggtgacatgagcatactcccgtaactagcacttctcacaaagtgcactccttgccggtaccatgtccacattgcaagtgttgagtccagcaagaggcgaatccacacgcgtgaggacgacctgtacatcgccggatgggtggacggcgttcaggggcggggttgcccgagctgtaccggcgcatgtccttggagatagaggacgagaa

SEQ ID NO: 24549 - DNA, 539 bp, Triticum aestivum
  unsure (1)..(539): unsure at all n locations
  Clone ID: PAT_TA_24549
gtaattctcgttgacagcaacaaatatggaaagtccgcacgaacatcagcagaacctactaatgtctcgcatcatcaccaatgtggaaaaactgaatgaagctatttcccttttgaacatgaatcttcagcatatcaacatacagaatatgaatgtagagctagtagctcaaatgttcaagaactatcaaacaaacgttctctttcatttagaagctaccgactccctcaaagatccatcataaagtttgatcaaaaccatcaggcgggtgaattcgggcaaagacatcttcgagttaaagaaccggtcctgccgtgcataccttttggatgggnaattttatcggtaccctacganggcatccggctatcaatcaaaatcaattttattgggggccaaaaggaaaggccatcacaattccccgcctggcccttgtactcgaatcacgaccaaacactagtaancccttcaagaacatttatttgaaatatattccggtcaccanaaagctaanttttctcgactttatccgaggcaac

SEQ ID NO: 24550 - DNA, 524 bp, Triticum aestivum
  unsure (1)..(524): unsure at all n locations
  Clone ID: PAT_TA_24550
ctcgtgccgaattcggcacgagccaagttaaacaatcaatcatgtctgtaccaagcattttcaagatatcgcaaaatcttccaatgatttgctgaataaagatttttatcatctttcagctgcagcccttgaagttaaaagcaacacccccaatgatgttgtgttcaaagtcaatggcaagagcacacatgagggagcgaccagtggattgctcgaagccagatactctgataaaccaactggcgttactcttacacaatcctggaatactatcaatgcactagacaccaaaatcgaaataaccgacagtatagcgaagggactcaaggccgaaattctcggatcatttttgcctgccacccaggcaaaaggggctaaactaaatcttcacttcaagcaagcccgggtttcacggtcgcgccttcttcgacctacttaaagggccaacagcacttgttgatgctgttattggacaaggatgggtttctagcccgggtgcatcccccggctacaacgttcanaag

SEQ ID NO: 24551 - DNA, 605 bp, Triticum aestivum
  unsure (1)..(605): unsure at all n locations
  Clone ID: PAT_TA_24551
ctcgtgccgaactcggcccgagctccccaccacctcccaccgatggcgacgacgagctcccctcgtctcctacctctcccctcctccacctccacctgcacctcctccgccctcccaccagtctgtccttcccgcctccgcttcaatccaccagcagcagcagcaggcgcggtttctacttccgccttgggccgtggctgcagttcttggctcagcctccgctgccgaagcgctgccggacccttgccgccctcctccgagccaccgcctccatctcctcaagattggcaagagaggttgtcaagattacaggatacgttacggatattctttgcagttctgttctggatgtcactgtttttctggggcaagtgcttggggtggaaagtaacaactcagggggcaagaagggccaacgatttcgaaacaaatccaaagtgaatatgcccctaggagtggttacaggcccccctttactgggtataatatataaactttcccngtgtttcgtatgaacaaancaaagtggtaattantacatccnggctcnagatgcnacaagttgtattccgcatgtattcaaaatggttaacaattggtntttg

SEQ ID NO: 24552 - DNA, 500 bp, Triticum aestivum
  Clone ID: PAT_TA_24552
ctcgtgccgaattcggcacgagctcctccactctgctctctctccgtgctctctcgacatacgcagccactcctttagctttttcttcactgttactcacgagctatctgacctccagcgtcgaaatcataatcttaagtctagtcaactatatactttaccacctacatcaaccatcaaaatgcgttcgtctatcttgacatccttcagtcttctcatctctagctatgcttccgcctcatccattcatggagcctccagcctcgagcgaagacacggacacgcacaagtccagcctatcaacatcgtcatccttaatgataaagaagaatgacgttcataagccattcttccctacctttgggtgagcatgacaacttcaaatgcggcaaaaaaatctacaagcggacgaagatcgacaaatccctatcaaagggttgccaggtttacaaagagcaacgacaaaagagtccatttccctccgtgttcactgcattcca

SEQ ID NO: 24553 - DNA, 783 bp, Triticum aestivum
  unsure (1)..(783): unsure at all n locations
  Clone ID: PAT_TA_24553
ggcgggggggttcggacgngctagaactactcnatccccgggctgcaggngcgtgccgaattcggnacgaggattacttaagtgaaacctttcacacatactcttttaaactcacctcttatcatctacacctattcctatctctgatttgttataacatctgcannacgttagattaaactacaaantgttacccctccgtcggtctcttctcaaacccgcgccgatctcgccattctccaatacttccttgagattattccacgcttgcaaatcagatatgtccgttaaagccttcttcgatgtgtcctggaaaggaccggttcttgacgctaaaaacaaggctactggagaaatcaaagaacaaagcggtcgaatcaatttcaatctctacaatgatgtagtaccaaaaacagctgagaatttccgttgcttatgtactggagagaaaggcttcggtttcaaaggttcttctttccaccgcattatcccaggctttatgctccaaggaggcgatttcaataaacataatgggtaccgggtggcaaaagtatctatggtgagaagtttgcggacgagaattttaccgttgaagcacactaaacccggaatattatccatggctaacgcaggcccaaaacacgaaacggcgtcccaatttttttatcactacaagtcattacgaaattggctagacaaaaagcacgtccgtaatttggcgaaagttaacgggacgaagaatccatgagggttgtcaaagctattgaanctacaaggaatggg

SEQ ID NO: 24554 - DNA, 800 bp, Triticum aestivum
  unsure (1)..(800): unsure at all n locations
  Clone ID: PAT_TA_24554
aggcaggtaggtttgctttactcggtaaggagaccaggtgggtgttaaacacccatcctgctatgtatcctatatacgagaaagcacaactcttgcaacacatcctccttccacaagagaaggacacgatgtgccccttcactcctgaagaaataggaggtgatggagggttcacatccgatatagacttcttcaaaaaggtcattgacttaaagtcaagagaccctgaagaagtctatcatcggataggagacctcttccatcatagggaaggtatggttctcatacgctctgagagcttgaaccaagtggtcaagcaagtacaaggcctggcttccgacggagaatgccttaaaggcatatctccctaaaggatatgataattgatatcacggaaagctaactcatctttaagatctattacggtgaagggattcttagaacccccccagcgtacgttcttcaagatggttaaggcagcgtactataggagtatactatctggtgtaccttacgaggatttgcctgtccttcagtatgtggatgctcttaaagagcacccgcataggaagggaacgcccaaatacataaatttaccaatgtttttaaaacattggagaaatcctggatttgggcgaggacaaatatcctcgtatttggtacgaagttatatggtaccagaagtaagactacctatccatgtcttggaagtttggactaaacccccgagaaagtatccttaaaggatatcgctcggggattacctantcgaatcttcctcctccttggtcgaccaatan

SEQ ID NO: 24555 - DNA, 489 bp, Triticum aestivum
  unsure (1)..(489): unsure at all n locations
  Clone ID: PAT_TA_24555
ctcgtgccgctttccgcgccggaccattgtaacctcgtcattaaaatcaaaaccagatatgtttgccacacgcagagcatttgcgtttgccgcgaagaatcgcactttttctacatctgttaaagacctatcaaaagttgcagtcctcggctcgtcaggaggcattggacagccgctatcacttctattgaagcttaatcctcggatatccgagttagctttatatgacatcaatgctgcgccaggcgtcgccgcggatttggcacacataaacacgaagagcaaagttacaggtcatgataaaactgaaagatgcattatctgaaagctctcacaaactctgaaatcggtaataatacctgcccggggttcctcgaaagcctgggaatgtctccccgacgacccattttacatcaatggcatcaatccgttcggtgttctaaccagtggccacctcaaaaatccggccccaaaaggcaaaantttggt

SEQ ID NO: 24556 - DNA, 584 bp, Triticum aestivum
  unsure (1)..(584): unsure at all n locations
  Clone ID: PAT_TA_24556
ctcgtgccgaattcggcacgagagagaactagncccgagnttttttttttttttttttttttttcnggaggcagatttcaattgctttctatgaacggctgaaaacggcgattaattgcgggctaactacagactttcatgaccacaaaagtacgttatggacatgggttaatagaacatctacgttgcacgggaccttgccacatttaattcatctgtcgtattaaagcatttatgtgttcttctctgtttcccaagatctcctccttccacaaagtgtcggaactttctcgatctgaagccaccaagtaggatttgacaagcttgaagggccacaaaaagttgggatgcgctcttgaagttcnggacnccacggggaaaaattttcgcgggatcaaatcccccccactcccactcccaatccccccatgggtcccttcggggttcctctttcngaatgaattagaaatttgnttcaagttggangaagcaattgcccctggcnntggtncaaacctttttcccgttaacccgccggcctctgggtatanaactnaacccccccccnaaaagggggcccctng

SEQ ID NO: 24557 - DNA, 1296 bp, Triticum aestivum
  Clone ID: PAT_TA_24557
tcagtagccaatactgtcattaggcaacttaatcaggtgtgcccactggagaatctgcggcatgttaagcgggtgcgtcgtcgtattcagtgtgaaaaatccgagttatcgatcatcttatgcctttccactgaatctgaaagtggtaagaatgggtttcctgaggctgtacagaaggtagtgaaggcttaccagttgagtcctttcattgcaaaagttgccagctatcctgctatgtcgaaagaggaatgggaggaacagtgcaaactctggccaacttcttatcatcccctgcatgacactggtggttcatctggatttaaagaggatgaattaccatcaatatttgattgcatgaggactgctatccagttatcagaggtgggcaacacggccattattgttgatccatcaagtatgcaaataatttcaaaggctacagatcaaacacaccagcatgatgccttccagaaaaggaacagatgtgtcaatgtggaagcagatggtggccgctctttggctgaaacagctggggctaatgatggcaggttgttgctgtcaagctcccatgttcgcaatggcttgaacatggaggtctcatgtatggacccgtggggatggacaaaacagaggtcttctgagcagaagactttgtcctctgaaggtggttttctttggcatcctctgagacatgctgccatagttgccattgaaaatgctgccgagagagatcgaatgatgttccatacttcaacttctccaacaaccgaattagacttaaatggcgatatggataattgttctgataatgaaccagcaaagcggccaaagatagttacaaaggataaagaacaagctgagcatcaagaatgcgggagtgacttgtctggaacaaacagaccatatctctgcacaggattcgacatctaccttgtttgggaaccctgcacaatgtgtgctatggcacttctacatcaaagattcaagcgtgtcttctacgctttccctaatccaatcactggagctctgggcagtgtctacagattgcatggggagaaaagtttaaatcaccattattctgtgtttagagtaaaaatgccagagccagatttgaatgtttcaagtgatttccctgaaaaaggctgctcagattttgtaccatcctagttcttgaaaatctacgagcttttctaggctaaaaacaaaaaattcgtcatcttcgctttgcaagggccatgttatccggtgggtttctggttcctctcctttgctttgtcagtacggtggtgctggttc

SEQ ID NO: 24558 - DNA, 768 bp, Triticum aestivum
  Clone ID: PAT_TA_24558
cgtggagagatttggttgattttatatcgctgaataatataaaatattatgagtgcagaggctccaccccgaggtttcttgctctttctcggccgtcgggaatctatgttcttccactctttcgtttaagacatgagctttgttcatcctgttgccgacacgcgggacatctatatgcctccattttacaaaatcatactatatgcctccatgacacgcgggacatctagcatcaaggtggcgtgtcatgcaagaaaatggagatatgcagtgcgtaagtgagtcgtgcacttcgatggcacctagtagtactacgcaatattttttctccacgatggcacgtgaatagtgcatgtactcaatgacagagcacgggatggtagccatggacatggtcggccctttttgaagagagtactaataaatacgtaactttgatgtgtcgcgtcaactcgcagaacgacgagaagcttgcttactacgccttctccctcgccaacgcgtgcgcggtggctcgcagcacgaggagaaacttttgcttacaagcggtggacgtgcagcagttcatttggtgtcagattgccagaagtactactgtagtaccatcattattgttcgacttccggaagaggagaagagccaagcgcaaggtcacctactaacctagtacagtactactatagccaaagccggtccacctttttagagcatggttaataaatataggcggctcttgcagcagcacatcatttagagcaagtactctgt

SEQ ID NO: 24559 - DNA, 578 bp, Triticum aestivum
  unsure (1)..(578): unsure at all n locations
  Clone ID: PAT_TA_24559
aggcaaacntaaccggttaaaacaacgggacgactatgtttagccccgttttctncgnttattcgcttttcacccaggcgggggcccggacccanaatcaaaggaaaacccacnttacgctnggatctttcggcaaattcggcgcccntcccgaaaaaggatgttggaaataattcagcgcgaagcttccngctgtaccntcacacaacttcaccgcgaaacttatccctgaggtgattggacgggaaattgagaaggccacgcagggtatctaccctcttcagaatgtacatatccgaaaggtcaaactccttaaggccccaaagttcgacctaggcgcccttcttaacctacatggtgaatcgagcacggatgatgctggccaacgagttgagcgtgatttcaaagagcaggtgctggattccgtgtaagaaattgttgcgtaggttggtactgggagagtattttagcaatagtttattcctgtcgtaaagatgcaaatgccaagttcntgactccgaaacaaaaaaaaaacctgcggccccgggggatcccacttagttcttagagcggcnctc

SEQ ID NO: 24560 - DNA, 449 bp, Triticum aestivum
  Clone ID: PAT_TA_24560
gtaccttcgttttcacttcaatacaacctctctctctccctcgctctctactctaactttaacccaaatatctctaattcttacaaattttcacccaatatcaacatgcagtttaacttcttcgctatcattgccttcttggccacttctgctctcgctaccgagactgttactgtaactgtctgttcaactacctcagcctatccttccaccggatactcaatgccaacatctcctgcctctccatcttctggatacggctctaacccaggttacggctcaaacccaggttacggttcaaacccaggctccggttccggctcaggatcaggatcttccggcactggtgcctactcctacccgggaaccaagcaaccctcctatgccatacaccggagctgccagcgttaatggagtatccggcatggctgccatcgcaagttattggt

SEQ ID NO: 24561 - DNA, 549 bp, Triticum aestivum
  unsure (1)..(549): unsure at all n locations
  Clone ID: PAT_TA_24561
ggtacacagctaccaaggacgaattggcacatataaaacctctggctaagtttctttcgttcaagtcaatagtattcttgacttggtggcaaggggtggtgattgcaataatgtattctttgggcctgcttagaagtcctttagcccagagcttgcagttaaaatcaagtattcaagatttcattatttgcatagagcgcagatgggcattgcgtcagctgttcacctctatgtgttccctgctaaaccctacgagctcttaggtaaccagtcacctggaaacatttcagtccttggagattacgcatcctctaaccctatagatcctgaagaagtcaaggagagtaaccggccgagcaaaatgaagcttccacagttcgaaccggatgagagaagtgcaacaaacataaaggagagtgttcgcgactttgtggttggcagtggggaatatgtgatccaggattttaagttcactgttaaccaagcagtgcgaccggtggagaagcggtttgataaactgctgaaaaagaaaggacaagtataagaacn

SEQ ID NO: 24562 - DNA, 563 bp, Triticum aestivum
  Clone ID: PAT_TA_24562
ggcctcgacaaggccgtcatccaacccggcaagggcttccgcggcgccctcggcctcagcgagggagggccgctgtttgggttcaccaagtcgaacgagctgttcgtggggcggctggcgcagctgggcgtggccttctccatcatcggcgagatcatcacggggaagggcgcgctggcgcagctcaacatcgagacaggggtgcccatcaacgagatcgagccgctcgtcatcttcaacgtcctcttcttcttcgtcgccgccatcaaccctggcaacggcaggttcatcatcggcgaggacgaagagtaggctgatgctgctgtcctcgaacctgatgagtgatgagtagtactgtgcgcttgggttacctgtgctgtgttgatcgatcagtgcgtctcgcagtgcgtgtgcgtacgtgctttgttgtgtattagtaagcgtgatgagacctcgaaaggtagggtgtcgtgttgagttgtcttgtagaaacaagagcttactcgtattgtagcttcaaatgcatgaccgtacacctgtcaaacaaaaaaaaaaaaaaaaaa

SEQ ID NO: 24563 - DNA, 580 bp, Triticum aestivum
  unsure (1)..(580): unsure at all n locations
  Clone ID: PAT_TA_24563
ggtcacttcactgctcaagtagctggcaagagctttgaacgcgttgcaaccttgcatcccggtcgatcgatcgatggcgtccaaggtcgagctggtggtggaggtggcggacgacgagaagaaggtggtgtcgtacagcgtggtggacggcgagctggtgagcttctacaagaacttcagggtgacggtgcaggtgaccgacaagggcgccgacggcgccggcgcggtggtgaactggaccatggacttcgacaaggccagcgacgaggtgcccgagccggacgtcatcaaggagaccgccgccaagaccttccacgacctcgacgactacctcctcaagaactagcagctcttagctgcctcgtcgctggccgctgcggacgatcctccatccgtccgtccgtccatccatccatccatgaatactgtcgttgttgcctgttgtctgcggtgtccccgcaccaagcttactctcacgtaaacgaccgtgtgtacggccgtgtacgtgtgcatctgcctgcgatgggacggccgcgtgagtagngaataataaatataacaataataaagtcgcagcttt

SEQ ID NO: 24564 - DNA, 771 bp, Triticum aestivum
  Clone ID: PAT_TA_24564
gtcacttcactgatcaagtagctggcaagagctttgagcgcgttgcaactttgcatcccggtcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaagtccgccggcaccgtccgcctcatcaagtacaccgagggggttccgatggtgacgttcgccaaggagaaggtggaggtggcggacgacgagaagaaggtggtgtcgtacagcgtggtggacggcgagctggtcagcttctacaagaacttcagggtgacggtgcaggtgaccgacaagggcgccgacggcggcggcgcggtggtgaactggaccatggacttcgacaaggccagcgacgaggtgcccgagccggacgtcatcaaggagaccgtcgccaagaccctccacgaccttgacgactaccttctcaagaactagagtagcttttactaactgcctcgtcgctggccgccgcgtccgtcgtccgtccattcatccatccatgtctactgtcatcgttacttgctgtcaaaaaaaaaaaaaaaaaactcgaggtcgacggtattgttaagcttgatatcgaatttcgcacaagcttaattccgtgcacccgaaccttggctttggttgtggctgggtttagcagcagaacggaaggcaccatggttttcaaaaccca

SEQ ID NO: 24565 - DNA, 492 bp, Triticum aestivum
  Clone ID: PAT_TA_24565
tgagcggataacaatttcacacagaattcattaaagaggagaaattaaccatgtcgtggcaggcatatgtcgacgaccacctgtgctgcgagatcgacggtcagcacctcacctccgccgccatcctcggccacgacggcagcgtctgggccgagtcccccaacttccccaagttcaagcctgaggagattgctggcatcgttaaagactttgaagaacctggacaccttgcaccaactggtcttttccttggaggcacaaagtacatggtcatccaaggtgaacctggggttgtcatccgaggaaagaagggcaccggtggcattactatcaagaagaccggcatggccctgattcttggtatctacgatgagcccatgactcctggccagtgcaatttggtcgtggagaggctcggcgactacctcatcgaccaaggctactacgtaggatctcatcaccatcaccatcactaagcttaattagctgagc

SEQ ID NO: 24566 - DNA, 546 bp, Triticum aestivum
  unsure (1)..(546): unsure at all n locations
  Clone ID: PAT_TA_24566
ttcgtcgacgaggaggtcaccggcctcgacaaggccgtcatccaacccggcaagggcttccgcggcgccctcggcctcagcgagggagggccgctgttcgggttcaccaagtcgaacgagctgttcgtggggcggatggcgcagctgggcgtggccttctccatcatcggcgagatcatcacggggaagggcgcgctggcgcagctcaacatcgagacgggggtgcccatcaacgagatagagccgctcgtcatcttcaacgtcctcttcttcttcatcgccgccatcaaccccggcaatggcaggttcatcatcggcgaggaagaggaataggctgctggctgctgctgctggcctcggacatgagtcgtgtgcgtttacttttacctgtgactgtgcgtctcggtgcgcgcgcgtaagtgctttgctgtgtatcaattactcgtgatgagacctcgaaggtagggtgtcgcgttgggttgtctgcttgtagaaacaagagcttatatataaattactactagctaaaaaanaaaaaacaccggg

SEQ ID NO: 24567 - DNA, 1075 bp, Triticum aestivum
  Clone ID: PAT_TA_24567
accgcatgatatatgcagtkaataattttagcttggggtttgtcggttggtgacgtgtcgaagggaaaaaaaggattttactatgttttctttttaakgtttggcatcggtcgtatcaaactcagccgctctttcgctgagtaatgtacctggaggcccgtaaagaaggacaccctttggttgggcaattccgagactctcaaacagctcaggatgcttkatgggaagctcaatcacctccttgatctctttaatttgctgatcaagaccaccaatcatatcataggtagagtcaggaaccttctccaccttcataagattaaccagtggatcgactttkctgggcaggataaggtgaagcatgtagctgtcgttccgaagagcaactcttgttgaaggggttatctttgtaatatcaatacttttatcaagatctacaacatatttgccttctggatgaaccttcactagaacctttggcttgcccatgaccttcacaacctcgccaacatatgagcccggttcttgaagcagccgcaactcttcccggagcattctaactcgagarttgaggtcgttgcgctgggcctcgaggcggttgaggttgtgcgtcttggtccggatctggagctgcaggtcgtggatgtgctgcaggtagtactggcgcaggccctccccgccgccggccctgcccttggccgacgccgccgacgggtcgtcaacgctcgccggcagcgccgagggcttcgcgatgtccatcgccaccgccgccatcgggattcccccctcgtctgctccgccgctctgggggtggctcgagtccgctcgggttcgagggtgagcttcttttccggcacgtttgctcgtgccgaattcggcacgagggacgactagatcggcaccggcacgagcgaatgctttttggccattaattgtacgtccgttcgtgctttgcttgtttgttgtgtacgtgagaccttggggtgtacttaggtgtaagaagaagttggtcgttgccttatgaaaaacaagagctagcagctaatttgccatgcatgccgacggttgcagatcc

SEQ ID NO: 24568 - DNA, 766 bp, Triticum aestivum
  Clone ID: PAT_TA_24568
ggtggcgctgatgctggcgctggtgctgctggcggaagtgcctggctgggcacgcgcggagtgccaggtgacgcagctggcggtgtgcgcgtcggcgatcctgggcgggacgaagcccagcggcgagtgctgcggcaacctccgggcgcagcaggggtgcttctgccagtacgtcaaggaccccaactacgggcactacgtcaacagcccccacgcccgcgagacactccagacctgcggcatcgccctcccgcactgctaggcctcctagccgaccgagtctactctgctacgctagttactctagctgagtaagtgctgtgagcagatcgacgacgacgacagccatggcgatgatgaggaaggaggcagtggtggcgctgatgctggcgctggtgctgctggcggaagtgcctggctgggcacgcgcggagtgccaggtgacgcagctggcggtgtgcgcgtcggcgatcctgggcgggacgaagcccagcggcgagtgctgcggcaacctccgggcgcagcaggggtgcttctgccagtacgtcaaggaccccaactacgggcactacgtcaacagcccccacgcccgcgagacactccagacctgcggcatcgccctcccgcactgctaggcctcctagccgaccgagtctactctgctacgctagttactctagctgagtaagtgctgtggtacgcaagtatatgttggtatgttggaataaaacgatggtgatctacggcgtcaggctgctggccggtg

SEQ ID NO: 24569 - DNA, 550 bp, Triticum aestivum
  Clone ID: PAT_TA_24569
gcttcactgctcaagtagctggcaagagctttgaacgcgttgcaaccttgcatcccggtcgatcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaagtccgccggcaccgtccgcctcatcaagtacaccgagggggttccgatggtgacgttcgccaagaccttccacgacctcgacgactacctcctcaagaactagcagctcttagctgcctcgtcgctggccgctgcggacgatcctccatccgtccgtccgtccatccatccatccatgaatactgtcgttgttgcctgttgtctgcggtgtccccgcaccaagcttactctcacgtaaacgaccgtgtgtacggcccgtgtacgtgtgcatctgcctgcgatgggacggccgcgtgagtagtgaataataaatataacaataataaagtcgcagcttt

SEQ ID NO: 24570 - DNA, 913 bp, Triticum aestivum
  Clone ID: PAT_TA_24570
ttcggcacgaggcactgctcaagtagctggcaagagtctttgaacgcgttgcaaccttgcatcccggtcgatcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaaagtccgccggcaccgtccgcctcatcaagtacaccgagggtacgtgcgccgtgaaacgatccacatatccggagcttgtatcagtatatatatgtaacgtgagcattgggtgcgtgccttcaggggttccgatggtgacgttcgccaaggagaaggtggaggtggcggacgacgagaagaaggtggtgtcgtacagcgtggtggacggcgagctggtgagcttctacaagaacttcagggtgacggtgcaggtgaccgacaagggcgccgacggcgccggcgcggtggtgaactggaccatggacttcgacaaggccagcgacgaggtgcccgagccggacgtcatcaaggagaccccccccaagaccttccacgacctcgacgactacctcctcaagaactagcagctcttagctgcctcgtcgctggccccttcgaacgatcctccatccgtccgtccgtccatccatccatccatgaatactgtcgttgttgcctgttgtctgcggtgtccccgcaccaagcttactctcacgtaaacgaccgtgtgtacggccgtgtacgtgtgcatctgcctgcgatgggacggccgcgtgagtagtggaataataaatataacaataataaagtcgcagctttatgatcacgtatacatacgaatggtgctaaatttgtgcgatttggtttgattc

SEQ ID NO: 24571 - DNA, 574 bp, Triticum aestivum
  Clone ID: PAT_TA_24571
gccggccggttctcagatctccacacactaccagtacactccactcccatcacacacacggacacacctgcgagagcgtgagccatggcgtccatggggaagaagcaggtggtggcggcgctgatgctggtgctggtggtgctggcggcggcgccgggcggggcgcacgcggcgtgccaggcgtcacagctggcggtgtgcgcttcggcgatcctgtccggggccaagccgagcggcgagtgctgcggcaacctgcgggcgcagcagccgtgcttctgccagtacgccaaggaccccacctacgggcagtacatccgcagcccccacgcgcgcgacaccctccagtcctgcggcctcgccgtcccgcactgctaggcgccggcaggcccctggcgcacatggcaagctagctgcctcagtgaccatgagagcgtcagactatagctagcctatctgagtgcctacgtgttgcgtccatgaaagcatcttcctgtcaaccatgtggttcgactttgatgatgctggaataaaaatataaaatgttgggtaaaaaaaaaaaaaaaaaaggccccta

SEQ ID NO: 24572 - DNA, 600 bp, Triticum aestivum
  unsure (1)..(600): unsure at all n locations
  Clone ID: PAT_TA_24572
gtcaaagcacgacacatccaggtccaagcaaagcatccccagccgagccgagaccgcgtgcgctccacgcagcatccgccgcagcagccgcccagagaagtcgccgccggagaaggaggaggatgtcgtggcagacgtacgtcgacgaccacctgtgctgcgagatcgacggccagcacctcacctccgccgccatcctcggccacgacggcagcgtctgggcgcagtcccccaacttcccccagttcaagcccgaggagattgctgggcatcattaaagactttgaggaacctgggacatcttgcaccaactggtcttttccttgggaggcacaaagtacatggtcatccaaaggtgaacctggggtttgtcatccgaggaaagaagggcacccggtggcatcactatcaagaagacggcatggcctgatcttggtatctacatgagccatgactcctggcagtgcaattggtcgtggagagntcggcgacactggtcaacaggttcaagccgcctgatatatgtatttggtcgtcggacaagttgtcacgtgggcttnatcatctctgggtacgatatatatcagtaatanttacttg

SEQ ID NO: 24573 - DNA, 855 bp, Triticum aestivum
  Clone ID: PAT_TA_24573
ttttttttttttttttttgaagatatattagtttcccttcacagattattttggacacagcaggtttgatccacatctcccagttacacaaagcaaacccacttgcttataattaaatcatgcacaagacagaacaaaagcaaacaactcgctctctgtacaagtagagctaggcgcggatcaagccgtgcacggcgccggcgccggcgggcttgcccttgacggcgaggtagtatggcaggaacgcccccttgccgaccccggccgcggcgggcgcggccatcgacggcgtgacctgcaggaacatgtagtttccggcgaagaggtcggccacgcagggcccgccctccttgagccttgtcaccaccccgggtcaccgacgcccggaccctgccacccacggccgctgccctccgacgcagcgccccgcgcccaggctcgagatcctcagaggcctgccgcgccggcgcggcccggtgcctgaggatgaccggcggctccgccacgtcctcctgctggcgatgatcgcggccgccgcgtggcggtagtagtggtcctgcgcggcggcgacggcgtagtgcgcgtcctcctggtcgctggcgggaggcggtgggggcgggagcttctttagcttttggtaggcgaagctgctcatggtgaggtaggaggaggacgggacgtgtcgaagggaaaaaaaggattttactatgttttctttttaatgtttggcatcgcgtcgtatcaaactcagccgctctttcgctgagtaatgtacatttgcctcgtcatggtaacttgtgggttctgctgctgctttattgaagatgattgcattttaaaaaaaaaaaaaaaaaa

SEQ ID NO: 24574 - DNA, 893 bp, Triticum aestivum
  Clone ID: PAT_TA_24574
ttttttttttattgcactcatttgagttcttttctcttattttcctttggatggacaaaagagaacaatgaagaatggcttctctagaaataacatttgcaacattcaagtaaaacaacacaccattgcggtcaccgttctcagcacagcaaggctaaccaatctagtcgacaaagcaacatacattacaagcaaacgaacggttcccatctcataataacccaataaagaaatttaaccctgaagaggcagctgcaaggcactgcaagttacagttgtcgacgcggttcatgaaacccgcagctcatctggcaaatgtgccgctataagtttaaaccaccgatacatgccggcaaaagctgagatgctaaaacgagggcctcacttccatagcttccgcagtgacatgttcttctcggtatccttcttcatcaccttcgccacggccatctcgaaatcctcctgggtgacgtgcacccttctctcgcggaagggcaaacattccagcttctgtgcagaccgcctttagctctgctcctgatgcaccgttcatcttctcagcaatttttttcagatcaatgccacgcatcaagttcatttttcttgaatgaatcttcaaaatatcaccacgggaatctgcattaggatttggaaattcgatcttcctatcgatacgaccaggcctcagaagagcttgatccaatatgtctagtcctatttgttgccataagaaccttaattttgttcgagtgcttcaaaaccatcaagttggttcagaagctcaagcattgtacgctgaacctcgctagtcaccgttgccggatcccgactccattctagcagatccaatagagtctatttcatccataaatataatggatggtgcatgctcc

SEQ ID NO: 24575 - DNA, 1116 bp, Triticum aestivum
  Clone ID: PAT_TA_24575
ttttttttttttgcatttcactcatttgagttcccttttcttatttcccttcggatggacaaaagagaacaaatagctaaggactgaagaagagtttccctagaaataacatttgccacattcaagtaaaacagcacaccattgcggtcacccttctcagcacagcgaggctaccaatctacgtagtcggtaaagcaacattacattacaagcaagcgaacggttcccaactcccgtctcataatataacccaataaagaaatttaaccctgataaggcagctgcaggttacagttgtcgacacggttcaaagaaacccgcagctcatctggcaaatgtgccgctataagcttaaaccaccgatacatgccggcgaaagctgagatgctaaaacgagggcctcacttccatagcttccgcagcgacatgttcttctcggtatccttcttcatcaccttggccacggccatctcgaaatcctcctgggtgacgtgcacccttctctcgcggagggcaaacattccagcttctgtgcagaccgcctttagctctgctcctgatgctccgttcatcttctcggcaatttttttcagatcaatgccacgcatcaagttcattttcctcgagtgaatcttcaaaatatcaccacgggaatctgcattaggatttggaaattcgatcttcctatcgatacgaccaggcctcagaagagcttgatccaatatgtctatcctattagttgccataagaaccttaattttgttcgatgcttcaaaaccatcaagttggttcagaagctcaagcatagtacgctgaacctcgctatcaccgttgccggagcccgactccattctagcagatccaatagagtctatttcatccataaatataatggatggtgcatgctccctagccatcacaaagagttcacgaaccatcctggacccctctccaatatacttttgaaccaactcagaacctgagaccctgatgaaggtgcagtcggtgtgatgagcaactgcacgagcaagtaatgttttccctgtacccggaggcccgtaaaggagcacaccctttggttgggcaattccgagactctcaaacagctcaggatgc

SEQ ID NO: 24576 - DNA, 1357 bp, Triticum aestivum
  Clone ID: PAT_TA_24576
ggggttttttttggcttccctagaaataacatttgccacattcaagtaaaacacatcattgcagtcaccgttctcagcacagtgaggctaccaatctagtcgacaaagcaacatacattacaagaaagaacggtttccatctcacatctcataatataacccaataaagaaatttaaccctgatgaggcagctgcaaggcactgcaagttacagctgtcgacacggttcaagaaacccgcagcaaatccggcaaatgtgccgctataagcttaaaccaccaatacatgccggcgaaagctgggatgctaaaacaagggcctcacttccatagcttccgcagcgacatgttcttctcggtatccttcttcatcacctttgccacggccatctcgaaatcctcctgggtgacgtgcacccttctctcgcggagggcaaacattccagcttctgtgcagaccgcctttagctctgctcctgatgccccgttcatcttctcggcaatctttttcagatcaatgccacgcatcaagttcattttccttgagtgaatcttcaaaatatcaccacgggaatctgcattaggatttggaaattcaatcttcctatcaatacgacccaggccttagaagagcttgatccaatatgtctatcctatttgttgccataagaaccttaattttgttcgatgcttcaaaaccatcaagttggttcagaagctcaagcatagtacgctgaacctcgctatcaccattgccagatcccgactccattctagcagatccaatagagtctatttcatccataaatataatggatggtgcatgctccctagccatcacaaagagttcacgaaccatccgggaaccctctccaatatacttctgaaccaactcagaacctgacaccctgatgaaggtgcagtcggtgtgatgagcaactgcacgagcaagtaatgttttccctgtacctggaggcccgtaaaggagcacaccctttggttgggcaattccgagactctcaaacagctcaggatgcttaatgggaagctcaatcacctccttgatctctttaatttgctgatcaagaccaccaatcatatcataggtagagtcaggaaccttctccaccttcataagattaaccagtggatcgaccttgctgggcaggataaggtgaagcatgtagctgtcgttccgaagagcaactcttgttgaaggggttatctttgtaatatcaatacttttatcaagatctacaacatatttgccttctggatgaaccttgactagaacctttgacttgcccataaccttcacaacctcgccaacatatgagcccggttcttgaaggagctgc

SEQ ID NO: 24577 - DNA, 859 bp, Triticum aestivum
  Clone ID: PAT_TA_24577
gacacatccaggtccaagcaaagcatccccagcccagccgagaccgcgtgcgctccacgcagcatccgccgcagcggccgcccagagaagtcgccgccgggagaaagggggaaggatgtcgtggcagacgtacgtcgacgaccacctgtgctgcgagatcgacggccagcacctcacctccgccgccatcctccggccacgacggcagcgtctgggccgagtcccccaacttccccaagttcaagcctgaggagattgctgggatcgtttaaagactttggaagaacctggacaccttgcacaaactggtcttttccttggaggcacaaagtacatggtcatccaaggtgaacctggggttgtcatccgaggaaagaagggcaccggtggcattactatcaagaagaccggcatggccctgattcttggtatctacgatgagcccatgactcctggccagtgcaatttggtcgtggagaggctcggcgactacctggtcgagcagggtttctaagcccgccctgatatgctgttattttggtcgtctgggactaagtttgctctactgtgggctttgcatccatctgcttggcgtaccgcatgatatatgcagtgaataattttagcttggggtttgtcggttggtgatgtgtcgaaggggaaaaatggatttactatgttttctttttaatgtttggcatcgcgtcgtatcaaactcagccgctctttcgctgagtaatgtacatttgcctggtcatggtaacttgtgggttctgctgctgctttattgaaagatgattgcaattttagtgacgtgcttgcctggtagtaaaaaaaaaaaaaaaaaaaaaaactcgag

SEQ ID NO: 24578 - DNA, 596 bp, Triticum aestivum
  Clone ID: PAT_TA_24578
acttactaccagtacactccgctcccatcacacacacagacacgcctgcaagagcgagagcgtgaaccatggcgtccatggggaagaagcagaagcaggtggcggcgacgctgatgctggcgctggtggtgctggcggcggcgccgggcggggcacgcgcggcgtgccaggcgtcgcagctggcggtgtgcgcttcggccatcctgtccggggccaagccgagcggcgagtgctgcggcaacctgcgggcgcagcaggggtgcttctgccagtacgccaaggaccccaactacgggcagtacatccgcagcccccacgcgcgcgacaccctccactcctgcggcctcgccgtcccgcactgctaggcaccatccacgtacatatggctgagctagctagatctgcctcagtgaccatgagagcgtcagactatagctagcctagctgagtgcgtgttgttgcgtctatgaacgcatgtggttcgactttgatgatgctggaatgaataaaatgttgggtgatgatctacggcggccaggttgctttcttcctggctgcagccctacgatgaaaaaaaaaaaaaaaaaaggccccta
